United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 32

SEQ ID NO: 167816 - protein, 177 aa, Triticum aestivum
  Clone ID: PAT_TA_62234.pep
MAGDLGKSSGGARVCVTGATGFVGSWLVRKLLDAGYTVHATMRGTGDEEKVGRLRRLVVPGGVAPERLVLFEADLYDPASFAPAIAGCQSVFLIATPFADGAAEAAVGAVRSILRQCEESGTVKRVIHTASMSTASPLTAAGYKDFIDESCWTPFDVDYPLRSADFDKYMLTKLLSE

SEQ ID NO: 167817 - protein, 119 aa, Triticum aestivum
  Clone ID: PAT_TA_62235.pep
MEILPVRHEVSNQCTLRCYSRRGRFQRPAPALARPPRRTRGRTPAGTCWARRPSVPRARAEKGRGGGGDRRRGTRRRRGTAWTRRPPWRARGQSERMEGAGGRGHDDIMAGEREGVRRG

SEQ ID NO: 167818 - protein, 190 aa, Triticum aestivum
  unsure (1)..(190): unsure at all Xaa locations
  Clone ID: PAT_TA_62236.pep
MAGGEHGANGLQEHDHAGALEEGRGGGANQPAGCEDAEQALSSTGNQPMISVQFVQKVLAEILGTYLLIFAGCAAVAVNQRTAGTVTFPGVCITWGLAVMVMVYSVGHISGAHLNPAVTLAFATCGRFPWRQVPAYAAAQVVGSTLASLTLRLLFGGEPEHFFGTVPXGSDVQSLVLEFIITFYLMFVIL

SEQ ID NO: 167819 - protein, 245 aa, Triticum aestivum
  Clone ID: PAT_TA_62237.pep
MQRDDRSRDSEGSGSRRRWYESRDRDLTPRAGDQGDSHSRSSYSRQQPPYQQQQQPYSPMYQSPTQQRQYEPQRQDQFQMYQQSPQQNPALPQRPQQYQYPYQNQYQQQQQPYYNAPPQSMPGYNSPYQQQQALQQQNPQRPQTPSSVFSSSSDTSTSLLDISRFKDTKEYGGLLGTFFKAPSERVKQRLHRKKSKKRRVLYFGNSSSPLCDSDLAYGNGYVRPKSRTKPRKSSRISGAGYGSAA

SEQ ID NO: 167820 - protein, 228 aa, Triticum aestivum
  Clone ID: PAT_TA_62238.pep
MSLTTDPDPSDGCPAFIPLEANPELMTTLIHKLGVSDALEIHDVYSLTEPEMLAFIPRPALALLLVFPISAVYESQRMAEDSLVDEYKGKGDTEPVLWWPQTIRNACGLMGLLHAVTNGNARNFIEEGSTLDKVIKKSMPLDARGRAKVLESTPELATAHKEAATQGDTPAPAAEDNVELHYVCFAKGTDNGLWELDGRRKGPIRRGDLDDNEDVLSSKGLALGALKF

SEQ ID NO: 167821 - protein, 158 aa, Triticum aestivum
  Clone ID: PAT_TA_62239.pep
MQPMLALGLLLLLSLDGGVAVAAEDGQFAYQGFAAANLTLDGVAAVTPNGLLLLTDTEYQTTGHAFHPAPLRFLDSSTTMTNSAAMARSFSASFVFAIRSRYDGLTSYGLAFVVALTSNLSAAESGRYLGLLNATNGTASDPILAVELDTIIRGGARI

SEQ ID NO: 167822 - protein, 108 aa, Triticum aestivum
  Clone ID: PAT_TA_62240.pep
APPAPSLPGSGAGQPDPHRLHLARLPGSPLPLESALHPLLPRATSSSFPCIERSRVPRAVVLAAAYSSEAQRAPSWPAPPHPPNWARAKSEQRPTPSPVPVGPGKFSP

SEQ ID NO: 167823 - protein, 75 aa, Triticum aestivum
  unsure (1)..(75): unsure at all Xaa locations
  Clone ID: PAT_TA_62241.pep
MSCCGGNCGCGTACKGGNGCGGCNMYPEAEAAGATLLVSATTTHKAISGAMEMGAENAAXACTQRKXSTSCACSC

SEQ ID NO: 167824 - protein, 70 aa, Triticum aestivum
  Clone ID: PAT_TA_62242.pep
YAELHAPVAVSDSAGGDPGAEGEGALPGVGSRGERHGCGGDGGIGDDDEGLVGAATAGSSAPLLSLSLLR

SEQ ID NO: 167825 - protein, 201 aa, Triticum aestivum
  Clone ID: PAT_TA_62243.pep
FPLTRESTRRLRPIPTILAGAPYRGTPMPPRRRPPGQRISSPKTAATPDAGRSAPGSKMPRTPTCSGSKRQRARPPQAPPREPSPPAPPPPFPPRRVPGSPLPRGPGGGASLPRGPPAPLSPPPPGPSPPPPGLGQETQWQPQGSGKGRKSRGRGRDWGVLFLFFFLCFFYFSFFFFFFFFFFFFFFFQGLVPFPSESGFP

SEQ ID NO: 167826 - protein, 152 aa, Triticum aestivum
  unsure (1)..(152): unsure at all Xaa locations
  Clone ID: PAT_TA_62244.pep
IGRLHNKKSCPASDQSWSLWNNTSLNDAFGVDAPGDKPEVTKVNSPYLLGYRPTNSNGPVILGIGGGGYIELVLGREGGDVSKXLNTLGFYAFVLVHRFPNRDTGPQAPLDDAKRALKIMAQSGLAPKGVNICGLSPGGHQGAELLAEYPQG

SEQ ID NO: 167827 - protein, 143 aa, Triticum aestivum
  Clone ID: PAT_TA_62245.pep
MQIFVKTPSGKTITLEVEGGHDIADVKARIHDKEDVPPDQQRLIFAGKQLEEGHTLADYNIQKESTLHLVLHLHGGRGGTGKGGTYPKIEPNLLQLALKYRQLKLVCRKCYARLPVRSANCRKKKCGHCNETRTKKKLKPRDP

SEQ ID NO: 167828 - protein, 109 aa, Triticum aestivum
  Clone ID: PAT_TA_62246.pep
RTASPSPERSLCPNGRGHGVEVERSPGRGGTNAAAPPFRPGSSGNVRSQAFDAGIVPPRRNYKHYDQFIHRKLRRVTVEQLFYGLGLKKASQSARRVRWRELVTQMMRG

SEQ ID NO: 167829 - protein, 171 aa, Triticum aestivum; identical to SEQ ID NO: 141856
  Clone ID: PAT_TA_62247.pep

SEQ ID NO: 167830 - protein, 240 aa, Triticum aestivum
  unsure (1)..(240): unsure at all Xaa locations
  Clone ID: PAT_TA_62248.pep
MKLNVKTLKGTSFEIEATPEASVGEVKRIIESAQGQNVYPADQLMIIYQGKILKDDTTLEVNKVAENSFLVIMLSKPKASSSGASTASKTPVSQSQPATPPAPVTSAARSPPSQAPVAASEPAPPSAQPSAVSDTPSPAVTASGDADVYSQAASNLVSGGSLEQTVQQILDMGGGTWERDMVVRALRAAYNNPERAIDYLYSGIPESVEXPPVARAPAPAHRHQTCRLLRLLHLYHSAAI

SEQ ID NO: 167831 - protein, 158 aa, Triticum aestivum
  unsure (1)..(158): unsure at all Xaa locations
  Clone ID: PAT_TA_62249.pep
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVLPNINPVLLPKKXLEKAEKESQSPKSPKEEGPRSRPRRQEDPQEEGRRQKDRRR

SEQ ID NO: 167832 - protein, 81 aa, Triticum aestivum
  Clone ID: PAT_TA_62250.pep
GHRRGLEQQHRYHHHHWKGQGWGCLEQQHQLEGQGQGCFEQQERPRAESQLVVSSPLLPISKLALFTASGIRSSWLDEAQV

SEQ ID NO: 167833 - protein, 43 aa, Triticum aestivum
  Clone ID: PAT_TA_62251.pep
LVVPSRLRTDAQRLKLMVHVTVHICYSPYFMSLYIHFEIRSSA

SEQ ID NO: 167834 - protein, 93 aa, Triticum aestivum; identical to SEQ ID NO: 117326
  Clone ID: PAT_TA_62252.pep

SEQ ID NO: 167835 - protein, 196 aa, Triticum aestivum
  Clone ID: PAT_TA_62253.pep
MASRHSMQLFRALRTSQSTIRQPVNRISVCRFYSTSTEDAPAPLLSKLKADLKTAMRAKDTPRLTVIRSIMSANLNASKTSTPIKTDVQLVALIRKIQKGAQDAAAEAKAANRDDLVQKEEEQIKVLNEYITNSGVESLTEAQLKAMVQDAVEASKAAGIQAKSIMGDVMKRLSGALEGKDVDKKELSKMVKELTG

SEQ ID NO: 167836 - protein, 39 aa, Triticum aestivum
  Clone ID: PAT_TA_62254.pep
AKKKIVVFSANLAFNVVVSCNLLILLCTLSAEKMKSTYI

SEQ ID NO: 167837 - protein, 143 aa, Triticum aestivum
  Clone ID: PAT_TA_62255.pep
FSYMNTSKLDVFHGSEAIRGFPSRLKSPESQPESALLLHPCSLSLSMCAKTRMRLPEKDPPSHPLQPQVLFTSALSRNKARKPSARGPFSIAKGILMRDGVSGLIKGATVTCIAAAASNVLFLSCYEGLKLYYVQYGAKLEII

SEQ ID NO: 167838 - protein, 81 aa, Triticum aestivum
  Clone ID: PAT_TA_62256.pep
IRGRRQEAVDRSSERNSLVYSYALLYVVLLLSFRCSASMVMVPLVMLGVATSPFSSISPSYGSCKFQVSINGTKTCLFVHN

SEQ ID NO: 167839 - protein, 120 aa, Triticum aestivum
  Clone ID: PAT_TA_62257.pep
GRAGTSHPSPARRSSASCSPAFFPLVTTPCRPGDQTGDGLAAAAAATVEPRRWPRRLQLKQRVAGGLTAGRQTAGGLRRSSVQNCRADCVVTSLHQLLLIYVVVAAALHADLGPSTIGWW

SEQ ID NO: 167840 - protein, 254 aa, Triticum aestivum
  Clone ID: PAT_TA_62258.pep
MATSTSRDRGGYPPDSTRLRIGDDIAWADVGGVYDRDDSLKENTNPKCLLKAHNPSAPGQHHHHHHNGAASQRFSGNLKPTAAPIIGLSGKLGQGGARRTHQQHPPAMFPKKAKTGGGGRNPRPAVPEDEPSSPKVSCIGKVLSERERARRRPRPPPSERPPSGCCPGLGFLMRRSRSRKSAVESVDWSPPPPPPRRREAKAAETEEAAPAPAPGLGVMRFASGKAAADLAGPDGGGRPRGEIRAVVARAGDLI

SEQ ID NO: 167841 - protein, 73 aa, Triticum aestivum
  Clone ID: PAT_TA_62259.pep
TTMINDDDFMDISGRRRCGVDKPPKLVYFPTMLSHHISQPWHKIFSLLRFPFYLYHLGGSLIIGYMAFIYIYF

SEQ ID NO: 167842 - protein, 130 aa, Triticum aestivum
  Clone ID: PAT_TA_62260.pep
MEKYTNSFPARTILLCVLLLYSTIHTECQIMQGLANEKINLPTGLCIHRPEKLCPTKPFCFCCLVNRECYLAMDACVSNCAKSASSGIEASQKYGLSSRKKRKKEIRSITFPCNAPMSSTLYLCPGGKPR

SEQ ID NO: 167843 - protein, 74 aa, Triticum aestivum
  Clone ID: PAT_TA_62261.pep
IVNGIACAYLLIWSVIYCFPYALPTSPQSMNYTCVIWGGLTFLVSVWWFASARKGYKGPTTTGSVVSGVAVGSV

SEQ ID NO: 167844 - protein, 139 aa, Triticum aestivum
  Clone ID: PAT_TA_62262.pep
MAASGSAQSRRFAVACGVLSRCIKAAEARPVVLPLMPGAEVPAEDERAAGPAPASAHMTIFYGGQVLLLDEVPDDRAAELLRVAAAAGGARGDGDLPMARKASLQRFMEKRKGRLAARAVPYSRPDGDTASCNRLTLTL

SEQ ID NO: 167845 - protein, 136 aa, Triticum aestivum; identical to SEQ ID NO: 106789
  Clone ID: PAT_TA_62263.pep

SEQ ID NO: 167846 - protein, 115 aa, Triticum aestivum
  Clone ID: PAT_TA_62264.pep
YTEAVGQMHGREDYQRVADVTGYSSSSVELRIPNSSLESIVGAGGVNLAEIRQISGARMKLLEAHPGSLESIMEIQGMPDQVRVAQSLLQGFIGANSQSVQPSQSSRDVHYPRWN

SEQ ID NO: 167847 - protein, 106 aa, Triticum aestivum
  unsure (1)..(106): unsure at all Xaa locations
  Clone ID: PAT_TA_62265.pep
SRRRRRSRSLHEEGDGGEEVEAGRHGCAVRAPPPGASPRPXWPPSPSSASASTYCLPRVPAHPLLPPXPPPSVSPPSPPPPPPSPPPPPAPPPPPPPPPPPPPPPL

SEQ ID NO: 167848 - protein, 154 aa, Triticum aestivum
  Clone ID: PAT_TA_62266.pep
AGPGFLAIDEAIAFSEGEETGGSHKARFGEIEQRGMALTPKGRRLYDDLINEWRETSSSLTEAESKEKHLAKIFERFPDDMETLRKEKLAYFSYKPVHNASIAQDADINSLISSGAVEVEPITYEDFLPVSAAGIFHSNLGDDGGMIHTVVADK

SEQ ID NO: 167849 - protein, 228 aa, Triticum aestivum
  unsure (1)..(228): unsure at all Xaa locations
  Clone ID: PAT_TA_62267.pep
MSTTTTTTNQPITAASMLRLFPDIDTSSAPLSGHDEEQIRLMDEVCIVLDEDDKPIGTASKKICHLMTNIDKGLLHRAFSVFLFNDKNELLLQQRATEKIXFPDMWTNTCCSHPLHIPTETGSTLEDSIAGVKRAAQRKLEHELGIKKEQVPFEDFHFLTRIHYKAPSDGMWGEHEIDYILFIKANVDLDINKNEVRDTQYVTPESLKQQFDDPSLVFTPWFKLICNS

SEQ ID NO: 167850 - protein, 78 aa, Triticum aestivum
  Clone ID: PAT_TA_62268.pep
MSYQQGYPPPGTAAAYPPPGHHQQAYVAPPPAMYQQDQQYPPAGADTTSRGGHGHGGDGFLKGCCAALCCCCLLDACF

SEQ ID NO: 167851 - protein, 186 aa, Triticum aestivum
  Clone ID: PAT_TA_62269.pep
LRRGDYNATGVEGPIKRHSLTLLASDDPTVHEEPEFAHTILSQDRIRLASKGAIARAGGNQHHSKNFVENTFGWEGGFFAPLFWNLGVNSQNNAAEAPAGVHVEDVNEEARHMAPPSEETLRLRGLVGRAYMMDLSVLAESSDKIVCTVSSMGCRLLAVMMGWEDSMENGGWHNVDGTYGWTGIDW

SEQ ID NO: 167852 - protein, 100 aa, Triticum aestivum
  Clone ID: PAT_TA_62270.pep
PELSHRSPNSPLQHRAPPAPGSLAHLPLRSLNRSPPPCLSTTRTRTLRSSAPGTTPPTPPTRSTPTTHARARALIFSPPPDPAREPPSASSSLRRPRRSP

SEQ ID NO: 167853 - protein, 221 aa, Triticum aestivum
  unsure (1)..(221): unsure at all Xaa locations
  Clone ID: PAT_TA_62271.pep
MVLEAVMVVVDNSESSRNSDYQPTRFDSQVDAVNITFQSITQGNPESSVGLMSMGGKGPEVLVTLTTEQGKILEGLHRTKKKIGGSSHLKTGIQVATLALKHRQNRSQRQRIIVFVCSPVEESEKELTTLAKKMKKANISVDFVLFGDLDDDSTKNKLQLFIDTVKTNEGCHLVVIPPSSKLLSDQLVSXPILLGENAGGSGGAGGAGGGNDXVEFGFDPA

SEQ ID NO: 167854 - protein, 191 aa, Triticum aestivum
  Clone ID: PAT_TA_62272.pep
MDTAPAPAPAKPSLSRKPSPSFRLRNGSLNALRLRRVFDLFDRNGDGEITLDEMAAALDTLGLGADRASLEATVGAYIPAGAAGLGFEDFEGLHRALGDALFGPIVEEEPGKEGEAEDEDMKEAFRVFDENGDGFISAAELQAVLKKLGLAEARNLAAVQEMICNVDRDRDGQVDFGEFKCMMQGITVWGA

SEQ ID NO: 167855 - protein, 76 aa, Triticum aestivum
  Clone ID: PAT_TA_62273.pep
PAGPGCSKEGIDLSQVIAVGDGANDLLMLDKAGLGVAWNAKPRVQMEANARLNGESLLDLLFLLGFTAEEIDALAV

SEQ ID NO: 167856 - protein, 151 aa, Triticum aestivum
  Clone ID: PAT_TA_62274.pep
MNSHSIMAVPSVFAAFDKDGDGKVSVSELRRCMEATLGEDVPEEEAAVTLAAVDADGDGLLNQEEFSRLATAGTHEEDDADVKRRCLREAFGMYASSSAEDTITPASLRRTLSRLGSHELGVEECRAMICRFDLDGDGKLSFDEFRIMMMA

SEQ ID NO: 167857 - protein, 261 aa, Triticum aestivum
  Clone ID: PAT_TA_62275.pep
HSIRSIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 167858 - protein, 126 aa, Triticum aestivum
  Clone ID: PAT_TA_62276.pep
VVRVCAHPPVIYQCTRVLASSSGLTRSWDEIPGMAPPASRFLWSVVPAGVDVGADEVLGLAMRIGYRQRRGHGVGGGVDNENVWRREVLRYDMRTDATATVAELVGREKHDDFVVFGYHSSMAPLY

SEQ ID NO: 167859 - protein, 115 aa, Triticum aestivum
  Clone ID: PAT_TA_62277.pep
MAPTKKVKKSGENINNKLQLVMKSGKYTLGYKTVLKTLRSSKGKLIILANNCPPLRKSEIEYYAMLAKISVHHFHGNNVDLGTACGKYYRVCCLSILDPGSLPFRSLAFVSTFSL

SEQ ID NO: 167860 - protein, 98 aa, Triticum aestivum
  Clone ID: PAT_TA_62278.pep
MSYYNQQPPVGAPPPQGARPVDSRYGDKGGYPPPGYPPAGYPPPAQGYPPAGYPQQGYPPQYAQQPPPHQQQQQSSGPSFMEGCLAALCCCCLLDACF

SEQ ID NO: 167861 - protein, 97 aa, Triticum aestivum
  Clone ID: PAT_TA_62279.pep
PAGPGNPTVSRTKLRFSSCAVFTTRVLNTVVGEVHVMMEYEPQSFFSWPAALASWLASFCGGSDGGGHGEPVAGDGPTRQMAAAAKHLNGAHKIRFS

SEQ ID NO: 167862 - protein, 205 aa, Triticum aestivum
  Clone ID: PAT_TA_62280.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 167863 - protein, 176 aa, Triticum aestivum
  unsure (1)..(176): unsure at all Xaa locations
  Clone ID: PAT_TA_62281.pep
RSGGGRDLLFSYIPTVDTVPTRLANTRTHQXHDSDDKGRVRKNRTYPAGRALDDGQHHHRTNMDKNHPTILXKDAMRQFHKQQNHFXKAIINRDQLGPLVPRDIRDAYDELEKKDIVSVLDSSLPRSYSKVLGKAAASPDIRIWSTEPVEVHRLADENNSHFSGCLDLVAYEKHGH

SEQ ID NO: 167864 - protein, 110 aa, Triticum aestivum
  Clone ID: PAT_TA_62282.pep
GNATRDRRKTDRLYRICCGLSVCIHTPQVNRICATICPSNVLLNILQLDKERKAITRTKEPHQARVLTLSRQYTRSLADHDDERIRHLHRRVTTKETNKVAILPRAIRDY

SEQ ID NO: 167865 - protein, 134 aa, Triticum aestivum
  Clone ID: PAT_TA_62283.pep
FPALFYVVFLQVSCAVSRHPAESKFELRQNVPAVMTVNGFQQGEGGGGPASCDGQFHSDDEFVVSLSSEWYAGGARCGRYIRIVDSFNIGINVKVVDECAGCDNEVGASSHIWKSLNLDTSQGEVNIRWSDLDF

SEQ ID NO: 167866 - protein, 75 aa, Triticum aestivum; identical to SEQ ID NO: 106874
  Clone ID: PAT_TA_62284.pep

SEQ ID NO: 167867 - protein, 115 aa, Triticum aestivum
  unsure (1)..(115): unsure at all Xaa locations
  Clone ID: PAT_TA_62285.pep
TKTPPRPTPHSPHPPGGGLPNFLNPKGNKKXPPAVGRRPAPSHPTKKKPFFPPPPPGKKKNRPPIISPPPPKKTTPPAPPHTPPSYPPPPPGPATPKKRVPPPPTPPCPLTKQEE

SEQ ID NO: 167868 - protein, 184 aa, Triticum aestivum
  Clone ID: PAT_TA_62286.pep
LISFTWSMMQATHFMHSKTVAPSSKSYMFASFSQRNAIMISDLPFAVGDGGADGEQIILEVASVAEVPVCSPGMSFWAWEMSVWMAPMFLRGPSQCVHLELSCPLLQPEVEVEALEVSGHRRPCSRHRDHFRGHRLCRPRRGSSIHAELQDGLDHDRGQGVGWGEVSSATKTEEEEGRDEGWGE

SEQ ID NO: 167869 - protein, 157 aa, Triticum aestivum
  Clone ID: PAT_TA_62287.pep
GQASTPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 167870 - protein, 155 aa, Triticum aestivum
  Clone ID: PAT_TA_62288.pep
PQAPSLLSPLPSSQSLASFPRRHPPRKGGCLAAAATAGAAPAASAATAAAGARCSPTWRPPPAPPPWSCPPPPTRGAPAGSRRPGRPAAATAPPASAAPRAAAPAAAAIVFAPTTPAGRGEHEDEEDKQASTITTSSPPPSVSSPAAACARGRAR

SEQ ID NO: 167871 - protein, 123 aa, Triticum aestivum
  Clone ID: PAT_TA_62289.pep
CSPGVTCELDRAMAARAGKALALAMLISFLVVQGTTGKLTENCYCVFYNWCFNFGPKPRDHVICMEKSLKHCFKGCPRTATTPYVTPLADLVNPGVLSFPASYRRGQHGRSCRGCRSRRVPRH

SEQ ID NO: 167872 - protein, 147 aa, Triticum aestivum
  Clone ID: PAT_TA_62290.pep
LLSSREGPLLWAHRRLRFQEPCRRKPRDGLGPGQRRVQAALCQAEGEPAPSPPRLVAPGGVGSADSAAPQGKGPPRRRVGAAGANYAEDAAAISTASRDGEGPSHLTERGNAACLRRSGRRVRRGWVLHRACYCMRPRRASCFFICS

SEQ ID NO: 167873 - protein, 88 aa, Triticum aestivum
  Clone ID: PAT_TA_62291.pep
SSRERLRCRWAVDLRTMKRLSGHACSYGGTYPPARCKHCSFDWNILLRFNLPGATSLHPVLHDHLYFGAATLSTLYQIRGRLRHECTS

SEQ ID NO: 167874 - protein, 156 aa, Triticum aestivum
  Clone ID: PAT_TA_62292.pep
QFPILPIFSLPTESATRVAVIETAPSATETCRPWRRGSCPCRSSAQRTESSALLWRAWLRRRTHGALCCRRSISPAAARQGIHSKAAAACKAQKARRRARPRAQQRRLRLPSARHPEGQRRSGHGIPERRRPCRPRRPACSKSIRSSPSLVQFLSI

SEQ ID NO: 167875 - protein, 78 aa, Triticum aestivum; identical to SEQ ID NO: 106976
  Clone ID: PAT_TA_62293.pep

SEQ ID NO: 167876 - protein, 55 aa, Triticum aestivum
  Clone ID: PAT_TA_62294.pep
FVLLCSYGAFFFFFFVFFFFFFFFFFFFHQNVMHNLNIFLTVKLNQKASFNIPTT

SEQ ID NO: 167877 - protein, 174 aa, Triticum aestivum
  Clone ID: PAT_TA_62295.pep
MAETEYRCFVGGLAWATDDHNLQQAFSQYGEILDAKIINDRETGRSRGFGFVTFGSEESMRQAIEEMNGMDLDGRNITVNEAQSRRSGGGGGGGGYGGQRGGSGGYGGGGGGYGGQGGGGYGQGGGGGYGQGGGGYGGQRGGGGYGGGGGGYGGGGGGYGGQRGGGDSGGQWRN

SEQ ID NO: 167878 - protein, 140 aa, Triticum aestivum
  Clone ID: PAT_TA_62296.pep
MAMSLSLARLALPPVLQALPGRRPAHSALAFPANSFFGAPLAVAAAGAAALSPAAPLPRPLAVVAAGKGYKMKTHKASAKRFRVTGTGKIVRRCFGKQHLLSKKNAKRRKRLSKMVQVNKSDYSNVMGALPYLKVNKKAG

SEQ ID NO: 167879 - protein, 98 aa, Triticum aestivum
  Clone ID: PAT_TA_62297.pep
DGKNLRQRAEHSAFQARQLQRLQPVDEEEVDDEFAEVLDPGRQRSVDAAGAAPSGWRAAGGASWRAAGGASWRKGRASRAGGASWRMGRASRTGGTAG

SEQ ID NO: 167880 - protein, 97 aa, Triticum aestivum
  unsure (1)..(97): unsure at all Xaa locations
  Clone ID: PAT_TA_62298.pep
MKGTIXAAKRILQAXLXMGXLSHXNADFFPKCCNNCRSFSGVDVCDDAHPKCPKGCSACRVVSTSPEMWRCADMKSTVDGXCGGPCFFLPTAPTAGI

SEQ ID NO: 167881 - protein, 104 aa, Triticum aestivum
  Clone ID: PAT_TA_62299.pep
MADRLTKLASQRAVVIFGASNCFMCHTVKTLFTELGVSWTVHELDKDPRGKDVERALVGMVGRSPPVPAVFIGGRLIGTTDQVMTLHVGGQLVPLLRQAGALWL

SEQ ID NO: 167882 - protein, 123 aa, Triticum aestivum
  Clone ID: PAT_TA_62300.pep
SFRRKTREKKRELGLAITHPHGDLQEEHRRADLGRPRSHGRRPLLMLLRRRGREVLSAYLGAGLQPEAVQEAVRGEVESTLLHGVGRRPAHGGNRLLLLSAQAREDCSCCLVNFVGTMKRSII

SEQ ID NO: 167883 - protein, 78 aa, Triticum aestivum; identical to SEQ ID NO: 106969
  Clone ID: PAT_TA_62301.pep

SEQ ID NO: 167884 - protein, 115 aa, Triticum aestivum
  Clone ID: PAT_TA_62302.pep
SDALGGQDSSPGLDIGSVSTLFVAWRSWRIRPLRSCRGCCHWRRMLSCSHPSAVLMAMAVVCRQLGGACGAACPVEARPPCCPTGFVASCAEFGSDRGMTWGRWVVADAVEAEVV

SEQ ID NO: 167885 - protein, 86 aa, Triticum aestivum
  Clone ID: PAT_TA_62303.pep
KYSSITHPRPRHLHRKVRRRPPRHERKIHTLETGSIHSTGIQLARPESATPCSQTPSELSRIGSLISLDTYETGIVPRCKSRQHPP

SEQ ID NO: 167886 - protein, 120 aa, Triticum aestivum
  Clone ID: PAT_TA_62304.pep
PTYRWTCDTGCKYLAPGGFRRNDMFQSHQRWLHQGGHMSLHSCTHCLRGRSLFANNSPWTPHAYAVASASAAFPSNARSGGSIKELLSFRLAHLAHDPLYRGLHLGRVTSLFAVSLLPSA

SEQ ID NO: 167887 - protein, 50 aa, Triticum aestivum
  unsure (1)..(50): unsure at all Xaa locations
  Clone ID: PAT_TA_62305.pep
MPDSTIAVGSHREVYEVGALKAALAEYIXSTLIFAFARQGSGYGLSKRCA

SEQ ID NO: 167888 - protein, 186 aa, Triticum aestivum
  unsure (1)..(186): unsure at all Xaa locations
  Clone ID: PAT_TA_62306.pep
MSTSSGAKEAPANNPGLQAEVDPATKGYFMQQTLEKLINANSTEVDWERSFYLNLVAHTSYTVXVALCSISNLRNRADKSKRLPPIYKVSKTVYASPSRVNFRLDQRKAVETVPAYPNIYFSVDDFDDPFDAVVLSDPEHCYCVILNAHDGAAFPEESESSNVGSNTIWXNSGSSGENPPKVHSLP

SEQ ID NO: 167889 - protein, 147 aa, Triticum aestivum
  Clone ID: PAT_TA_62307.pep
LTVAKHEFARPSTLRCRFQQNRELVPAKRKIAVAILTSFFSLWQQIGTPVPAKNKSWFQQKGKMVVSILTGRCSSHQIGIAVAVAVAGCSIAGHRLQRAWTSFPAPAPHTPSSQPPQSRDHATVAARPPVARNREHRGPAGHASSNR

SEQ ID NO: 167890 - protein, 90 aa, Triticum aestivum
  Clone ID: PAT_TA_62308.pep
FLSLEDHPPPDVHAFHRARRALLILARLRPLSGSGPSFPSSGLACPCPCVVGFGAVSSRGALTSHYSRLPWCLFDKRSRHFAGERSSGFV

SEQ ID NO: 167891 - protein, 93 aa, Triticum aestivum
  Clone ID: PAT_TA_62309.pep
ILNVRDQIQILSNSVYKSVEHRVIVNAKEERISLALFYNPRGDVPIAPAAELVTPDRPSLYPPMTFDEYRVYIRKNGPRGKAQLEGFKGQAVN

SEQ ID NO: 167892 - protein, 154 aa, Triticum aestivum
  Clone ID: PAT_TA_62310.pep
MAPKAAEKKPAAKKPAEEEPATEKAPAGKKPKAEKRLPAAKTAAKEGEGKTRGRKNVGKAKKGVETYKIYIFKVLKQVHPDVGISSKAMSIMNSFINDIFEKLAGEAAKLARYNKKPTITSREVQTSVRLVLPGELAKHAVSEGTKAVTKFTSS

SEQ ID NO: 167893 - protein, 114 aa, Triticum aestivum
  Clone ID: PAT_TA_62311.pep
MPKDTGDAKLLIQSLNKAYAATPANLKIIDLYVVFAIVTALVQVAYMGVVGSFPFNSFLSGVLSCIGTAVLAVCLRIQVNKDNKEFKDLPPERAFADFVLCNLVLHLVIMNFLG

SEQ ID NO: 167894 - protein, 96 aa, Triticum aestivum
  Clone ID: PAT_TA_62312.pep
MAASVACAFFFDAEPVGEPGMPALDACALCAKPLARDSDVFMYRGDTPFCSEECRHEQMHLDAVCARQAARRLQRFTAEAECHRGQRQSRKVSIAS

SEQ ID NO: 167895 - protein, 166 aa, Triticum aestivum
  unsure (1)..(166): unsure at all Xaa locations
  Clone ID: PAT_TA_62313.pep
TFSAAPAGASLPPTPRPPPAPRPPPSPRPPPAPXPPPSPRLLPAPGSPRDGRLPSPTXPPPASGSSGVAPSPPSGCPRRRSSRHSASSLVGGPSPVHPAVQTHRPRPFTFAAPLSSSHREVFSPAPATNTGRCPFCHNGTSTNTSVVILNQFLTRPPRKPCSCMLT

SEQ ID NO: 167896 - protein, 107 aa, Triticum aestivum
  Clone ID: PAT_TA_62314.pep
GPLEAGPANPAPWHTAHTAGAALTAIFQGAVALLAFTRTADFLAELQSYVRDDDGAVILKMVGGLGTAIFVLEWAALALAFSLRLDEDDDGDDDLRRAKNWADAYHV

SEQ ID NO: 167897 - protein, 151 aa, Triticum aestivum
  unsure (1)..(151): unsure at all Xaa locations
  Clone ID: PAT_TA_62315.pep
RLASPPSPWHRSATAPAPPVTTTTRRPAPRAPPPGIFAGHEARRRPRLRWFXPGSTGSGAPRPDPSVPVTGAPPPPPSGLAGASPRLANVTPNPPAFPSIWWDREEERPVSPGPTAPSPATSSAGPEPACFGLLRGLPSASSPNGPSPWFR

SEQ ID NO: 167898 - protein, 142 aa, Triticum aestivum
  unsure (1)..(142): unsure at all Xaa locations
  Clone ID: PAT_TA_62316.pep
ASVPPYVYLSTPSTPLANYFFMLATKVFPCFNFRSPPRLQTTLEEDILGVGPSAPHKKVPGRYFHTVLFCFRSQCLNPLWRGTRPSSPRRDQDRGPDHAQEPSPGPPERPWLKEACFFFFFFFFFFFFFFFFFFFLDFXRPG

SEQ ID NO: 167899 - protein, 158 aa, Triticum aestivum
  unsure (1)..(158): unsure at all Xaa locations
  Clone ID: PAT_TA_62317.pep
MEGAGASSSSTDDGATREAADADGRPAAATEAASKPAPAPAPGKTMKKQKRARHPRFAFMTKTEIDHLEDGYRWRKYGQKAVKNSPFPRSYYRCTNNKCTVKKRVERSSDDPSVVITTYEXQHCHHTVTFPRGAXAATLASQMVFSGHHHQQPRVQRL

SEQ ID NO: 167900 - protein, 188 aa, Triticum aestivum
  unsure (1)..(188): unsure at all Xaa locations
  Clone ID: PAT_TA_62318.pep
MPPGRHPFGEGRITMRKTGDKPHVAPPSIPRHGSDRVLXLGPLSADPPSYLTGQLPGDYGWDTAGLSGHPQTFADKRQLQVIQCRWVMLGALGCVYPXLLVHFAVKMGEVVCIKAVSHIFGDGDLNYLAHPDVWHEESIVXICVCQMMIMFTVEXYRVRVCPTLQIKDPFYTDDSFDLLVLAEDPEAF

SEQ ID NO: 167901 - protein, 78 aa, Triticum aestivum; identical to SEQ ID NO: 106977
  Clone ID: PAT_TA_62319.pep

SEQ ID NO: 167902 - protein, 131 aa, Triticum aestivum
  Clone ID: PAT_TA_62320.pep
MLLRNGGATLFVTAGANSLGGAFNALTEGRLVQKSLRKKVGHGLSGVFFMVSGPLFRNSTGERFFAGEAPFLNCARFLTYGLGFYSDKVLEKSGTREGKREELLRGPLNYAIGLRIIVQAFGGDSPIGIIS

SEQ ID NO: 167903 - protein, 233 aa, Triticum aestivum
  unsure (1)..(233): unsure at all Xaa locations
  Clone ID: PAT_TA_62321.pep
MGVKQFFKDRPLKVKDSKVTKAAELTLRESIWPIALVTVLFFLWGFSYGLLDTLNKHFQKVLDIDRARSAGLQAAYFGAYPXSSLGHAAWILRHYSYKAVFIWGLSLYAIGALIAIPCIKAKSFAGFCMSIFIIGNGLGSLETAANPFITVCGPPRYSEIRINISQAFNGVGTVIAPVLGSYVFFNNLDDEEALANVQWVYLSIAVFVLILACLFYISQIPXITDADMAFQAQ

SEQ ID NO: 167904 - protein, 155 aa, Triticum aestivum
  unsure (1)..(155): unsure at all Xaa locations
  Clone ID: PAT_TA_62322.pep
PPSTPASSLLSPAASSQSSPSSPRHHPPRKGGCLAAAATADAAPAASAATAAAGARCSPTLRPPPAPPPWSCPPPPTRGAPAGSRWPAGRPAAATAPPASAARPAAAPAVFATEPAPRRPAGXGEHEDEEDNWTSNHXPPPPPSLAAACARPRAR

SEQ ID NO: 167905 - protein, 234 aa, Triticum aestivum
  Clone ID: PAT_TA_62323.pep
NRRARLLGSCPHLSSVLARPAPTVADANAMAPRLLPQTPAVVEIEGDALAYVSTPTGASMFTFGSDARSMTSALVAPPSLPRVDADVLRLPSPTSGTSPPSPCAGARRRLLVIGLPLARPPGDSPMSSRGHRAGTWSLATKLVNSASNGVTTRTLLPGGSPTRKRVPETLLADVELCCSVTGGSRMVVSAVSGGGFEDGETTCFLSLLISLTHRIHCIRAMCMRHTSILSCLFN

SEQ ID NO: 167906 - protein, 86 aa, Triticum aestivum
  Clone ID: PAT_TA_62324.pep
WPCRVRVLEVCWHLSSGAQIHESHRWYKHSLVGRLATHSPYFRPDSASVSLACHISVVFYYCRCCTGSFGSGSVPVTFPCTSGTQA

SEQ ID NO: 167907 - protein, 131 aa, Triticum aestivum
  Clone ID: PAT_TA_62325.pep
MCSTTPCIMVLARVFQHGPRSSVSSSEETHTESASSLDRVGGGVPREKTHTVPAPSIYLSQRGPSRRDVAVADLAATPLTCSTRSGASPQGKKVSGGRRWRGRGWISWWGRRRRLLSDIGGGEGLRGLGRP

SEQ ID NO: 167908 - protein, 149 aa, Triticum aestivum
  unsure (1)..(149): unsure at all Xaa locations
  Clone ID: PAT_TA_62326.pep
MAYDDRDTIVVSGEDAIEPQENVSEYSLPLSVPDQGLDDGSHPIVDQLPDASASPLAQQETSTASTSKGIKKAKSKKRVVVKKAARRSKWNQDNILTDPKSPLASADLRSILSNPMAWEILENEERAEILALXPDSQHILSAGTEDACP

SEQ ID NO: 167909 - protein, 223 aa, Triticum aestivum
  unsure (1)..(223): unsure at all Xaa locations
  Clone ID: PAT_TA_62327.pep
QLQQPWVKEKIHISIEVIGHVDSGKSTTTGHLIYELGGIDKRAIERFEKEAAEMNKRSFKYAWVLDKLKGERERGITIDIALWKFEXTTKHSCTVIDAPGHRDFIKNMITGTSQADCAVLIIDSTTGGFEAGISKDGQTREHALLAFTLGVKQMICCCNKMDATTPKYSKGRYEXIVKEVSSYLKKVGYNPDKVPFASISGFEDDNMIERSTNLDWYRAPPFL

SEQ ID NO: 167910 - protein, 89 aa, Triticum aestivum
  unsure (1)..(89): unsure at all Xaa locations
  Clone ID: PAT_TA_62328.pep
RVVXXXXGELXXSTXFXNHFPLFXGWSSSRSXDSXXXXXXXXXXXXXXXXXXPQPXXXXRXXPXRSLLLPWVXXEEATXCSLXLSEXPX

SEQ ID NO: 167911 - protein, 224 aa, Triticum aestivum
  unsure (1)..(224): unsure at all Xaa locations
  Clone ID: PAT_TA_62329.pep
MXIFVKTLTXKTITLEVESSDTIDNVKAKIQDKEGIPPDQQRLIFAGKQLEDGRTLADYNIQKESTLHLVLRLRGGMQIFFNTLHRXPTITLEVESSDTIDNVKAKIQDKEGIPPAQQRLIFAGKQLEDGRTLADYNIQKESXTLHLQLQASRRPCKSFDKTLTGKTITXLEVESSDTIDNAKAKIQDXEGIPPEQQRPDLCPPTSSQEARPPCPNSTPPKEPP

SEQ ID NO: 167912 - protein, 144 aa, Triticum aestivum
  unsure (1)..(144): unsure at all Xaa locations
  Clone ID: PAT_TA_62330.pep
MGWAARFLTAVSFLAAGVLFAPDALFGGAPGRPAAGVAAARLAHVLCFATAWGAALWVTFIGGIVMFKHLPRHQFGSLQGKMFPAYFMLISGCSAISVAAFAYLNPWKTASTIERYQLGFLLAALGFDLXNLLVFPPMTIQMMM

SEQ ID NO: 167913 - protein, 171 aa, Triticum aestivum
  unsure (1)..(171): unsure at all Xaa locations
  Clone ID: PAT_TA_62331.pep
MANPRVFFDMAVGGAPAGRIVMELYKDAVPRTVENFRALCTGEKGVGKSGKPLHYKGSAFHRVIPDFMCQGGDFTRGNGTGXFSIYGAKFADEKFVHKHTKPGILSMANAGPNTNGSQFFICTVPCNWLDGKHVVFGEVVEGMDVVKNIEKVGSRSGTCSKQVVIADCGQL

SEQ ID NO: 167914 - protein, 87 aa, Triticum aestivum
  Clone ID: PAT_TA_62332.pep
IRKSHNKHTMSKVIFTSLRFFEGSSTTSQLPCDVRHNYSNATDPCSVTTLPAWSDLMAILSKPDNISVAAVASSGRVSIFNKADNGA

SEQ ID NO: 167915 - protein, 151 aa, Triticum aestivum
  unsure (1)..(151): unsure at all Xaa locations
  Clone ID: PAT_TA_62333.pep
PPPRPTTCSASSSPPSVPRTSPAESRPPPPRPPPPPPPPPPPPPPPPLPPPPPPPPPLSPPPPPPPAAKAPKDEDYKDQPNQPSHDPPXPPPSSTPPSLPCPSPHPPPPPIAPPPLPPPPPRAPRRTPPHTPPPPHAPCPPPXPPAPPPPP

SEQ ID NO: 167916 - protein, 124 aa, Triticum aestivum
  Clone ID: PAT_TA_62334.pep
HSNTWIFFFKRAYYSNTPSRPVFLLFLRRPSPPCTTSVSASPSGSTRAQRKAWSSAAASAAQRTSTPAPAGSLDASLAAKRLNTRAALCKPTGFDETTSPFTALISAAAAAAARDLDLKRVEHS

SEQ ID NO: 167917 - protein, 84 aa, Triticum aestivum
  unsure (1)..(84): unsure at all Xaa locations
  Clone ID: PAT_TA_62335.pep
XTRHQALMPTMVLVLYLNGNNCLSLNHLAVTSLSSLTQVSSHINHRVDYELKENKGVRYLFRHFLAMELFFESWFKGFDLVFYA

SEQ ID NO: 167918 - protein, 53 aa, Triticum aestivum
  unsure (1)..(53): unsure at all Xaa locations
  Clone ID: PAT_TA_62336.pep
MAVTFSDLHTADGXKGLEXHLAXKTYISGDGITKDDXXGVAXXXXXPXXEXPN

SEQ ID NO: 167919 - protein, 204 aa, Triticum aestivum
  unsure (1)..(204): unsure at all Xaa locations
  Clone ID: PAT_TA_62337.pep
GFTFPSDKVSPETRATMTAAEXLRSQXEEXNIEEDEXILEDDDDDHQDDNEDEDEMDDDDVEGGDGSGRSRSEKKGRKXMERXXMKGITGVXRVILFXSHTATFVLSXXEXXXXSXSKTYVMFGEVKMEDMDAKLPDRSGRGKLQAPGTRARHPQRGKPPVGATPRRRRSIKTGGCQQRMLERAMGGGPPGFQGPGGERRFQGR

SEQ ID NO: 167920 - protein, 121 aa, Triticum aestivum
  Clone ID: PAT_TA_62338.pep
PRSPPPHPGTAAAYACRTPLLHSPHSSAQLSCCLRASLLRMLGLPLLLGSWRRRRGCPPTAAAAAADSGTYGASRCGAGVAVKMADAGGVAEVPWDLVEWIRCVLLLPGWTGVPWIVRRTG

SEQ ID NO: 167921 - protein, 153 aa, Triticum aestivum
  unsure (1)..(153): unsure at all Xaa locations
  Clone ID: PAT_TA_62339.pep
CMYLPVLDLLLPYMMWDPPIWIVFWLYLHLPRFPRFSXMVXXTXPPXHSLXWGPWSKKTXLXAGLQDSXHQHVCKSIHXAWSLXPWKEGVEERELSKGDGDPRSLXSAXPRKEGGEGRELXKXXXXRXPSXIQGDQDVXXRXGWVWWMGRGRR

SEQ ID NO: 167922 - protein, 110 aa, Triticum aestivum
  unsure (1)..(110): unsure at all Xaa locations
  Clone ID: PAT_TA_62340.pep
MXSXXASXVSFXRXXKXXNGXSVSFSAPRKGNVSFRLQSVPQRFSVFCVVKKEIVXKVCDIVKSQFVFVXXTVVSGSSXFXDFGVDSLDRFEIVLGFXRFLGXXVEESSV

SEQ ID NO: 167923 - protein, 139 aa, Triticum aestivum
  unsure (1)..(139): unsure at all Xaa locations
  Clone ID: PAT_TA_62341.pep
LPSLATTHSQGGCLAAAATAGAAPAASAATAAAGARCSPTWRPPPARPPWSCPPPPTRGAPAGSRWPAGRPAAATAPPASAAPRAAAPAAAATEPVHRRPAGRGEHEDEXRRSKQSSSPPPPPSVSLPLAAACARARAK

SEQ ID NO: 167924 - protein, 147 aa, Triticum aestivum
  unsure (1)..(147): unsure at all Xaa locations
  Clone ID: PAT_TA_62342.pep
PQWVVLEQRLMSCHPKYSVAMSHPRSLFATTSSQATTSLPXPMTGWRGGRSXKRTPTPSITTTTLRSSSVTRPPTPXPDAAHGPRRRGGGRXHPGDILLXPDKASAPPAAAXXEXXGXXGHXEHEXXAXGXHXXPXXXGAPELXXPE

SEQ ID NO: 167925 - protein, 56 aa, Triticum aestivum
  unsure (1)..(56): unsure at all Xaa locations
  Clone ID: PAT_TA_62343.pep
MXDAKGTTXXTLXTXKXMXNXLVXXKXFVVEXIHPXRANVXKGEXKERXXKGXEXK

SEQ ID NO: 167926 - protein, 212 aa, Triticum aestivum
  unsure (1)..(212): unsure at all Xaa locations
  Clone ID: PAT_TA_62344.pep
MAAATMALSSPAMAGTPVKASRAAPFGEGRITMRKTAGKPKVAASSSPWYGSDRVLYLGPLSGDPPSYLTGEFPGDYGWDTAGLSADLETFAKNRELEVIHCRWAMLGALGCVFPELLARNGVKFGEAVWFXAGSQIFSEGGLDYLGNPSLVHAQRILXIWACQGVLMGRXWKGYRVLGGPAGVKMGEPLLPPGGVFDPLGLRQGTRGAWGG

SEQ ID NO: 167927 - protein, 222 aa, Triticum aestivum
  Clone ID: PAT_TA_62345.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELQGEEIKNGRLAM

SEQ ID NO: 167928 - protein, 98 aa, Triticum aestivum
  Clone ID: PAT_TA_62346.pep
ETRRDICDASIAGASALRTNGMLAASHDAYVQMCISDILSNGMSNGKCCTNRAVSRDSVRLLASECLDDPHSTQRSHHAEHHVRLHTLSTSFRLADLD

SEQ ID NO: 167929 - protein, 132 aa, Triticum aestivum
  unsure (1)..(132): unsure at all Xaa locations
  Clone ID: PAT_TA_62347.pep
FFPLXXIMKXXXXXXGVGGFVXRXGXXKXDXDVVAXNXPFIITEYMIICVMXDTVXGKXKXHEVKVXGSKKLLLCEKEVGGVXXRNLIDIPSPPXXGGEXXVEXXGVXSEKDKDVVHIKGWCQMKGIIFDSQ

SEQ ID NO: 167930 - protein, 163 aa, Triticum aestivum
  unsure (1)..(163): unsure at all Xaa locations
  Clone ID: PAT_TA_62348.pep
GFWNWTFXLIDEDENGXXXIXXNWRGIXFEFFTDAXQXXIXXGDDGXXRKIXXXXXIYYXXXXXXXXXXXXXXXXGXXGSPGIRLLPPKRGGRWGLPFLLSRQEKRIPNAIPQGHKRNLNCQFFHPFACPERRLGATPRRHPIGDHYPPFFFFPGAPLWLAPR

SEQ ID NO: 167931 - protein, 161 aa, Triticum aestivum; identical to SEQ ID NO: 129051
  Clone ID: PAT_TA_62349.pep

SEQ ID NO: 167932 - protein, 241 aa, Triticum aestivum
  Clone ID: PAT_TA_62350.pep
WACVLILEAVVPALADPDPEIGAARPMVPQAARDRARGMADEWKEAAERKGGVEGAKPPDAHAFLQHVATFAVAEKEDKELYKRIVLSFSWRRQMPRLALTLGLEDDMEEIIEELITKGQQLDAVNFAYEAGLLEKFSPVPLLKSYLEDSKKIYCISDNVSTSSGQSGVNANKKEQSVLRAVIKCVEDHKLEGEFPLEDLRKRLERLEMAKTEKKKAALSCSSGGPASKRIQGSAGGTMSP

SEQ ID NO: 167933 - protein, 66 aa, Triticum aestivum
  Clone ID: PAT_TA_62351.pep
VSYLDRVHSGLNSLPDSKPIILVWRGNKVKDFSELHKSNSRSYGKRPLKRLSPSVYAQVSPCLSFS

SEQ ID NO: 167934 - protein, 152 aa, Triticum aestivum
  unsure (1)..(152): unsure at all Xaa locations
  Clone ID: PAT_TA_62352.pep
LPXXRLPPLYDGEGYQYSWPCARSRPPPSGSRRAPLXPLLRRARRTLICRPLRPGARGAAAVPSLRLPASLPRLQASPRAHVVAVVALIPDPPWCWYLFLFRPCRGLREADFGGVSILAXRMCCHPPSSVDGRRAQRTSRVSPPPSFGGESL

SEQ ID NO: 167935 - protein, 258 aa, Triticum aestivum
  unsure (1)..(258): unsure at all Xaa locations
  Clone ID: PAT_TA_62353.pep
MFGFGHHHKDQAPXXSXPNQIFKIYWRXSEDYCLAXRDXEVVLAPVNPKDETQHWXKDMRFSTTVKDEEGMPXFALVNKGTGLAVKXSIAQSHSFXXXPXNPXXEDXXGVGXEXKEGXKGFRCIRMVNNTPPPLXDPLNGDKDHGGVHDGTHXRALGRXGRGETQCWEDPGRGAEGHRPPWRPGPPGAKNHRPGGGGAPPWDRGHLSARGREGVRPFTARREPGLPPPPPGEELTRTGNGKWGGKEKGGRGRVLGFGK

SEQ ID NO: 167936 - protein, 113 aa, Triticum aestivum
  Clone ID: PAT_TA_62354.pep
DRTDARFSYVFSLLGINSTKVSNIFTVPARQTRVYNSSCQGLIRIPNSSTGFEARESRGRETCLVVTRPKQSQQAQEQIDDVKVERDGSPDILVILVTLDDAARVIDNVATED

SEQ ID NO: 167937 - protein, 94 aa, Triticum aestivum
  Clone ID: PAT_TA_62355.pep
FSHTLSQTHKQARKKGSPQDDRKELLLLPPSSSTPPVRTPGPSSPPTPPPTTPRTPTPPFSQTAGITHSTPSPTSAGTPSYEANTRTTSSATAS

SEQ ID NO: 167938 - protein, 81 aa, Triticum aestivum
  Clone ID: PAT_TA_62356.pep
MGNPEKMMDEIFNLQLTPNSLQGHARTREKEEKEQKLKGKKALATPPVDGARIYVENAFRLRTDPMNSLRLPSRLHAAVSR

SEQ ID NO: 167939 - protein, 89 aa, Triticum aestivum
  Clone ID: PAT_TA_62357.pep
QCPTASLSLCMNYHCSAVRMKETCSTPPWTPPIRTTRTTSDATEGKGIFTTLLRWWRSFSPRWCSDALQGPGHRRRLAGDLRRLQDLLL

SEQ ID NO: 167940 - protein, 121 aa, Triticum aestivum
  Clone ID: PAT_TA_62358.pep
MARLNSKAVVSAVVLAAVVLMMAGREATALSCGQVDSKLAPCVSYVTGKAPSISKECCSGVQGLNGLARSSPDRKIACRCLKSLATSIKSINMDKVSGVPGKCGVSVPFPISMSTNCNNVN

SEQ ID NO: 167941 - protein, 132 aa, Triticum aestivum
  Clone ID: PAT_TA_62359.pep
PALGSSSLVGAQAPMLTNLSIGQRRRQVTDGVRVAGVEADEYPVEGVAWAAQGAASGALDLAEPRRGDVLAPGVALPIALAVDVGQRPLLGWLLVGWIWQREEEEHAQGSNGGRFLLRLHLLSLTIVRRREA

SEQ ID NO: 167942 - protein, 86 aa, Triticum aestivum
  Clone ID: PAT_TA_62360.pep
ISSRSVVPATLSQKTGGCSGHANWSLVLADFRRGEARCGVLVGRARVFEADQSQSEGIVMAAHGTCSRVSGRTLRVESSLRCLLRW

SEQ ID NO: 167943 - protein, 233 aa, Triticum aestivum
  Clone ID: PAT_TA_62361.pep
MATTAMALSPSSFAGKAVKDLPSSALFGEARVTMRKTAAKAKPVSSGSPWYGSDRVLYLGPLSGDPLSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKEIQNGRLAMFSMFGFFVQAI

SEQ ID NO: 167944 - protein, 52 aa, Triticum aestivum
  Clone ID: PAT_TA_62362.pep
DPRSVITRECLARTCSCYWWRSLHSTATSTPAMAGGTRLQPSPPYAISALAA

SEQ ID NO: 167945 - protein, 114 aa, Triticum aestivum
  unsure (1)..(114): unsure at all Xaa locations
  Clone ID: PAT_TA_62363.pep
XXFFFFFFRAVSSRPGRVLHLFSRSYELLPLLPTGPKQTDPKAPYRISFFLEAEIRFISVQLGCRRRAVAPRACGAAGPSSVRARVCPARGRVAARLRSLGEPGTAVATDVTIA

SEQ ID NO: 167946 - protein, 249 aa, Triticum aestivum
  unsure (1)..(249): unsure at all Xaa locations
  Clone ID: PAT_TA_62364.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYXGPTLLEXLDQINEPXEXSDXPLRLPLQDVYKIGGIGT

SEQ ID NO: 167947 - protein, 214 aa, Triticum aestivum
  Clone ID: PAT_TA_62365.pep
IFSKCHNHPARIHEISARVHRKQSNFQIQQCIYSENNDRRREKFRAYGLGELQFEAVDVAGEGEQQRSRPCEGIVVAFTGDQPTTRSKESPGVRRPAGDATAAIIGVGDEQLQRASELKQSDAGVGVGEDQQRSLRLEKSSAVVGVGEEQRGRRSERRGLAVGVGEEQRGRRSERRGLAVDQPGRQPPETLDPFSSLDPLFSSSDLMFLSSIWW

SEQ ID NO: 167948 - protein, 233 aa, Triticum aestivum
  unsure (1)..(233): unsure at all Xaa locations
  Clone ID: PAT_TA_62366.pep
RLRSTPCLLPFSPLSLAKKSRRRRISTRRARWRCVNNHNTRDYSKRVQAEPQKRRQGNTDYRDQESSSXPDNNGRTRPSTGVLHDVTNTDVTAEIVHPTIAADIEMACXYSXELPRXGLSDGLTNYARXYCTXVSLLSRRAVPCPEIYPEYEGKAEATAEDFSAEPTDETTTIRALLYASLIRTTTVNRACVALKGDVNVVHDIPQSRYRLAGFKKDEKQLHSDIPAEHLWMA

SEQ ID NO: 167949 - protein, 67 aa, Triticum aestivum
  unsure (1)..(67): unsure at all Xaa locations
  Clone ID: PAT_TA_62367.pep
MRRPAASVSVASKVQSVPKKAKEMIHFSRDQLIGLAFVAFGIILFVGFFYAAVVXKMLPPYENWLLI

SEQ ID NO: 167950 - protein, 145 aa, Triticum aestivum
  Clone ID: PAT_TA_62368.pep
GRRLRRTPLKKGRQHPSTTEPPQPGACRVPTRCGSLGASARQHRTEMDGLNRGCVAAFLTSDSCLCRGSTNHLASAISCRPPPLGQWSHRFPSRSVATPTTTQLPGDESVRPPEIQAHTTARCGSAWTSRRRYLPQCGLGAERSS

SEQ ID NO: 167951 - protein, 155 aa, Triticum aestivum
  unsure (1)..(155): unsure at all Xaa locations
  Clone ID: PAT_TA_62369.pep
TPSTPASSLLTVAASSQSSPSSPRHHPPRKGGCLAAAATADAAPAASAVTAAETARCSPTLRPPPAPPPWSCPPPPTKGAPTSSRRAAGRPADATAPPASAARAAAAPASXVTEPAPRMPTVEAXHEDDEDNWTSNHXPPPPPSLAAECARPRAR

SEQ ID NO: 167952 - protein, 58 aa, Triticum aestivum
  Clone ID: PAT_TA_62370.pep
QASRSSPGRRGSSSRGAGSGPWTTWTAALGEIVSIVGRGKSKELTLSGKSRPAGSSGR

SEQ ID NO: 167953 - protein, 126 aa, Triticum aestivum
  Clone ID: PAT_TA_62371.pep
ILADSLSDDDFRKVLPRFQPENLEKNALIFESVNAMATRKGCTPSQLALAWVHHQGSDVCPIPGTTKMENFNQNVGALSVKLTPEEMAELESYAATGDVHGDRYPEMMNTWKDSETPPLSSWKVES

SEQ ID NO: 167954 - protein, 202 aa, Triticum aestivum
  unsure (1)..(202): unsure at all Xaa locations
  Clone ID: PAT_TA_62372.pep
MAQPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDASTLESLRQKRMEPVSYEQALTCAKEIKAYKYLECSALTQRXLKSVFDEAIRAVLNPRPTPSKQKKNNAPSCRYP

SEQ ID NO: 167955 - protein, 145 aa, Triticum aestivum
  unsure (1)..(145): unsure at all Xaa locations
  Clone ID: PAT_TA_62373.pep
MGIDLDRHHVKGTHRTAPKSDNVYLKLLVKLYRFLARRTDASFNKVVLRRLFTSKINRPPVSLSRIVANINKEAEKRTVVVVGTITDDNRLLERPKVTVAALRFTATARARILAAGGEAITLNQLALPRXTGSNTLXLRGPKNPP

SEQ ID NO: 167956 - protein, 231 aa, Triticum aestivum
  Clone ID: PAT_TA_62374.pep
MNGEDPPERPQEISSIINGLERYNPEAVGALETYLQDQCEQKFTDCNANRTLLKLYQLNPDRIKDEVITNVLVKTMTQFPSAQFSLALHLINPSSVVTGDLGEAITKLRSLNGQLEGAQYSRFWADLDDDMVADLIADIPDFEEVVRHRIALLVSQAFREIQIGHLESWLGLNEDATKKFVTEVCGWTVDAEGNVKVPSNPDNEAKKAEIREDVNVEQFSRVLRRSWEDTV

SEQ ID NO: 167957 - protein, 219 aa, Triticum aestivum
  Clone ID: PAT_TA_62375.pep
MTAFVLVFTPDISPSQMSSRTPLRRFNNLNLGSLLRKQNILPRTANFSRPSQRLISISRPLKMSNDDDYMAFLNKANQDTGAGASTQAKAVFKAKDQDAEVPKAIVDVCKKAVYTSDADEPFEEVSLKWQGKNGLPTETEFAKLIDHSSPESAEIQILDPLSWDSHGKYTDVIEAVREASHGNDVRVYQVTRDSTRIEYWVISHADGKLIGAKALSVES

SEQ ID NO: 167958 - protein, 147 aa, Triticum aestivum
  unsure (1)..(147): unsure at all Xaa locations
  Clone ID: PAT_TA_62376.pep
LSTPSIHHPPTPPEFLALSSLARLDSRDVAAVVVMWEAVLMMAGRQASPVLSRAQVDSMLAAGVEGETGRATSIMRECXSGVQGKNGLXRRRPNSKRLCFFFTSPPHQIEGINMGKVSGEAEKEDQPACASPSESPPNETMSTTLNT

SEQ ID NO: 167959 - protein, 122 aa, Triticum aestivum
  unsure (1)..(122): unsure at all Xaa locations
  Clone ID: PAT_TA_62377.pep
MALTFTKLXFSRLFATKEMRVLMATLNAAGKTTILYXVKLKELCTTIPTSRSNAQTVEYQXIIFTDPPAASQDEITPLRRXYFQNTQRLMDVEYSPDXXRVGDAQDELHRMLNEDDLRDAEL

SEQ ID NO: 167960 - protein, 172 aa, Triticum aestivum
  unsure (1)..(172): unsure at all Xaa locations
  Clone ID: PAT_TA_62378.pep
APSLPPRRAPPPVPLHAAAPPSPSPLLTTKMVKNTCXYFKRAHSDRYIGLXKRWCWTKGIASRGTRKFKGCTLMPNIGYCSDNNTRHYLPSKTNKRADYNGSEMDLLMMHNMTYCAEIAHNVSTKKRKDIIDPAAQLDIVLTNKLARLRRQDDEHTARRYRLDWLRCRKLLR

SEQ ID NO: 167961 - protein, 216 aa, Triticum aestivum
  unsure (1)..(216): unsure at all Xaa locations
  Clone ID: PAT_TA_62379.pep
VSSHGSDSPPFPPSGVATIPSAGLYCSTPEQGRTSRTARSAASSPGPPKNQVVRTASPGSRSPPVAYGACSGTGGDSKGVGTGAFAYLEAVLQDLDAVMVQLLDNPDIDVNKARILPSHLLLAVFNDQEVGRFLAHVTIAHGGVLPYINPXMLPKRRVQKESGSTRIRGKSPENAAQRRLRLQPARRISLRVELLCSDSDQLFRCKCCVELVRKFL

SEQ ID NO: 167962 - protein, 151 aa, Triticum aestivum
  Clone ID: PAT_TA_62380.pep
MQIFVKTLTGKTITLEVESSDTIDNVKAKIQDKEGIPPDQQRLIFAGKQLENGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRG

SEQ ID NO: 167963 - protein, 175 aa, Triticum aestivum
  unsure (1)..(175): unsure at all Xaa locations
  Clone ID: PAT_TA_62381.pep
GLEVRKRKAWRDVEYRCFMGGLAWATDDQSLQNAFSKYGDVIDSKIITDRETGRSRGFGFFTFASDEAMLQAIEAMNGQDLHGRNIIFNEAQSRRSGGGGGGFCGGGSSGSYGSQRRERGGAGGYSGGAGGYXGGRSGGGGGYGSRDGGGDYGSRGGGGGYGGSRGGSGGGNWRE

SEQ ID NO: 167964 - protein, 173 aa, Triticum aestivum
  Clone ID: PAT_TA_62382.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGYGGQRGGSGGYGGGGGGYGGQGGGGYGQGGGGGYGQGGGGYGGQRGGGGYGGGGGGYGGGGGGYGGQRGGGDSGGQWRN

SEQ ID NO: 167965 - protein, 232 aa, Triticum aestivum
  unsure (1)..(232): unsure at all Xaa locations
  Clone ID: PAT_TA_62383.pep
MSVEQDVKVVESCMVTPSEETPRKGLWISPIDLTXATRGHTPTVHLYLPGSGPVDGFFDVARLKAALAKALVAFYPLAGRLGMDSNGRAEIDCTGEGALFVVALSDLTVEDFSKLKPSRELNRLFIPRVEDYSPPLMCGLQVNFLKGGGVAIGMTLHHTSADAMSAFHFLQTWAAFSRDAAAAAALELPCHERTLLRPRSPPVVHPDALTVFCPRVGKSEPPGAVENVIFVL

SEQ ID NO: 167966 - protein, 93 aa, Triticum aestivum
  Clone ID: PAT_TA_62384.pep
ANRCRSQPSPSGGVGVLRHGHAPAVLDGVNEDRRHGRRRLPRLPVPPAAAAEEGGDEGRRLLHGPNGRSWRRSAREGGSAADGQQIESAPLCS

SEQ ID NO: 167967 - protein, 174 aa, Triticum aestivum
  Clone ID: PAT_TA_62385.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTI

SEQ ID NO: 167968 - protein, 75 aa, Triticum aestivum; identical to SEQ ID NO: 106874
  Clone ID: PAT_TA_62386.pep

SEQ ID NO: 167969 - protein, 203 aa, Triticum aestivum
  unsure (1)..(203): unsure at all Xaa locations
  Clone ID: PAT_TA_62387.pep
PTRAGRAGFCGNLISXAFSALVGAGVLSNMQGVLGHAAWRWLFWIEGAITMGVAVSAAFILPDLPHNSRGFTEEERQVAQLRMVEDVGEADEDSREESAFYGLKLAAKDVKIYIMMLTFTAYVVGLSFNAFFPSLTQTLGFGYVPTLLMSAPPWVFSCIASVINAWHSDKXQQQFWHIARPICARTNPLPPSHMATHACPHAK

SEQ ID NO: 167970 - protein, 175 aa, Triticum aestivum
  Clone ID: PAT_TA_62388.pep
MQIFVKTLTGKTITLEVESSDTIDNVKAKIQDKEGIPPDQQRLIFAGKQLEDGRTLADYNIQKESTLHLELRLRGGAKKRYKKTYTKPKKQKHKHKKVKLAVLQFYKVDDATGKVTRLRKECPNADCGAGTFMANHFDRHYCGKCGLTYAYNQKAYRLLAIALLFLLYLWRAQLT

SEQ ID NO: 167971 - protein, 126 aa, Triticum aestivum
  Clone ID: PAT_TA_62389.pep
FMAQSVPDQDPVMVAMTAACAPALSGENIGLRKYIYVPNILLISCVMLFARKSFVAVESVDSIKNQDYSDATSFAEINSRMLLIDDFSTPKQKQSFSQELRYIELIKCIRVHGGKKLPCRSWNASG

SEQ ID NO: 167972 - protein, 140 aa, Triticum aestivum
  unsure (1)..(140): unsure at all Xaa locations
  Clone ID: PAT_TA_62390.pep
MRSSSTWSRRASPPTPCGGRRSRCPGRRSDELSLAIQDLATRKIIMRPNSHGDLYXFSTNSGVQALLTVVGSDVWHRRLGHPSDKTISTLARFFLPIMXKDMSQNTLCTACQLXQWPRLPFSTXKTFTTAPLPPHKKKIK

SEQ ID NO: 167973 - protein, 84 aa, Triticum aestivum
  Clone ID: PAT_TA_62391.pep
TTRFDNKPKNGGHVPAGHGGARQDRKHPGGRGNTRGMQHHGIIIYKNHPSDCTKGRMTNTHQLTNGVNTPTTNIKRVWTVSASC

SEQ ID NO: 167974 - protein, 203 aa, Triticum aestivum
  unsure (1)..(203): unsure at all Xaa locations
  Clone ID: PAT_TA_62392.pep
MIPIKIGMNXFGRILRIEARXTLRIPDVELVADNNPFIATRLHASTLCKYDTDHXIRRNHHEINVKDSPTLLFLDKDVAESDCRNPXEIPWCAXIDAEYTAESTGVXTDKDKDACLIKXGAKKAIISALTKDANKVAGGDNAKEYKLDIHIVSNDICTTNWLDPLDNAIMEWVDIVEGXMSTVHGMTATHMTDDGPYLQDWIA

SEQ ID NO: 167975 - protein, 257 aa, Triticum aestivum
  Clone ID: PAT_TA_62393.pep
MSQGKTFTLNTGAKIPLLGYGTWQASPGEVGQGVYEALKVGYRHLDLAKVYGNQPEIGEALKKSFAEIPGLKREDVFITSKLWNSQHDPKVVAAALDDCLQELGLEYLDLYLVHFPVSFKGSQKHVGQDLFPLTGGNEPDGDVEIDDSISIVDTWKAMTELPKSKARAVGVSNHTKEHLEALIKGTGVTPAANQIERHPLLIQPELIAYCKEKNIHVTAYSAFGNNMVDAPLLFTYPEVKGVAERLTKEKGHRGHTH

SEQ ID NO: 167976 - protein, 150 aa, Triticum aestivum
  Clone ID: PAT_TA_62394.pep
MAGRKGGDRKKAVTRSVKVALQFPVGRIGGYLKKGRYSQRVGSGAPVYLDAAIEYLAAEVLELGGDAGKDNKKTRIIPRHLLLAVRNDQQLGRMLAAVTITDGGAIPSIYSVLLPKKSPAAADNAVKSPKKIKAAKSPKKKVVAKEHSPL

SEQ ID NO: 167977 - protein, 113 aa, Triticum aestivum
  unsure (1)..(113): unsure at all Xaa locations
  Clone ID: PAT_TA_62395.pep
XKETYSQHISTKASIRLLILMDRHTNHTRAPAMLLPLLFLVCFALHAQCRIIEGMENDKINLPTGLCIYSKGCSGNCCYLCLVLEDCFVSMEECKKACQKDTPAIFNHTSPSI

SEQ ID NO: 167978 - protein, 170 aa, Triticum aestivum
  Clone ID: PAT_TA_62396.pep
MSCCGGNCGCGAGCKCGNGCGGCKMFPDVEATAGAAAMVMPTASHKGSSGGFKNAAGKTGGLHCTNLKGGTRVGVGPGGTWKLNPGHRKAGPAKKGTPPGLCREKKRNFFFPPPPPPPRGLNPPKPPPKLVSPPARKKKKKKKPPRGGSLYNFVVTNKRGPPLPGGAPPF

SEQ ID NO: 167979 - protein, 149 aa, Triticum aestivum
  Clone ID: PAT_TA_62397.pep
PGTGPGRACTRRCCLASGGATGSGAAFLRTGQLRRRAGRVGVVPARWRPPAAAPRSPRSRTRRRPVKALHDGAVATDLDAWRQRRRPRGSWRRQATPGPFLEPPIAPEWISRGSLIRLRAPPVSRAVVRGLPLAQTAATSQTRGGEPVQ

SEQ ID NO: 167980 - protein, 90 aa, Triticum aestivum
  unsure (1)..(90): unsure at all Xaa locations
  Clone ID: PAT_TA_62398.pep
RYCVAEAELDGGAQAVTLQPDAVRRGTAARTSTGPRPPPSSWXHRRAXAPXRTSSPWRRRRRRRRPLRLVGXRCGEIWXRWGIEKAGVEV

SEQ ID NO: 167981 - protein, 151 aa, Triticum aestivum
  Clone ID: PAT_TA_62399.pep
MAPKADKKPAAENKVEKAAEKAPAGKKPKAEKRLPAGKTAAKEGEAKTRGRKKGSKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 167982 - protein, 159 aa, Triticum aestivum
  unsure (1)..(159): unsure at all Xaa locations
  Clone ID: PAT_TA_62400.pep
MTDLAEQPVHELQVDNEKSVLPNEDTIALDKTEDPVQGNDADASADAEPEPKPKTEAEPEGESKQDDAPGQLDSVVAENTTDEEETQQNVPIDFVTLSMFIIDDIDFIPPTEPVKDILGGAGTYSALGARLLSPPTKSTSVGWIXDQGSDFSSSLSHSS

SEQ ID NO: 167983 - protein, 199 aa, Triticum aestivum
  unsure (1)..(199): unsure at all Xaa locations
  Clone ID: PAT_TA_62401.pep
RFQVRSRSLRRLLLMRWXSVIRRMDSTARPPAPVVHDVGYEEEEQAFLRTLNCLADTENNPLPRPMRRRHGEPRDPSDNXSPFPGDILRSSSANDYGTESSTHTAIQEPLMPVELILSYYTSSTLSKIEGQRADHQPEPPLQTDYVYHIFRKMKQTXVIPNGADMLDGLCKNGLVPXGMNLFGLMREKGAIPQVVIYAA

SEQ ID NO: 167984 - protein, 162 aa, Triticum aestivum
  Clone ID: PAT_TA_62402.pep
SNSAAPDSLLFLFFSPSTNPIRCPTPADVAGCPVRSDCVLICHCGAETLHIICALTNEDWLPQLRPCWVKNVAMSAVHKERTALTNNDMPDAMLIHPIPWTRTDGTFVYFVDYACRHREPISRDQRSLPSLRSDRQLVPSLCVSASQLMIIPSTGSDNMMKA

SEQ ID NO: 167985 - protein, 264 aa, Triticum aestivum
  unsure (1)..(264): unsure at all Xaa locations
  Clone ID: PAT_TA_62403.pep
MTNGYLFREYIGAQFTGVQFSDVPVNTGVSFHFILAFAIDYLASQQSKPTPTNGVFKPFWDTGNLTPAAMAAAKAAHPNLSIMVSLGGDTVQNTGVNATYAPTSVDSWVANAVSSLSAMINQYGLDGVDVDYEHFGTDVDAFVEGIGRLLTQLKARFPNIRTSVAPYDLPVNQKYYQALWRKYSGVIDYVNFQFYGYGANTIVQYYVQFYDEQARNYPGSGGTKLLASFKTGXGKLPGIFIFSADSSKMSPYSFKYETQAQQIV

SEQ ID NO: 167986 - protein, 171 aa, Triticum aestivum
  Clone ID: PAT_TA_62404.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVAEGMDVVKNIEKVGSRSGTCSKQVVIADCGQL

SEQ ID NO: 167987 - protein, 143 aa, Triticum aestivum
  unsure (1)..(143): unsure at all Xaa locations
  Clone ID: PAT_TA_62405.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVAANPSXTNALILK

SEQ ID NO: 167988 - protein, 35 aa, Triticum aestivum
  Clone ID: PAT_TA_62406.pep
HSKKRASPYPVAHTGRRARRIPWRAASRLLSPDLP

SEQ ID NO: 167989 - protein, 156 aa, Triticum aestivum
  unsure (1)..(156): unsure at all Xaa locations
  Clone ID: PAT_TA_62407.pep
MAGLGFEETELRLGLPGGGNEAEEAAAAVRSSGKRGYAETIDLVLKLEPASAAAPPSGDDEESSVVTTAQPDADPEKPRAPKAQAVGWPPVRSFRRNMLAAALVKVTMDGAPYLXQVHMATYHSYQDLHNMFSSFTIGTLXTQGMSAMTESNLVDL

SEQ ID NO: 167990 - protein, 112 aa, Triticum aestivum
  Clone ID: PAT_TA_62408.pep
LSPPRVLPRALTYTPASPPGNWKEVQTAETLEITWHTKPKHSGDNISISPMSGGSQNSQVPINTIATRGEKDACFHTPARPTTCPGNNNVILSPPSISHNHPRGFSSTPFPL

SEQ ID NO: 167991 - protein, 148 aa, Triticum aestivum
  unsure (1)..(148): unsure at all Xaa locations
  Clone ID: PAT_TA_62409.pep
DPQNTSLLTPLVAASSQSSPSSPRHHPPRKGGCLAAAATADAEPAASAATDAGDARCSPTLRPPPAPPPWPCPPPPTRGAPADSRLSAEIPAAATAPPASAERPAAAPAVSATEPAPRRXGRLGEHEDEEDNWTSNHXPPPPPSLVAA

SEQ ID NO: 167992 - protein, 263 aa, Triticum aestivum
  Clone ID: PAT_TA_62410.pep
TQTAKWHWSCHSRFLSKPDEVGVVAVGFSGGQPKAGVDIGPAALIQSGLLTEIRDELGYKLFGDETVQQFEDLIPESDPDFRGMKKPRHASAVTRKIASHTYEHSREGRMTLTLGGDHSIAIGTIAGTAKATRERLNREIAVIWVDAHADINTPESSDSGNIHGMPVAFLTGLAKEEKEECFGWLEDDMRLNVKKLVYIGLRSVDIGEKKILREHGIKAFSMHDVDRHGIGRVVEMALAHIGNDTPIHLSFDVDALDPMWAPS

SEQ ID NO: 167993 - protein, 171 aa, Triticum aestivum
  unsure (1)..(171): unsure at all Xaa locations
  Clone ID: PAT_TA_62411.pep
MANPRVFFDMTVGGAPAGSIVMELYKDAEPRTVENFRALCTGEKGVGKSGKPLHYKGSSFHRVIPDFMCQGGDFTKGNGTGVVFIYGEKFADEKFVHKHTKPGILSMANAGPNTNGSQFFICTVPCNWLDGKHVVFGEAVEGMHVVKNIQKVGSRSGTCSKXVVLRDCGQL

SEQ ID NO: 167994 - protein, 94 aa, Triticum aestivum
  unsure (1)..(94): unsure at all Xaa locations
  Clone ID: PAT_TA_62412.pep
RPALQLPQSAASGRYLEKGRYGTAXVASAAPGYLAAVHQNVTAKALXIAALARKDEKKTPIIPRQLLFVVQHHQXFRELLTGVTITTGDVMTNL

SEQ ID NO: 167995 - protein, 155 aa, Triticum aestivum
  unsure (1)..(155): unsure at all Xaa locations
  Clone ID: PAT_TA_62413.pep
NHTPASSLLTVILSVLSFLPSPAPTAKERCLAAAATAGAAPAASAETAAAGARCSPTWRPPPARPPWSCPPPPTRGAPAASRWPAVRPAAATAPPASAAPRATAPAAAATDSLHRRPAGRGEHHDEXRRSKQSSSPPPPPSVSVPLAAACASRAR

SEQ ID NO: 167996 - protein, 78 aa, Triticum aestivum; identical to SEQ ID NO: 106977
  Clone ID: PAT_TA_62414.pep

SEQ ID NO: 167997 - protein, 108 aa, Triticum aestivum
  Clone ID: PAT_TA_62415.pep
TPRTWNAKTTLSHSTSPWDPFLGSGLVARASPLTEPINSCVASKILRYHHMTEILNGIVPGSPRTSISDTRGWEWIRFGYKILFLIWGSYQVVKTDERVIPAGRGYHG

SEQ ID NO: 167998 - protein, 171 aa, Triticum aestivum
  Clone ID: PAT_TA_62416.pep
MRECISIHIDQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGATGSGLGSLLLERLSVDYGKNSTLGFTV

SEQ ID NO: 167999 - protein, 229 aa, Triticum aestivum
  Clone ID: PAT_TA_62417.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAMIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 168000 - protein, 187 aa, Triticum aestivum
  Clone ID: PAT_TA_62418.pep
MQPPPDLEIIPVAVDDASLLTSASSTVIIEMASSVIATATSMTTSTTASATFVSSAPPTPYSENGSGGECSLLGSFALVVQGALGALALLSLVYKRWRERPQRPLKIWFFDVSKQVFGSVLVHIANIFMSMLTSGRFSVQVDPSAAAVTARSDDDYAPNPCSFYLLNLAIDTTLGIPILIILLKVLT

SEQ ID NO: 168001 - protein, 214 aa, Triticum aestivum
  Clone ID: PAT_TA_62419.pep
LYLRDFSKPVLPLSSQSSLLSTCSNTSLKMKLRTGQLLTLTFLLHGTCSGFVMRDTEEVSIYYPDATFQYELEDFEVANGTDSSLQERTNVRICEYVSVQHLANCVTIVAGLQAIGIALGNAAKSLSNSNSCATVSGTAGNGKVKYRYYATGRHCDTTAEASTIAGAIEHHLKNVSGGKLCRTECLDLTHGGTWNGYLLVGPASKFESDMYCGP

SEQ ID NO: 168002 - protein, 104 aa, Triticum aestivum
  Clone ID: PAT_TA_62420.pep
YNCYTENATADGLIFVFSKPRYLHPVFKRKKPVLSSPPSAYRLTPSLLQNVLDQGRAKPDGTRPEQIFSYLRKQYPRRIISCLPKLVFLLCFNHQKRQQLSLVL

SEQ ID NO: 168003 - protein, 77 aa, Triticum aestivum
  Clone ID: PAT_TA_62421.pep
IHPPAAAAVLPCHPDRRLHHVLLNQVYTPPVLARRRTISSPAPPHYSLPAPCHQPLPVLPHHLLPCNNTPTSLPVPV

SEQ ID NO: 168004 - protein, 232 aa, Triticum aestivum
  unsure (1)..(232): unsure at all Xaa locations
  Clone ID: PAT_TA_62422.pep
MRECISIHIGQAGIQVGNACWELYCLEHGIQPDGQMPGDKTVGGGDDAFNTFFSETGAGKHVPRAVFVDLEPLLFDPXPRTGAYRQLFHPEQLISGKEDAANNFARGHYTIGKEIVDLCLDRIRKLSDNCTGLQGFLVFNAVGGGTGSGLGSLLLERLSVDYGKKSKLAFTVYPSPQVXSTSVVEPYNSVLSTPLLLEHTDVSILLDNEAIYDICRRSLEMERPXYTNLNRL

SEQ ID NO: 168005 - protein, 154 aa, Triticum aestivum
  unsure (1)..(154): unsure at all Xaa locations
  Clone ID: PAT_TA_62423.pep
LQQRASSLLTFPASSQSSPSSPRHHPPRKGGCLAAAATADAAPAASAATAAAGARCSPTLRPPPAPPPWSCPPPPTRGAPAGSRRPAGRPAAATAPPASAARPAAAPAAAVFEPAPRRPAGXGEHEDEEDNWTSNHXPPPPPSLAAACARPRAR

SEQ ID NO: 168006 - protein, 174 aa, Triticum aestivum
  unsure (1)..(174): unsure at all Xaa locations
  Clone ID: PAT_TA_62424.pep
MPESDNDSGGPSNTGGEGELSSPREQDRFLPIANVSRIMKKALPANAKISKDAKETVQECVSEFISFITGEASDKCQREKRKTXINGDDLLWAMTTLGFEDYVDPLKHYLHKFREIEGERAAATSTSTTPHLPDNNATGYADYGGADVPAPGPGRHEDDGPPHLPLHASAAPSN

SEQ ID NO: 168007 - protein, 194 aa, Triticum aestivum
  unsure (1)..(194): unsure at all Xaa locations
  Clone ID: PAT_TA_62425.pep
MLKLRLATYKINRKNRILKSYIHLQWLHYLRSAATEAEWQRNQYVPTVEEYMIEAVNSFAEGPIMLTSLYFVQQNSXEYIIKDPEYDELLRIKGNCGRLLNDTRGFKRESSEGKLNIISLLVLQSGGSMSIEGAQETVQESIASCRRDLLRMVVREDRVVPRACKEVFWRFCRTVHLFYCHTDGFSSPKECSAR

SEQ ID NO: 168008 - protein, 211 aa, Triticum aestivum
  unsure (1)..(211): unsure at all Xaa locations
  Clone ID: PAT_TA_62426.pep
VLAFKMQRSGSFERRSSVNQRPSPSPSPIPMPSSRTRTPSPSRGRPQSFRGSNKPSSSSRPISRSRSRGRSSSRSSSPSPSRRKKRSDDHDYFGXFKTTAGLLAGIGVATVIAHKVWPKGVLHGDHEDWEHPPPKHSRKQHRHRSPGNSERVYERTTRRHGDVVHHEEISRRRPQNYERMPQEHVRVRHHVERLPHTPDDYYAQEQAFLSY

SEQ ID NO: 168009 - protein, 265 aa, Triticum aestivum
  unsure (1)..(265): unsure at all Xaa locations
  Clone ID: PAT_TA_62427.pep
MRLKAGPAYVKPTLLMDPKWSNVTAGQNILINKQXDDVVFSTRYGNRATVINYDIEFQGGLIQIVDSLLVPPSGMLQVLMASKVESFLGGLFKAGLMPDLADRKDITVFAPRDQAMESVGNALNSLSPKEIRQVGNEKFINSAKIITTDILISNGILHIISNVNNPKDADAVPNPTLWAQKPVFKSAGVDDVFHSAIPCTSDCPVTNTPAPTPVDQAENNAATTPWFNTRSSTGVAAARATGQIARAALGIVGVGAGMVFYRMGD

SEQ ID NO: 168010 - protein, 77 aa, Triticum aestivum
  Clone ID: PAT_TA_62428.pep
FTKYAKVKPNALNEDELDAMRTANRKEGDFKGWAASKAEWGMLYSLAKDKDGFLQKDTVRTVYDGSLFAKLAKKAGN

SEQ ID NO: 168011 - protein, 127 aa, Triticum aestivum
  Clone ID: PAT_TA_62429.pep
LICFRYLSPQRESRLFVHLLALAIDGGGGPDLAQTSGTTSTAGATCLLQVDRLHHPGVPGVVLHIVEWDPAVATATVSTSPGAAGAPPHSPDGSVTGLNTHGTRVKTQPDGRTPKLFFVVSVGRLNR

SEQ ID NO: 168012 - protein, 75 aa, Triticum aestivum; identical to SEQ ID NO: 106874
  Clone ID: PAT_TA_62430.pep

SEQ ID NO: 168013 - protein, 157 aa, Triticum aestivum
  Clone ID: PAT_TA_62431.pep
LTKKTPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 168014 - protein, 75 aa, Triticum aestivum; identical to SEQ ID NO: 117166
  Clone ID: PAT_TA_62432.pep

SEQ ID NO: 168015 - protein, 228 aa, Triticum aestivum
  Clone ID: PAT_TA_62433.pep
MAAATSSFATLAIARPAAAGSAAQRALLASKAPSSALSLRGGRVASPALSASRQSRARFVASASAEPYAPELQSKVTNKVYFDISIGNPVGKNVGRIVIGLYGDDVPQTVKNFRALCTGEKGFGYKGSSFHRVIKDFMIQGGDFDKGNGTGGKSIYGRTFKDENFQLVHTGPGVLSMANAGPNTNGSQFFICTVKTPWLDGGHVVFGQVLEGMDIVKMIESSETDRGD

SEQ ID NO: 168016 - protein, 86 aa, Triticum aestivum
  unsure (1)..(86): unsure at all Xaa locations
  Clone ID: PAT_TA_62434.pep
MAATAVTLPNSAPSPFPVAAPSARRCLQLRRSPAPRRADRVAASAARTEVPTKPTPVTPSGIILXDPAVDHKEHLLGTGYDTKVIP

SEQ ID NO: 168017 - protein, 205 aa, Triticum aestivum
  unsure (1)..(205): unsure at all Xaa locations
  Clone ID: PAT_TA_62435.pep
MAAATMALSSPAMAGTPVRASRAAPFGEGRITMRKTAGKPKVAASSSPWYGSDRVLYLGPLSGDPPSYLTGEFPGDYGWDTAGLSFXPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDLLSLAEGPRG

SEQ ID NO: 168018 - protein, 83 aa, Triticum aestivum
  Clone ID: PAT_TA_62436.pep
GGAPRRLYARGPGRTCCTRCPAGQDLSRIAGGRFEAATTAPSTPLTPSSARSSTPSPSDSRTSSPPPAPPRGTSPCPTSTTPC

SEQ ID NO: 168019 - protein, 205 aa, Triticum aestivum
  unsure (1)..(205): unsure at all Xaa locations
  Clone ID: PAT_TA_62437.pep
MASATGVPERFPSIEDRETEPLLGRPGDAAQEDGVPMIKNLVLGTGIVAQLGIVLLTILVWASVLSKPLILFSAHPLLQSLAVLTLAQSVLSLQPTHTAEQKRVGQRVHAILNLVAFLILVAGVTIIEYNKFANNGAHFHSVHGYLGVITSIVLLLQYGVGFTMWATPSLYGGVDNAKAVWKYHAGADXVFVLLLATVTSAVETD

SEQ ID NO: 168020 - protein, 93 aa, Triticum aestivum
  Clone ID: PAT_TA_62438.pep
NTTRDRDDDLASYVASIISTFQPLLGSSSQVRTTTTRIDSHSSIGRLLPRALRLLTRLIRECELCPPTTINRHSTHIDRTRLGSIGTVQDKRT

SEQ ID NO: 168021 - protein, 216 aa, Triticum aestivum
  Clone ID: PAT_TA_62439.pep
MAASQEYMDKALLRRSYRNVWQTDLTCAIQADFPYCCLSLWCGPCVSYMLRRRALYNDMSRYVCCAGYMPCSGRCGESKCPELCLATEAFLCFGSSVASTRFLLQDEFNIQTTQCDNCIISFMFCLQQLACICSLVACIVGNQELSEASQAISCVSDAVYWTVCSCMQTQHKVEMDKRDGKLGGAAMTVPPTQQMSRIDQPMPPQVGYAPQPASYR

SEQ ID NO: 168022 - protein, 126 aa, Triticum aestivum
  Clone ID: PAT_TA_62440.pep
SYAARKNGVLFPILYMHTSIVLPGEEKRTEKVRRKGGLPAGEMSLVFFFLRLIVIRKDGRGHHGAGRGARGGHHASGRGRCAAGCAHRGAPRARGHTPMGFDPVTPRSRGFGKRGEGDRDEEEREG

SEQ ID NO: 168023 - protein, 72 aa, Triticum aestivum
  unsure (1)..(72): unsure at all Xaa locations
  Clone ID: PAT_TA_62441.pep
LLPLIPCLXVRRTGDEIVTNVVRSGEYAGQRSYQRIRHAFRHCRPFEFHRASLRRMSAAHIVRAHQYTYGYT

SEQ ID NO: 168024 - protein, 66 aa, Triticum aestivum
  Clone ID: PAT_TA_62442.pep
MRLSLSLLVISWCRRGALRPGDGGAGDDGVRRGGADVVHLVVVLTLLAAGLLLLESVPCSGLAWLP

SEQ ID NO: 168025 - protein, 216 aa, Triticum aestivum
  Clone ID: PAT_TA_62443.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKN

SEQ ID NO: 168026 - protein, 217 aa, Triticum aestivum
  Clone ID: PAT_TA_62444.pep
SQSNSVIISLFFSRRSKKLCCPDLFDIMPSEQQEESIVEFLGKAFLTTCIFELRFRGGFSALLPLDLAPDLTVHGIPPLRLRRRRHGFCFCSGGFVLGGGLHPPHDHRREHPVGHEVEEQHDGTDRDERGDVAGVGGRAGHQLGREDLAQLRRQRTEPPRTPRKHCSWTLRGCCRCATAGATPSRRGGGGQAPGAYRQGSRLHGDGTSRYLRVEELF

SEQ ID NO: 168027 - protein, 132 aa, Triticum aestivum
  Clone ID: PAT_TA_62445.pep
GVAGGRGRTRSGRASWCWAPRPSPTSPTASDSSPTSTAPRRPWTTKSTAPTTPQPQPPPPPGRTSPVTRRATAASRRPGTRPPCSATDSPRRQGASAAAWLVVAFRRTLCKRIIKALELNCFGTGIKKTNKK

SEQ ID NO: 168028 - protein, 139 aa, Triticum aestivum
  Clone ID: PAT_TA_62446.pep
GRAGTTRTSTLSPYRRRAACSFPPRRRSFSLAAHHGVQWSKEFGPWRRRRTTATRGGAGPPCGTASTASASRAPPDRAPWRRATGAAPPSMPAQRSTGPRTYAGTPTAAAARSGPFVRDAKWLDDLLIELEFHLSGRLI

SEQ ID NO: 168029 - protein, 85 aa, Triticum aestivum
  Clone ID: PAT_TA_62447.pep
MIAKTLTRKTITLEVESSDTIDNVTAKIQDKEGIPPDQERLIFAGKQLEDERTLADYNIQKAATLHLVPRMRGDMFIFLNTLTGK

SEQ ID NO: 168030 - protein, 185 aa, Triticum aestivum
  unsure (1)..(185): unsure at all Xaa locations
  Clone ID: PAT_TA_62448.pep
PKKKKKKKKKEKKKKKKKKKKKKSPLWDLQKPPHFPQGPSPGPLKTAALGSEKGNNPLGELKIQKLGLKISRGKAGGKPPPGAKGSEKLSGKNPRXRKGCFLGRTFGIPRKEKIGGPLPRRGPKGGGISQGGPQGKGXQPPKGHFPQNGNFRFGIRGPLDSGIKNHPPIGIHGQGFQRWMAPPGG

SEQ ID NO: 168031 - protein, 237 aa, Triticum aestivum
  unsure (1)..(237): unsure at all Xaa locations
  Clone ID: PAT_TA_62449.pep
FPRSGLFGFAELSLSPYFPSVEYWHGIRDALTAQGATVLTPAVPPSSSIADRAAALRSALEAHAPAPEAVTIVAHSMGGLDARYMLSHLEPLPVRVAALVTVATPHRGSAFADYLLDEEVSPVHHYLPQLYKTLERAGLGTAAFSQLTRRYMAEEFNPSTPDQPDVRYFSYGAAVERPALLSPFRXPHAVMTQAEGPNDGLVSVESSSWGTYKGTLLGVSHLDLINWSNRVGWTVRE

SEQ ID NO: 168032 - protein, 147 aa, Triticum aestivum
  Clone ID: PAT_TA_62450.pep
FLHPPARRHLPAFYLSGSIPPPPGLPLVPMPTNPHRIPSIQPCTDPSNHHSKLLPRVPRSHVCPAPRRGAPPAPDPTRRRSSASSSRPRAARRQKPAGRHTSPLSTPSSRSLSYPTPLPLCFLIGGAPPPLEGLARPCTPPPAGDLT

SEQ ID NO: 168033 - protein, 89 aa, Triticum aestivum
  Clone ID: PAT_TA_62451.pep
QMQQQQRQLGVVSRLSVQLHTPVLRFLFHPSADSLVDDDDGDEEDDDEVVVVWVHVSASAGRSPACRRCSYPAVSSCIKASSIALEFWT

SEQ ID NO: 168034 - protein, 250 aa, Triticum aestivum
  Clone ID: PAT_TA_62452.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGQGPLEKLCRHLADPV

SEQ ID NO: 168035 - protein, 220 aa, Triticum aestivum
  Clone ID: PAT_TA_62453.pep
FPTLAAIVASLATISATYSIIKQALALGCFPRVSVVHTSKKFLGQIYIPDINWVLMILCIAVTAGFKNQIQIGNAYGTAVVIVMLVTTFLMVPIMLLVWKSHWILVVTFLVLSLMVEFPYFIACINKVDEGGWVPLAVAITFFIIMYVWHFCTVKRYEFEMHSKVSMAWILGLGPSLGLVRVPGIGFVYTELASGVPHIFSHFITNLPAIHFVVDFECEK

SEQ ID NO: 168036 - protein, 129 aa, Triticum aestivum
  Clone ID: PAT_TA_62454.pep
MGTAFSSSSSTPESRAMALAKAKEIVASASVVVFSKSYCPFCVQVKKLLTQLGASFKAVEMDTESDGTEIQSALAEWTGQRTVPNVFINGKHIGGCDDTIALNKGGKMVALLTEDEAISGSSSKTNETD

SEQ ID NO: 168037 - protein, 137 aa, Triticum aestivum
  Clone ID: PAT_TA_62455.pep
TFGFIGFFIKLFRPSEANFLFDGASLILYLIGFGVYVANIVKALRSVSAEIWTNDGFDGKTHEGESGELILGREDSLKVLSASNTILALVLVGILVLQAGEWYAEKKEADDVRAMEAKEAAEKKEGSPSKASNKKKQ

SEQ ID NO: 168038 - protein, 171 aa, Triticum aestivum
  Clone ID: PAT_TA_62456.pep
MTSLSSSAAAARATFLPSSCRARPAGGRRSQLLVTRAAASSPKLPGGRKLRAADVGGGPAGGAAAEALAKGGVETFLIERTMDNCKPCGGAIPLCMVSEFDLPLDLVDRRVTKMKMISTSNVAVDIGRTLAPHEYIGMVRREVLDDFLRNRAQNAGAEDLHGLYLRHEAPK

SEQ ID NO: 168039 - protein, 248 aa, Triticum aestivum
  unsure (1)..(248): unsure at all Xaa locations
  Clone ID: PAT_TA_62457.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVDSSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQXRLIFAGKQLEDGRTLADYNIQKEATLHLVLRLRGGQQLPWGWTCWFILGRPNPAV

SEQ ID NO: 168040 - protein, 181 aa, Triticum aestivum
  unsure (1)..(181): unsure at all Xaa locations
  Clone ID: PAT_TA_62458.pep
MMAETEAASAAAAAEAGPAEEGTTNKTVVLVGVDDSDHSYRALEWAVRYVAETAGAGAPVELVVVHAKPAVSSVVTLGGPAAAGXVVRYVDADLRRRAEEVVDRARRLCAANSVQGVVEVIDGEPRFVLCNAVEKHHADLLVVGSHGYGAIKRAFLGSVSDYCAHHAHCSVMIVKQPKPKE

SEQ ID NO: 168041 - protein, 142 aa, Triticum aestivum
  Clone ID: PAT_TA_62459.pep
MDASATGAGAKAKKGAAGRKAGGPRKKSVTRSVKAGLQFPVGRIGRYLKKGRYAKRVGTGAPVYLAAVLEYLAAELLELAGNAAKDNKKSRIVPRNLLLAVRNDQELGRLLAGVTIAHGGVLPNINPVPLPKRTAEKEPQEG

SEQ ID NO: 168042 - protein, 37 aa, Triticum aestivum
  Clone ID: PAT_TA_62460.pep
LLTIHRASGVSAEIKAILVWIYYRLLECRVLQYNHVN

SEQ ID NO: 168043 - protein, 59 aa, Triticum aestivum
  Clone ID: PAT_TA_62461.pep
FLRSRPLLLPSPNQTKQEQPWAPNWRGSAPYPDGQARVASTHNAPRCSQVLHSTPFAPP

SEQ ID NO: 168044 - protein, 114 aa, Triticum aestivum
  Clone ID: PAT_TA_62462.pep
MPKAAGDAKLLVQSLTKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 168045 - protein, 140 aa, Triticum aestivum
  unsure (1)..(140): unsure at all Xaa locations
  Clone ID: PAT_TA_62463.pep
LHLPDWLVXWGHPGNMAVVLFAMGGYGTYLGFRIKLSDDPEEKAKAKDLHPKLLGGMFFFFALGATGGVTALLTSGKPIFESPHAVTGVIGLALLTVQSLLPTLFEGNPGLRGAHGLLGSSIMTLFLFHAAFGLQLGLSF

SEQ ID NO: 168046 - protein, 75 aa, Triticum aestivum; identical to SEQ ID NO: 106874
  Clone ID: PAT_TA_62464.pep

SEQ ID NO: 168047 - protein, 213 aa, Triticum aestivum
  unsure (1)..(213): unsure at all Xaa locations
  Clone ID: PAT_TA_62465.pep
MGKVVVAEATARQVASFVLGAAAALTVVMLVQYRAPAAGLSRARTPGHFSGLRLSSDEQHHRRNGTAAARAVVHHRAPPVAGSAARDDDRRRPANATTVTKPNCTSTSHLPSTHRHEEKGGKEESAEFRGLAAAVARAAMDDRTVIITCVNQAWAAPGSLLDLFLESFRIGDGTARLLXHVLVVXMDPGAHARCLAVHRXCYHYIIPXLNIDF

SEQ ID NO: 168048 - protein, 109 aa, Triticum aestivum
  unsure (1)..(109): unsure at all Xaa locations
  Clone ID: PAT_TA_62466.pep
MSAQDYYGGGGGGGYPQQPQPSYGPPQGQYGPPQGQYGPPQGQYGPPQGQYYGPPQGQVPMQYQQAPPQQSGGKGGGGGCLAGCLAALCCCCVAEQGCEXCMECCSESL

SEQ ID NO: 168049 - protein, 125 aa, Triticum aestivum
  Clone ID: PAT_TA_62467.pep
VGDPRGFREASRPRWRPTSERVVGAGPACPHQRAPGDGAVNSRQLSRFLPPLLSLSLSKRKKRCLNWVACAGLRDGVASLLVAPAAGSTTVLSGSPQANASWPPVSRCTASTRGASVRSARPLWS

SEQ ID NO: 168050 - protein, 187 aa, Triticum aestivum
  Clone ID: PAT_TA_62468.pep
RTNMASRRALFSSALRASAAVLPARPIFTIAACTARPSLAPRAFAPFARSLRSYSSEKKDPEKEIKKWEFDELKKLVEDGSHDNIVIVDVREPYELFETGKIPGAINIPITTAVQSFHIPEEDFEEMYGFERPPKDKELLFYCKAGVRAKSAAHLAQHAGWTKVSDYPGSWLDWAAQNGPVEGVKRP

SEQ ID NO: 168051 - protein, 99 aa, Triticum aestivum
  Clone ID: PAT_TA_62469.pep
SAGTGTTMAETYCAYPAASAAAAAYPTRRRLQTLTAPGDLPAARKPSRQPPSFLSFRRHKAEMTTLPVAGADPQVENGKDYPPMNDLFPLHKKDIQHGT

SEQ ID NO: 168052 - protein, 141 aa, Triticum aestivum
  Clone ID: PAT_TA_62470.pep
VTPPCPPPPPPTSSPKRSTLLLRPWPRSAARRGRHHHRHRRRLPPLRRRTRAQTSPRTKRPSPCLVPLPPRTRPRSRRRARSPRPLTRRRRRSHPPRPRTLPPRSSLRRRDRARTPTVPTTRRMGVPNLTKMRRRRSHLRS

SEQ ID NO: 168053 - protein, 168 aa, Triticum aestivum
  Clone ID: PAT_TA_62471.pep
EQSACRIRQILVCLFFQKKREQRGLRRAAAARLCSASRRVRAPHHRNAWARSREPVSSHGRAEARHTQVEESVEDGAGGSERHGCLLAYSPARSHIPLIFPSPLTRGWEGREEVVVGSAAAARSAGDGERSAAAAAARSAVEVGGADGVGGRGTRTNAASVGFGFGKP

SEQ ID NO: 168054 - protein, 141 aa, Triticum aestivum
  Clone ID: PAT_TA_62472.pep
MQYNNLGRSGLRVSQLSYGAWVTFGNQLDVKEAKSLLQACRDAGVNFFDNAEVYANGRAEEIMGQAIRDLGWRRADVVISTKLFWGGQGPNDKGLSRKHIVEGLKASLKRLDMEYVDVVYCHRPDATTSIEETVRAMNLGD

SEQ ID NO: 168055 - protein, 69 aa, Triticum aestivum
  Clone ID: PAT_TA_62473.pep
TGQASCGKCLQVTNTATGAQITARIVDQCSNGGLDLDHDTVFSKIDTNGLGMQQGHLTVNYQFVDCGDN

SEQ ID NO: 168056 - protein, 205 aa, Triticum aestivum
  unsure (1)..(205): unsure at all Xaa locations
  Clone ID: PAT_TA_62474.pep
MQIFVKTLTGKTITLEVESSDTIDNVKAKIQDKEGIPPDQQRLIFAGKQLEDGRTLADYNIQKGSTLHLVLRLRGGMQIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCXHSNQLRPKKKIKN

SEQ ID NO: 168057 - protein, 75 aa, Triticum aestivum; identical to SEQ ID NO: 117166
  Clone ID: PAT_TA_62475.pep

SEQ ID NO: 168058 - protein, 164 aa, Triticum aestivum
  Clone ID: PAT_TA_62476.pep
ATTSQLGEVFGDKAVRQAIGVGDIEFVSCSTSIYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYAAM

SEQ ID NO: 168059 - protein, 278 aa, Triticum aestivum
  Clone ID: PAT_TA_62477.pep
MATEDERYRQSSQFRLWSFSKANLQELRAKTNSLAREQIAPRLATNPPPDFLTPDEEIRLVKFFTVELIRAAQFCELPTEVRATAAIFLRRFYVTNSVMTYPATDLLKTSLFFGCKAEGFFYKLNAFSEKFPNTTGEQILAGEFLLCQGIRFAFDVRHPFRALEGAILEFRRRLPDEETRINKAHAQAREILKFSPLVTDAYFHYAPSQIMMAALSMVDHGLLEILIPSPGQGGNASQDAVFAKCGTDPRSCRQSQDARGGTTERMTDYWGAPENRQR

SEQ ID NO: 168060 - protein, 150 aa, Triticum aestivum
  Clone ID: PAT_TA_62478.pep
VSSDRQRPNLQISRRLRNEQPALAAPLPSRVPTEAVGTMSMFPGMDLTKMDAPTLTLLGAACCVMLSMHFTVQLVSQHLFYWKNAKEQKAILIIVLMPPLYAITSFVGLLDIKGSKAFFTCLESVKECYEALVIAKFLALMYSYLNISIR

SEQ ID NO: 168061 - protein, 151 aa, Triticum aestivum
  unsure (1)..(151): unsure at all Xaa locations
  Clone ID: PAT_TA_62479.pep
MKEATASGGGAAAGPNDPRQPGTARPYAPPKLSSQDLPVDYAGFLAVVFGVVGVMLHYKVCSWIAIIFCAQSLANMKNFENDLKQLSMAFMXCCHGFGDELFWASSRRGKALANPHTMGCMDFSCYISESLSRARIKCTTTSSVRDRDIVL

SEQ ID NO: 168062 - protein, 240 aa, Triticum aestivum
  Clone ID: PAT_TA_62480.pep
MAVAVKVGSWGPLSGEAQDIAGERRPQRLESITIYISEAPRLRVCGFSFVYVDQNGEHVVVGPWGMPNDNPQIIPFVMNPGEYVNSMSGTFDDEGITSLKFTTNQDRDYGPNGSEMGIAFSVPLPANCTENTDTADGAVVAFFGRSDDTGLKALGIYVPVMQGSRVMIGPWGGCGKIVDIDGTPVELRSVSVYSTKYLGGRIYGFSFTYIDQTGNLVDVQTWGNAYGPPDVLLLQEGEYV

SEQ ID NO: 168063 - protein, 56 aa, Triticum aestivum
  Clone ID: PAT_TA_62481.pep
FSGDRRNEGKMQIFVKTLTGKTITLEVESSDTIDNVKAKIQDKEGIPPDQQRLHPL

SEQ ID NO: 168064 - protein, 171 aa, Triticum aestivum
  Clone ID: PAT_TA_62482.pep
MAARRTILLAVAAMAVLSTASAAIYNVGEPGGAWDLSTNYGTWASSRNFQTSDQIVFKYSPQAHDVLEVSKADYDSCSTANPITTFNSGNDVVTLTATGTRYFVCGFPGHCAGGMKVKIDVMPGSSSTSPAPGSGPSASNAPPPTPVSSATNVEATGFGLAVLLAIAGLMA

SEQ ID NO: 168065 - protein, 166 aa, Triticum aestivum
  unsure (1)..(166): unsure at all Xaa locations
  Clone ID: PAT_TA_62483.pep
SXKGXXXXXCTQSYLLPIMLTSLVVLVLASVSIASPTLEKRAITCLRVGQTATASWTNSAGKRCTFTGVVGSNYGANPSGSGDYSCNGRCGAGCSGTAVGNVYTQDCFSHDICSYFNSAGGGASDPNCGAAFNAAVDDTALGFANGCSQTNPSNGVTKPNGAPVCV

SEQ ID NO: 168066 - protein, 60 aa, Triticum aestivum
  Clone ID: PAT_TA_62484.pep
MALGGLFFFFFFFFFFFFFFFFFFFFFFFFFFFFFFFFFFFFFFFFFFYGILTKTLPKLI

SEQ ID NO: 168067 - protein, 188 aa, Triticum aestivum
  unsure (1)..(188): unsure at all Xaa locations
  Clone ID: PAT_TA_62485.pep
MEGGGEGKGRAAPAAAAAGGGFGGYESAGDRKWWPWLVPTVIVACVAVFVVEMWVNDCPRHGSALGGGCVAGFLRRFSFQPLRENPLLGPSSTTLGKMGAHDWNKVVHQHQGWRLISCIWLHAGLIHLVVNMLSLLFIGIXRLEQQFGFVRIGAIYLLSGFGGSVMSALFLPNNYISVGASXGALFGL

SEQ ID NO: 168068 - protein, 140 aa, Triticum aestivum
  Clone ID: PAT_TA_62486.pep
MGGKGVLGLDYGDGQAPLGPDISGPELAPAVANAGAIGLLRLPDWSAPDHVRELIRRTRSLTEKPFGAAIVLAFPHEENLRVVLEEKLAVLQVYWGEFPKERVDEAHRAGVKVLDQVRTLAEGHFTGMDKPGCGLRLLNG

SEQ ID NO: 168069 - protein, 61 aa, Triticum aestivum
  Clone ID: PAT_TA_62487.pep
MHLMYTLDAQGNRLYTLKKVAQGQVTKSAHPARFSPDDKWSRQRVTLKRRFELLLTQQKEE

SEQ ID NO: 168070 - protein, 65 aa, Triticum aestivum
  unsure (1)..(65): unsure at all Xaa locations
  Clone ID: PAT_TA_62488.pep
AYARVSFQPSTPPLQNPDSLLARHTDITHAQGLRQISTVSSFPRQEEGRIMVGPXEXXXKXPPPP

SEQ ID NO: 168071 - protein, 31 aa, Triticum aestivum
  Clone ID: PAT_TA_62489.pep
ENLFSQRQSLIYCRYSCNWILCFFEEFTCPK

SEQ ID NO: 168072 - protein, 130 aa, Triticum aestivum
  Clone ID: PAT_TA_62490.pep
MLQAGSERAAPLPGAARLWVPGMSPVVPDAGAGASARAREIARRREEMLGMLRDLPEAEYELSLTDLVDKTAAAGANNGCAAPLPTERKEASPSPSPSPLGLAERPASGGQAEQQQAARTTERKGSPSPR

SEQ ID NO: 168073 - protein, 208 aa, Triticum aestivum
  Clone ID: PAT_TA_62491.pep
MRSSRDLRFAGLLLLFSASVLLPVARAQQETEEEEEFSYSLDAENGPAHWGDIKEEWSACGKGNMQSPIDLASPRVSLGRGLGYLNHSYHPANATIVNRGHDIMLKFEGDAGSVSIGGTPYFLRQLHWHSPTEHSVNGRRYDMELHMFHESAQGKAAVIGVFYEIGAHDAFLHKLEPYLEMIADRKDREEKMGMMDPRGARGKASGYY

SEQ ID NO: 168074 - protein, 86 aa, Triticum aestivum
  Clone ID: PAT_TA_62492.pep
NPDRVCIPILFPQHSSCVISRRAPTTAGSRTDTSSTAREPAAKETMARQHLSLTTKSVPRMGLSHGEERASLSLLTTSTYDLQGDR

SEQ ID NO: 168075 - protein, 220 aa, Triticum aestivum
  Clone ID: PAT_TA_62493.pep
SMAITYSSIYNTYIHPQQTIQITARLRTPHVGQKLLRNHNGIPCSQQKGKCYSPPTPPIVPANPTTKSSTLIPRPNRTASGSRTRTGPAAAILDSFFSSEIIRSIPPSPGTGRTGSTTGRDAAAAAAAFLGPGLALLPLAAGRLAVAGEAREEAREYARLHLPAPRQRPPRVALPLHCGPPLLQAPSCSESQEEGSRGALKEIGVGLSVFESRPGRLEAG

SEQ ID NO: 168076 - protein, 83 aa, Triticum aestivum
  Clone ID: PAT_TA_62494.pep
IQDTPVCVRRLPTMSSQGRRGSGASARPPPPPATHSRPASSSSSTPPCSSFLLFPIEFEVERGHMSSSVNLLFIQSYKKMKIL

SEQ ID NO: 168077 - protein, 56 aa, Triticum aestivum
  unsure (1)..(56): unsure at all Xaa locations
  Clone ID: PAT_TA_62495.pep
IRHRTKPPMGFQRSSQRLFSXAFLALHLHAPAAMATXGRQAPXXQPLPATNIGRPS

SEQ ID NO: 168078 - protein, 132 aa, Triticum aestivum
  Clone ID: PAT_TA_62496.pep
LCTNALNTSLCGGVGGFVGWWLVLLGGAGEAGRDGGVVHGVVEALHPRHPSPQLPRFLLRQADERLLLHFDHRRRRRGLHIVRPSRPPDQWRPPLASLGRPSADPPTSSRRDGGGARPERGGRAGGEGNHGC

SEQ ID NO: 168079 - protein, 94 aa, Triticum aestivum
  Clone ID: PAT_TA_62497.pep
SRQRRRSKVSCSSSGRCSPPSSRTPTTDERPPKTQCKTLGSNAKDESIRCYSINPDFPTGDFSRHLHHMGIADSSPTYSHSSSSCNVLWIMSGF

SEQ ID NO: 168080 - protein, 138 aa, Triticum aestivum
  Clone ID: PAT_TA_62498.pep
CSVFYLMFLETKQHALLGTVTASFAETYVSASTTFFGRANRMVFSIVHLRRFYRVYAVTEQCECSKLTPQYSFAGCLDDLALALLSLLQGLHVAVKSMSMVSSELGVGTLKRRVTGSLGLLDSVPVRLARLVVLGAVL

SEQ ID NO: 168081 - protein, 245 aa, Triticum aestivum
  unsure (1)..(245): unsure at all Xaa locations
  Clone ID: PAT_TA_62499.pep
FRRILYQRGSANGKRVQANLGAKNHALLSLDANKEHALDSIAGAAFGAAGQRCMALSVLITLGDAKQWVDDLVKKAKNHVAGSGFDSKSDFGPLITPQARDRCEALITSAEKEGAKILLDGRGWKPEGFPDGNWVGPTVIAGVTPEMECYREEIFGPVLLCMEADTLQSGINIINSNAWGNGTVIFTNNGAKASLFQQEIDAGQVGINVPIPVPLPMFSFTGNKRSVXGTGLTNFYGQDGLRFYP

SEQ ID NO: 168082 - protein, 159 aa, Triticum aestivum
  Clone ID: PAT_TA_62500.pep
MEGPRAVAMVAVIVLVACCGAQLAVAGGDQGQPAAGGPEASLLCISECGTCPTVCTSPPPAPPSPSSSSSTPSPPSPSSSSSTPSPPSPSTSILPLPTPPSPYLTLLLPPPPSSSSTELPPSTPSPTPPKSTGGSSSSSSSSTPSSHLSSPTIPVDVLV

SEQ ID NO: 168083 - protein, 109 aa, Triticum aestivum
  Clone ID: PAT_TA_62501.pep
LTTYDSDHWHQSCLGSTRTTKKVLQKRRLQEENNLPDPTIEGQIVGLHLEDQIRRNSEQFLHQGYDAENAAIARYNQRVIPRVFTPELETTKRSHPMLSPSLATIQALV

SEQ ID NO: 168084 - protein, 150 aa, Triticum aestivum
  unsure (1)..(150): unsure at all Xaa locations
  Clone ID: PAT_TA_62502.pep
MEPEASKEAEKQPMDAEAGDPADPRDLVSSDDEIDYSVEPEFYDPAVDDVDECWAHKQRKGRTSDAVLSCPACFTTLCLDSQRSRLIRFYGRGKEKGRIGKXTAVDSTTPEVENKGPVYHPVCCEICSTEVGVFDEDEVYHFFNVIPSNS

SEQ ID NO: 168085 - protein, 190 aa, Triticum aestivum
  Clone ID: PAT_TA_62503.pep
MRIPYVPNPPETKTEEHAAIVKRIEERRAPRPLQSLDLALLHSPHVADGWNSFLGAVRTKTSLSDDLRELAISRVAVCNKAWYEWKHHAPLAVKGGVSEAGLEAIKQDTLGERPAELSEKQWAVILFTDEMTRNVQVEDETFDRLREFFNEQEIVEITATVACYNCVSRFLVALDVGERNGTDPEAVTGH

SEQ ID NO: 168086 - protein, 83 aa, Triticum aestivum
  Clone ID: PAT_TA_62504.pep
IPDHCRYQCTDWGVGVEIDGSVRRDAIADLIAEVMEGGKGKVMKKKAQEWREKAVKATEPGGSSRRNFDELIRDVLAPCFHGS

SEQ ID NO: 168087 - protein, 170 aa, Triticum aestivum
  Clone ID: PAT_TA_62505.pep
MGAGMKRSRDEEVLSLALALTTDSSTSSTTSADSAGSPAKKARRRTRGAVVATSGEGEFVCKTCGRAFASFQALGGHRTSHLRGRHELELGVGVAKAIRERRRRENKHDECNICGMGLETGQALGGHMRRHREEMALRGDHDGVALLPDHGENGHQVTTKRPPVVLKMFD

SEQ ID NO: 168088 - protein, 184 aa, Triticum aestivum
  Clone ID: PAT_TA_62506.pep
LIDLDQNPQLYAMYLDAEHEDSYYRDQGVFGDGISIEDTMNVLVKYRNGASLSYSLTAYAPWEGFRVSFNGTGGRLEVEIVENSYVNSGGDQAAEGSIESRKILLRPLFEKPREIQVEEGVGAHGGGDTVLLNDLFGTPVSDEYMRAASHIDGAASILTGIAANRSIVTGQAINVDDILMVPDS

SEQ ID NO: 168089 - protein, 118 aa, Triticum aestivum
  Clone ID: PAT_TA_62507.pep
PNKTQTQFINYLCGAKRVNGWMAILGEHKIPPPTVECFDSPTMGNTTDQYMSYGAVLWPVIFDQRAVPTPGLLGFHLSDSVHQGRENGRPGLTLTRTGKPHCSLCHRTVPPDHIPIIT

SEQ ID NO: 168090 - protein, 145 aa, Triticum aestivum
  Clone ID: PAT_TA_62508.pep
MVVPSVFAAFDEDGDGKVSVSELRRCMEATLGEDVSEEEAAAVLAAADADGDGLLNQEEFSRLTALGAQEEDDVDVKRRCLREAFGMYASSSTEDTITPASLRRTLSRLGSHELGVEECRAMICRFDLDGDGKLSFDEFGIMMMA

SEQ ID NO: 168091 - protein, 155 aa, Triticum aestivum
  Clone ID: PAT_TA_62509.pep
MNSHSIMAVPSLFAAFDKDGDGKVSTSELRRCMEATLGEYVSEEEAVAALAVVDTDGDGLLNQEEFSRLAAGAHEEDDADVKRRCLREAFGIYASSSVEDTATTTMITPASLRRTLSRLGSHELGVEECRAMICRFDLDGDGKLSFDEFQVMMMG

SEQ ID NO: 168092 - protein, 115 aa, Triticum aestivum
  Clone ID: PAT_TA_62510.pep
ESPQETLHSSKQMVAVFSDKDPQVMDTIECFMHGYVTWHLCDARYRLHEIYEKVKDQDTEDAKKFCKFFEQAANVGAVAPSEWAYPQVAQLANVRAKDDVKEAQKPILSSIELVE

SEQ ID NO: 168093 - protein, 99 aa, Triticum aestivum
  Clone ID: PAT_TA_62511.pep
APEITKILSPTPPRTPRFDFPGNNLSYHDYGTDDLSRPRAASIGSISLPLGTSSRQLLFTSRLPLWLFLFFPLFSLTLHHLDSFHLVLLTWLPTIYWNH

SEQ ID NO: 168094 - protein, 76 aa, Triticum aestivum
  Clone ID: PAT_TA_62512.pep
TNFGNGFSPSFHIEGIAKSSSSSSLYFMPWFDTGGDGGLDEIDFLLRNEKFENLELNIELSLLFYVHMRFFNLRVV

SEQ ID NO: 168095 - protein, 57 aa, Triticum aestivum
  Clone ID: PAT_TA_62513.pep
SVGWVFELNYFLFFFFFFFFFFFFFFFFFFRTLKPWIKEKQFCQIQGEMVVHRLIEL

SEQ ID NO: 168096 - protein, 201 aa, Triticum aestivum
  unsure (1)..(201): unsure at all Xaa locations
  Clone ID: PAT_TA_62514.pep
MKFSSIIAAAFAGSPALAVPAGFVTTDGTKFSLDGKDFFFAGSNAYYLPFNIWGTDHYKDVKLGLEAAKDAGLKVIRTWAFHDNNRTFSSGGLPQYNTGVEDTVFQWFEADGTVKIDLSKLDVVVEAAEATNMKLILALTNNWADYGGMDVYTVNLGGRYHDDFYRLPAIKKAFKNYXKAVVDRYKDSPAVMAWEIANEPR

SEQ ID NO: 168097 - protein, 74 aa, Triticum aestivum
  Clone ID: PAT_TA_62515.pep
GRSSRRAGISTVPILLLSHSSTINKIMAVAQDSQLVNQGYGACKSCGCNVFGNSNGGTDKNVACVCTHKYGNHL

SEQ ID NO: 168098 - protein, 65 aa, Triticum aestivum; identical to SEQ ID NO: 127349
  Clone ID: PAT_TA_62516.pep

SEQ ID NO: 168099 - protein, 153 aa, Triticum aestivum
  Clone ID: PAT_TA_62517.pep
RIPTPRYGSHYFLCTRTTSLLPVLLPHGKYRDDMLARQVVLRRAALSPYRPSTQRILACQLRPLDRRISFLPWRKKKPDPQSYPVYFANPNFFFYGHPTPAEAAAEKKLLPRLKWSIRPGRFRRWASTTIILYICWQIFCTAVDDPLFEWPDA

SEQ ID NO: 168100 - protein, 137 aa, Triticum aestivum
  Clone ID: PAT_TA_62518.pep
MVATKSGELRALFASLDQNGDGRVSAAELRGCMRATLGEDVPAEEAEALVASADANGDGLLCEAEFLELVLQAAWAGHAGEEDDELRIRALREAFGMYEMEGQGCITPASLGRMLGRLGAEQGAVECRRMICRLDLD

SEQ ID NO: 168101 - protein, 204 aa, Triticum aestivum
  Clone ID: PAT_TA_62519.pep
MHEIFLTALIEDKDFAGACSVLGGLTNMDPWESIQRVLYFQGPPRPMGIFNQSSIKKPISPPNTGFLWKELHQNLTRQSFILQTRYDVLKDRDMGTNAPAMDLDATQGVLKWTDFPDPPRGQPLLTQRKKVELWEQKMLPSLMRDNNHTFKTGTIEEMYRFYRDEIEFCLVRYYFPHPIENYVPHGDKTAAIHATGQATIIRLP

SEQ ID NO: 168102 - protein, 48 aa, Triticum aestivum
  Clone ID: PAT_TA_62520.pep
ERHHLSNRIRQNCSMAKLSYTRILGFNKGGKPASETKPPLKNQASIVN

SEQ ID NO: 168103 - protein, 233 aa, Triticum aestivum
  unsure (1)..(233): unsure at all Xaa locations
  Clone ID: PAT_TA_62521.pep
LSNVHIILAFVAFVATWAHCASSTLPGGLPQLPWIMAIMAIWFCDRLSRMFHLLSVNWSTKGWTEAVCEAMPGNVTRVTLHLPRYKDIEPGTHAYLRIWGVSAWESHPFSICWTNHVRDSSLPIAEKESSNTVDKSTMTTSVSFLIAAQTGFTKKLYDRASHYPSGLRAKAAMEGPYAGHHSLDSYGHAVLFAGSTGITHQVSYIRHLLRGHNQGTTATXRITLVXIIREYES

SEQ ID NO: 168104 - protein, 272 aa, Triticum aestivum
  Clone ID: PAT_TA_62522.pep
ACHKNNYIKSLPILFCETFRFFELEQSDSSDMASQSTTTVCEPSSSRLKPGSIRTSTLRANPKDSMKSTWRLADRKNWTTSHWFFEYLGIHPVSLDKKVPVHQKGDKVPYTPEWQLHRWVLVHSLVPIAIHHLIVKLTGHNLTPMQAFLFYSLAFKVAAVHQLHALRRVGHITGFLDGDVHARDGVPDVGVTKVMKSLIATSSFRPVFTVFLSYRTYQSPSSMNWLWLPLEIGLYGIVLDFWFYWYHRLMHEVGSLWKIHRTHHLTSTRTHS

SEQ ID NO: 168105 - protein, 140 aa, Triticum aestivum
  Clone ID: PAT_TA_62523.pep
YVKELRAYYEDLVEFTEGKDADLDLEELDKAIETFKKAADEVKALEERARESDDEDLKKVVNHKYRDFQRGFISQDGLPNRDFYKHVVNAPGLDTGYAAVTFPGITEGVLYADKGNFTLAQEWVGKTARGIVLAAKILKT

SEQ ID NO: 168106 - protein, 102 aa, Triticum aestivum
  unsure (1)..(102): unsure at all Xaa locations
  Clone ID: PAT_TA_62524.pep
KYLGTAVTVRNDAGETNVLNTKXNFGTITPENDIKRKVIQPTXGQIKCLSSDHLPTRATQRGTEFRCHTLIXHIQIPSCVLNANWNNQTLQHVMKDHIHRLL

SEQ ID NO: 168107 - protein, 85 aa, Triticum aestivum
  Clone ID: PAT_TA_62525.pep
ILLSSHLFSNAVRLCLKRQYSKYPAMAARSKTKFLGELLILSRFHKYNPVFTTFAGAWSALLAGAAELSDQDRTISTAFCLFTNG

SEQ ID NO: 168108 - protein, 223 aa, Triticum aestivum
  Clone ID: PAT_TA_62526.pep
EHPIRSIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKEPTLHLVLQLRGGMHIFVKTLTGKTITLEVESSDTIENVKAKIQDKEGNSP

SEQ ID NO: 168109 - protein, 94 aa, Triticum aestivum
  Clone ID: PAT_TA_62527.pep
LLLPSRHSFISSYPRTKQVNQDNIAQYASFHSRKQTGTRLILVAVRIAVNCLAERFRTPTCICYLGRYLNIELRFVVQSELGRTRRRLPTKIAK

SEQ ID NO: 168110 - protein, 210 aa, Triticum aestivum
  Clone ID: PAT_TA_62528.pep
MSGPGVGFEYPPVEVKWLQRDVLLFANTIGATVDELHFLYEFDPKFAVFPTYPVILPFKKDSQEVVDYYKASKAVQIPGIPKLDYTRVVDGQRKIEFLKALPTTSAGRKFEIRQKVIGVYDKGRPGTVLETETNLVDVESGEVYTRVISSGFFIGQGNWGGPKGPATKNYPPPEGKAPDATIEVQTTPGSALLYRLNGDYHPLHADPAPG

SEQ ID NO: 168111 - protein, 50 aa, Triticum aestivum
  Clone ID: PAT_TA_62529.pep
VTWIWLFTTPFNPVSPRLFYNGHPTYLFITSSGTSHSYKKGGFANRHNFL

SEQ ID NO: 168112 - protein, 77 aa, Triticum aestivum
  Clone ID: PAT_TA_62530.pep
MPAAAVPEPHRRTSTMSGALGHWDEPKTKSTINIVTTGDGSDDDDEEGWEAMKAKRDKKRSMWKSKKGLGSEFGTRI

SEQ ID NO: 168113 - protein, 151 aa, Triticum aestivum
  Clone ID: PAT_TA_62531.pep
RAHIFAQWNFIAKQLTTRFESASATLPIAQQSFTNTFALAALLALLAAWCALYLLRAADAPPLEAFGKTFSERETLGGLLAASAFVVFVTSVGSIVFSALAAGAALACAHGAFRVPEEQLFLDDDIQPGAGGRVGSSVDLLSFFTNAAGGG

SEQ ID NO: 168114 - protein, 30 aa, Triticum aestivum
  Clone ID: PAT_TA_62532.pep
GCFVVMVVGFIGIKLGLFIQSTKGFRSFQG

SEQ ID NO: 168115 - protein, 148 aa, Triticum aestivum
  Clone ID: PAT_TA_62533.pep
TIALTTLSIFISSIIRNQTFTFTHPFVYGGKTRSFICSNKREFIHTTGYHTPGWFSKVVVATCAAMIMVAQSLHRTAEGLQGRPPYGRPRCPHGLPPHIGRRLGSRASGPIPTSWQTEPLMITADTTNSAICRSTMKRPALAKDAIVM

SEQ ID NO: 168116 - protein, 67 aa, Triticum aestivum
  Clone ID: PAT_TA_62534.pep
GVLRRRRGDRWPEFRGVLTGSVLGHEFGGFAPPARAAAGRQDGVRGAGAPRRQGGRRMRPRREEEKV

SEQ ID NO: 168117 - protein, 66 aa, Triticum aestivum
  Clone ID: PAT_TA_62535.pep
IDTLPFISVHLSITPTTQNGTDLPPYRRFSLLLLSWAPPALQDGLTPPRRPPPEHPTRPPSRCCSY

SEQ ID NO: 168118 - protein, 187 aa, Triticum aestivum
  Clone ID: PAT_TA_62536.pep
HSNTRHTLSTLNPQSHLYPTTAVSSKLTPVLLLEQTGRINFNLFDDVVPKTAENFRALCTGEKGFGYEGSSFHRIIPDFMLQGGDFTRGNGTGGKSIYGEKFADENFTLKHDKPGLLSMANAGPNTNGSQFFVTTVVTSWLNGRHVVFGEVADEESLNVVKALEATGSGSGAIKYTQKPKIEKSGEL

SEQ ID NO: 168119 - protein, 153 aa, Triticum aestivum
  Clone ID: PAT_TA_62537.pep
MAPKADKKPAAENKVEKATEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 168120 - protein, 110 aa, Triticum aestivum
  Clone ID: PAT_TA_62538.pep
MGLAYNTYLSSSKIYGCKTCKAHLANHEDIISRNFRGQHGKAYLFHSVVNIETGPPNERNMTTGRHVVRDITCRQCKETVGWKYDKAYESSEKYKEGKFILEAELLCTVT

SEQ ID NO: 168121 - protein, 189 aa, Triticum aestivum
  Clone ID: PAT_TA_62539.pep
MKMDPPPKMLASLAITILMMTMAISVALASDAAVLEGQARAFLIWKDSLDNQSQQTLRSWGNTSEPCNWRGITCGTGVHRHQPVIDGIFLRGMRLRGVLESLNSSALKTLTRLDLSYNNLTGNIPPSIGVLGELQALLMQGNQIRGSIPPGLANLTKLCFLMLHDNEVSGEIPRQIGNMSSLVTLNLSS

SEQ ID NO: 168122 - protein, 98 aa, Triticum aestivum
  Clone ID: PAT_TA_62540.pep
RPPLSPSLPNKFTLVVSYGTGFTTRDDDTLQAACSPEDDDEKLEEEQEEEESASLDEDVCIVKDLSEAEEFRLEWLDYGRCMIPYCMLLQLSLTPTTT

SEQ ID NO: 168123 - protein, 105 aa, Triticum aestivum
  Clone ID: PAT_TA_62541.pep
IHTKATLHQDHYGFGHEAVGHHRPPPLRARGVRGDRGRQGEGAVRRGVLPGRPHHLRQLPRPGARRVRLRVRAGRRQGLRAPPRRRRDPHQLPHAQYVAELLVRV

SEQ ID NO: 168124 - protein, 225 aa, Triticum aestivum
  unsure (1)..(225): unsure at all Xaa locations
  Clone ID: PAT_TA_62542.pep
MSSQDNSPCRILVMASGFGSNFQAIIDAISSGSLPNSRIISLIVNRKSAHATVRADKAGIPWEYFNLISGGFLKKGESDEQKIVEGRQKYDAALAEKILSFXVKPELIVLAGWMHVFSTAFLDPIKKAGINIINLHPALPGEFDGASAIERAYDEFKAGRLTRSGIMAHYVIAEVDRGTPILVKEIEWKGESLEEYKDKVHSHEHELIVNATTKVAQETVQKRAS

SEQ ID NO: 168125 - protein, 82 aa, Triticum aestivum
  Clone ID: PAT_TA_62543.pep
NASLNTYICLSYLKPISSVKSYQSGSLWLNHDCCISNASYFRKKKTKDECSVSTHQRLRDWSIEHSRNRSVFMRTPPPMLSR

SEQ ID NO: 168126 - protein, 221 aa, Triticum aestivum
  Clone ID: PAT_TA_62544.pep
RLGSPARWLRPCSSSITYLAYDSNFTFEHLEESIIDTALWGADDPRWTPPSSVICLSGINVCDLCSEVQSNESAVNACKCFPNLFGVPRLPIAVQVFCTSNGRNNGLQALVAFERGTAIGEFVGLITKDIEEQDVMDSQVGGTRYQIWQGKQGNFTRFANHSCKPNAQFKKFVWLGTQHIVMVSKGIEAGTEITVDYTESYWRGLDKKCLCGEPCCRVHKG

SEQ ID NO: 168127 - protein, 125 aa, Triticum aestivum
  Clone ID: PAT_TA_62545.pep
MSLHYLPPVKPSAIALGTAFNHGVELAVLAPIFGQTYQRAKSSNTKEEFIRSKEASGAALAWVFSLTGSALQAYGVGALINATGTLTYKGAAYLGALIFFATSDPGYVSQIFVENRPLNTVGVSL

SEQ ID NO: 168128 - protein, 116 aa, Triticum aestivum
  Clone ID: PAT_TA_62546.pep
LLLFLANLVAARTERETRTQSLRDNRTGIMTAVIAKLVLPVIVMFMVFSAVLVAARPLAGENGAPEKSQPETPSSDSSGRCISSGCKGRQGQITRARPGAQIIKGAPDSLHKPARG

SEQ ID NO: 168129 - protein, 92 aa, Triticum aestivum
  unsure (1)..(92): unsure at all Xaa locations
  Clone ID: PAT_TA_62547.pep
TRAIQWGVEYIDVELWLPXRIRKKLYDQRGNSRIMSAFHDFSGSFRWPLAYAQEVFERSTPYADIIKMIAIINEHNENFELEYFRSKKKKTK

SEQ ID NO: 168130 - protein, 208 aa, Triticum aestivum
  unsure (1)..(208): unsure at all Xaa locations
  Clone ID: PAT_TA_62548.pep
NVAQRDSRRCPYDCQWQGWYYCASFVFNPTIPGYPNARLPRVSLFSEIYQVSGPVCRFDRQIAGQGYIVAAPSSYHDXTGPEDLKYDDEDTXDRGNKYKIXKSLEPYYSDSYATVYYLLSLRSCTGHIGSTGMCLGDHLAVRAALDPRIAACASNFATDIHSRTLGPFDAPNNSSTVPANSNHTQDLFHKXRARLTMIFVVNDTHVPD

SEQ ID NO: 168131 - protein, 102 aa, Triticum aestivum
  unsure (1)..(102): unsure at all Xaa locations
  Clone ID: PAT_TA_62549.pep
MSSRPPRVAIITRGIDAVKKAVIIQSDDNGNKPHPFCHLLSAGIERXPLRMMIRRMCKTXTRTQTRXRAFIKVVNYNHLMSTHYTLETQGTQMRRLQRHLQE

SEQ ID NO: 168132 - protein, 83 aa, Triticum aestivum
  unsure (1)..(83): unsure at all Xaa locations
  Clone ID: PAT_TA_62550.pep
MPAAGALVVYRAVFAALGCLMVGTLVYTCITDGSPFRAELLTPWMMTTLVDFYVNIXAISTWAAYKEGNCIISILWPELRDCF

SEQ ID NO: 168133 - protein, 192 aa, Triticum aestivum
  Clone ID: PAT_TA_62551.pep
LASVKLVLKKTFDDLRLYFTHPVFFPSFAVALLYCTVLSFGGVMVTYLLSSGYNSIQIAAMRTISVAFEVLATWIGPWLMKKIGPVRAGLWFLSWQLGCLSIGISIFWRYADNVLVSTLALVGSSMFSRVGLWGVDLSAQVIIQEEVEAQNRGAFSAVEASWQHVFEMYAYTSTIIFSSPSEFHNPTALSVA

SEQ ID NO: 168134 - protein, 93 aa, Triticum aestivum
  Clone ID: PAT_TA_62552.pep
CLQSAEVTNDVPGVGFGGLSLATNTDFPLTVKMPQGMTCEGTVGGANNVCIVRVRNSAAAGPFGGSGAFTQSASARKRAIAFRLKKRMQIVRN

SEQ ID NO: 168135 - protein, 54 aa, Triticum aestivum
  Clone ID: PAT_TA_62553.pep
MVYKKKKKKKKKKKKKKKKRKRKKKKEEKKKKKKKKKKNKNAKKKKKKKGPRGA

SEQ ID NO: 168136 - protein, 171 aa, Triticum aestivum
  unsure (1)..(171): unsure at all Xaa locations
  Clone ID: PAT_TA_62554.pep
MDHVDSHLAHQASQENVSFFTPLNLVLICAVLYTTYALMRSSPPPSLPRDTPSTVFRTYNPHTLLPFNGEEGRPVYLAVRGRVFDVSPGRNFYGPGGPYSNFAGRDASRGLACGSFDEDMLTKDLNAPLDKLEGLDEEQMDALRGXEERFLEKYNVVGKLVSMQDYEAQKA

SEQ ID NO: 168137 - protein, 175 aa, Triticum aestivum
  Clone ID: PAT_TA_62555.pep
MLSTLRVASRRAARPAQYNLAAIRAASNWANVPQGPPDAILGITEAFKADKFDKKINLGVGAYRDDAGKPYVLPSVREAEMKVVESKLNKEYAGITGVPEFPPAAAKLAYGANSPALDRITITQTISGTGALRVGAAFLAIPHSHLLSRWRQHLRRWHHCYPRAQPVPARCSCCC

SEQ ID NO: 168138 - protein, 108 aa, Triticum aestivum
  unsure (1)..(108): unsure at all Xaa locations
  Clone ID: PAT_TA_62556.pep
GAAEALFFGGVSLGLLDLALGCYLPWFEAIGRLAGTPPFLDAARTPKLAAWAGRFRAAEPVIALLTAVDKVXEYITKVLYPKWNVALTAPPTNFRTEGVGVFTSCCAR

SEQ ID NO: 168139 - protein, 111 aa, Triticum aestivum
  Clone ID: PAT_TA_62557.pep
LWYRIVQLTMSHTPVEGILILQTPCNMLILSHANACIQDMLRRLDELLHLYEVRQQIDSAQPTDRQTAESRILDPASTSPRADSMEETTHALTSLYSYPPLTRRNSKASSN

SEQ ID NO: 168140 - protein, 190 aa, Triticum aestivum
  unsure (1)..(190): unsure at all Xaa locations
  Clone ID: PAT_TA_62558.pep
MVFSRLLPSRRLLSAFLHTPTPIPAARASGPAAATTSPIAQSLQAGRFFSATRRDXPGDPRQRAEHIGARARQLQRRRLXSYALTXFGCEGEIRPSVSSIFPPPLAIYLTRTDGVERFATDPSKTRCRRGDVVRKGSGGHPSSSSSEIEGAVNDLENDDLXRYEGALPDLFREGHSVALEGSLKPLTDEL

SEQ ID NO: 168141 - protein, 180 aa, Triticum aestivum
  unsure (1)..(180): unsure at all Xaa locations
  Clone ID: PAT_TA_62559.pep
MASSSSFLLLAALLALVSWQATASDPSPLQDFCVADMNSPGTIRFVIMFSPNTYVEIYFWXLYASRNNVKSEITCTSLLPPVRVNGFVCKNPMEVNADDFFKAANLDKPRVPNKVGSNVTLINVMQIAGLNTLGISIARIDYAPLGQNPPHTHPRATEILTVLEGTLYVGFVTSNQPAPN

SEQ ID NO: 168142 - protein, 183 aa, Triticum aestivum
  unsure (1)..(183): unsure at all Xaa locations
  Clone ID: PAT_TA_62560.pep
YPHPPHSRRRFSSISITGTSHLSSESLRLSQLDRDHREPQVSPCREPAISSTNNIRRRIRRRGRTPQINNDFSRFHTARERRISPSELVAESRAIPPPATXSAQCREVALMLNEFETDREGYLHIXELDGFHVRGRSGXAEIDAELRDVFYVYDSNGDGRVSIGKLMNVLRRIDKACSTANTR

SEQ ID NO: 168143 - protein, 275 aa, Triticum aestivum
  unsure (1)..(275): unsure at all Xaa locations
  Clone ID: PAT_TA_62561.pep
MSLHKTAVLLFSCHAFPAVSSLPPLRSITSSRGVRTSYAPATTCSTERHRRYATVNSDQRGSFSHNEVPQWPKHSYPSPYEIFSMKSDAPYTKHRFYQLVKVYHPDRHIHTSDIDNIPHAIRLERYRLIVAANDLLSDPSKRQLYDVHGLGWTGGKPQTLNETVRSADRAWRHKAGSAANNATWEDWERWYDARDGRVRDTGHMSNGLFATIVVVMCMIGAFAQMSRAEQYGADLMEXKAQSDLAIGQQVARRNTIAAGRSKDERVDMVLKDREN

SEQ ID NO: 168144 - protein, 252 aa, Triticum aestivum
  unsure (1)..(252): unsure at all Xaa locations
  Clone ID: PAT_TA_62562.pep
ILELNMVHPKAEKALQEAKRLVAQLESYDDDPITHQNVLKQTEAVRLAIQSPMDRMTHLMEQVSFCGAFHTIIGVRAYHATPADGSSITAEELGRITNVVTTVIERVYRVAISHGVFIETAPDTYAHNDLSRILNPRGLGSFFLIVVEFGRGFIHLADYCKSHQPEDIFDLTKSPAVYSVGKEHLGKSYYELLDIDPDPERRELWNANMVAVDELMPVXGMFPFASLKREVSRIQVDHSWVISXLVVDNHAL

SEQ ID NO: 168145 - protein, 224 aa, Triticum aestivum
  Clone ID: PAT_TA_62563.pep
MFLTDKYHALLPPHSAPGSIDDQEGIERSTQAVLDDSKIEEELGSDKYDAVLVACFSVHCLVPKLTRYRHLAVTGIFEASILTSFSLTAAQENGAKWGIVTTGKFWEDHLSDGVKKFFGQEKGGVNSKFAGVFSSSLTAGDFHTVPPEKVREKLKEATQKLLDQGQVNCVVMGCGGMAGLEGIIRSTAVEQYGKADGDLVYIVDGVKAGVMQLEQMIRSKRAFR

SEQ ID NO: 168146 - protein, 223 aa, Triticum aestivum
  unsure (1)..(223): unsure at all Xaa locations
  Clone ID: PAT_TA_62564.pep
MRPSTRLGSLMLRRGFASSARRLDNYGFIGLGQMGYQMAKNLQSKLKPSDKVSIFDINPESMKGLETEMKAASSGAQVELAASAFDASKDADTIITVLPEPQHVKGVYKSIITSSLPKKDQVFIDCSTIDPSTSRQVAKTVSSARQGMFVDAPMSGGVVGATAGTLTFMLGASPSLVPRLEPVLMLMGKXVLHCGEQGAGLSAKLANNYLLALXNIATAEAMN

SEQ ID NO: 168147 - protein, 78 aa, Triticum aestivum; identical to SEQ ID NO: 106977
  Clone ID: PAT_TA_62565.pep

SEQ ID NO: 168148 - protein, 250 aa, Triticum aestivum
  unsure (1)..(250): unsure at all Xaa locations
  Clone ID: PAT_TA_62566.pep
MASRVVFSRRSLAPLATMALGGLALTPATVFAEGPSDLKRKPIYDDFEIPASKPAPVTPPPAATTPVAEPVEEEERQYSPTPTDRLAVYVGRGRLSLYKYAVAAENKINETMDSAFNLEQSFTSTIASLAPSRESGEQLMPGAIYVLVAAMAGSIITRNRSIILRASLPLAMGIGAGWTVIPVTMRNVSDLTWKYEQRFPVVAQSHIRLRESILNSASFAKAHSQVGVXYVDEKVTDAREAVEGWVQKGK

SEQ ID NO: 168149 - protein, 89 aa, Triticum aestivum
  Clone ID: PAT_TA_62567.pep
FPQSIVNFSTFLCASLSQTTLLLYCKAHYFDDATQVCFCGDLDGRDGVDPPRGELGASVGQRGIVWRVHRPAVPVFVQAAVKHVTCGGV

SEQ ID NO: 168150 - protein, 270 aa, Triticum aestivum
  Clone ID: PAT_TA_62568.pep
MSPSLDAPTDASSPRLSVIVTGGASGIGLAITRHFASQGHMVAVLDVNSKTGPDVVAQVAKEYPKATVSFKWCDVSSWEGQYAVFDQAYREHGDRIDIVIVYAGISDPVVGALDCVPTEFPRKPQLRMQDINLNGVIYSVSLAVHYMLKNEIGSRLPDSRGSIVCTSSSAAFYPFPVSPLYSTSKAGIVGLVRSMAVRLQEPKIQINALAPGALETNIAPDKELFRFMVITPMSTLIRAVEQFVTDPSRSGQTAETNEEEITLRPHVEYA

SEQ ID NO: 168151 - protein, 200 aa, Triticum aestivum
  Clone ID: PAT_TA_62569.pep
MKFSLAVLLPVAGVLAAPTPPGIPSDSTARSLLSGLTVSAPTNTDTYNRDLFPHWQTYEGTCNTREFVLKRDGTNVVTNSACAATLGTWKSPHDGATWTQASDIDIDHMVPLKNAWISGAASWTTAKRTQFANDVTRPQLWAVTDNVNQSKSDKSPDSWKPPLTSFYCTYAKSWIQVKSYWQLTITSPEKTALGSMLDYC

SEQ ID NO: 168152 - protein, 154 aa, Triticum aestivum
  Clone ID: PAT_TA_62570.pep
MAACVDKWNPAYSCHRISRSIYRFMPDCTFTAPAGAAVNGNGGCCNGGDEVWEELYAEAQADAQDEPLLGMFYSELVLPHPSLEAALAAHLSAKLCIPGALPQDALRDILAGALAAHPEASQHTRADLLAARDRDPACAKMVHCFLYYKGFLAL

SEQ ID NO: 168153 - protein, 231 aa, Triticum aestivum
  Clone ID: PAT_TA_62571.pep
MADSDSPGWKWFPNVKNSWSLDVVTLLAVIGESAMAEQTQTITASLLCLLPRLIPAPQALLKPSRPSRMPETLAKMTGVYSGTTLDSVGFFATIITPLDALQPYSFSVFEIRHTDPSQLYETDINPPSAQESWSMRSLKWVKSRRSSSYSREHQHNGKETRGNRIPRAPRTDGGLPLPAQASSTAATRTTTFEILGKSQVDEDAPNPSYAGPRQSKKFRTCSQTLLLIPKD

SEQ ID NO: 168154 - protein, 117 aa, Triticum aestivum
  Clone ID: PAT_TA_62572.pep
TCFALGLACVVCAVFRLIYISTVDLNTNITGTMPTTVFLFILEPNLAILCVSIPMLRPFYAKYKKRMGGSRLDEYSNSRSTGFRDMSRTGASSAAAPEAVRDPNLSTWEMVFLPSAR

SEQ ID NO: 168155 - protein, 122 aa, Triticum aestivum
  Clone ID: PAT_TA_62573.pep
PFHLQNSQHPQSPPKWSVSLSWLPSWLLPPPSRALSGASASSPTSPTAVLPVEVAAARKSARMPRSLSLMDLSFHTTSLAMLEVLGSALAQSLPRAALSATPEPSKFGFDAYYFIRSALVLP

SEQ ID NO: 168156 - protein, 167 aa, Triticum aestivum
  unsure (1)..(167): unsure at all Xaa locations
  Clone ID: PAT_TA_62574.pep
LPQAERTDGGFPQRGARPPRAPTPAPLVAGDPNRPNPPQTLGGSPATAAECPSSASITNKGGAWRGGTHLDANTVVTATHVCPATNCQSXHDIRAAANSRTSGGVTPRASSNTMLVXPTRTTHNNDVAHQKVSTHIAGGGPIAKGHPATAASDADGGTTHTVAGWGD

SEQ ID NO: 168157 - protein, 90 aa, Triticum aestivum
  Clone ID: PAT_TA_62575.pep
ALPGLTTSSTSHFIATRMRPCCIRFILGHGAELEKEREPSLTRWIWGGISCHGLAVRIRPQGKYSVFRSFWIWLALALFLQCLWPSDSSM

SEQ ID NO: 168158 - protein, 153 aa, Triticum aestivum
  Clone ID: PAT_TA_62576.pep
DYSAHISSHNAVRTNDEALLAPNQIEKVQNRMRAVHNKRLEENYQKACKRAEKKGRKLPPKDQYYDHWGYPYMMYGPFMAPTIVFVPVYAYGTAPTCAGGTCGGNVAAGACGGGDGGDGGDGGGCGAGGCGGGGCGGGGGCGGGGGGGMWRWW

SEQ ID NO: 168159 - protein, 230 aa, Triticum aestivum
  unsure (1)..(230): unsure at all Xaa locations
  Clone ID: PAT_TA_62577.pep
MQIFVKTLTGKTITLEVESSDTIDNVKAKIQDKEGIPPDQQRLIFAGKQLEDGRTLADYNIQKESTLHLVLRLRGGMQIFVKTLTGKTFTLEVDSSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLXVLXLRGGQ

SEQ ID NO: 168160 - protein, 79 aa, Triticum aestivum
  Clone ID: PAT_TA_62578.pep
SRSLGLGEGGFSGISSQEDGSTIYLYATGDNSWFRLLGPTTLIFQAIGFAWLFFMLLQEWRDKRRASMMHCSSLPSGDQ

SEQ ID NO: 168161 - protein, 136 aa, Triticum aestivum
  unsure (1)..(136): unsure at all Xaa locations
  Clone ID: PAT_TA_62579.pep
MSYYDNPQSQWSSSTQQQQQQQQPTQTQNSWEHQGSTTPVRAGASGPQPQDDYAFSYQFDEVDRAYENLQKSGKGYGMGGRHSRGSHHTPGSRPHSVNNFDDARGGSRXAQPSNFYANQRHQPSRGSNEAEQVMQA

SEQ ID NO: 168162 - protein, 94 aa, Triticum aestivum
  unsure (1)..(94): unsure at all Xaa locations
  Clone ID: PAT_TA_62580.pep
ISKTAPXPXXFPTTPPDNTTTTSTTRGXRCTRRRPPPAPPATXRTXTGATATTSPTPRTGATPARAAPPAPTPTTATTRPGTRRTPTRRPPPAA

SEQ ID NO: 168163 - protein, 76 aa, Triticum aestivum
  unsure (1)..(76): unsure at all Xaa locations
  Clone ID: PAT_TA_62581.pep
MSASFFSLQGQTALVTGGTRGIGQAVAIGLAEAGSDIILVQRDTTSQSTKESIEKLGRKAFXFXRLFNRKNLLPAL

SEQ ID NO: 168164 - protein, 109 aa, Triticum aestivum
  Clone ID: PAT_TA_62582.pep
MEQHFCFSLLKKKVANNNQQICHHRLPAHPERSLGEKETYRWRSLPLPQTRSRSRSMSEAATVMATETAPTFSSGQRWTSKDGAGGCGCGGADGTLAAGQDEKKERRFV

SEQ ID NO: 168165 - protein, 113 aa, Triticum aestivum
  Clone ID: PAT_TA_62583.pep
VPWKPPVTKTEYVTKWKPPIIKYKTVTETDTVTKYKWKPPVTKTETKWKPPVTKTETKTTTETKYIHKPPVTKYKTETVTKTITVNKPKPTYHKPGYENPGYGDGGHKKEYKA

SEQ ID NO: 168166 - protein, 260 aa, Triticum aestivum
  Clone ID: PAT_TA_62584.pep
VTDTTTFKRLVRFVPKSDSTRILIGEPSQEDLDIGVATRDGKDVTVNVFTGSSVLSPGTRTDRTESIERILSPLAQEEVGTIRCIGLNYVQHANEVKMDIPKIPTLFLKPIIVLGDPWPAPTFLPKITQNDGSGDYESELAVVIGKIAKNVSEENAMDYVLGYTAANDVSSRVSQLNQSQWCFSKGFDGACPIGPVLVSTSAVPDPSKLHIRGLKNGKVLQDCSLDDLIFSIPKLVSFLSQGTTLPAGTVIITGTPAGVG

SEQ ID NO: 168167 - protein, 224 aa, Triticum aestivum
  unsure (1)..(224): unsure at all Xaa locations
  Clone ID: PAT_TA_62585.pep
MPGLTLPTFTRAEVEEHNSEGSCYVTIGSKVYDITDFIEDHPGGPEYVLEYAGRDIEKILKDSDFHTHSDSAYEILDESLVGFLVPEKSVNGHANGTANGNGNAKLSNGDANGTVHPRTGMSCEEDLSRETDYNMDYKKNKFLDLNRPLFPQLWFGGFTKEFYLDQVHRPRHYKGGQSAPLFGNFLXPLSXTAWYIVPIIWLPCIAFGTHVASQGFDTSSTLLA

SEQ ID NO: 168168 - protein, 194 aa, Triticum aestivum
  unsure (1)..(194): unsure at all Xaa locations
  Clone ID: PAT_TA_62586.pep
MQSSSKAGGNGDAKHLVCVTGAGSFIGSWVVKELLLRGYRVRGTARDPAHRKNAHLLALDGAGERLTLCRAXFLHGDSLRAAFWGCRGVFHIASPVSNDPELVPEAVEGTRNVINAAADAGVRRVVFTSSYGAVHMDPNRSPDTVVXDYDYCKQTGNLYCCAKMMAEVAATEEAARRGLELAVVLPATTIGPAL

SEQ ID NO: 168169 - protein, 57 aa, Triticum aestivum
  Clone ID: PAT_TA_62587.pep
SYFSSGSFHLILFWVNDQQWNCDSCVTRLVVVLQRGEQTEAGRSLGGSDLVAEVLMN

SEQ ID NO: 168170 - protein, 186 aa, Triticum aestivum
  unsure (1)..(186): unsure at all Xaa locations
  Clone ID: PAT_TA_62588.pep
MSHNLHPSINKGITKGSSSFSGGKLRCECSSNPVEVTLGGQVAHNHACGCSKCWKPEGALFSVVAVIPRDXFQVTANANKLTIIDESAAIQRNACRDCGVHMFGRIEKEHPFKGLDFVHVELSDEKGWQEPQFAAFVSSIIEQGFPAEKANEVRSQFKDLGLESYDALSPPLMDAIASWTAAKAKI

SEQ ID NO: 168171 - protein, 262 aa, Triticum aestivum
  Clone ID: PAT_TA_62589.pep
SSDLSMKAIQIKEFNAPYSVSEVDKPKSKPHQLLIQIKAGGFCHTDCMALAGEFGSKLPFIGSHEPTGVVVEVGSEVEGFTEGDRVGCLNFDSCCGKCPDCKAGKPIYCDAPLMKGLTADGAWAEYMVSDARFAVKLPDALKFPTAACMMCAGATIYGGIKNAKVPAGGSIGIIGIGGLGHIGTQLAKAMGYQVAAIDAKQDTLDLVSSYTLKPDVCILASDPLEYSMKKITDVVKSDYPLDAVIIATDAPPAFDLAAQLTR

SEQ ID NO: 168172 - protein, 154 aa, Triticum aestivum
  Clone ID: PAT_TA_62590.pep
SAAELTDGVLADGIQDDCGNVTRFVMLAREPIVPRTDRPFKTSIVFAHDKEGTSVLFKVLSAFAFRDITLTKIESRPHRHRPIRLVDDANRGTAKHFEYMFYVDFQASLAEPRAQNALAEVQEFTSFLRVLGSYPMDMTPMTAGSSSTVTSSDS

SEQ ID NO: 168173 - protein, 267 aa, Triticum aestivum
  unsure (1)..(267): unsure at all Xaa locations
  Clone ID: PAT_TA_62591.pep
MAQSVPPASSHGQLTVGEVGTSVNSVPYARHEEIIRAPLTYLLNLPGKDVRSKMIAAFNQWLKIPEDKLDVIKRIIMLLHNASLLLDDIQDSSKLRRGLPVSHSIFGIAQTINAANYAFFLAQQELPKLGDARAFEIFTEELLHLHRGQGMDIYWRDASICPTEEEYFTMVSNKTGGLFRLAVKLMQLASESDKDYVPLVNVLGVIFQIRDDYLXLQSGNYAKNKGFGEDLTEGKVSFPIIHSIXRSTPXNIQLSSILKQRTTDIDV

SEQ ID NO: 168174 - protein, 193 aa, Triticum aestivum
  unsure (1)..(193): unsure at all Xaa locations
  Clone ID: PAT_TA_62592.pep
IPPAPNPKQASTPRVKSATCQPASLQRSPTPPRPRPCPPPPPPPRPWARSPRPPPWRSPVPSSSSPSAASPSPASTTTPLLRTTPRPFVHASPPPPPPQRXAPARARPPWPGPPPRPRRRRQRPSRRPPTPTDRPPTGRPDARPPPCPISPARPRPLLLPGPVASFLGFLLCRWCLVALASAGRLLTPGVQMD

SEQ ID NO: 168175 - protein, 233 aa, Triticum aestivum
  unsure (1)..(233): unsure at all Xaa locations
  Clone ID: PAT_TA_62593.pep
MRARFKGPAGTGILELPDDATVQALFDEIRMKTGISKFGVRYGLPMAMKSLEATQGDQIARSLGLHGETLTIFSEESSSAPVETVPTGTPQSQVTASKTSKKNESPEDVNVPWPQREGTLLLRVMPSDNSCLFTAFGGALQNQLSAQNLRRMMADYILQHPEEYSEAVLGSPPSQYCRSIQDPDRWGGGIELSILSSIFDIQICTFDVQTQSKIEFXEEKQDRCILVYSGIHY

SEQ ID NO: 168176 - protein, 210 aa, Triticum aestivum
  Clone ID: PAT_TA_62594.pep
LAATFGRGTSPPAIESRADCREPSAMSKRGRGVWDMELGSLDTTRLLMLLAQQHQHQHHHRGVAEAAQAMTGGRVFQCKTCNRQFPTFHALGGHRASHKRPRLHHPPPQHALVGVDDDAALCLGRRAPQAPPQPARPRVHECPICGLEFAVGQALGGHMRRHRVEAEAEAGANAPSSKAAPATEMVVASCDDAGICLDLNLTPSENCAKC

SEQ ID NO: 168177 - protein, 189 aa, Triticum aestivum
  unsure (1)..(189): unsure at all Xaa locations
  Clone ID: PAT_TA_62595.pep
TPSKGSHLAEFQPAIIRAIPTVPEXHYLVHPVKLLQVMPDDVDAGRGPTYVXPTAGTTTSNASDTLRRLTAKKAPXFRGWRRRDAAYDGSGCICPEFRQHHQALXRADCIRMFAHKRLLTXLTASCLYARDGRRLSESLETKPXYLQNDATDSRXTTERRDMQVGVRRRFRGLKLCMXMRIHGTAKIQE

SEQ ID NO: 168178 - protein, 142 aa, Triticum aestivum
  Clone ID: PAT_TA_62596.pep
RRVTLCEYRRGTIDQLEVVSAILADANLEENALSKKKKKKGQPTETYASREVSSTTAWAFGQDIPVVRLDLGLPTVTEEEYDGPEDHIALPPSAMERVMQYGDEAQIVVTTMRRRGAQGGSQGEDGFFEDDCEVLDFADQRV

SEQ ID NO: 168179 - protein, 105 aa, Triticum aestivum
  Clone ID: PAT_TA_62597.pep
PYQQDSSGGGLRGTVRSASESKPAGAATLGSIVGFTPASSGSRGCCAGHQPSGRRGAVDEAVVAAVSAEAEDKGRRHGFAVRRRPASDALLVLVRWLKTHTYSAC

SEQ ID NO: 168180 - protein, 220 aa, Triticum aestivum
  Clone ID: PAT_TA_62598.pep
MADAPPSLPGPMPSSFDGEGEFHNERPMQKVVRKIKEEPLIPLGIGLTTAAFINAYLALRRGDSKQANRMFRARVAAQGFTVFAMLAGSMYYQKDREKTKELRQLQEQKDAEEKRQKWIRELEARDDEEKAMRAKLEKRRQQVQAQRAEEAQATAAPTEASSSGGILSRVGLWPTGSKDEKKDVEKVVEEVVGEENTKQKKKNPKSSLGDLGEIISKKKD

SEQ ID NO: 168181 - protein, 159 aa, Triticum aestivum
  unsure (1)..(159): unsure at all Xaa locations
  Clone ID: PAT_TA_62599.pep
EPYHRSTSFRRNHYRLCLGLHSFAWLTGMGMALAPRSSLSLRSLLLLMSHRKPHRSSFFSSSAAVPPAAPGTATPAADPAVQPPAAPGNLLLTHSIVISKHRVPVTCEPSPEXLPHSKPAKILILQFLKVRAKQTKDGPPRQPPGTMDIDAKDPGKKTL

SEQ ID NO: 168182 - protein, 135 aa, Triticum aestivum
  Clone ID: PAT_TA_62600.pep
MVSSMKHCRDQAPEVPLSLSLSLGAMADRSKKQRRGADGEFVCKTCSRAFPSFQALGGHRTSHLRALLVLALGLTGGSDQPATNKATDQKQAHQCHVCGLEFEMGQALGGHMRRHREQEAATTAQAPPVLLQLFV

SEQ ID NO: 168183 - protein, 161 aa, Triticum aestivum
  Clone ID: PAT_TA_62601.pep
MPTRLSKTRKHRGHVSAGKGRVGKHRKHPGGRGLAGGQHHHRTNMDKYHPGYFGKVGMRYFHKQQNHFWKPIINLDKLWSLVPQETRDAYVKGDIKDTVPVLDLLPLGYSKVLGKGRLPEIPLVVRARWVSRLAEEKIKQAGGVVELVALSEASATVSVNA

SEQ ID NO: 168184 - protein, 114 aa, Triticum aestivum
  Clone ID: PAT_TA_62602.pep
MAPAAKKQKKKWSKGKVKDKAQHAVVLDKTTSEKLYKDVQSYRLVTIATLVDRMKINGSLARQCLADLEEKGIIKPVVTHSKMKIYSMLAFPTPHSPRVNYLYTHLDTLSRHNC

SEQ ID NO: 168185 - protein, 170 aa, Triticum aestivum
  Clone ID: PAT_TA_62603.pep
RAFRETMSIFPRSSAMATIGARDGVKWLSGRGRSNFPGMAHFTGPKQGARQISTQICSDRPTRQGNLALFYPHSLLSLPSEKIVAARRLGTAVLGGPAVVSQQAEGSDGRSGKTATRAPGSRLRPTTRGLCTTMSSQPVPTPSLSTAGKGTFLRDSTFSCMDKRLLLSGP

SEQ ID NO: 168186 - protein, 112 aa, Triticum aestivum
  Clone ID: PAT_TA_62604.pep
NTRERPSFSLLWIGGTSWFFDLLQPGLCCSFSCTRHLRILNPIVHLVLAADHAAVVITDCTSFQQSSWDYCSAESRSRLLFLRHIYVLLGCTVVKQDTVVTMDAGVLSIYLV

SEQ ID NO: 168187 - protein, 100 aa, Triticum aestivum
  unsure (1)..(100): unsure at all Xaa locations
  Clone ID: PAT_TA_62605.pep
NMAAVADAAVIQRRHPLLLALQRQHFADDGGILPLDYIADTRHATTEATTDATTDATSLLTTISDNVWXWLVTTISINVGQQRASGRCLTALLRQRTYRP

SEQ ID NO: 168188 - protein, 64 aa, Triticum aestivum
  Clone ID: PAT_TA_62606.pep
SLPPPRPNLGHLKATICPIPYYRCKKPHHPPPEDLAEAPEEYLPHLNPSLHQRYGELQRSRRGP

SEQ ID NO: 168189 - protein, 77 aa, Triticum aestivum
  unsure (1)..(77): unsure at all Xaa locations
  Clone ID: PAT_TA_62607.pep
TEKNGEGXGDDXXDXXRDPHRDXGXXTXXHKXAEXAXRGRAXHSENRPXRAEXADEXEQTQXSGGAPXTDDAAGRAT

SEQ ID NO: 168190 - protein, 196 aa, Triticum aestivum
  unsure (1)..(196): unsure at all Xaa locations
  Clone ID: PAT_TA_62608.pep
PLEPAGGFSKGAXXFEFLSQNHTVSQSGFETPCDLMTGGMDSGFMANPNNTVSPPPQVAMQVMVDTPLWFYCKQGNHCGQGMVFSINPTAEKTQAKFKELAIQQKGDGKLAPIQGGLPASPAASKPAEAAPPAAPPAEDAPPEATGVVPGKGTMAPDGSCVCHVSCAAGAFPAAAQGINSLGGMAGALPYNMGGVS

SEQ ID NO: 168191 - protein, 125 aa, Triticum aestivum
  Clone ID: PAT_TA_62609.pep
RRKLRLSTWWQGEYRSIIQREWPRLLLWVWGAPSSSRGQRSLPWWLRPQRRQQQPFFFFQRPRRGPWCFLGRRKIRLVPSPQLFLVGVPEPVGLPEVSSPQGRHALSAPPLLFLNYFCCRRCFLV

SEQ ID NO: 168192 - protein, 227 aa, Triticum aestivum
  Clone ID: PAT_TA_62610.pep
MAEPVKLIGTLASPFVHRAAAALRLKGVPYELVLEDLQSKSELLLKHNPIHQKVPVLLHGGKAICESLVIMEYIDEAFDGPPLLPTDPYDRATARFWAQFLEQKCSRPFWLALWLDASEEQKGFVKEMKENLALLEGQLEGKRFFGGESIGYLDVAACGPAHWIYAFEEVTGVSLMGENEFPALRRWGKEYTENENVQECLPTREQLVALFTAKKDIYKMDSHAMLH

SEQ ID NO: 168193 - protein, 193 aa, Triticum aestivum
  Clone ID: PAT_TA_62611.pep
VHSWCNDRKDPADQVEFPSSSVDGACTRHSLDRSEAEMLQWETPMCSRTGIEVDDGGGAGADGPAVGGATSGRCGPATVVEEGRGLTKGCLLGRLATNVALNPWNLVRRELRRNSETSKGAGQEARRCFLEIVTSSRDTLSSKAEQCTSVQVTASLRSVLVCFNFLKGDFLRPPLWCPLCGGGNGGAREDFGG

SEQ ID NO: 168194 - protein, 97 aa, Triticum aestivum
  unsure (1)..(97): unsure at all Xaa locations
  Clone ID: PAT_TA_62612.pep
KKKKNPXXXIXSHSKNNLFFSFPSFFXPXXXFFFPPXXXSLXXXXXXXXKXXFXXTTXTSXXPXQNPIXXXLXFYTTKISLSLFQSFLXSPXLEXXQ

SEQ ID NO: 168195 - protein, 225 aa, Triticum aestivum
  unsure (1)..(225): unsure at all Xaa locations
  Clone ID: PAT_TA_62613.pep
VQRLVGKVHGSLLYRMASSIQPLTKGVYAPSGPNDIRGPCPLINSLANHGYLPRDGRNVRVEEVLAGMNAVGLSKPLGAAFANPIFQERAPSKFHDDQVTQRSLLQKLWQTVTDPWSVLGKFGMRKPGQVDSEGHRVLNLDQLGLPNTVEHDISLTRRDHQQGDNITLQKDLVEDLLASSXDGKVITVDDLVEFRKKRIARQKEDNPSVQYGAFENDLACAEIAL

SEQ ID NO: 168196 - protein, 125 aa, Triticum aestivum
  Clone ID: PAT_TA_62614.pep
KDDASPSEIAQRAVSRLCNSDNNGLKPRVLVVGIGFKRGQSHLANSPGLELAKKLVETNKVDVAWADPLVAQEAVPQIERLPESDWTVEALERDFDMVIVAFRQDGLDFDVLDQVQGVLIERWCI

SEQ ID NO: 168197 - protein, 104 aa, Triticum aestivum
  Clone ID: PAT_TA_62615.pep
LLCVVVVSLLLPARLMRRGTATAWWLLVAAALLVLVLPLLASSARPPPVLQRGGGDAGLGGGRELAAMGAARRLGQRTPVNKPPSPNPHGASSMAVPPPPSLTS

SEQ ID NO: 168198 - protein, 81 aa, Triticum aestivum
  Clone ID: PAT_TA_62616.pep
IALPTLLSHSQRGKVILVFYMALEYSFDFSRSERNLAWCDRHNISPEEPNSMMPPSPLPMDSLWMSSVANQLQPGQISPLS

SEQ ID NO: 168199 - protein, 109 aa, Triticum aestivum
  Clone ID: PAT_TA_62617.pep
LSASCCPCYITLLTAHGRSIRTLYLPKPHLLRASSASSSSFLLIQSLQLSLLDKISVTNTSGLTLQTPFSFIPSQGTVGPKDLSSIARHSMHLVMTQIVLHMLTVSNIV

SEQ ID NO: 168200 - protein, 161 aa, Triticum aestivum
  unsure (1)..(161): unsure at all Xaa locations
  Clone ID: PAT_TA_62618.pep
EACPQPAPPAARARTKQTASKPTGGKAPRKQPATKAARKAAPATXGEKKPHRNRPGTGAQXEXRKXQKSTEXXXRKPPXQRPAREXAQDXKTDXRNQSAAGTAXQEAAEAHPDGRNEDTNXXASHAKRGTNTPKDNQHARRNRGERARAATAARERRQRDP

SEQ ID NO: 168201 - protein, 58 aa, Triticum aestivum
  unsure (1)..(58): unsure at all Xaa locations
  Clone ID: PAT_TA_62619.pep
VVXCXFAPVXFPSRRFRXVPAVXXRXAXSVSWSTVLXLWLXXLPLCSXPVLGKLFFFL

SEQ ID NO: 168202 - protein, 104 aa, Triticum aestivum
  unsure (1)..(104): unsure at all Xaa locations
  Clone ID: PAT_TA_62620.pep
LPCRVPFXPLFLLGGGGGEQKHCGLFSLAAPPFXSSLASLAGLSFALVLSPVVGPPVSAVAAAVLXAASSFVXXAFWRAFLRGRALAGVPVRVRPLPGGAPGGK

SEQ ID NO: 168203 - protein, 106 aa, Triticum aestivum
  Clone ID: PAT_TA_62621.pep
MAPSTILSITTRRANNSKAIHRARRCATRRSAPLAASPRGRAAAATSPPCTGRSPTASTAPAATGRASPPTPTPPAPPPAPSRSPPPASSCDVRRESPSAVPVAVR

SEQ ID NO: 168204 - protein, 204 aa, Triticum aestivum
  unsure (1)..(204): unsure at all Xaa locations
  Clone ID: PAT_TA_62622.pep
IHTRGLFLPCLHKTKCRTPLRIIHHAPGPGHSDAHRPRDRPSRGDCWIHDRHERRAEAAPARQLAQAEGHQRTSPLSTASTISTRTPTTTRXLRTSSATPSTSPASCAPSSSACNRSTPSTRTTTTRTTAPLSTNSSLCTRRATRRRRTSTTRTRTISTTTTRTIPAPATSSDPVAHFITGPPIDQPAFSSDHRRLHAPVHRNA

SEQ ID NO: 168205 - protein, 85 aa, Triticum aestivum
  Clone ID: PAT_TA_62623.pep
MASPSSLKVAATAPVLVLVMLSSSPWQAAAQMQCSRCTEDCNSSCDGSSSSVRCSRTCATPTLQCANCQRCMNSCLSYCQSTCVN

SEQ ID NO: 168206 - protein, 77 aa, Triticum aestivum
  Clone ID: PAT_TA_62624.pep
LPAAAAADDDSNRPSASTAAAAAAMVCPSPVLLPRPPTLGCDFLLEDHFATAVDALVFTNCCLFFSAAHALVLVGSL

SEQ ID NO: 168207 - protein, 60 aa, Triticum aestivum
  Clone ID: PAT_TA_62625.pep
PKHFVFFGFHMFYLSISKAFWTTGLQTAPDNNGLRMDTTILLQLSKIASYFTTSYLHHTQ

SEQ ID NO: 168208 - protein, 148 aa, Triticum aestivum
  Clone ID: PAT_TA_62626.pep
RPLEAAGRCSEGVDQELQYADVLWPQHNSDHRRDGDDGSNVDGDITKLSSPELSAPVPVPHRKRRSRSWSTSDGSGSGNDDCSDGDVRCTNDAKRNVPPHVLAERRRRLAGRSTAAYSMCSGKGRTLKGRDLRNIRNLVLRLTGFIEK

SEQ ID NO: 168209 - protein, 151 aa, Triticum aestivum
  Clone ID: PAT_TA_62627.pep
SAIYPPINVLPSLSRLMKSAIGEGMTRKDHGDVSNQLYAKYAIGRDAAAMKAVVGEEALSAEDKLSLEFLEKFERQFISQGQYESRSIYESLDLAWSLLRIYPKELLNRIPAKVLNEFYQRAAKESKSKGKARADTEARGQQQTEENLIDA

SEQ ID NO: 168210 - protein, 222 aa, Triticum aestivum
  unsure (1)..(222): unsure at all Xaa locations
  Clone ID: PAT_TA_62628.pep
MKDFAGVRSQASPADLLALVKQLLSKGQPLDDKKGTTELLIGILTALPRSSKARTALTNKLIDTLWGNLQHPPLSYVGGDVKYEVAGAEPDHKSHCAQYDTIEFQVPGTNVTLKEQVPQAPDGLHQYRMPDGSFNNILEPNLGKAGTPYAKSVRTEKRLHGVKPDPGLLFDLLMARDEGSFKENPAXYLFMLFXHAXIIIHDIFRTNRTDMKQSDTSSYLDL

SEQ ID NO: 168211 - protein, 76 aa, Triticum aestivum
  Clone ID: PAT_TA_62629.pep
PLPWRSPPSSYTSSSSSSSSVVLSEALPENHELHCHHVVVLLESSLNFSSPLAGSRRRRRPRAVRVLNAEALSVRR

SEQ ID NO: 168212 - protein, 144 aa, Triticum aestivum
  Clone ID: PAT_TA_62630.pep
MPGGKGKSSGGKSSGGKTSGTEGANKKQQSHSARAGLQFPCGRVKRFLKQNTQQKMRVGAKAAVYVTAVLEYLTAEVLELAGNAAKDLKVKRITPRHLQLAIRGDEELDTLIRATIAYGGVLPHINRALLLKVEQKKKAKALEG

SEQ ID NO: 168213 - protein, 99 aa, Triticum aestivum
  Clone ID: PAT_TA_62631.pep
PNHPKRVSFQQKMCGIVPFVKGLYEDLLEAIDDLFPSRTADTAPLMNNRQSFPLAQPYNQAYTSASRPVAEDRCEVTERLEVRTARARMPSPPRGPPTR

SEQ ID NO: 168214 - protein, 96 aa, Triticum aestivum
  Clone ID: PAT_TA_62632.pep
LLTAGNGRDSAISQDREGHIAAPLTISTHTSRHLSLSFTSHKCFYLLHPRIPTLSLDPRLPSYRSHNSHITHRSHIPPLTSPTPARPLCIQLLATQ

SEQ ID NO: 168215 - protein, 205 aa, Triticum aestivum
  Clone ID: PAT_TA_62633.pep
MSRRYDSRTTIFSPEGRLYQVEYALEAISHAGTAIGILAKDGIVLAAERKVTSKLLEQDTSAEKLYILNDNMICAVAGMTADANILINYARQAAQRYLLTYNEDIPCEQLVRRLCDLKQGHTQHGGLRPFGVSFIYAGWDPRRQFQLYLSNPSGNYGGWKGTSAGANNASAQSLLKQEYKEDCTLKEACGMAAKVLSKTMDSTKL

SEQ ID NO: 168216 - protein, 225 aa, Triticum aestivum
  unsure (1)..(225): unsure at all Xaa locations
  Clone ID: PAT_TA_62634.pep
MVRESGISATKPIFPNFLLPSIKLPFSRRHSASSSSAESAASSAVTTPASSPPNDGHLAKAGRNRLSRTSPNTLRCSTCSADIAFASQVISKGFTGRYGRAFLVAPPALPAPQTLSNIRIGKSENRQLVTGWHVVADINCGACSSKLGWKYVDAKEQGQKYKVGKFILEMERVVTYRSWEDAIDEHEEEPPATSKKSSDNEVEFDSDNDDECEDIFAGTXDPEVV

SEQ ID NO: 168217 - protein, 131 aa, Triticum aestivum
  Clone ID: PAT_TA_62635.pep
MSDRPSHRGGRGQGSHPRGGRGGGRGGGAGGAQQERERPKKENILDLGKYMDKQITVKFNGGREVKGTLKGYDALMNLVLDDVHEVVRDDEGNESTRSLGLVVVRGTLLVLVSPVDGSEEIANPFVQPEDD

SEQ ID NO: 168218 - protein, 188 aa, Triticum aestivum
  Clone ID: PAT_TA_62636.pep
MRPEAFSSSFKMSAGDMQDEQLKEALITYEKLQGIEDDFEDVELEILRQQDKLTKDLYVRRAEVVSKIPQFWPLVFEQSPPEADEYIQPSDSELLLNALTVLSVERFELPNGDPRSIAIKWEFKENEWFEDKALEKKFYWRFPKDGWAGLVSEPVDIKWKEGKALTNGMLTLAKNAPDQEEGRPEAPG

SEQ ID NO: 168219 - protein, 105 aa, Triticum aestivum
  Clone ID: PAT_TA_62637.pep
PAGERLSDSLEKSRAMNKRGRDEWDLHLANLDTSRLLMLLAQQHQHHQHQSAVTWAVQATGSGRVFEWKTAQPAVPHAPEARMTPSQSFLTQAAPSVSVNRYQNG

SEQ ID NO: 168220 - protein, 224 aa, Triticum aestivum
  unsure (1)..(224): unsure at all Xaa locations
  Clone ID: PAT_TA_62638.pep
GRDSKRGVPARVCRSRRQQIESSSFPFPRAFGSTGQSGIICARADTDAHVHVGCGACTYVCPRSQWRVNGHTHVVRTYVQGSGHGLPPCPGTTSRARQSCKHGHGGFHCRAVHVPPRRRAMPMHPPTRXPQLGRPPIDGRIHWHTHTPACSLALPNPARAQRLYLLSSPRESVRSSRTRSWMDRRPGDGEDAVEVIDRSPGRDGAGPGGRRNGTAEDTETCPVF

SEQ ID NO: 168221 - protein, 254 aa, Triticum aestivum
  Clone ID: PAT_TA_62639.pep
IQTLKDPSSFAPPPKRTGTGLIPAAPRRDTASPSNHQDPYAPGSQEHGYTESQDQAEEPPKPRGPYRVDTTGLSTDNLPKPPGRRDGADGRSAQPPSYQSAMTGVGGGRAAPPSLPPRLPPRTNSASTVESSPGASPAPISSGLLNQGAVSRLGAAGINVPGFGIGRSNAASPSPPPPPRAGVAAPPPTQTPSHMSELQNRFSKLGSSSSNANAAAPPPPSEGTTWAQKQAALKTASSFQKILHQSHFQTPEQP

SEQ ID NO: 168222 - protein, 213 aa, Triticum aestivum
  Clone ID: PAT_TA_62640.pep
MGADIQQWTIEKPWLETHCLLGEGPFYEKSVDTLRFVDIRNKRLHYVKVTEGPSSLKTVQLDVCPTVTANIAGVDPQERIALGVKYGLAIFDVKKETYELIQPFEEPANERLRSNDGGVDPLGRFWLGTMTDFGLGPFKPEGAVYLMDSKSREVKLPDMTIPNTPGWSPDGKTLYITHSSAREVFAFDFDTESGEISNKRVFYTHNGSGEPDG

SEQ ID NO: 168223 - protein, 72 aa, Triticum aestivum; identical to SEQ ID NO: 140853
  Clone ID: PAT_TA_62641.pep

SEQ ID NO: 168224 - protein, 236 aa, Triticum aestivum
  Clone ID: PAT_TA_62642.pep
MQTANNPISHHTSHTMGEGAASSNSGDNSCGANSVGHHTSHTMGQGASSSSSGANGGGGVAEAQRVDDGITLGASLTDVETYNNDNDNESDDASSLGDSLASLDGTAGSVATSMRSSGSLSNFKIIDTTLREGEQFATAYFTTETKMKIAKALDDIGVEYLELTSPASSPQSKADAQAICKMGLKAKVLVHIRCNMDDARIAVETGVDGINMCIGTSAQLMKHSHGKNLHWIAAKA

SEQ ID NO: 168225 - protein, 201 aa, Triticum aestivum
  unsure (1)..(201): unsure at all Xaa locations
  Clone ID: PAT_TA_62643.pep
KKIPSIFKHXNMFASSSRESGTLRRSIHHHNMITGCVLRPDHQAHKLRSRSRSRGRSRRNVRRLVESNADVSLDSGSQVNLGLKVELDTDKESSGLLVAILIGGTLEKLTSGLREAGGGGKRNNKLLLLAAATTSSLAVRVGVGGVGRLGQSSSGVAARSRGRGKVGKGKVRGRRGRSGGSRGRHCAGLGGVGQIVKVDCS

SEQ ID NO: 168226 - protein, 47 aa, Triticum aestivum
  Clone ID: PAT_TA_62644.pep
TSSPITNREKMCLTHDDILILSYSDSLAPSITPCQRRQPLPRPLPAD

SEQ ID NO: 168227 - protein, 176 aa, Triticum aestivum
  unsure (1)..(176): unsure at all Xaa locations
  Clone ID: PAT_TA_62645.pep
MGRCCCCFPSKPPRENPMHPIAEPLIKRKPNHTPPYHQRPPVTTHAHKGMNAVVRLKTGFERFRTNVYNKNPKLFESLRKDQSPKYMVFACADSRVSPTITLGLNPGEAFTVRNIAGMVPAYQKTRHCSVGSAIEFAVVVLKVEXIVVIGHSRCGGIRELLSLKDEGANAYHFIED

SEQ ID NO: 168228 - protein, 87 aa, Triticum aestivum
  Clone ID: PAT_TA_62646.pep
PCLAYASGSKIESHPLQTITLRSLIHQTDSTSFWLLPSIPWRSCIALCANWGLQGSATGELGPYHDGSLLPSLYHDRSVSTRSNCVL

SEQ ID NO: 168229 - protein, 236 aa, Triticum aestivum
  unsure (1)..(236): unsure at all Xaa locations
  Clone ID: PAT_TA_62647.pep
GLCFPPVHPSQVQLRPSSRHHQQQPGQQHQQQVVNAPNKHAAGTGIKFTPNQKSGTKADNVVPGFVPVKGGTVSRRSDDDDGDDDGSYDVPKGDQDDDSGDGVMFTTFTAPHTKVGTIKKEESAGDDESAEERKFKAPSTKKQNGKKQKHTGDDDSPSKTDDHPKTSPSAXQSKSEDKPKASGSSSSDDKKXQPSRPEKDAKQGEKDKNEAEKKKKKHSGNDDSPSKTTITPRSLP

SEQ ID NO: 168230 - protein, 165 aa, Triticum aestivum
  Clone ID: PAT_TA_62648.pep
QKFLHVPFKFFTWSVVFLHVEAPVCCSPNSTVPFELVEVLEHELKAVAPSRWRRVLLPLFFKVQDSKPGVGSTHLTSPLGFRKQALKERSRRMFYELDRSMQKKPLVLPALRSKFPLLFSCTAASLATSCRVKQQWPSKTVSRGMTAAVTRVQKRVIREKDFILK

SEQ ID NO: 168231 - protein, 154 aa, Triticum aestivum
  Clone ID: PAT_TA_62649.pep
LPLQGHIGAYLVVAGVDPTGTHLFTVHAHGSTDKLPYVTMGSGSLAAMSVFETQWKPDLSQEEAIKLASDAILAGVWNDLGSGSNVDVAIITSDKTTLKRNYITPNQKEPKLQSYRFPKGTTAVLNEKIIKKEEIKRYITVEDVPVEEKMDVDT

SEQ ID NO: 168232 - protein, 127 aa, Triticum aestivum
  Clone ID: PAT_TA_62650.pep
MKRSTATILLLMLSLVSLASAGDVDNTIRLPSDGKGIPDEASMALTGAREKLGGEERPWECCDRTICTRSMPPLCLCLDQVERCAAACKRCEPADSDRSLYVCRDQYFGDPGPSCTDGDAVAAAGGN

SEQ ID NO: 168233 - protein, 178 aa, Triticum aestivum
  Clone ID: PAT_TA_62651.pep
MGDASVFKYPSPLTGYEDAPPLPNDMAEDGKSYVNPAAKKSEAYEKFIDPFDQTPRGAFDVHIYYFQGNKEQTKYAKELWERIRREFPELRTYKVWDGPIGPHPVAMFEVNIFTPAQFGAFIPWLNVWRGPLSALVHPNIIPEEGVDRWASMKRDHLERAIWMGERIPLDLSLFNNQS

SEQ ID NO: 168234 - protein, 101 aa, Triticum aestivum
  unsure (1)..(101): unsure at all Xaa locations
  Clone ID: PAT_TA_62652.pep
MSTRRAALSLYRRSLKLALDWAVHRHLWRGQALYIRSLFEANRSVTDPRXSRALSIDTDNPLESWKHPDPYTPPTAPGGSKYERNLPSPVLDPPPHPVNRH

SEQ ID NO: 168235 - protein, 151 aa, Triticum aestivum
  unsure (1)..(151): unsure at all Xaa locations
  Clone ID: PAT_TA_62653.pep
TRTQEAQQRYERAPAXXXQXKAGKKAXKNXXXEKRPRNNXXGQDXQPKRKGXRRXKGPEXXXXQRQKKNXQKRRKXPPXXXQXQHGXDRNTAAQXXKRXNKXRXETKAEKKERPXQEATAXKEGKKKEDGGKKPNTGKDGHNHEXRPKENK

SEQ ID NO: 168236 - protein, 176 aa, Triticum aestivum
  Clone ID: PAT_TA_62654.pep
MAASSAPAASLLKRQLKEMQAGRDLPGISCGLVNDDNIFEWEVMLMISDDCKYYGGGNFRARLSFPPSYPHMPPSLTFQDPIPFHPNIYENGKLCISILHPPEDDEYGYEDASERWSPVQTPESILISTISLFHSPNDESPANVEAARMFREEREGKHKDFRRRCRKCVRESLGED

SEQ ID NO: 168237 - protein, 81 aa, Triticum aestivum
  Clone ID: PAT_TA_62655.pep
MATELTAAQLRAHDGTDASKPIYAAIRGKDFDVSAGRGFYGTGGDYALFAGREDARALAKMSKDADDVYGDLSGLSHKELG

SEQ ID NO: 168238 - protein, 127 aa, Triticum aestivum
  Clone ID: PAT_TA_62656.pep
MVGAQEQGLKLLVPRSGVSIYAIRVQMALAMKGLAYDYLPEDPRCKSDLLLASNPVHKTLPVLIHSGRPVCESLIIVEYLDDAFPGNGASILPADPYRRAVARFWAAYVDNKVCSLPSRLASLSYKN

SEQ ID NO: 168239 - protein, 167 aa, Triticum aestivum
  Clone ID: PAT_TA_62657.pep
IGIDEGKRFIIPREYMPSRSKTRRNSREPLQLYALIRKKGNLSAANGAELSFSPSDRGDETKESHPKGPRGYATSSRHPIQIRRAHAPGKTSEKSNRETRRAEIGRLAAERESGTAAAELTSRGRDQAERRRRRRTRSSASISRGLQQVAGGALSLAICGSWEGEGN

SEQ ID NO: 168240 - protein, 109 aa, Triticum aestivum
  Clone ID: PAT_TA_62658.pep
ISILQTHSYLISNLKSDTPCLKLTHLKLPNAMHYYSFIPLAIAKPSGSRLHSHNYDSLNRHDIASHDDAAAVALGTDAKRHARLAEDFEARRSVVKDRHLYRRWRCCFT

SEQ ID NO: 168241 - protein, 231 aa, Triticum aestivum
  unsure (1)..(231): unsure at all Xaa locations
  Clone ID: PAT_TA_62659.pep
MRYSVPLLAALAASATATPAEAMGKRAEKLFTLETAPGETVEVTEDEKFQMIDDHIHFFDITEWKDHNPADASLAFTTPKFPETLSHQSNVANIVIKLSTKNMEKQLKKLSSFHNRYFNSAYGVEAAEWLHXEGQKVIKKSKHPLASVRLIQHQAWSQPSIAVSIPGKVRLTTVITGSHLDSVISNDRGAGRAPGADDNGSASIMLLNLLRAFLEDPRIAKGDHLSTVEFH

SEQ ID NO: 168242 - protein, 188 aa, Triticum aestivum
  Clone ID: PAT_TA_62660.pep
GSPTEKVLEHLNQRLEAVELALEEDDFDDKTLTEKCKISAQNKVSSTKTKQIVISRPPKSLAIHMQRSVFEPSTFNMKKNSAPVDFPMTLDLAPWCLGSTGSNPLDEKSRLEEEWVTDPRKSMVAGDQGSSKLAGPIYELRAVVTHYGRHENGHYICYRKYPRRSPSTKVAEDDVPDNKAGAQSETST

SEQ ID NO: 168243 - protein, 123 aa, Triticum aestivum
  Clone ID: PAT_TA_62661.pep
MASHMLRPLASSAVPASASELCASSFFFQKQLNGYRLKDGRLSSRKQWHSTLKASSQRALVADVSKPLALIRHVSTPTPRNYSTVVLPKTTPYENLVVGVPTEIFPNERRVALTPANVAILKK

SEQ ID NO: 168244 - protein, 125 aa, Triticum aestivum
  Clone ID: PAT_TA_62662.pep
MSFFRSFFTRATSPGTMSQASTKVQQLIDNNSVVVFSKSYCPYCKQTKKTLDDLNTEYELLELDEVSDGSAPQDALEKISGQRTVPNVYIKQQHIGGNSDLHSLNSGGKLKNLLKEANALKASKL

SEQ ID NO: 168245 - protein, 147 aa, Triticum aestivum
  Clone ID: PAT_TA_62663.pep
MAMGRGQARLLCAMMVVLLCVASQFQAGWSAGGGGGGGGGGARGGGGSSGGGRTGGGGSSGGGRTGGGGRGSAPFWGSGGGGSYVPGARGGYVPGSTGGRGSTAGSNGRSAAGEPYGYWPRRLHFRCRRHARRHGASSVVLSVLSQA

SEQ ID NO: 168246 - protein, 212 aa, Triticum aestivum
  unsure (1)..(212): unsure at all Xaa locations
  Clone ID: PAT_TA_62664.pep
SRLCTFCVFGWXMERLGFGNMHVHGAMFALLCFAPLWVLNHAATNIRSKAVSNAVSAAGVVLCALGLLYGGFWRARMRRKFGLAGKDRLPFFSSLSLDVADYLQWMFCWGCALAQEVRTGNLLLDVESTGGSGGVQVQVDNSLRPLPREDGSFEIAAVAGTPSVPLAYNSPRRGEELPLVQLKDGSWSPGEMRPPVPPLMQDGGGPPGGRIQ

SEQ ID NO: 168247 - protein, 165 aa, Triticum aestivum
  unsure (1)..(165): unsure at all Xaa locations
  Clone ID: PAT_TA_62665.pep
MYDDVAERLEQTLMSSYSSGSKPTLPDELLYDDVGLPIWNQIIFTPEFYQTHDEIALFDKHGADVAARCQAGVTIVDLGAGDTRKVGHLLAAFDKANVSTKYLALDISRSSLDHNIKYLVGQHSSKQSSVTCAGIWXTFGDGMNYXKKIQSPRLVLSLXSVLCND

SEQ ID NO: 168248 - protein, 104 aa, Triticum aestivum
  Clone ID: PAT_TA_62666.pep
LFHYLTSSFLYFCITLHSASISASRSLLFRSSPPASAFNFHRFLRFQGSRFFDSQSQWPAPFAEVGSGRSRPRGSERSFPRSTFVKDAKLQQRQKDETPFFQEP

SEQ ID NO: 168249 - protein, 236 aa, Triticum aestivum
  Clone ID: PAT_TA_62667.pep
MDTPSSLRRLAVALLSLAPTVLAQNKADVISKCLDDAGVRNVIDTDSSWAQETVMFQKRLKPDPEAIAFPENSDEVASALKCARESKVKANALGPAHSFQGNGFGIPGNLVINMAAFDEVSYDKKSTLLTFGGGTHVGPVQKYLWDTAGRHVPHVRGAHVGVTGSSIGGGFGTTSRYLGTPMDNLVEIQYMLYNGTIVNAKKGSDLFWGAQGAGASFGIILSTKTKTFQPQFDKAI

SEQ ID NO: 168250 - protein, 152 aa, Triticum aestivum
  Clone ID: PAT_TA_62668.pep
WGLFLSLVSFFQIATWVSKRQSGRNLSLAAKCPRGIPFFIQVARPRKKKTFSSKGEFQDVQRKMMGFSYLKENVVLSWVRKVRLSEGKKHWYLDKTRAPVSSAGGGTNFRRSIKKHWFQVFFESVFFFFFCFFFCFFFFFFFFFFFFFFFFL

SEQ ID NO: 168251 - protein, 194 aa, Triticum aestivum
  unsure (1)..(194): unsure at all Xaa locations
  Clone ID: PAT_TA_62669.pep
MKILTKQEEEAHYAEVLKGGIIGGTLFTGLGLAGVFVASRRYPSFRGLTLPFRAFLVTSTGTFGAIVNAERWSIAHQIALDPKRTYRDQAARTADLIRENETAYERFKDYAKENRYQIVFASWVASMGIAFAIVSRQPMSTANKVVQARVYAQXLTLAVLIVSAIYEMRDLKNGDSRFQTVRMVDPNDPTVIEQ

SEQ ID NO: 168252 - protein, 246 aa, Triticum aestivum
  Clone ID: PAT_TA_62670.pep
MMDLHIKPDPQQEAHESAPSTKSFQHSPEATGTELERALHGRHLQFIAIGAAVGTGLFIGTGNALATAGPVSLLIAFIFVGTLLFSVMTALGEMAAYIPVAGAFTTYATRFLDPTFGFAMGWIYWFSWSITFALELTAAGLIIQYWEKDLSIGIWITVFWFLFTAANFMPVRWFGEFEMWFSSIKVITIIGFIIFSICVNAGVGDQGYIGFKYWKDPGAFNEHIVEGDIGRFVGFWSVLITAGFSY

SEQ ID NO: 168253 - protein, 118 aa, Triticum aestivum
  unsure (1)..(118): unsure at all Xaa locations
  Clone ID: PAT_TA_62671.pep
MGNEEKTHLNVVAIDHVDSGXKSTTTGHLIYQCGGIDKRTIQKLEKESAELGKGSFKHAWVLDKLKADRESGIEIDIALWKPETHRYSVXFTPPPGNRDLLKNMITGTSHRQIAPFSS

SEQ ID NO: 168254 - protein, 97 aa, Triticum aestivum
  Clone ID: PAT_TA_62672.pep
IPKKRKKKKKNFSKKKKIEDNQKDLEMAVEILPEMFEKPITELSDPKLKVDIMDKTSYCNKRRVILLEDTAENLANGEWNFNADLLVATTSAPVHRR

SEQ ID NO: 168255 - protein, 201 aa, Triticum aestivum
  Clone ID: PAT_TA_62673.pep
MGGNASKVTAQDKAILDMKNQRDRLHQYQRKITVLTDKETDIARQMLAKGDKKRALLALRRKKYQESLLTKTDAQLAQLEKLTSDVEFALIQKDVVFGLQQGTKVLKEIHTEMGGIENVEKLMGETADAIAYQQEVSDLLGGRMTNQDEQEVEDELEALEAELAGPVPAERLPDVPINELPESQKVEAQAERAKQPAMLAA

SEQ ID NO: 168256 - protein, 213 aa, Triticum aestivum
  Clone ID: PAT_TA_62674.pep
MQIFVKTLTGKTITLEVESSDTIDNVKAKIQDKEGIPPDQQRLIFAGKQLEDGRTLADYNIQKESTLHLVLRLRGGMQIFVKTLTVITITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNI

SEQ ID NO: 168257 - protein, 155 aa, Triticum aestivum
  unsure (1)..(155): unsure at all Xaa locations
  Clone ID: PAT_TA_62675.pep
MPSPKQRKVAIVGSRSVGKSSLAVRFVDGHFVDSYYPTIENTFSKMIKYKGQDYSTEIVDTAGQDEYSILNSKHFIGIHGYMLVYSVSSLPSFEMVQVIREKILNHLRTDSVPICIVGNKSDLRPXEQRQVTPEDGQKLSEKIQCGWTEASARYN

SEQ ID NO: 168258 - protein, 217 aa, Triticum aestivum
  Clone ID: PAT_TA_62676.pep
MGRTNRSALALACLLALLLVQLPRGARAVDGDLCGKVKCGMGSCGESGDYMFGFACRCNPGWSRYHLGDVDFPFLPCAIPNCTINYSCQDGSSPPAPSPPPPAAPPLTNLSVYDPCLMQYCGGGTCEKVESSAFAHRCACPDGFRNLLDDDAYPCYRQCSLGSGCSDLGIGIINGSDPSTSPPAPVSFTVQKSGAAGRSTPPAHGAAGAPHTDYLPL

SEQ ID NO: 168259 - protein, 177 aa, Triticum aestivum
  Clone ID: PAT_TA_62677.pep
VTDRFGMPIQAEAVPRKLADPFDFGGGHIDPDRAVDPGLVYDVDAREYNKFFNCTLGYVDGCESYYLNLNLPSIAVPNLKDHVMLRRTVTNVEPVEATYHLMVEAPAGIDVSVEPSVINFTQSGSKMVTFMVTFTTRQRVQGGYTFGSLTWSNGSTHSVRIPIAVRTVIQDFVADTA

SEQ ID NO: 168260 - protein, 216 aa, Triticum aestivum
  Clone ID: PAT_TA_62678.pep
MALPPKFAGQKLQFAHPPASDSGVAHTTHTLEFYLDYCCPFSAKIFRTLRSDVIPAIKSNEHWASSLTFIFRQQVQPWHPSSTLMHEAGLAVLRLAPERFWDFSAALFDEQKAFFDVSVVNETRNDTYRRLAKIAAKSGIDENKVYELLVIPDKAGDDGALNAGNQVTNDLKVITKMNRLVGVHVTPTAVFDGVVQDVSSGWNKDQWVEWLQKNVV

SEQ ID NO: 168261 - protein, 111 aa, Triticum aestivum
  Clone ID: PAT_TA_62679.pep
RPLLILTTPIITMTEACLEEGHSTSVLEARGRSSCTTTTSTMPLFPISTLNASPPTRTSLPTTVSASRITSLLTVPSPTVSMTALSRISSMTPTTLLLMATVERTARLSPT

SEQ ID NO: 168262 - protein, 178 aa, Triticum aestivum
  Clone ID: PAT_TA_62680.pep
NNCLRFHNHPSYLSLLSPVIQRKHDMTARVAPGSSSYTEPSTTMSPTADHDVLRGRKRERSMTRGSVRTFRAAPADESSNLRGRSRRRAASPALSYTSRPSSPRRVPSPTRRRLLHARLRREHCPSRVASPIEQQLQQQHRPVRRRQRTRSQSRGPRLEMELGSRSTRWLSGLRNESE

SEQ ID NO: 168263 - protein, 106 aa, Triticum aestivum
  unsure (1)..(106): unsure at all Xaa locations
  Clone ID: PAT_TA_62681.pep
MVTTQVEGPVIGIDLXTTYSCVGVXQHDRVXIIANDQXNLPTPSHSLFTDXQRLIGDAAKNHVAMSRIKSVFNANSIISITVADGPVQSDITMWPYKVIPAPADKP

SEQ ID NO: 168264 - protein, 115 aa, Triticum aestivum
  Clone ID: PAT_TA_62682.pep
YGYHIQPISFEGDLSLNTWLEFNSFYVFCKQVFFESDCFRQARSQTQNMQAASNSPGAHREWSRLIRYRTLKVRQKRIFLIKINHNNSEHGEFLDFFEVAGVMGSMYEHSDAIHV

SEQ ID NO: 168265 - protein, 60 aa, Triticum aestivum
  Clone ID: PAT_TA_62683.pep
TCVLLQYYGLTEANYYTVLFGVSRAIGVLPQLIIDRALGAPIERPKSFSTDKWAELVKKL

SEQ ID NO: 168266 - protein, 140 aa, Triticum aestivum
  unsure (1)..(140): unsure at all Xaa locations
  Clone ID: PAT_TA_62684.pep
MSAKVPRNFRLLEELEKGEKGLGAEACSYGLEDPEDLLMSSWNGTILGPPHSVHENRIYCFXMHCGPDYPDLPPTIQFISQVNLPCVNPNNGVVDPSQLPCLAQWKRENTMETVLIELRRYMASSQNKKIPQPPEGSTYP

SEQ ID NO: 168267 - protein, 185 aa, Triticum aestivum
  Clone ID: PAT_TA_62685.pep
TYTQLLRHVQNSVLALLVAAGATQSQAAFTLKKTYDSSNFLDSFNFRDRAYFDSIDPGYEGDPTGGSVNYLSRSQAVSSGIVNTNNGKILLGVNSVDKAPLLTPGGSKHGRGSVRLEPKESYSSGILIADIEHMPGVACGVWTAYWSYNFDEDPVGENDIIEGINANQNGNYVSSAHLWKMTPQP

SEQ ID NO: 168268 - protein, 168 aa, Triticum aestivum
  Clone ID: PAT_TA_62686.pep
KAGRIDMTVYGVWIAALCLSSFVLRMYAFGDGELGEDCNDRYSDSCETVFKARATTFACLTWFSLFLAWEMIDKRRSFFRMQPKSKLYFTQWMHDIWRNQFLFWAIILGVVTLFPIQYIPVISDTVFKHKGITWEWAIVFIAAALFFGGIEAWKFAKRAYFRHQAAKS

SEQ ID NO: 168269 - protein, 92 aa, Triticum aestivum; identical to SEQ ID NO: 122424
  unsure (1)..(92): unsure at all Xaa locations
  Clone ID: PAT_TA_62687.pep

SEQ ID NO: 168270 - protein, 83 aa, Triticum aestivum
  Clone ID: PAT_TA_62688.pep
AIRRAMQVGVNSGICQLRSGDMLQGNTRCREKALSEASGPENRPKVPQRPRIVVFDFSIDVYLLSICIVYLMLIFFFFSFFFV

SEQ ID NO: 168271 - protein, 210 aa, Triticum aestivum
  Clone ID: PAT_TA_62689.pep
MAQQAPTMQIDNLLAQVKVLGSSLNVADRAKVQKSLLDALSHVETPYEHMLRLSGSHLQLACIRFGADIGLFKALVESQEPLTCSYLGEKLNANANILGRILRLLASARLVKQTGLDTFTAEKITQELAAQAMESGAHLLFDIHNRTYQALPDYLCENKSKDVDNMHNGIFQKAFSTDLSCYEYLVPHPKLQGFMQDAMKLNQTEGDWLS

SEQ ID NO: 168272 - protein, 169 aa, Triticum aestivum
  unsure (1)..(169): unsure at all Xaa locations
  Clone ID: PAT_TA_62690.pep
DAEFSPSLLXSAVYLLQLIQQISTFAINYQGRPFRESLSENKGMFYGIVGVSGLAFACALELFPDINEGMKLVPFSEEFKTNMTAVMVVDYAACWIIEVSLKKFFSDYRPRDIAERRPEQLEREAVRRAVVQKKKEEEEEKKRLEKVAEFERKVEERRRKIEEWRAGRT

SEQ ID NO: 168273 - protein, 172 aa, Triticum aestivum
  Clone ID: PAT_TA_62691.pep
MSVSKQWTRVRTLGRGASGAEVFLAADDASGELFAVKSASAACAAALRREQRVMAGLSSPRVVSCIGGRGAPDGSYQLFLEFAPGGSLADQMATGLDELAVRGYAADVAAGLAYLHSAGMVHGDVKARNVVIGADGRAKLADFGCSRKAGADVPIIGGTPAFMAPEVARGEE

SEQ ID NO: 168274 - protein, 124 aa, Triticum aestivum
  Clone ID: PAT_TA_62692.pep
MPPVLPFDTNGADEMLLLDMISQYHHVQHAAFFSTIAPVKREASQEEDKAAVDVGRAFRGVRKRPWGKNAAEIRDSTRNGVRVRLETFNSPEDAEMEYDEADFAIRGGDDVLNFSGEHVRRSLE

SEQ ID NO: 168275 - protein, 234 aa, Triticum aestivum
  unsure (1)..(234): unsure at all Xaa locations
  Clone ID: PAT_TA_62693.pep
MWNAAFLASLFLIPLATGAPAIRIEERQAPCQNVHIFLARGTDEPYPGRQSSVVSAICSGLPSCDYENINYPAGFNTYCSSIYAGITGGLLQITTYANRCPNSKIVLSGYSQGAQLFGDILGGGGGQSLGCTQPSNPALNPANSPGNKIAAALFFGDPRYVANQAYNTGTGASRSGINPRNGAQLTSLNLFSSVLRSWCLAGDTVCAQGTDPTAHTSYFNVXSQEAGVXVKTXV

SEQ ID NO: 168276 - protein, 96 aa, Triticum aestivum
  Clone ID: PAT_TA_62694.pep
IRPPTLYPWACSVNETRIFIHIPATPMPFIQYPTRKKVSPKAPRMYIPHPIYMYRKYLHRKRTRKRGRPHCHTCIYHDSAILRLTHVRHLVPQHVT

SEQ ID NO: 168277 - protein, 79 aa, Triticum aestivum
  Clone ID: PAT_TA_62695.pep
MATELTAAQLGAYDGTDASQPIYVAFRGKVFDGSDGRGFYGTGAYYALFSGREAARALAKMPTDTLDVSVYLSVLSHKE

SEQ ID NO: 168278 - protein, 93 aa, Triticum aestivum
  Clone ID: PAT_TA_62696.pep
MSGTSDYWRGSMAWDPNQQESHHLALGTPMRPISGVPVIRSGPARTPVTESNPFTDPPKPKPEGDGLGGSTGAGSVTSRDGSFGSPSRFQERI

SEQ ID NO: 168279 - protein, 91 aa, Triticum aestivum
  Clone ID: PAT_TA_62697.pep
PLEAGGPGKIQKKKKKKKSSGRSDVQVLPKNTSSASSPSSSSAAKDSGHSEKNKKQQGVKNEERKEKKRSNLDRAALTTPHFPFHSRPGLL

SEQ ID NO: 168280 - protein, 152 aa, Triticum aestivum
  Clone ID: PAT_TA_62698.pep
MNPHQKNKVDVKSLTPEEQRLFRLYGKLPSRSDHFAKHLKDRKYFDSGDYAMSKAGKGDGVDAGAVGSQHPLPENIPHLSSPVNGSGTNVPKHHGSVPGIQAGSPIKESSFLKSETSVDETQGDNVDKPQGADAAAAPEPVAAGGEGIPIRR

SEQ ID NO: 168281 - protein, 129 aa, Triticum aestivum
  unsure (1)..(129): unsure at all Xaa locations
  Clone ID: PAT_TA_62699.pep
MLIQLSRATRARSAVAAVSRVARPNAVQVRGFIAPTVSRKADFVQELYLKELKAYKVPVVKESDAEGNVXTFSVPKTPASPEETDLAGNLKEYESMAVEIEGQDTSAQSAGAPKVADWLEAEEDEEPHH

SEQ ID NO: 168282 - protein, 175 aa, Triticum aestivum
  Clone ID: PAT_TA_62700.pep
KFTTIINISLIMCEPSSNDQESADSRETDQGIAYKDLSPEQQEMSDILYKMESHDLNLLGIADLGRDGIFRYLDADRNIHYAIALRPALIKALLDRLPYDMAEEKFWRGVDGTKVPKEQWYDPPPGILPPPLSEEHRKEGREINKRLKGKMDKIVEDIENYKERLVFIESDNKLE

SEQ ID NO: 168283 - protein, 65 aa, Triticum aestivum
  Clone ID: PAT_TA_62701.pep
MAKDKIHISIAVIDHVDSGKSTTIAHLIYKLAGIDKRVIERVENEVAEMNKRSFQNAWELDKLQD

SEQ ID NO: 168284 - protein, 203 aa, Triticum aestivum
  Clone ID: PAT_TA_62702.pep
LLQNTFLPIECITLADLFSAAIASRGLQDFFDKHCRAEHPAGTRWLDTVRNQPIFSEAAEKVELLETVTLTNPPNNFDYPNKEDKKEAKKEAKKEAAPAPAAAAAPAEAPAADEAPAAPKAKHPLEALGRPSFPLDEWKRKYSNIKDHNEAMKYFWDNFNFEEWSIWKVDYKYNEELTLTFMSNNLIGGFNNRLEGSRKYIFG

SEQ ID NO: 168285 - protein, 67 aa, Triticum aestivum
  unsure (1)..(67): unsure at all Xaa locations
  Clone ID: PAT_TA_62703.pep
MVATKTGELRALFLSLDRHADGRISAAELRGCMRATLGEDVLAEEAEALVASADADXDGLLCQAEFL

SEQ ID NO: 168286 - protein, 106 aa, Triticum aestivum
  Clone ID: PAT_TA_62704.pep
QYAPAPPSPADPKIAPPGLHISDRAPLPPPPPSPWSSKNHPTTAAARPLIDRWMAAMMVAARQGRELQRYSASTGGRIVVGCIPHRVRDDNGEAEVLIICSGQKGA

SEQ ID NO: 168287 - protein, 96 aa, Triticum aestivum
  unsure (1)..(96): unsure at all Xaa locations
  Clone ID: PAT_TA_62705.pep
MTKRTNKVGVTGKYGTRYRASLKNRVXKMEITQHAKHTCTFCGKVTAKRQATGIWDCKSCKSTVAGGAYTVATPAAGAMRSSLFLSDTLLRFKGGL

SEQ ID NO: 168288 - protein, 160 aa, Triticum aestivum
  Clone ID: PAT_TA_62706.pep
QTHSCLEDSFPSRSASEFRVNGWPPATTAQQKQAQGSVEERHPVRADDCPPNPRPPPRARAPPSPSSEPPSPASAGAATSRTPHSWPGSVPSTQPTSPVTTTSSTGPTARSCRPTGTTRCSCQTPRLPTPSTDATSPSISSRNAMAPRPGSSPTAAAGEV

SEQ ID NO: 168289 - protein, 239 aa, Triticum aestivum
  Clone ID: PAT_TA_62707.pep
MDAIQEQFTLLSLGLFTIGVRMVVRTRSVGFSGWQLDDYLMPITGIIFTAETVAAYLVGAKFQGLTNSYMTDEERANIDIDGEEHYNRVWGSKIQVIGWSFYACILWCLKFCVTAFYARLTSGLSHLRIRVIIAYVILGITYAVVFFTILLSCQPFHHFWQVNPDPGLICQPTKSPAYVLVVVIPNILTDIYLLSIPLPLLWGVNISLRRRLTLMLLFSGALFIMMAGTIRAVTILTRC

SEQ ID NO: 168290 - protein, 195 aa, Triticum aestivum
  Clone ID: PAT_TA_62708.pep
SVKHLPIPHVDVQERFLFRQVEPKESMVFRCVARYGYRDTLEMAGDFVATLVEYLQYYVRDLSLYCTAEPLRTSYPSIRIDSFRWEKKPSGRSGHSGHGHGIHAEEMLTPIQSFSELTMHQVGMSNRLPQFQTAKMNLEEMLRIEEDQKVIQREVDNGVVYILGETEVVVKTHSNLLKKIAANYIFDFLRKNSRK

SEQ ID NO: 168291 - protein, 78 aa, Triticum aestivum
  Clone ID: PAT_TA_62709.pep
SDATGYLVLPDPRTYRHVIGPNGSKVNAIRKESNCKIQVPRDQAKDEAIEIVGTKEGVELAKDLILEAVREGSNKTRE

SEQ ID NO: 168292 - protein, 32 aa, Triticum aestivum
  unsure (1)..(32): unsure at all Xaa locations
  Clone ID: PAT_TA_62710.pep
KPEGLFFFFFNFXFFFYFFFFFFFYFIFXFFF

SEQ ID NO: 168293 - protein, 161 aa, Triticum aestivum
  Clone ID: PAT_TA_62711.pep
MDHSHMDHSGMDHGDMDHGHGGGGMTDMCSMNMLFTWDTNNLCIVFRQWHVRSTTSLLFSLIAVIILAIGYEALRSVSRRYEQSLDNRVRSVPRQSQGQADQRAHLIKAVLYALQNFYAFMLMLVFMTYNGWVMVSVSLGAFLGYLFFGQRTSATKENACH

SEQ ID NO: 168294 - protein, 175 aa, Triticum aestivum
  Clone ID: PAT_TA_62712.pep
MAAVEGEKKMITLKSSDGQEFEVEEAVAMESQTIRHMIEDDCADNGIPLPNVDSKILSKIIEYCKKHVQASPKPADSGAAADANSSTSTAAPASAEDLKSFDAEFVKVDQATLFDLILAANYLNIKGLLDLTCQTVADMIKDKTPEEIRKIFNIKNDFTPEEEAEIRRENQWAFE

SEQ ID NO: 168295 - protein, 114 aa, Triticum aestivum
  Clone ID: PAT_TA_62713.pep
TELEKTSDNRDTIYLRQSLVLAHLQLGDTARATEELEKGMRRVPWLYCGLFQELNLDTPPSIWGISADSDSRSFWVTLYIHQAKDLWNNAQVTSLLTTEVKNLEKVDTSVLACL

SEQ ID NO: 168296 - protein, 256 aa, Triticum aestivum
  Clone ID: PAT_TA_62714.pep
MLLSTRFQARALRQLISKQPSRSISTSAAKSLLITPSTQLTAKSLTTFNSSTPRSASFATSAEATAEPVNTNFAAVSTGGIPYPGIPNIEDPYKKRQWQLEHMAGAFRVFARMGFTEGAAGHISVRDPVDRNTFWINPMGVHFGMLKASDMVHINEDGQVIGGNRVAVNAAGFTIHSAIHKARPDVDAACHAHSKYGKAWSTFGKPLDMISQDACIFYKDHSVYSDFGGVVFEDDEGARIAQALGPKKRSVILQKH

SEQ ID NO: 168297 - protein, 246 aa, Triticum aestivum
  unsure (1)..(246): unsure at all Xaa locations
  Clone ID: PAT_TA_62715.pep
MWKFVVTGMLAMASAVSAAYPNPGPVTGATRVHDPTVVKMPQGGYLMAHTGDYVTLKTSTDRTAWKEAGAAFPNGAPWTTQYTKGEKNLWAPDISYHNGQYYMYYSASSFGQRTSAIFLATSKTGASGSWTNQGVVIESNNNNDYNAIDGNLFVDGDGKWWLSFGSFWSGIKMIQLDPNTGKRTGTAFYSLAKRDSSVEGAVEAPFITKKGNFYYLWVSFDKCCQGAASTYRVMXGRSSSVTGPFV

SEQ ID NO: 168298 - protein, 168 aa, Triticum aestivum
  Clone ID: PAT_TA_62716.pep
MGKEKTHINIGVIGHVDSGKSTTTGHLIYKLGGIDKRVIERFKKEAAEMNKRPFKNAWVFDKLKAERERGITIDIALGKFETTKYYCTVIDAPGHRDFIKNMITGTSQADWAGLIIDSTTGGFEAGISKDGQTREHALLAFTLEVKQMICCCNKMDATTPKNSKARYE

SEQ ID NO: 168299 - protein, 159 aa, Triticum aestivum
  Clone ID: PAT_TA_62717.pep
MVQSAILGFPRMGVNRDLKKATEAYWGGKISQSDLLAEAKRLRLAHWKIQQDAGVDIIPSNDFALYDHVLHQIQDFGAVPERYTKDGLDPIDQYFAMGRGHQKEGVDVPSLEMVKWFDSNYHYVKPTLQDGQTFKLAESPKAVADFKEAQDAGISTRPG

SEQ ID NO: 168300 - protein, 131 aa, Triticum aestivum
  unsure (1)..(131): unsure at all Xaa locations
  Clone ID: PAT_TA_62718.pep
MAVPLLTRKIVKKRVKHFKRAHSDRYIXSSWRRPKGIDSRVRRKFKGCTLMPNIGYGSDKKTRHYLPNKFKKFVVHNVSELELLMMHNRTYCAEIAHNVSTKKRKDIVERAAQLDIVVTNKLARLRSQEDE

SEQ ID NO: 168301 - protein, 100 aa, Triticum aestivum
  Clone ID: PAT_TA_62719.pep
TRWEGGPRAGGDARGTGVLDPQMRRAGERASCLRKRKQRPRLRFGSSFRPGEPQDRQEVPTSLPHLAAAWRLTGWGGRQPFLVFFLFCFFFFFFFFFFFF

SEQ ID NO: 168302 - protein, 56 aa, Triticum aestivum
  unsure (1)..(56): unsure at all Xaa locations
  Clone ID: PAT_TA_62720.pep
PAARGVGPGNSQXKKKIXILKKKKKKKTKKKKKRAQKKKKGPERPRTRTLNGIFRG

SEQ ID NO: 168303 - protein, 156 aa, Triticum aestivum
  unsure (1)..(156): unsure at all Xaa locations
  Clone ID: PAT_TA_62721.pep
MKPGTEPATGVPVGGAPGAPTAWSSGLFDCFDDCGLCCLTWCCPCITFGKVAEIVDRGATSCGTSGALYVLLASLTGCHWIYSCTYRSKMRAQYALPDAPCCDCCVHYCCEPCALVQEYKELKARGYDPENGWHLNVERRNGGAGVNPPGMQEMXR

SEQ ID NO: 168304 - protein, 92 aa, Triticum aestivum
  Clone ID: PAT_TA_62722.pep
ISLSGMPMHMLHQIPHGIQEQMQFMQAATYGAQHKPQTSWGSIPQRPGTSGSMTPHQKPSLPAYGGYAQSIPPAERSNVGLPSRYRASKLKG

SEQ ID NO: 168305 - protein, 159 aa, Triticum aestivum
  unsure (1)..(159): unsure at all Xaa locations
  Clone ID: PAT_TA_62723.pep
EKXXXKXXKKKKKKKKKKKKKKKKKKKKKKNPFSFSPQKKLNLFLKPFQSFFPQNFQNGPLVLLEPPRGFLDQRLVLVQTLNPLLSKPEKLWFKSRDHGKMANRKKLWGRFGIGLSLKKAKEKGKGQKEKKGKKWEKKTATATFRGGRMANTKLELAYI

SEQ ID NO: 168306 - protein, 181 aa, Triticum aestivum
  Clone ID: PAT_TA_62724.pep
DSGIHSGNIQTAIETLNDFDPEILDEDKALHFSLLRLQLVELIRTCNTPGGDIGPALKFATEQLGPRAPTNNKFLGDLEKTMALLMFPSDSLEPELAALLKPELRLEVADNVNRAILERQSQRRESAIRQLVRMRVWAENTARDKGKSLPEYLELGLYNDVPDLGRLPPQTRNGHDPMITT

SEQ ID NO: 168307 - protein, 237 aa, Triticum aestivum
  Clone ID: PAT_TA_62725.pep
MASSSKQPPKGILKKPKSIQERNADPKEIALAHANIIQHRKDLEAEILESLVILSEYPQVRKPPHNASNPASSDIADFKSHVRLFQPSDYDDLIIERNVNDLCGYTLCPRPRRNMGPGGQWKIASNGSIMKREDLEKWCSQQCARRALYVKVQLNETAAWERAGIPDIEIDLLDEDKSQETDVDRAARELGKLKLEEQRQAARDTAALALERGEPDASKKQSKKINITLKEKDAKAP

SEQ ID NO: 168308 - protein, 107 aa, Triticum aestivum
  unsure (1)..(107): unsure at all Xaa locations
  Clone ID: PAT_TA_62726.pep
NGTSEGLFCLRRSKSDDRSQPAKGSRRERXEQPERRARHGDATRNGERQTGQRRHRQEXSTSEXEDARERREKQSRTATAPPPPPARRHSRNRHAAAAGPFFFPPPP

SEQ ID NO: 168309 - protein, 106 aa, Triticum aestivum
  Clone ID: PAT_TA_62727.pep
RRARGRRGRGGPSGGGTGGAAPAPPQPPGVARNTASRTRGCCRRRPARRSTGRTAGRTACASRRTPHPTSLNMMEGSIDRKFGLSRNQPSGCSYVVRPGGTVLVLA

SEQ ID NO: 168310 - protein, 129 aa, Triticum aestivum
  unsure (1)..(129): unsure at all Xaa locations
  Clone ID: PAT_TA_62728.pep
MGLLLLPAVALAALIVYYVLFPKKQTGLPLPPGPKPLPIIGNLLDLPPAGTAEHQHWAKHKELYGPXSSLNILVQPMIALNSPDAMHELLENTSTKTSSRPHRNVCRRALWSPSDASSYPLRLQAPDTF

SEQ ID NO: 168311 - protein, 136 aa, Triticum aestivum
  Clone ID: PAT_TA_62729.pep
MATRRTILLAMAAMVILSTASAAIYNVGEPGGAWDLSTNYGIWASSRNFQTGDQIVFKYSTQAHDVLEVSKADYDSCSTASPVITFNSGNDVVTLVATGTRYFICGFPSHCAGGMKVKIDVMPGSSSTSPAPASGP

SEQ ID NO: 168312 - protein, 244 aa, Triticum aestivum
  unsure (1)..(244): unsure at all Xaa locations
  Clone ID: PAT_TA_62730.pep
MADRFPSLEDFDSGAQTDIKDPTAEPSTDDFLAREKALLGDDAEQFTTNNDAAAFADADDDLLGGAGGNEQSTFESQFPDLTQPEAGTGVSAGTAITGGPSVSYNSGYQAASFEEEQEPEVIKEWRESRDNKIAKRAEQFAAQREETIKEAQQNIDDFYDNYNNKKEKGIAQTRKEADEFLESREDTVSGGTSWDRIAKLVDVSGKGAKGGCSGSGKXRFRELLVSLRKDEKRLALRPTNVSLF

SEQ ID NO: 168313 - protein, 89 aa, Triticum aestivum; identical to SEQ ID NO: 130083
  Clone ID: PAT_TA_62731.pep

SEQ ID NO: 168314 - protein, 219 aa, Triticum aestivum
  unsure (1)..(219): unsure at all Xaa locations
  Clone ID: PAT_TA_62732.pep
IKFKKKKKKKKKKKKKKKKKKKKKKKKKKKKKKKKPPPSRFPPPPPFAAEAETWGGKKFGWELWRRNNPNGIRFGKGGLCWKNRKKPPIVRITRPPPPKRERRFVLKAKRGXGIYRTRGKRGGRNPPGPKGIVXGKPKPQGIPQLRFQRNKRFVVEKKLGPRLGGFRALNPNGGKEDPPKKNFEATLVEGAKRVVRNNPGINWFXKPGHKHRELRGPPS

SEQ ID NO: 168315 - protein, 137 aa, Triticum aestivum
  Clone ID: PAT_TA_62733.pep
MVSSMKQYRDQADAPSPLSLSLSLGVVSDSSKKMHRGGADGEFVCKTCSRSFPSFQALGGHRTSHLRGRHCLALGLAAGSDQPGTKKTVDQKQAHRCHVCGIGFEMGQALDGHMRRHRGQEAATTAQAPPVLLQLFL

SEQ ID NO: 168316 - protein, 186 aa, Triticum aestivum
  Clone ID: PAT_TA_62734.pep
LGDSFLVCARQAQQVTGSTKPMEEARGHQGIPAFGEWNYGDGDDWPVLAQRFESAMHTQLPVHKACKRARACRRRRFPAFGDWNNLGDGDAGGWTTAVVNQYFEPVTAHKSLKEEFNGYHSGVVAMGKQQHKVARQTWVDDSGTHVAMQPFSFVAVKAVDDDLYDVPPDMLCAKPLRKGRTWLRRP

SEQ ID NO: 168317 - protein, 235 aa, Triticum aestivum
  Clone ID: PAT_TA_62735.pep
MASGYDRALSVFSPDGHVFQVEYAGEAVKRGTCAVGVKGTDVVVLGCEKRSAMKLQDTRITPSKIQLLDHHVALAFAGLNADARILVDKARLEAQSHRLSVEDPVTIDYITKYVAGVQQRYTQAGGVRPFGISTLIVGFDHGSDVPRLYQTEPSGIYSAWKANAIGRSSKTVREFLERNYKEDMNREATIRLAIKSLLEVVQTGAKNIEISLMAPGATIETLPTSEIEGYVREIE

SEQ ID NO: 168318 - protein, 143 aa, Triticum aestivum
  Clone ID: PAT_TA_62736.pep
MALPWRTRASTYLCLMDTETRVLLPLNAHPEQNYGVAMIKKTVPAAKPQPTCTCGLDSASEQLPVSRNVVDKPGNVIDHDYPIDAEFLEIIVHHIFSHSIFRPVFFILPPYLRNQTATKPICLNPLLHAAYAPAPPALQHSTP

SEQ ID NO: 168319 - protein, 202 aa, Triticum aestivum
  unsure (1)..(202): unsure at all Xaa locations
  Clone ID: PAT_TA_62737.pep
MDQIHQSAHQAPTDKKRESVPDMFDNSAGEIAVCDMEKQKAAEGNAHFHRLGWKRLTVVLIVEAIALGCLSLPSAFATLGMXXVVTPTAGLGFVAIYTSHVVGQVKLAYPEVSHYADAGKLMFGKFGYELVGVMFSLQLIFLVGSHCLTGTIAFLNLTDNGTCSVVFGVVSAIILLIVAIPPSFAEVAILGYIDFVSIIVAV

SEQ ID NO: 168320 - protein, 73 aa, Triticum aestivum
  Clone ID: PAT_TA_62738.pep
MGLPTFSESTTTTTASSQTPQEQQTNNSTGVATGAGANTDAGVTRPKTEAELEADRLYEEAMEEEYAKRDGGS

SEQ ID NO: 168321 - protein, 222 aa, Triticum aestivum
  unsure (1)..(222): unsure at all Xaa locations
  Clone ID: PAT_TA_62739.pep
MASAEAPAARPILYSYWRSSCSHRVRIALNLKGIDYEYRAVNLLKGEQSDPEFMKLNPMKFVPALVDGDAVIGDSYAIALYLEDKYPQRPLLSXDLKKKALNIQIASIVCSGIQPLHNLTLVRFIEQKVGTGESIPWVQQQIDRGFTAVENMIKGCAGKFAMGDEVQLADVFLAPQIFAAVTRYQTDMSNYPTLARLHGQYMTHPAFEAALPDRQPDAPSSG

SEQ ID NO: 168322 - protein, 130 aa, Triticum aestivum; identical to SEQ ID NO: 122616
  Clone ID: PAT_TA_62740.pep

SEQ ID NO: 168323 - protein, 149 aa, Triticum aestivum
  unsure (1)..(149): unsure at all Xaa locations
  Clone ID: PAT_TA_62741.pep
MQKKRASTKIHQIIKRSSKFISMGAGMKRAREEEPIVSLALSLSTDSSVSTXDSDDSGTGAPAAKKRTRRGRVVAMSGEGEFVCKTCGRAFETFQALGXAHRTTHHRGRHGLFLGVRAARVIREWXRCEDRHRQQHDWHICGLGFETGP

SEQ ID NO: 168324 - protein, 69 aa, Triticum aestivum
  Clone ID: PAT_TA_62742.pep
DHDVIGICAWIVSYRSSLNTTLVLSNPPTHKTKNSSGLPVAPPPSIRASKQNKCGHPHHRILLRLQIRP

SEQ ID NO: 168325 - protein, 85 aa, Triticum aestivum
  Clone ID: PAT_TA_62743.pep
HLAVVRHNSHGLGAKSLSGLAAREETKDDGRVDTVLRVVTHDVLCHDIVGLRTVTESLAKNSITECSFINTDELTTSRKTVDLSQ

SEQ ID NO: 168326 - protein, 86 aa, Triticum aestivum
  Clone ID: PAT_TA_62744.pep
MSDDEGISIYDEVEIEDMTFDEAMGVYQFPCPCGDKFQITLEDLLDEQDIAVCPSCSLMIRVIFDLDDLPKPPTSGASGGQVPITA

SEQ ID NO: 168327 - protein, 163 aa, Triticum aestivum
  Clone ID: PAT_TA_62745.pep
TMSWSMPSLGGSSVPRRMSLISDGLRPKMFISLRQRTTREDGTGLTTTGIGIGIPNIVFFSRTTTRHRYLDPPSFPASTQTASSVLKTPLPYPPVRVTDPEVLSCPTATATPTHRLKAALARLTTTTCLPPAIVTAAVDATVIKSIHSPPQDTNSNPPLETTP

SEQ ID NO: 168328 - protein, 145 aa, Triticum aestivum
  unsure (1)..(145): unsure at all Xaa locations
  Clone ID: PAT_TA_62746.pep
MALTAALGRRGAEQDRDGGGSNGGNGNGGGEARMIMREHMFDKVVTPSDVGKLNRLVVPKHFAERHLLPRVPGGAAGADCPEAVLRFQDGFWXFLTPAPFPFSYWSSSQSYVITKGWSAFVRDRRLAAGDTVSFCRAGAPLFIYC

SEQ ID NO: 168329 - protein, 90 aa, Triticum aestivum
  Clone ID: PAT_TA_62747.pep
GPGFPVLTFADNPSIHSAICKVSLCRPIRIQNDDEIQVCCAGDPDVGDHGALRRVELGAAVGRQCADRSVRCRRSQRQVHPPASPATVSA

SEQ ID NO: 168330 - protein, 110 aa, Triticum aestivum
  Clone ID: PAT_TA_62748.pep
ARPEPDFPIGTGDRFNKGKVVPKGLSTSDRNLKSILTPTEVNSALEGLAKQFKEVELIYPPHKTYRGFQDPAAARLERTPSSSSSVVHTPVSAVAQTMSSTGSSDLLHAR

SEQ ID NO: 168331 - protein, 62 aa, Triticum aestivum
  unsure (1)..(62): unsure at all Xaa locations
  Clone ID: PAT_TA_62749.pep
XSRSGLLGFTLFTLSSPTSPRTSVELRFLRSTSSRDSPLSLITPSLLLSLVMTRPIPSPVVR

SEQ ID NO: 168332 - protein, 224 aa, Triticum aestivum
  unsure (1)..(224): unsure at all Xaa locations
  Clone ID: PAT_TA_62750.pep
MEEEPPPAEPRSQRFVLWLHGLGDSGRANEPVAGYAFAGARWAFPTAPTAPVTCNRGMLMPSWFDIHDTPITSKSARDEADVLRAVERVHAMXXHEISAATRPEDVFIFGLSQGGALSIASVLLYPKTLGGCAVFSGFLPFGASFASRVTAEAKKTPVLWVHGRADFLVPIEAGKDGTKFLRRRLGMRCELKVYDGLGHXLAPYELQYCEQWAAGGGWWLPTTT

SEQ ID NO: 168333 - protein, 91 aa, Triticum aestivum
  Clone ID: PAT_TA_62751.pep
MSEKKRAPGPRKDEVVTREYTVNLHKRLHGCTFKKKAPNAIKEIRKFAQKAMGTNDVRIDVKLNKHIWSSGIRSVPRRVRVRIAFFFLPPP

SEQ ID NO: 168334 - protein, 91 aa, Triticum aestivum
  Clone ID: PAT_TA_62752.pep
ICAKPISLHIYRPLKAILHRVHLTAGARDDPAVDWNGARNNATKSAIAGTSSTEFEARLCSLGSLLRVHGMLGLGLVCLQRLGGSHGREFL

SEQ ID NO: 168335 - protein, 67 aa, Triticum aestivum
  Clone ID: PAT_TA_62753.pep
KEEHHMPLPPQSVACAPSMTSWPEPSKKGEVPVRAAVRTTCYVRAWPWHRHPHLSPYTFPALNPCCG

SEQ ID NO: 168336 - protein, 92 aa, Triticum aestivum
  Clone ID: PAT_TA_62754.pep
QNTHIHHFKMQLSTFVASVLAVTASAAPSFPKPTITDTRSAIDTLGSLSGYFNLVAEKVKAAKAYDVAPACDLSQDTEALDGQLLPPSKGLY

SEQ ID NO: 168337 - protein, 234 aa, Triticum aestivum
  unsure (1)..(234): unsure at all Xaa locations
  Clone ID: PAT_TA_62755.pep
MPSATGSNWEKYQKNFADDEVEEKKITPLTDEDIQVLKTYGAAPYGTSIKKLEKQIKEKQQSVDEKIGVKESDTGLAPPHLWDIAADRQRMSEEQPFQVARCTKIIADEKGDESKSKYVINVKQIAKFVVQLGERVSPTDIEEGMRVGVDRNKYQIMLPLPPKIDASVTMMTVEEKPDVTYGDVGGCKEQVEKLREVVEMPLLSPERFVNLGIDPPXGXLLYXPPGTERPLCTS

SEQ ID NO: 168338 - protein, 250 aa, Triticum aestivum
  unsure (1)..(250): unsure at all Xaa locations
  Clone ID: PAT_TA_62756.pep
ISDVPQCVDILSDILQNSKLEESAIERERDVILRESEEVEKQVEEVVFDHLHATAFQHQPLGRTILGPRQNIRDITRTELTDYIKNNYTADRMVLVGAGGIPHEQLVQLAEKHFAGLPSSGPQTGAYLRSKQKADFMGSDVRVRDDNMPTANIALAVEGVSWNSEDYFTALVAQAIVGNYDKAVGQAPHQGSKLSGWVHKHDLANSFMSFSTXYNDTGLXGIYLVSRQPDRVDDLVHFAIREWMRLCTTS

SEQ ID NO: 168339 - protein, 134 aa, Triticum aestivum
  Clone ID: PAT_TA_62757.pep
CASSYAPLLTCPVSNNKIVPLTIIKGAGHEHIPIPEGECAIIADFHSVKSQSSHSTPYLTTGFYRVVPGPTRYGEYDYEETKYVLKGRIDITRMKLLARHTTLLPVTGPSSMLDPKPSSQPRLKVSHSTLSPDQ

SEQ ID NO: 168340 - protein, 57 aa, Triticum aestivum
  Clone ID: PAT_TA_62758.pep
RFHVKVINPRQRTSLGKSMENYTEKLYRFDSQRSKHQQLNHAISHQSCPVKEHTTIH

SEQ ID NO: 168341 - protein, 69 aa, Triticum aestivum
  Clone ID: PAT_TA_62759.pep
ASPPSPSPCPPPAPLPGTPPSTSRRPHSSPPAPAAPRRQGPLGRPEGRPRALPPESPRAASTTMPSYNC

SEQ ID NO: 168342 - protein, 137 aa, Triticum aestivum
  Clone ID: PAT_TA_62760.pep
DELAVALGGTVDDACGSWPPWLLAPPLAGVWLGSCCLPAVCMCCRCRLQLPRISCFAATCMREFGGRPPAYVLLAAATLLLERWNAGEPENERCTPEAGGAQALRRQAAAAARVLRRRASSSPWLCACVRECGCVRW

SEQ ID NO: 168343 - protein, 134 aa, Triticum aestivum
  unsure (1)..(134): unsure at all Xaa locations
  Clone ID: PAT_TA_62761.pep
MSAETERSSTESSAASGLDFEDTALTLTLRLPGDPDRKRGASSSSSCSLADRSSLLAEAPPAPKARAVGWPPVRSFRKNALENVAAGSTRAACAPAKFVKVAVDGAPYXLRKVNLRDYPGYDQLLRALPGKPCS

SEQ ID NO: 168344 - protein, 101 aa, Triticum aestivum
  Clone ID: PAT_TA_62762.pep
SFSRCLHSISGHIAIEEPDITSVAIAPGRVDTEMQGVIRSGGKESMNQAQYESFVDAKEKGILLKPEQPGNVMAKFVADPLKELSGKFFSWNSPEVKAYQE

SEQ ID NO: 168345 - protein, 248 aa, Triticum aestivum
  unsure (1)..(248): unsure at all Xaa locations
  Clone ID: PAT_TA_62763.pep
MSEHYPTLAQTALVAAAFKILLFPAYKSTDFEVHRNWLAITNSLPLEKWYVEKTSEWTLDYPPFFAYFEWILAHVARLVDPLMVKVYNLDYDSWQTVYFQRTSVIVTELVLVWALQTFIETAPLKSRRAAQTVALSIILSPGLLIIDHIHFQYNGFMYGILVMSLVLARQNSELLSSGLIFAALLCXQHIYLYLAPAYFVYLLRAYCLSSKSIFRIRFLNSIKLGLGIGAIFGAAFGPFAAMDQIPQL

SEQ ID NO: 168346 - protein, 73 aa, Triticum aestivum
  Clone ID: PAT_TA_62764.pep
HARTRQHAAAQQAVDILHEISTILNCHLDRRTLSICISMIERGVNPEALAQVIKELRQEGQRMEPPAAAARRR

SEQ ID NO: 168347 - protein, 201 aa, Triticum aestivum
  Clone ID: PAT_TA_62765.pep
MLKHLPKERITGDVSKTAGQSSAEEARAADALALRGRLGGELGAPRSVRDVGMSSTSFPLLTRTNYPSWSVMMKVIMEARHMRKAVDTGDVEYEEDRLAMEAILRSVPPEMVLTLGAKETAKEAWDTIKTLRIGVERVRESKAQTLWLQYEEIRFKTGEQVDDFALRLQDLVNKLATLGDHINNKMVILKFLPLVPRQYKQ

SEQ ID NO: 168348 - protein, 144 aa, Triticum aestivum
  unsure (1)..(144): unsure at all Xaa locations
  Clone ID: PAT_TA_62766.pep
MGRTLDVLLGRTTKQTARLKSLLGLATKRIAVVRAHREVRCAQAXGDVEQLLRQGHPDRALLRAEQVIRERDTLDVLLLLDAYCALLADFSALLDAHRDCPEELLEAAAGLCYAAARCGDLPELHEARALLDAKFRRGFPPAAA

SEQ ID NO: 168349 - protein, 168 aa, Triticum aestivum
  unsure (1)..(168): unsure at all Xaa locations
  Clone ID: PAT_TA_62767.pep
MGQAVSAASSPFRRKSQPPPVPQATAPPAAKDHDTELVRIFRRYDTDGDGRISAAEIREIWGCTDAEAQEMVASXDSDGDGLISIEELGALLKGGGSEDLPAAFAKFDENGDGVITPDELRRAFLQPLLGREKHTLEECTRMVAAFDQDGDGVLSFDEFKTMMAPKSA

SEQ ID NO: 168350 - protein, 123 aa, Triticum aestivum
  unsure (1)..(123): unsure at all Xaa locations
  Clone ID: PAT_TA_62768.pep
ISQASTPASSVLTASSQSLASFPRRHPPRKGGCLAAAATAGAAPXAASARNGLRTGARCSPTWRPPPAPPPWSCPPPPTRGAPAGSRRPARPVAATAPPAIAELQADAPAALATDLPPRMLGA

SEQ ID NO: 168351 - protein, 80 aa, Triticum aestivum
  unsure (1)..(80): unsure at all Xaa locations
  Clone ID: PAT_TA_62769.pep
MADQLTDDQIAEFHEDFSLFDTTDMLXIITKELGTAMRSMRQNTTEDEIQNMINEDHDDGHGNHRPPIVTPTDGPQDERH

SEQ ID NO: 168352 - protein, 171 aa, Triticum aestivum
  Clone ID: PAT_TA_62770.pep
GNCRAFFLGSRIGVEILDLDDRWTLVTAMSMPDHLIVVSRRRAALGGVCMRLFLLSLSEGTTSSQHLGVEGLEVDPEVDVVAVAHAVLVAVLGMEVLDEDAVVVETCRCRHAIRNSSCDCPHGGRRRPCCRSSVRSCGRGPHRLLSLVVRRRFGDCTEREHCWSGDCVLYL

SEQ ID NO: 168353 - protein, 114 aa, Triticum aestivum
  Clone ID: PAT_TA_62771.pep
MARVALVAVFAVLAALAVAEMASGAVTCGDVTSAVAPCMSYARGQASAPSGACCSGVRTLNAKASTPADRKAACNCLKNLAGSGITMGNAANIPGKCGVSVSFPINTKDNCNHL

SEQ ID NO: 168354 - protein, 106 aa, Triticum aestivum
  unsure (1)..(106): unsure at all Xaa locations
  Clone ID: PAT_TA_62772.pep
MQSPLLLHSSSETPPRPTPPSASMAPFAEKKPAANKPVEEESAAEKAEKTPAGXKKPMAEKRLPAGKLTAAAKEGGTAKKNVTKSVETHKIYIFSALKPVQLRRRN

SEQ ID NO: 168355 - protein, 163 aa, Triticum aestivum
  unsure (1)..(163): unsure at all Xaa locations
  Clone ID: PAT_TA_62773.pep
MGKEKTHINFVPIGHVDSGKSTTTGHPIDKLGGIDKRVIERFEKEAAEMNKRSFKYAWVLDKLKVXRERGITIDIALWKLETIKYYCTVIXDAPGHRDFIKNMITGTSQVDCAALIIDSTTVGYDDDISKDGQTREHALLAFILGVKQMICCCHRMDATTPKV

SEQ ID NO: 168356 - protein, 119 aa, Triticum aestivum
  unsure (1)..(119): unsure at all Xaa locations
  Clone ID: PAT_TA_62774.pep
MSGFLSKPRETASADMGVTIQYVQARQNFAQPTATSPLEVDVCCSNGIFSRAAVPIGAXTGVYDTLELSDGGSDYSCPGVSKAAINVKSIIGTGSXCKDPTTETETHTFMPPKIDGTPN

SEQ ID NO: 168357 - protein, 140 aa, Triticum aestivum
  Clone ID: PAT_TA_62775.pep
MGRRSGGGGGGGGFRSAPRPAAPAPKPAAKQSSAPAPAKTDSSSAPTSIFGSIGSAVADGVGWGVGTSMAHRAMDSIMGPRTVRVVEEPAPAADACGIQNQAFSNCIYGNESDISRCQNYFDLLCQCRRGGGAGGAATIA

SEQ ID NO: 168358 - protein, 102 aa, Triticum aestivum
  Clone ID: PAT_TA_62776.pep
MRIAWSALLAGAAELSDQDRTISTAFVFQQTALCVLAAYLFCGAGMVWNDWIDRDIDAKVARTKHRPLAMGSVTTTEAMVWMTLQVIMSWGVLRVMLDNKDV

SEQ ID NO: 168359 - protein, 161 aa, Triticum aestivum
  Clone ID: PAT_TA_62777.pep
DRGRWRRPRDRHVALAASATVGATRERGGRRGKQSLPRRVQQACTTSPTTSSSSCSCAWPRPSPSSAPRPRASAGAASSSRTTPRPRTTGSAAPSARPASPATTTSTGTTTSSYRTPWRPTASTDANSPSTFSRPSLTARCPGRSPISRGGPPPLLYEAPR

SEQ ID NO: 168360 - protein, 132 aa, Triticum aestivum
  Clone ID: PAT_TA_62778.pep
GFETRASGAGLQSRPSAVQAGDPVPVRAKRRYRPGTVALREIRHYQSGTKLLLRKLPFARLVREIALSMRPADAGLRWQSQAIMALQEAAEAFMDHLFEDTNLCAIHAKRVTIMQKDIQLARRIRGMWGGLG

SEQ ID NO: 168361 - protein, 94 aa, Triticum aestivum
  Clone ID: PAT_TA_62779.pep
GPYHLMIAMVNEVGAKRNYSPVGYNNVSSTRRHSLLGYCYRCWYCITEKCSFNWTTQRNWKGCYEWVVFGDRLDRPCRHNKYQRILTKYTYHCA

SEQ ID NO: 168362 - protein, 45 aa, Triticum aestivum
  Clone ID: PAT_TA_62780.pep
SLPDEERHDRHHRDRRGNELRSHHHHILNYGRFTQTSFANSAMRR

SEQ ID NO: 168363 - protein, 71 aa, Triticum aestivum
  Clone ID: PAT_TA_62781.pep
VPPRCSSAPSRTRLSASPSPPATSAPSGCTAQHAPPPAIATHQIVDDLQHGLLSTCGIDEVVLSPYPTMPY

SEQ ID NO: 168364 - protein, 81 aa, Triticum aestivum
  Clone ID: PAT_TA_62782.pep
AYNTEWPPASAYGSRTSLLLSGGRRRRLAPRPRRRRDWLWPRGLEGRRGGFRAAADQRGSGMRWVREGAEQERGDVRPGPA

SEQ ID NO: 168365 - protein, 203 aa, Triticum aestivum
  unsure (1)..(203): unsure at all Xaa locations
  Clone ID: PAT_TA_62783.pep
MNPSIVTVAAALVAMVRVGPEELASRLSEVRPVHLFLACFLPAAATVVYLMLRPRAVYLVDYAGFRTPHTCRIPFASFLEHAKLVPQLNERSIRFMTRLLERSGLGEETCLPPAHHYIGTHKYCTVDAARAEFELVAFSAIDDLLAKTGIAPEAIDILIVNCSLFCPTPSLVDMIXNKYKLRSXIRSMHLSGMGCSAGVPALG

SEQ ID NO: 168366 - protein, 136 aa, Triticum aestivum
  unsure (1)..(136): unsure at all Xaa locations
  Clone ID: PAT_TA_62784.pep
MSDTVYPEVLWAQRSSDADVSKNFIYLTISVPDVSKDNISLDLQPTKLNFTGTSSTLKKKYHAELELWGEIDPAESKINHTSKNDEIKLQKKELKEEYXPRLLKDSKRVHFLKTDFDKWADEDEQNEAPEDDFSQF

SEQ ID NO: 168367 - protein, 84 aa, Triticum aestivum
  Clone ID: PAT_TA_62785.pep
HKKRTFTSGGSPSSFSSQLKLSASAVREIPRRDDNGGRDGERGSAAPVGHPCPRRRRRRSEAIGERSRVDRERDRNGDGDAQRR

SEQ ID NO: 168368 - protein, 112 aa, Triticum aestivum
  Clone ID: PAT_TA_62786.pep
FISVLRRGGALVGGAAVEVEHAALAVLGRALAVAPVELLPGVVVAGDVPSLDAHHGARRLLGVAEHHQPGDEEEEGDCQLHGGSHAGVCVRLLNFVCCLGPSMESRPPPERP

SEQ ID NO: 168369 - protein, 96 aa, Triticum aestivum
  unsure (1)..(96): unsure at all Xaa locations
  Clone ID: PAT_TA_62787.pep
RDSCLCRRRSHPRQVRDRQSGHERALSQRGHHQELAEVRMGQAHSYRCIHHRAQATIFYVPMVSSTPSMPTYHKRTAXKHGSYYLNVSNPKEILIW

SEQ ID NO: 168370 - protein, 107 aa, Triticum aestivum
  Clone ID: PAT_TA_62788.pep
SPERGRSEELPPPFSALLPRDTTPERERERDGDAGAGGGGGAAAGAQRAGGGRGAHSPRTSACAYNLTGCAGYMHGTDAPKPPQTCCGPIPNPVNNQTDCLRAPPRL

SEQ ID NO: 168371 - protein, 95 aa, Triticum aestivum
  unsure (1)..(95): unsure at all Xaa locations
  Clone ID: PAT_TA_62789.pep
CIKIXWVLMAVFTKNSVVAVCLGALMLMTTLLSSEGSELVGCLEPHQNCFPDDCQRTCADNIIGKNVTGSCEPEHGPLKPYPALVCCCYRDGLRS

SEQ ID NO: 168372 - protein, 63 aa, Triticum aestivum
  Clone ID: PAT_TA_62790.pep
PYYNRRNRCGAGQLPYELMAPPPGPGITSPRCPEQRHHLVRREEIHGTVGIFPPRYTLHRQLL

SEQ ID NO: 168373 - protein, 147 aa, Triticum aestivum
  Clone ID: PAT_TA_62791.pep
FSSVTSFLAFSSPITLQADSSVSFLRYRNANPPDDAAADTAAPPTARFLQEWRKRAGLPAADPRVPSACACARGENLRVRSEPRARRDMVATAPLFDFRFPRLRRGSRLASILRLGGPSLVSKFCSTIALRCMSTSGEGLVSRYFGL

SEQ ID NO: 168374 - protein, 59 aa, Triticum aestivum
  Clone ID: PAT_TA_62792.pep
PLAAGRAGQYNTGNSPPHAYRPRPPKRAASGPRPSRRPPRASLSDTTPDGPRTPRRTRA

SEQ ID NO: 168375 - protein, 173 aa, Triticum aestivum
  Clone ID: PAT_TA_62793.pep
TLGENPALEAFHPPYPSVEATLHIHHMSLRSSNLRRSLDTAKNPAEGNRVCADLCVLLDSKLRPAGKSGILVLVHLTNDLIRGRGLDTLNSRENIGDLELGDLDTVLVGEDAKWDVLGKSALFTADGCVDSHDGDSDVRLLLGRSSHDGRGEGSDAGEDGGKVHDDVILVLDM

SEQ ID NO: 168376 - protein, 75 aa, Triticum aestivum; identical to SEQ ID NO: 106874
  Clone ID: PAT_TA_62794.pep

SEQ ID NO: 168377 - protein, 91 aa, Triticum aestivum
  Clone ID: PAT_TA_62795.pep
SCIPTGPRPVEAKRITTSSFVFSPLDQLFTRNSPPTDGFESNRTSSRVLTLRSLKGSDRQMHARKGRWNCDFSWLYCNYVVIYLTKTFLLF

SEQ ID NO: 168378 - protein, 91 aa, Triticum aestivum
  Clone ID: PAT_TA_62796.pep
KCLKESYLNHYKLQQLLFQSNTMAPNSKRRFSLSALSPASKRYNKVMNERSDNRRSVDSTASRSTLGGMPVVDVENHLIDPAYRWTTANRN

SEQ ID NO: 168379 - protein, 164 aa, Triticum aestivum
  unsure (1)..(164): unsure at all Xaa locations
  Clone ID: PAT_TA_62797.pep
MPAGHGLRXRTRDLVARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKVRGEVISTKRQPAGPKSGFMVEGTTIETDTPIPYDVVNDLKGGY

SEQ ID NO: 168380 - protein, 214 aa, Triticum aestivum
  Clone ID: PAT_TA_62798.pep
MSIFPRSSAMATIGARDGVKWLSGRGRSNFPGMAHFTGPKQGARQISTQICSDRPTRQGNLALFYPHSLLSLPSEKIVAARRLGTAVLGGPAVVSQQAEGSDGRSGKTATRAPGSRLRPTTRGLCTTMSSQPVPTPSLSTAGRTRTSMADNMVSGESEVVCVDFWANLFGMRVLIALRELGVSFEYIEEDLGTRERSDLVLRMNPVHRMVPILI

SEQ ID NO: 168381 - protein, 68 aa, Triticum aestivum
  Clone ID: PAT_TA_62799.pep
MRPPEEKTTRPEEAGLPAEEAKAIILRDKPGADIIVLPDGSSSDTQFIANRVRIFVNGTTAAETPIAG

SEQ ID NO: 168382 - protein, 234 aa, Triticum aestivum
  Clone ID: PAT_TA_62800.pep
RPGRAVPYLLHLLQALTRSQLSSYYQPWLPRPPHASPSSRKRWSSPRETPSSSPPSSSLWPPSPSSSPRSTWSSSSRSPPRCCTTSPRCRPPTPRAPSTPNKASEYLLLAHRRHTLHVRAKLRRISSLPASQSKERKNGGQAQSGSTGGRSPRGGVPGSRDGGGREWREAARGAGGRRHCACGDGGIAGGRCNPDGGEGRRAQVNVRRRHAPRDQGLRAQPRRALSAGHAMPCH

SEQ ID NO: 168383 - protein, 79 aa, Triticum aestivum
  Clone ID: PAT_TA_62801.pep
PINLLSSSNTPPRHGLLRGAPTPACFSTQALVTNLYDADEQCRSGAGDQPVRRGRADRHGNEEDQAAPRTRLSAASINT

SEQ ID NO: 168384 - protein, 130 aa, Triticum aestivum
  unsure (1)..(130): unsure at all Xaa locations
  Clone ID: PAT_TA_62802.pep
GFTRAVGGGLXNVAGTVESLDTLVAKITGGATIAEIAAEVKKEVEGLTDAAQKTYAEYYVRVFDKLSSNNDWVSKELGRLDGILAKGGLAPSKRDQIQQKTNVLRKFVLKKADEKVEQVKEKVEEVKDEL

SEQ ID NO: 168385 - protein, 72 aa, Triticum aestivum
  Clone ID: PAT_TA_62803.pep
RVQVRSVVSDLSRSLSYHVVNLQPKGITLIGSISHGTDREQAPEIVIAGVPWSFSITGYTVAESLRVGGGGA

SEQ ID NO: 168386 - protein, 105 aa, Triticum aestivum
  Clone ID: PAT_TA_62804.pep
TRPLPRHQALSHGTRQATRSNGALRRAVMADAAGPPAGGGVKSLATRQKLGISYLFDEFVIEPPGYVIIPYKSLCSMFSHQVNKTLWFNPQFIPNYIQHNYTPFY

SEQ ID NO: 168387 - protein, 149 aa, Triticum aestivum
  Clone ID: PAT_TA_62805.pep
RTSSQRCIDEAIVIVIVSERQPILLHRFACATQKSFRCAAERNVWYRTFPVPRWPLFHLFKLWQFVHVIDVVCQAREDSVRTRDCSVYFLPSAALRASAAACFFRIISALDSLACCIWVPLMVVLVFSVFLRFFSRAFSRWFPRAIVSV

SEQ ID NO: 168388 - protein, 173 aa, Triticum aestivum
  unsure (1)..(173): unsure at all Xaa locations
  Clone ID: PAT_TA_62806.pep
PPAAQQQRGGGGDDDGAPREPGGGRAGRRRAEAAETPRARDGSGKQRSRNPPRGPARKNQASRAGTNPTPPPRTRTQGPEDDDDDDEDEDEETGDADEDDADAGEDFTAEEGEDDDEDEDPEANGDDAGAGSDDDDGEDDDEDGEDGEXHDDDAEDDDEEEEEKEDQPPGKKK

SEQ ID NO: 168389 - protein, 232 aa, Triticum aestivum
  Clone ID: PAT_TA_62807.pep
MASRAAAAVLVLAALICAAHSSAAAEGLSRSFHAASCPELEEIAGTLVAETFRRDVGVAPALIRILFHDCFPQGCDASVLLTGNNTELNAVPNQTLRPVALDLIERIRAAVHRACGPTVSCADITILATRDALVQAGGPHFDVAFGRRDALAPASQDLVDTLPAPSFDVPTLISSFGNRSLDVADLVALSGAHTFGVAHCPSFSDRFTPNIDFNPLIDPLFARRLRVKCAKD

SEQ ID NO: 168390 - protein, 40 aa, Triticum aestivum
  Clone ID: PAT_TA_62808.pep
VEHNFSIDRVPIYACRITTEARTCANQAVSRIGVASSALL

SEQ ID NO: 168391 - protein, 165 aa, Triticum aestivum
  unsure (1)..(165): unsure at all Xaa locations
  Clone ID: PAT_TA_62809.pep
MRGRLTRLSPRNRAFALLLPHFASGAAHQPPPPAAMRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTISKEIADXCLDRIRKLSDHCT

SEQ ID NO: 168392 - protein, 228 aa, Triticum aestivum
  Clone ID: PAT_TA_62810.pep
PGRASIYGLYGLGDLPQGFARLSAIYGGTYMLNTNIDEIQYDGDKAVGIKATMTGVEEMKFETKAKMILGDPSYFPNKAKVVGHVLRAICILKHPLAGTNDADSAQLIIPQSQVGRKNDIYIACVSSAHNVCPKGYWIAIVSTIAETTANHHVELQAGLERLGKIEEQFMGPPIPVYEPLEDGSKDNIFISKSYDATSHFETNTDDVKDIYRRATGEELKVEGLREGI

SEQ ID NO: 168393 - protein, 87 aa, Triticum aestivum
  Clone ID: PAT_TA_62811.pep
DSKERETLGGFLAASAFVVFVTSVGSIVFSALAAGAALACAHGAFRVPEEQLFLDDDLQPGAGGRAGSSVDLLSFFTNAAGGGGGRG

SEQ ID NO: 168394 - protein, 110 aa, Triticum aestivum
  Clone ID: PAT_TA_62812.pep
LLWRRSPGGLRPGFLRPSPTPSASSPTSTSLTPSSPAPSAATLCACKPTVPSSSPTTACSSCLSASSLASASAHSSSLDAIPDPCRASMTATYICYGVTYSSLAILISIG

SEQ ID NO: 168395 - protein, 87 aa, Triticum aestivum
  Clone ID: PAT_TA_62813.pep
MQRSNSFGTSWADQWDTGADPSPRARGGNGDGQKGGVEKTKAAAATGLRKVKAGTAQGFQWIKDKYQKKSAGKNGKQGGGSEVAAGY

SEQ ID NO: 168396 - protein, 136 aa, Triticum aestivum; identical to SEQ ID NO: 117882
  Clone ID: PAT_TA_62814.pep

SEQ ID NO: 168397 - protein, 75 aa, Triticum aestivum; identical to SEQ ID NO: 106874
  Clone ID: PAT_TA_62815.pep

SEQ ID NO: 168398 - protein, 107 aa, Triticum aestivum
  Clone ID: PAT_TA_62816.pep
RPLRRRADSAGGSLTTCQRVQVAEAQPNSQQWLGCWILPRPRASPRPAMSSASPSSSWPSSPWWPSPCSAAPTGRTSQTPGAKRNAGPNPSLLFTVVEAAKEARRAH

SEQ ID NO: 168399 - protein, 59 aa, Triticum aestivum
  Clone ID: PAT_TA_62817.pep
RDGDFRTHVRHCVFLILDSVLGLRSDAPSTIGTCKVFYIIYFLPTIPLLCESLFVTSRY

SEQ ID NO: 168400 - protein, 63 aa, Triticum aestivum
  unsure (1)..(63): unsure at all Xaa locations
  Clone ID: PAT_TA_62818.pep
NLFGFSDLEDVLQLSDPVCSCGSYCKCCGRXYPDLTXEQGGAAARASRVVVLGVAPENKVGQL

SEQ ID NO: 168401 - protein, 128 aa, Triticum aestivum
  Clone ID: PAT_TA_62819.pep
PGREFTNKHNQQQLFNFTFKPLHLQAGVSALNQSIHLYSTHLHKKSIACNSTHPNYLHIQSTTQTTPSSCPLDLTTAPSPCPCPCLPLLPPTSQATLASCTTTPSDRWRLLALALLPPTLLLSVPVHP

SEQ ID NO: 168402 - protein, 111 aa, Triticum aestivum
  Clone ID: PAT_TA_62820.pep
GSRVRVGRQRLRCGYRTRPPPPAAASKFAGESAPPHRCRGRPPRLAPTRRRRGGEPRRTRQRTPRSSGTLPARQQTFPSSLLIQASLPFPPLLSLDRSPTRFLLAAAQKNE

SEQ ID NO: 168403 - protein, 106 aa, Triticum aestivum
  Clone ID: PAT_TA_62821.pep
MAVDGELKLLGVWTRPFVIRVRVVLNLKSLPYYYVEENLGSKSALLLGSYPVHQSVPVLLHVGRPVNEYQGIVQYIDEVWVGAGPIVLADDPYEMRRRHISALWYP

SEQ ID NO: 168404 - protein, 229 aa, Triticum aestivum
  Clone ID: PAT_TA_62822.pep
LLVRSRILRITINPESLCVDPRATSRSIKACVSWREKSIQQAVSLLPGRTCAPPLACTSPPSESTPRLPRQGRGFANRRSVAAGPRWQQQPAPTPPTSSWQTSRSASSAPSSAAGSGCLTRYFPTKTSCHSQPNTSDMSCRSPALLLRQQCRHSSRETPRPSWSCATSTDQPNTRPSSPARMALLHAPRVANAIGSIRGRTQLVFVRYSKPLSYAFLVSLDSLSQVMLG

SEQ ID NO: 168405 - protein, 109 aa, Triticum aestivum
  Clone ID: PAT_TA_62823.pep
LTFTCPHQHQFEAEHRRGCYRFVDQRLVWNAANCLTIPRDRQSSRRVVIELRYMHRLHVSHIHCAARIASLNPTKYSLPVVKLVFRRGEQVSVSGIDRGGADSRITRPR

SEQ ID NO: 168406 - protein, 139 aa, Triticum aestivum; identical to SEQ ID NO: 109909
  unsure (1)..(139): unsure at all Xaa locations
  Clone ID: PAT_TA_62824.pep

SEQ ID NO: 168407 - protein, 136 aa, Triticum aestivum
  Clone ID: PAT_TA_62825.pep
TDLLLATPSAKLEVWLEVESHHFYPAVADLVYELRVRPRLPGGAPPDPAVVDGLARKVADVLDVYDAHLAAGNRYLAGDAFTLADVNHMAQLFVMSRTPRAAELVAARPHVQAWWDDISARPAWKKTVAALPLPPA

SEQ ID NO: 168408 - protein, 46 aa, Triticum aestivum
  unsure (1)..(46): unsure at all Xaa locations
  Clone ID: PAT_TA_62826.pep
AARGGXGREFLIPNHQPNPLPSSPAVRRAPATGHGRLSHRRRSEGE

SEQ ID NO: 168409 - protein, 123 aa, Triticum aestivum
  Clone ID: PAT_TA_62827.pep
SPLLFSLYSYRFPEDQKEYITVSFHISRLTIYQEATMPLVPSSAPLPGSMTTFAYLREQKILNIVYVGLLVVEVLMVLGVISVALVKRVKAHRRPKAIRPVTPLTNYPPHQYMHFGNEKPTKS

SEQ ID NO: 168410 - protein, 139 aa, Triticum aestivum
  unsure (1)..(139): unsure at all Xaa locations
  Clone ID: PAT_TA_62828.pep
LPSLATTHSQGGCLAAAATAGAAPAASAAMAAAGARCSPTWRPPPARPPWSCPPPPTRGAPAGSRWPAGRPAAATAPPASAAPRAAAPAAAATEPAHRRPAGRGEHEDEXRRSKQSSSPPPPPSVSVPLAAACARARAK

SEQ ID NO: 168411 - protein, 79 aa, Triticum aestivum
  Clone ID: PAT_TA_62829.pep
YREPYSPEEQPAREYLTTAHDCRLDSRGSSPRPPMTVMQTPPALTRTLTSRLSTSSSAQHTSLQRRLLCFLTHVTTVMN

SEQ ID NO: 168412 - protein, 180 aa, Triticum aestivum
  Clone ID: PAT_TA_62830.pep
MFRLSGLWRTSRPSYRNMPGRFPDEESGSGESESLLGRGHKRVKRFWDGFVDFAFQDDILKIAVGLILAAAFTDLVKSFVSDVLMPPISIILPLNKNIEEKFAVLQRGPNYNTTTGYNTLHQAQDDGAVVLAYGSFVSQMISFLVLGIALYGLAHLWQLASSESIVKHTKKRKHCRQPIN

SEQ ID NO: 168413 - protein, 110 aa, Triticum aestivum
  Clone ID: PAT_TA_62831.pep
SKDGPALRGRCLARRSEAVRASADRRAPHGPGCRARTVGGTCTRVSGMPECGIGSVTNECHGRVRRGTASRQLGAVSASTRSSLWHRVLGSRHGIARRRSWLLGVWIWLR

SEQ ID NO: 168414 - protein, 112 aa, Triticum aestivum
  Clone ID: PAT_TA_62832.pep
LVMPVGVKHEYVKKKKKKKKKKKKKKKNKSQNNQGKPKRKKNSILSFQGKPGVHTKADYEGVVGGPAHFLNFTGELSGGAHPSLKFGVRFQDGPPRKKKKGFHPPLLPPEGE

SEQ ID NO: 168415 - protein, 75 aa, Triticum aestivum
  Clone ID: PAT_TA_62833.pep
SNRALTNGCGHQPARWLGRAGARVKVEPGWQQARQPEARPAAGRRRSSGTDPNGTAGEAASDEEVRWLRADLFGI

SEQ ID NO: 168416 - protein, 162 aa, Triticum aestivum
  unsure (1)..(162): unsure at all Xaa locations
  Clone ID: PAT_TA_62834.pep
RGVAQARSCPLSLTLDQAEYLARYNVLMPPACRRAGTLTAAATRSRAPSSPATSSNSVTXGRCNAHGHHEFWVGKNFDEVVVEARRRELAHRRACVARYVHPPLPRLMWSPQPSAAPADVANPSWQRSERQATPTTFPTSSGRSAIRDGSGMVSDSRTWRPR

SEQ ID NO: 168417 - protein, 62 aa, Triticum aestivum
  Clone ID: PAT_TA_62835.pep
LPFSSLRSPSPIIWDRDLRRSHPVPAVVEDPCRAPETQLTRERQEVSSSIALHDRPETPWAG

SEQ ID NO: 168418 - protein, 96 aa, Triticum aestivum
  Clone ID: PAT_TA_62836.pep
EESFSHRRDGKMQIFVKTLTGKTITLEVESSDTIDNVKVKIQDKEGIPPDQQRLIFAGKQLEDGRTLVDYNIQKESTLHLVLRLRGGSRGQYPKNL

SEQ ID NO: 168419 - protein, 250 aa, Triticum aestivum
  unsure (1)..(250): unsure at all Xaa locations
  Clone ID: PAT_TA_62837.pep
MSDNTASSPKQSPRSPTSQKSNASREAAEAAGPHGADHWANLAQESHDEDTDSSLGSDAGSSTASMNSSILNYRTIKGRTYHSERGNAEYWASNDDQQNEAIDIIHHYLLLALDGKLHLAPVGDDAKSVLDVGTGTGIWAIDFADEHPNAEQVIGTDISPIQPSWVPPNVKFEIEDCTQPWTFSPNTFDFIHMRYLYGSIGDWGALFQEAYRVCKPGGWVRSFEASPRFXSDHGTVQEGSAMNEWGNVFI

SEQ ID NO: 168420 - protein, 257 aa, Triticum aestivum
  unsure (1)..(257): unsure at all Xaa locations
  Clone ID: PAT_TA_62838.pep
MPVGTVLVTGGTGYIGSFTSLTLLEHGYDVVIVDSLYNSSEVALDRIELICGRRPAFYKLDITDEKAIDEVFAKRPAIDSVIHFAALKAVGESGEIPLEYYRVNVGGSISLLRSMERNNVNNIVFSSSATVYGDATRFPNMIPIPEHCPIGPTNTYGRTKSMIEDVITDFVNAQRNNLEKAGKEYKQWNGALLRYFNPCGAHPTGIMGEDPQGIPFNLLPLLGQVATGEREKLLVFGDDYSSRDGTAIRDYIHXVDL

SEQ ID NO: 168421 - protein, 56 aa, Triticum aestivum
  Clone ID: PAT_TA_62839.pep
GLAGKYKKREKKKKITPFSELLSLPLSSQTNLRKIISLFLTRLHALSLTSRHLARS

SEQ ID NO: 168422 - protein, 214 aa, Triticum aestivum
  Clone ID: PAT_TA_62840.pep
TPFAMSFSFGFAGDDISEDEQNSSTVKPTAPAPAATNSAFPVAGKPQLPPTLHQLSDLLAQQPSKIAYSLLYVELDDGTTVQLPRRELWDVRVQLMAEEENLAGAQSEGLGSHDVKTGVYEGGFKSWESSVDLVKVLAANKAISTLEQKPFRVMELGCGTALPSLAVFQWAMTSKSERKPLSLILADYNPSVLQLVTPTNFILSWALNNTQLPA

SEQ ID NO: 168423 - protein, 240 aa, Triticum aestivum
  unsure (1)..(240): unsure at all Xaa locations
  Clone ID: PAT_TA_62841.pep
MGSMGPAAGKPHAVCLPYPAQGHITPMLNVAKLLHARGFDVTFVNTEYNHARLVRSRGAAVVAGLPGFRFATIPDGLPPSDDNDVTQDIPALCKSTTETCLRPFRGLLARLNDPATGHPPVTCVVSDVVMGFSMEAANELGLPYVQLWTASAISYLGYRHYRLLIGRGLAPLEDAEQLTNGYLDTPVDDVPGLRSMRLRDFPSFIRTTDPDEYTVHYVLRETXRTAGASXVILTASATWR

SEQ ID NO: 168424 - protein, 63 aa, Triticum aestivum
  Clone ID: PAT_TA_62842.pep
MYQAIPYSSTRTWARPSPAAEPAVAVKAETAEATASREDAAGVDRAVSESPVVEVGRRSCCLT

SEQ ID NO: 168425 - protein, 264 aa, Triticum aestivum
  unsure (1)..(264): unsure at all Xaa locations
  Clone ID: PAT_TA_62843.pep
RWLSSSAGPKASRSSYSNYSPLWLTAVALGVAAPLAYKMSDIEPINADPSTLADRDAQKKRESGVNEDSPXRLRMEKFIREQQAQIVAELERLDGKKFRKDEWERPNGGGGTTCVLQEGNVFEKAGLGVSVVYGSLPKPAIEKMRANHKTMDPNMESIDFFAAGLSMVLHPYNPMAPTVHLNYRYFETANPDGTSQAWWFGGGCDLTPSYLFDEDAIHFHKTIKTACDAHEQEYYPRFQKWCDEYFFNXHRGEARGIGAIFFDD

SEQ ID NO: 168426 - protein, 203 aa, Triticum aestivum
  unsure (1)..(203): unsure at all Xaa locations
  Clone ID: PAT_TA_62844.pep
MSDTKVYRASTTAPVNIAVVKYWGKRDAKLNLPTNSSLSVTLSQDDLRTLTTASCSSTFTDGDSLTLNGESSDISGARTQACFRELRSRRAALEQADSSLPKLSSYPLKIVSENNFPTAAGLASSAAGFAALVQAIAFLYELPDSPSDLSLIARQGSGSACRSLFGXYVAWRMGEKEDGSDSKADLVAPASHWPEMRALILVA

SEQ ID NO: 168427 - protein, 102 aa, Triticum aestivum
  unsure (1)..(102): unsure at all Xaa locations
  Clone ID: PAT_TA_62845.pep
APPPGPRXLWPPSEATRPPAXAGXRRTTTQRAPTATXPTTPAARXPATATGPPGPPEPTPPTAQPTGRPTSPSTTDAHEPGQTPAPKEREPGGGGKRRTKPK

SEQ ID NO: 168428 - protein, 110 aa, Triticum aestivum
  Clone ID: PAT_TA_62846.pep
MNTVKSFWLGWGSLCVAGGGAYYFAKKQINADRQAKMDAHRRKIQMINNLEAEEGGGPPRDDHTYSPSTEIAQDPAPTRHAPATEDQRINEKSKYESSSVYRSPKGDRFS

SEQ ID NO: 168429 - protein, 227 aa, Triticum aestivum
  Clone ID: PAT_TA_62847.pep
MLSVGLKAVALTLLLGSRANASPNTPTASACRQIAKALGEGVFFPDDTDYSELSTINWSQTAWAQPACIVSPSNASEVSKVVKIAVAQKARFAIRSGGHSANPGYANINDGILISLDRLTKTVFDPSTSLVSIGPGNRWGEVYEHLEQFNRTMVGGRVPTVGVGGLTLGSGLSYLTDLHGLACDNVVSYEVVLSHGSIVEASATSNKDLFWGLKGGINNFGVVNEFN

SEQ ID NO: 168430 - protein, 102 aa, Triticum aestivum
  Clone ID: PAT_TA_62848.pep
VPYQVPKSSGESTDISSTMSTTLPMAAMFTRNKLVGWASVVFSIQSWLGESEDSKKNSTTPGYFSVGMSIMALVVTYLPIFLPPVGGKQASGTEAPAPVPLA

SEQ ID NO: 168431 - protein, 230 aa, Triticum aestivum
  unsure (1)..(230): unsure at all Xaa locations
  Clone ID: PAT_TA_62849.pep
MSMDLDDQPISIAPTTQQTGAATILCCNCGAPIDGTASTGALCYDCIKLTVDISQGVQREATLNFCRDCDRWLMPXSWIVASPESRELLALCLKKLRGLNKVRIVDASFIWTEPHSRRIRVKITIQDEVQDGMLLQQTFEVIYVVAYQQCPECAKSYTANVWRAAVQVRQKVLHKRTFLFLEQLIMKHGAHKDTLNIREXQDGIDFFFSQXNQAEKFIDFLNSVVPVKTK

SEQ ID NO: 168432 - protein, 139 aa, Triticum aestivum
  unsure (1)..(139): unsure at all Xaa locations
  Clone ID: PAT_TA_62850.pep
MQIFVKTPTGKTITVXVESAGAVDSLKAKIHEKEGIQSDHQRLIFARKQLGDGRTLADYNVKKESTLHLVLGLAGGDKASCYPPQMEPNLLALALKYRQHRLVRLKCYARLPLRSANCRKKKCGXHSNDIRPQEKLRYH

SEQ ID NO: 168433 - protein, 104 aa, Triticum aestivum
  unsure (1)..(104): unsure at all Xaa locations
  Clone ID: PAT_TA_62851.pep
MGKEEKTHLNVVGIGHVDSXKSTTTGDLIYQSGGIDKRTIEKIEKEAAELGKGSFKDAWVLDKLTAERERGITIDIVLWKFETPRYYVYDIEDNVQRDFIKNMI

SEQ ID NO: 168434 - protein, 139 aa, Triticum aestivum; identical to SEQ ID NO: 141293
  Clone ID: PAT_TA_62852.pep

SEQ ID NO: 168435 - protein, 54 aa, Triticum aestivum
  Clone ID: PAT_TA_62853.pep
MKTTIFVTLLSAAASIVSAGIVVTPVFFDQIVEKLSGDCPFGAVTPQGCARQRG

SEQ ID NO: 168436 - protein, 108 aa, Triticum aestivum
  Clone ID: PAT_TA_62854.pep
MAESTASIGGYMASGYRRVAGVQLYINHLKPARLGDRIEAKANPIRYLDPDAYLDKLLDAVHWIRQAVGLACGLLWGAVPLVGAFWIALTVPPSLHPQSPNLLLSLQT

SEQ ID NO: 168437 - protein, 214 aa, Triticum aestivum
  Clone ID: PAT_TA_62855.pep
FSTKWKNLAVSVCTRSHAQDAYKSVLECLAIDSTLSSEDQVKALIATSAEDILSKVSLSIIMTPVKDKDDEIPSFGSMKAYLASRQYKTPLMAGSTDFDAVIFQALGVFGGREQGALARDFVKYLTDNVPSMHRAKLESLASLYDISATDNNDEETVTKIVQVATDLTFYATTKVPRFPTGLLSRGCTTSTNPTRGKVLNKDAPLPDLIPGISS

SEQ ID NO: 168438 - protein, 179 aa, Triticum aestivum
  Clone ID: PAT_TA_62856.pep
KIRAYLNFDMIASPNYVYGIYDGDGDAFNLTGPAGSDAIEKDFEKFFKTKRLASVPSEFSGRSDYAAFIENGIPSGGLFTGAEQLKTEEEAKKFGGEAGVAYDINYHKAGDTIDNLNKEAFLVNTQAIANSVAKYAKSFKGIPQVNHLTRRRDADHAQIFKRTSAHTHAHSGPCGAVEV

SEQ ID NO: 168439 - protein, 82 aa, Triticum aestivum
  Clone ID: PAT_TA_62857.pep
FPLSLNMTSDSAAPDNSTIASPPATRVKTTTMESSPDAPDTRTSTGKGAPPYCSAANSLMATTSTLITTQPSQLAVKGCGRD

SEQ ID NO: 168440 - protein, 235 aa, Triticum aestivum
  Clone ID: PAT_TA_62858.pep
MVQITQLLSGIALASGVFGSPIERRAVINHDAVVGFPETVPSGTAGSLYLKYKPFVKTFNGCVSFPAVDAQGNTSGGLATSGSSESGCSKSTGQVYARGGTYNGRYAIMYSWYMPKDSPSPGLGHRHDWENAVIWLSSQSTSASVVGMAVSQHGGYGRRSSGTFSGNSPLVGYTAIWPTNHQMTFTDTKGGQQPLIAWESLPAAARTALTNTDFGSANVPFKDGTFESNLGKAAI

SEQ ID NO: 168441 - protein, 152 aa, Triticum aestivum
  Clone ID: PAT_TA_62859.pep
TPPALDCMPSSSLTGRTSAPDRSAAPRTSSFGSMENDHHRQGPATSTPATRSRTRRDPAQDNVYRVPPQDFALTVQRLTGAAPPRTPPPPPPDDRDDRRPSPARPPPPPALSMQEAYLDWCASNCVVLSPGTMAEIDRAARFNSGINNGNNN

SEQ ID NO: 168442 - protein, 153 aa, Triticum aestivum
  Clone ID: PAT_TA_62860.pep
RTHLTVSMDATTASGLPPNVVIFSPQNSPSVKSLLEAGLFTRLVTSASTTPEKLAALKNHAEVKDDFCLFHRYAILVFDAGENADAHHEHFRTICLALKELDIGLDVAGCINDATDSLAAGFQLDKVNDKSALVIDLIEQEEDSDEEEEMFVM

SEQ ID NO: 168443 - protein, 66 aa, Triticum aestivum
  Clone ID: PAT_TA_62861.pep
IQSCKYHIPPLLSDSRLHPFSFPVLYTHISIIKMLDMVFLPAGAVLIHVVPFGGLQCLTAVTFHNP

SEQ ID NO: 168444 - protein, 40 aa, Triticum aestivum
  unsure (1)..(40): unsure at all Xaa locations
  Clone ID: PAT_TA_62862.pep
MVSRLMHAERPGCESTAIXQYLDEGFAGDGRPALLPDDPY

SEQ ID NO: 168445 - protein, 101 aa, Triticum aestivum
  Clone ID: PAT_TA_62863.pep
KLLTRFARPSSPAFTPNVNLCLSISISIAVFNRLVRWSGIDGLLLVKLKLIVDDRIALRNVEFDPITIYWDRSHGRRRRHLPPHGSVLPELDGHHCRVATR

SEQ ID NO: 168446 - protein, 242 aa, Triticum aestivum
  Clone ID: PAT_TA_62864.pep
VPTCTSIRDYYKLPLKDFYSWNPSVGTSCQALIVDYWVCVSVIGWSPPISSPTPSPTKPINGISTPSPIQAGLHKNCNKFHKISSTTTCTSIQKYYNLPLKDFHSWNPSVGTSCQALLVNYWVCVSIVGWKPPVSSPTPSPTQPANGIKTPSPIQSKMTKNCNKFHTVMSTTTCTSIQDYYKISMSQLAQWNPDVGSSCSALLGGYNVCVGVIGQQPSPTPPSPVQPGVVKNCKKFHLVRST

SEQ ID NO: 168447 - protein, 134 aa, Triticum aestivum
  Clone ID: PAT_TA_62865.pep
MSHLTYYNYEGVGKTNNKEYSYSQAVRVGNTIKCSGQGGWDDQGNIDKEDLKGQIDLAFKNVEKNLKDAGARGWADVHSVRSYHISLSGSFDLMVEEFRKWMPDHQPTWTCVGVTELGIPGMIVEIEVEANIAQ

SEQ ID NO: 168448 - protein, 71 aa, Triticum aestivum; identical to SEQ ID NO: 122474
  Clone ID: PAT_TA_62866.pep

SEQ ID NO: 168449 - protein, 192 aa, Triticum aestivum
  Clone ID: PAT_TA_62867.pep
MAFAKPNLLYAVDENSNELRLFNLDLKTNELNLTTKKTASTGVVHLEFNSDKSRMVGAAYGNGTIDVWNTKDGGLELIKTIKSPGKLGPNKERQDASHPHQANLDPSGRYFAVNDLGTDSVVLIDSKNDAFTDKNIPIEAGCGPRHGVFYPRGQDKATHYIIACELSTRPSSTRSPTRATLLLSSTTSPSLP

SEQ ID NO: 168450 - protein, 191 aa, Triticum aestivum
  Clone ID: PAT_TA_62868.pep
MGQAFLTTVNQRTRNQFRPRVGKGGSASYQLRQYAEVTLGGGSLRKVVKLPEGEDENEWLAVNMVDFYNQINLLYGAITEFCSPISCPEMKATDEFEYLWQDNENFKRPTKMPAPAYIEQLMTWVQANIDNEQVLPSKIGVPFPKSFPALVRQIFKRMYRVYAHIYCHHYPVIRELGLEPHLNTSFRQYVL

SEQ ID NO: 168451 - protein, 123 aa, Triticum aestivum
  Clone ID: PAT_TA_62869.pep
RSMADVENPDVGEAEPNECSRRMLTSLMGFAFVAFMLVFAHTAALLEESHPASTSAALIALSLLGLFFGCWFGGIFVILVAEWHHGGVEGHARFADDLIQSDRFILPESIHQFLIRVDQHVDA

SEQ ID NO: 168452 - protein, 194 aa, Triticum aestivum
  Clone ID: PAT_TA_62870.pep
MSSTAKAVALSPAPYHIITYGTLLGTTFFHSFVNGIVAFRAVDRASFSAIQQKLFPIYFGLQTVLPGVLALTFPGNSLIGLANGPAGLVSEFARWHSLLPISVMGITGAINLLVLLPMTVDIIKKRRGQVKRDGKEYYAEGPHSDQMKALNKKFGMLHGISSLLNLATFVAAVGYGFTLGGRVLSVADLAWTIQ

SEQ ID NO: 168453 - protein, 108 aa, Triticum aestivum
  Clone ID: PAT_TA_62871.pep
GRSRRRAGFLCKPRSHSRYRQSHPSHRLHPREATTRMKIVIVIVTMIMTTKTKTKASGTGSLTRWRRSGTRLLATTRCFSAWCALLAFFVGFPWRLRRMVSPRLARGV

SEQ ID NO: 168454 - protein, 144 aa, Triticum aestivum
  Clone ID: PAT_TA_62872.pep
MAASTAPATATKLAADEYTAELAGVPFGAPMGAPEGVAETADGVIAEGASVGASVVGAGGDAIGDGDAAVGGVATGDLAGGAGSGAIRGAGMGPCAAAATARRARMAATTAKRAIWLLSTVKDLPEKIQRGEDGERMLGEERRW

SEQ ID NO: 168455 - protein, 46 aa, Triticum aestivum
  Clone ID: PAT_TA_62873.pep
SIHSVGEARRLSMVLVRSAGVAETPRERRRETTKEAFILSDWYQSR

SEQ ID NO: 168456 - protein, 60 aa, Triticum aestivum
  unsure (1)..(60): unsure at all Xaa locations
  Clone ID: PAT_TA_62874.pep
DSRAHIHDKEGILTDQQSLIFXGQHLVDLRTLXDYNVQNESTLQLVMALTVATQGIELPD

SEQ ID NO: 168457 - protein, 80 aa, Triticum aestivum
  Clone ID: PAT_TA_62875.pep
MAGGRKREWIRKKMTAAAGSGSLRMRALSTALRQRRKRLPRVDLLRFFYESIVFRLLWVLESIVVLARLCFFFLRFGFRL

SEQ ID NO: 168458 - protein, 255 aa, Triticum aestivum
  Clone ID: PAT_TA_62876.pep
MRDVSNRQIMSSIVIQVSQDFCKKPISIEVVQFEPQEGDVTARYWTECHSGRTTRKKKELPTYCLKSIYATAKEVRRYTIENALPAYLHTIQEELSSGREGGPVVFRTYYMILTRYMELIKEHKSGNAMSPEDEKEAKIYGNLFILWCAMQHTVGSLYIQGDETLGIRPENQDKSYPLYGKISPPRMIVAQFDNLVYNAVLETYKEKVLKDVDWLFNQDKNRWWFTVYNILFIFLREVSRMTADRYRHAQQNFWT

SEQ ID NO: 168459 - protein, 114 aa, Triticum aestivum
  Clone ID: PAT_TA_62877.pep
MPASLDSSRPIMAPSNRGSVRFSTYSMAPSLSPTVGTTDSAHAEIRDIATGLDRMENKALSSQRVILTDEKTDTMSKLALGAKLERALDRRMSGQDAVMRPRGQSLNEKLSEKE

SEQ ID NO: 168460 - protein, 224 aa, Triticum aestivum
  Clone ID: PAT_TA_62878.pep
MLPGRFLGQKKARSPAGLPTTPRTPTPATTPSSRTVAPLVASATSPRVAIPAASRSSTRVASSTTSRTSATSAQPANSRPANSRPPTTANPQVTSRTSTTANSYAASRTSTTANPYATSRTSTKTNLPATSRTSTTANPYAASRMSAASAAVAPSATSRMSTRVAPSTTSRTSTRATMASNQSTTLQPGAPTSRTARTRAPPLSATTSRSHAAPTRPIASSTRR

SEQ ID NO: 168461 - protein, 102 aa, Triticum aestivum
  Clone ID: PAT_TA_62879.pep
SCHPRKASSSSSSRVYLPNSCPDEQPVWGPPRRRPIPLPMLLHSEHSCLLDRAPMSHQPYLLKTMCPKALRSYFWVDPMCCERAIFLSHHYDQTPYSNRVVT

SEQ ID NO: 168462 - protein, 68 aa, Triticum aestivum
  Clone ID: PAT_TA_62880.pep
FQFAYCSGIRYYMVNKREYVNTTVGNPDGEDKPNKKYFDPRVWVREGEKTMSKRVAEALEDFNTANQL

SEQ ID NO: 168463 - protein, 233 aa, Triticum aestivum
  Clone ID: PAT_TA_62881.pep
MMAMARSSSLVLVAFALLCCYASTVSSQGNSSDGFLSCLTASIPRQLVFTPSSPSFTPLLKSSIRNPKFFTPSTVRPLYIITPTNASHVQAAVLCGRRSGLRIRVRSGGHDYEGLSYRSVRAESFAVLDLSSLRAVRVDAQAATAWVDSGAQLGELYYAIGKASGVLGFPGGLCPTVGVGGHFSGGGFGMLLRKYGMAIDNVIDAVLVDAKARLPEQNTMGSDVFWGLRRRRR

SEQ ID NO: 168464 - protein, 122 aa, Triticum aestivum
  Clone ID: PAT_TA_62882.pep
GISWSASPCVLILLARKPSRVYSRGGVKAGSAHHSGSYSSCYHEQRTHCDSPGSSHHTRRSRSISCHCHPAHPYGRCLSEGSSCLPSSSSMLESRPRSCFGRQHWLPLRAMWHDLSLQLVSL

SEQ ID NO: 168465 - protein, 132 aa, Triticum aestivum
  Clone ID: PAT_TA_62883.pep
MFRSAVLRSLRVAARPAAVRSFAAPRVASVAVPKIQSFQAVRFYSAGGALNKDEVEGRIMSLLQGFDKVNDVSNIKSSAHFANDLGLDSLDTVEVVMAIEEEFSIEIPDKDADSIHSVNQAVEYILNQPDAA

SEQ ID NO: 168466 - protein, 150 aa, Triticum aestivum
  Clone ID: PAT_TA_62884.pep
MSTDKITFLTNWHATPYHAPLYLAQAKGYFKEEGIKVALLEPNDPSDVTEIIGTGKVDLGFKAMIHTLAAKARNFPVQSIGSLLDEPFTGVVYLKDSGITTDFRTLKGKRIGYVGEFGKIQIDELTSHYGMTPEDYTAVRCGMNVSKAII

SEQ ID NO: 168467 - protein, 192 aa, Triticum aestivum
  unsure (1)..(192): unsure at all Xaa locations
  Clone ID: PAT_TA_62885.pep
MADRYSFSLTTFSPSGKLVQIEYALNAVNQGITALGIKATNGIVIATEKKSSSPLADQSSLSKISDITPNIGMVYSGMGPDYRVLVDRARKVSHTEYKRIYNEYPPTRILVQDVARVMQEATQSAGVRPYGVSLLIAERLEASTKGGPMLYXQVDPSGSYYPWKATAIXGKSATKAKTFLEKGYSEELELED

SEQ ID NO: 168468 - protein, 126 aa, Triticum aestivum
  Clone ID: PAT_TA_62886.pep
MKLVRFLMKCANETVTIELKNGTIIHGTISSVSPQMNTALRNVKMTIKGQEPISLETMNIRGSTIRYFILPDSLPLDTLLIDDAPKPKNKARKEAADRGARGGRGRGGPRGRGRGGGGGRGRGGRP

SEQ ID NO: 168469 - protein, 132 aa, Triticum aestivum
  Clone ID: PAT_TA_62887.pep
SRPGLTTGGPPEPPERGGPKTKTPIRTPIWPPRGRRGGWPGLWSKGSTGSWGGRFSKENGVGFPGNLGPPGGLLWKTWPAPPPEEEEPTPGPQNPVKKTPLGGYSPGVNPPENSPKQLAGYLAKRKKLAPVH

SEQ ID NO: 168470 - protein, 147 aa, Triticum aestivum
  unsure (1)..(147): unsure at all Xaa locations
  Clone ID: PAT_TA_62888.pep
MALKRINKELTDLGRDPPSSCSAGPVGEDLFHWQATIMGPSDSPYSGGVFFLAIHFPTDYPFKPPKVNFTTRIYHPNINSNGSICLDILRDQWSPALTISKVLLSICSMLTDPNPDDPLVPEIAHVYKXGRPRYEATAREWTRKYAI

SEQ ID NO: 168471 - protein, 152 aa, Triticum aestivum
  unsure (1)..(152): unsure at all Xaa locations
  Clone ID: PAT_TA_62889.pep
RPLREWRFXEGGRERDEDEDRVGDVDGEENWERLDEWNSGRIWSRRSQRSWCCSVRSMYFWRAMVYVCAPTDAIFDNGKDEYEAGVDRELFVDDTDVDRLCPEKKWGRTSNDETIEAILWYVGRFQGRMGVAIYNTVASQARVEFQVGSSGL

SEQ ID NO: 168472 - protein, 92 aa, Triticum aestivum
  Clone ID: PAT_TA_62890.pep
ARVHASLAVGALQGRGAGAGPTASHAATGAITRRVAVLGAPAAAHLRLACHGEEDSTTSTSTAAMTTTLTEDILVSYMLVLMDRVLALTAVP

SEQ ID NO: 168473 - protein, 157 aa, Triticum aestivum
  unsure (1)..(157): unsure at all Xaa locations
  Clone ID: PAT_TA_62891.pep
MISTTQISLPNGKKYDQPTGLFINNEFIAATGDEFVVTNPHTEEEVIKLKGASKEDVDKAVQAARKAFEGEWSELAAVDRGAFLYKIADLIDRDRELIAAIDAFDNGKPFSACLAGDLDESYNAFRYYAGAADKISGKTIETXPAKLPYVLQEPLGV

SEQ ID NO: 168474 - protein, 105 aa, Triticum aestivum
  Clone ID: PAT_TA_62892.pep
LPTVLPTTSVRDTSRIATQHAPRSCTTLDILLDTNPMLDKLRVHALHARRDGAPHLGHDLKSPAAETTVKTLPGRRLRYRVADVIVDAMPGSQLDAIMDAVAMCM

SEQ ID NO: 168475 - protein, 201 aa, Triticum aestivum
  Clone ID: PAT_TA_62893.pep
MDVATIEETNRIRISLGMKPLPVPGDNTTQNESMYADGDAPSTLESRQAQAYDNYNKVMEAEKAKKKREEKAAAVRKAREQAQRNAVLEGKGFGEAEEGGDLSAKDWLISQKKRQKNIAKVRKLEEELATAEAEAAAAAQYTSKDLAGIKVGHDTAGFLDGDEQILTLKDTTIDENEAEGDELENLDMREAEKLADRLDTM

SEQ ID NO: 168476 - protein, 114 aa, Triticum aestivum
  Clone ID: PAT_TA_62894.pep
MQIFVKTLTGKTITLEVESSDTIDNVKSKIQDKEGIPPDQQRLIFAGKQLEDGRTLSDYNIQKESTLHLDLRLRDGIIAPPLKALASQFHCDQMICRKCYARLPPRAIYCLNPK

SEQ ID NO: 168477 - protein, 170 aa, Triticum aestivum
  Clone ID: PAT_TA_62895.pep
MATTKLSPLSPVRPDDRRRAPAASVVLKVQDSTAAEAYEQYLRLPELSRVWKTACCPGWPDEGLVKPALQALEITFRFVSVALSDPRGYASRRELARRLESLTAREVEVVAALCEGDRGAPLAELSASEGVLPRERSASEVWQLPGSAAAVVCHASEASLLPRLAAWDKS

SEQ ID NO: 168478 - protein, 110 aa, Triticum aestivum
  Clone ID: PAT_TA_62896.pep
LLIIGHFLPPSFLFLSPFPFSLVLPRVSHYTLSFFLTYGAPRPLLQSCLSFTFISLTCALNILTVLHLQYSPRFVSNDGLHILPHASWSICSTLSLTLSFESRFACHIPA

SEQ ID NO: 168479 - protein, 53 aa, Triticum aestivum
  Clone ID: PAT_TA_62897.pep
VNDTHRRFYLEYEYSLQILFGVCTDVRKENPSSCHSLINERHARNLGLPPRAA

SEQ ID NO: 168480 - protein, 224 aa, Triticum aestivum
  Clone ID: PAT_TA_62898.pep
MHSFNILLSSSLFALTQAHSVILGAQGLDSSPNSVGFQVDPEIARNCITINPCQQDATIIRDAEITANIVNQCGRTEISGNIDVGENTENAIAAKQVTQVEAGGELTVTIHQVNADGAGPYVCDLDESSNTNTNIQNLTVTNNIPGTNGLSQAKTQAFNITVKMPDDLNCFGASTGNICTVRCRNNALAGPFGGCFAVQQGDTDKKNHTPQKHQTTQTLNGINA

SEQ ID NO: 168481 - protein, 70 aa, Triticum aestivum
  Clone ID: PAT_TA_62899.pep
RIVVQDGICRLYMALPASRCDWKLQASVFLRHALSQVTPDGLLVSSLSVTRKYLLERRTAGPRTKDDYNI

SEQ ID NO: 168482 - protein, 107 aa, Triticum aestivum
  Clone ID: PAT_TA_62900.pep
GGLPFRCSVYCDVVGHLRPPKNLGLGVIVPGNAARCEDPRGLFLLCGSTRWRNRCLSEWPRNVMSASKVAWAPSFGSARPSTEYYSSRGHSTNEISSESSELVPGVR

SEQ ID NO: 168483 - protein, 184 aa, Triticum aestivum
  unsure (1)..(184): unsure at all Xaa locations
  Clone ID: PAT_TA_62901.pep
MDSFFQRAFGDPMCSEDSNVVQQGIEKCPFLRNINEPTSFSLTSVNFPAPATGAKGPIFEDGPNFDTAFRVFHGRDGVVPLSEGAFAHIEKPLPKSTPEFNPLAAKAATISLSXFEAFFSFGDFSNKRNKQNSNKKNPNNLPQEXVSLNNYPEAMSNDRLENGPCPLAKXYIAIGGIVPLVQSC

SEQ ID NO: 168484 - protein, 138 aa, Triticum aestivum
  Clone ID: PAT_TA_62902.pep
FTEANEKPTHSAPTPEKPTGDKPVLPPVATVPYPPHGNGTVPTPTPVVPVVPSSYVPPVVSTPVAQPPHSVVPPPVYAPPSEIPPVASHPVSQPPAVVPPPAAGTPPATAPTPVPVSGGSVVRTGLMLAVPAVIAVFM

SEQ ID NO: 168485 - protein, 251 aa, Triticum aestivum
  Clone ID: PAT_TA_62903.pep
SDTFSSGRAIERAIRKPFTPLLGETFELVRSDKEVPGGFRLLVEKVQHRPLLLAMQADSANWSFSQSPAPGQKFWGKSAEITTDGRVRIVLRLSNGSEERYSWNIATMFLRNVVMGEKYVEPVGTMHVVNDSTGHKAAVEFKSKGMWGGRIEDVGVEIFNPEGANTGSGLVGTWTNSLKTTGKGGGQEIWRVGPLVENAANTFGLTTFAATLNEVTEIEKGKLPPTDWRLRPDQRAYEQGAIDDAEDMKQK

SEQ ID NO: 168486 - protein, 117 aa, Triticum aestivum
  Clone ID: PAT_TA_62904.pep
MERRAARRSSAHHSRMQMPPAPVGQKQHQQTQTQRRGGSKSCQRTPPPPGCFTIQLLMVFLWVAASLAFLPLVLPPLPPPPLSLLLLPVCLLAVLAALAFVPLDAHSNVVGGGSSCL

SEQ ID NO: 168487 - protein, 172 aa, Triticum aestivum
  unsure (1)..(172): unsure at all Xaa locations
  Clone ID: PAT_TA_62905.pep
MAPRAAVLLLAMAVASVFLASASAQGVMAPSSAPSSAPTXYEAAELPETASLDRIGIYDPKSEKWIAGTTAASTENFDRGYAPTLLLSVDESGDVRSVTLKGIRVDAGQTRDFGPKAIVIADKKGSQPELNKPVILSPGGKKAEEEEPKSFLQKYWWLIAIMVVMSLAGGEK

SEQ ID NO: 168488 - protein, 227 aa, Triticum aestivum
  Clone ID: PAT_TA_62906.pep
MKFSAILSFLAASSAALPTSNSFVAFEGRQAGSITRNDLSSGASSACPPVIFIYARGSTELGNLGTLGPRVASALESYYGRDKVWIQGVGGAYDATIGDNLLPRGTSAAAIREMIALFNLANSKCPSAKVVAGGYSQGAALAAASIEDLSTSVRDKVVGTVLFGYTKNLQNLGRIPNYPRERTKVFCNIGDLVCTGSLIVAAPHLAYQSDASGPAPEFLIQRVAASN

SEQ ID NO: 168489 - protein, 131 aa, Triticum aestivum
  unsure (1)..(131): unsure at all Xaa locations
  Clone ID: PAT_TA_62907.pep
RRLSKLARDVAIKLKLLQTSKLSIFEHSLISAQTKASQYSLLTKRKPKTTNLRNSETFYNPIITVASAAHHSTAMTDSPPPTEPRVRSKSPASRDRDDRKGRNDLFRXNSDRRQRRERSRSRDRNQTRDAE

SEQ ID NO: 168490 - protein, 211 aa, Triticum aestivum
  unsure (1)..(211): unsure at all Xaa locations
  Clone ID: PAT_TA_62908.pep
MQMLRRRPSPPQTITLDVESSDTIHNVQINIHDDDEIPPNLYRLIFAVTECYDDRTLVDYNIQNESTLHLEIRLHEGYADFLQTLSDKTIILYVKSSNTINYVKAKIHYNDDIPPNHQRLIFCAXHLDDDRTLDDYDIHNDFTLHLMLKLLGGMQIFVKTITGENITLXADSSYTMYYVNVKIHDKEGIPPDHHRLIFAVKQLWDGRTLAD

SEQ ID NO: 168491 - protein, 148 aa, Triticum aestivum
  unsure (1)..(148): unsure at all Xaa locations
  Clone ID: PAT_TA_62909.pep
MTASTELDPYSLGAAYYHWDHCQPTTASTYSLVARAPNAKLSMNGPNXTYSDAIGSYCSHCPPPSFCSESGSPYRPPAPMTAPEILSLQAATLAPSIPTNPDTDSEIWMVTELPFCQAHRTKSFKPMPDPRLAIVTLWLTMMHASQLL

SEQ ID NO: 168492 - protein, 93 aa, Triticum aestivum
  Clone ID: PAT_TA_62910.pep
VAARFVESSLRALAGDPDVYECTYVQSELTELPFFASRVKIGKNGVESIISSDLEGVTDYEAKALEALKPELKASIEKGIEFVHKHQGAAASV

SEQ ID NO: 168493 - protein, 55 aa, Triticum aestivum
  Clone ID: PAT_TA_62911.pep
LPLLSISSSDLGPGAEASQMMRVSGCKGPLRLRLRIGYTHPTAGQVMDQDNWTES

SEQ ID NO: 168494 - protein, 159 aa, Triticum aestivum
  unsure (1)..(159): unsure at all Xaa locations
  Clone ID: PAT_TA_62912.pep
MRLISWQRRKPVFVCEVDTQTLAIPATLKQMYIKVPVTHKEHYLHTFLLTEANVDKTVILFCNRTSTADYLHHLLRMLEHRVTSLHSKLPQRQRIDNLARFRASAARILVATDVAARGLDIPEVSLVINYDLPRDPDDYIHRVGSNSXRRXRKGEAVSF

SEQ ID NO: 168495 - protein, 242 aa, Triticum aestivum
  unsure (1)..(242): unsure at all Xaa locations
  Clone ID: PAT_TA_62913.pep
MGRVIRAQRKGAGSVFKSHTHHRQGPARFRALDYGERNGYLKGVVTDIVHDPGRGAPLARLDFRDPVRYKHRKELFVAAEGMYTGQSVYCGRRAVVAIGNVLPLASLPEGAVVCNVEQHVGDRGALARASGDYAIVISHNSDXRAMVGQVAGGGRTEKPLLKAGRAYHKFRVKRNSWPRVRGVAMNPVDHPHGGGNHQHIGHASTVRRDAPPGQKVGQIGARRTGRLRGQAAVNASKDSRAA

SEQ ID NO: 168496 - protein, 138 aa, Triticum aestivum
  unsure (1)..(138): unsure at all Xaa locations
  Clone ID: PAT_TA_62914.pep
RTRNVICRLSRRGSTWPTMADEMTTDMKGWLRWYVTGYPTARDVDSRATSHVGLRVRDDSTGAGWHQSLYLSCDPCLPLTQRADEENAERAMRRRGRVVSWERPMVNYNWSYICRCMSDAXTVHAHSRADAASCSRLK

SEQ ID NO: 168497 - protein, 241 aa, Triticum aestivum
  unsure (1)..(241): unsure at all Xaa locations
  Clone ID: PAT_TA_62915.pep
MRLLSLLSVVTLAVASPLSVEEYAKALDERAVSVSTTDFGNFKFYIQHGAAAYCNSEAPAGAKVTCSGNGCPTVQSNGATIVASFTGSKTGIGGYVATDPTRKEIVVSFRGSINIRNWLTNLDFDQDDCSLTSGCGVHSGFQNAWNEISAAATAAVAKARKANPSFKVVSVGHSLGGAVATLAGANLRVGGTPLDIYTYGSPRVGNTQLAAFVSNXAGGEFRVTNAKXPVXRLPPLIFGYR

SEQ ID NO: 168498 - protein, 95 aa, Triticum aestivum
  Clone ID: PAT_TA_62916.pep
QQCVGGLDPDCLMPPSYRVTVPIPPSLHPSPSNSLAAEARWTLKISIKNMSSNITSAILAIVIAVYPRERRRETCLVVFQMSAVLALNQMGFGGI

SEQ ID NO: 168499 - protein, 159 aa, Triticum aestivum
  unsure (1)..(159): unsure at all Xaa locations
  Clone ID: PAT_TA_62917.pep
MGKEEKTHLSVGVIGDVDSGESTTTGHLIYQWGGIDEGGIEKYEKEAVELVEGSLENGWGHDKIKAERECGSAIDMALWKSETPXYYVRAVDDPGHRDFIKNVIAGTSHGEWGILIVADGTGVVEPGISKRWPQRVKHPLLSIYGWKGATSLIKIGLLG

SEQ ID NO: 168500 - protein, 193 aa, Triticum aestivum
  Clone ID: PAT_TA_62918.pep
MASPSDRRPIVISGPSGVGKGTLINMLFTRHPDQFTLSVSHTTRNPREGESDGVHYHFVTKDAFRDLIAKDGFVEHAQFGSNLYGTSKATIEEQTAKGKVVVLDIEMEGVKQVKASTIDARYVFVSPPDTEELEKRLRGRGTETEESIQQRLTRAQDELAWARSAEFDKILVNDDLEKTYQELDAFVYTEKSD

SEQ ID NO: 168501 - protein, 254 aa, Triticum aestivum
  Clone ID: PAT_TA_62919.pep
MILRNAPVRHCRHTMASPISRSILRRMSTQVTPKTEAAPEMKEWTTSQATAAPPKIVSAARKKQRIVQDGILSLRTNSAHEHKVSTWTTPNKNSNSATPATPAQQYREWKRIQANTRSLGSKLVKRYIPTELVNNPPGPEDITLELLLASQTHIGHKTSLWNPANSRYIYGVRQGVHMISLETTAAHLRRAARVVEEVAYNAGLILFVGNRKGQMEIVTQAAEMAGACHLFTKWTPGGITNRDVILKMAGTKVV

SEQ ID NO: 168502 - protein, 187 aa, Triticum aestivum
  unsure (1)..(187): unsure at all Xaa locations
  Clone ID: PAT_TA_62920.pep
MMSTPQLRIETDAMRMLMSDYEVTLVNDNMQECYVRFRGPGETPFXGGTWKVHVELPDTYPYKSPSIGFVNRIFHPNIDELXSGSVCLDVINQTWSPMFDMINIFEVFLPQLLRYPNPTDPLNGEAAALLIREPKSYDAKVKEYVQKYASKEAADEAGAESEDDDELSSVASFGDDDDEPAXQMDDV

SEQ ID NO: 168503 - protein, 137 aa, Triticum aestivum
  Clone ID: PAT_TA_62921.pep
MVLSMKHCRDQAQEVPLSLSLSLGAMADRTKKQRRGVAAGEFVCKTCSRAFPSFQALGGHRTSHLRGRHGLALGLAAGINEPSSTKKTVDQKQAHQCHVCGLEFEMGQALGGHMRRHREQESATTAQAPPVLLQLFV

SEQ ID NO: 168504 - protein, 103 aa, Triticum aestivum
  unsure (1)..(103): unsure at all Xaa locations
  Clone ID: PAT_TA_62922.pep
MSGRGKGGKGLGKGGAKRHRKVLRDNIQGITKPAIRRLARRGGVKRISGLIYEETRGVLKIFLENVIRDAVTYTEHARRRTVTAXDVVYALKRQGRTLYGFGG

SEQ ID NO: 168505 - protein, 211 aa, Triticum aestivum
  Clone ID: PAT_TA_62923.pep
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYSVAKEFADSLGIPFLETSAKNASNVEQAFLTMARQIKERMGTTTANNTKPSVQVGQGPGVGSSSHTAAAKCTYALFSR

SEQ ID NO: 168506 - protein, 189 aa, Triticum aestivum
  unsure (1)..(189): unsure at all Xaa locations
  Clone ID: PAT_TA_62924.pep
FRPGGNTVPPVFEADESIVPRRTRAANGIRAQYLKTGVTPSASGSAYLEIESQDASGSKGMKLTCTVHGPRSLPRSAPFSPHMVLSTHVKYAPFATRQRRGYLRDSSERDLSSHLEAALRGAIIADRWPKSGVDVIVTVIEGDXAREVAVEQGSEEWDMMNVLSGCITVAAAALADAGIDCVDTVSWRC

SEQ ID NO: 168507 - protein, 251 aa, Triticum aestivum
  Clone ID: PAT_TA_62925.pep
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSQGDAVDLIIRPMGELIDLPM

SEQ ID NO: 168508 - protein, 118 aa, Triticum aestivum
  unsure (1)..(118): unsure at all Xaa locations
  Clone ID: PAT_TA_62926.pep
FERDDGIFTVLSERATALHKAFSQMEGVECAEPQGSMYLFPTINLPAKAAEAAKAEGRSADEFYCMRLLEATGICVVPGSGFXQKENTLHFRTXFLAPXTERXGRIXKFHNEFLDKYR

SEQ ID NO: 168509 - protein, 259 aa, Triticum aestivum
  unsure (1)..(259): unsure at all Xaa locations
  Clone ID: PAT_TA_62927.pep
FISFHWSFQNNYNQYESRINERNTHTLFLLNINNRIPSLLSLKLFYTSFLMLGNFIGVRGQDSYSNSTFLSPTSATGYSSCSTTTNNNQYQQENDDNMRKGTRPPPLNLSIVPRPRSLPRLSTTPQPIAREVTPLLTPLPEEADEPSGPVLRAVRIAVDFMQIVSCLLVILMLAVFLVSYTGAVNSCHGLKASVLIAALACDVGLGMWSIVNHDKTWCGPAVLLRAFTVTVLVGSLVSLLAVDXVFPEDYTYWGLPLSH

SEQ ID NO: 168510 - protein, 128 aa, Triticum aestivum
  Clone ID: PAT_TA_62928.pep
RPDASSQALLYRLSGDYNPLHSDPMVAQVAGFTRPILHGLCTLGFAARAVIKSFCHGDPAAVRNIFGRFLLHVYPGETLVTEMWVDGQRVQYQTKAKERDRAVLSGYVLLKHIPSSLSSDAENGGGRL

SEQ ID NO: 168511 - protein, 162 aa, Triticum aestivum; identical to SEQ ID NO: 131106
  Clone ID: PAT_TA_62929.pep

SEQ ID NO: 168512 - protein, 103 aa, Triticum aestivum
  unsure (1)..(103): unsure at all Xaa locations
  Clone ID: PAT_TA_62930.pep
MRPTQALSVGRYRHLXLTTKDVGKGFYKGNRTGSMGRHTKHGGYVIEWNKVRTYAVPPLKDFKLTPFVSREVKTQSGDYKGLEKGPQDPYFYVEQWKRFNGVD

SEQ ID NO: 168513 - protein, 63 aa, Triticum aestivum
  Clone ID: PAT_TA_62931.pep
LHQSPAPCQSLQVARLIIIALAHLGIYSCAETQLLHHHINFHLVSPSSNQTISCQSRWASRFG

SEQ ID NO: 168514 - protein, 233 aa, Triticum aestivum
  unsure (1)..(233): unsure at all Xaa locations
  Clone ID: PAT_TA_62932.pep
MWILPLVGYVGTLLGFCFLTLAIASGLYYLSELVEEHSVTAKRFLTRLIYSVIGIQLVLWLVDGFPFFATVLTIVSHVVYLGNMKRFPFVKLTDPLFLASCVLVLVNHYVWFRHFSDAQSRAYQRTSFYDKADVPSFAQIASYFGLCVWLVPFALFVSLSAGDNVLPTMGTEPVHGLDXRGKPQGMIKALVDQIRGAIGQIFGSIHRLDLLDRKSWEVIETHHSAGWTTEMLV

SEQ ID NO: 168515 - protein, 211 aa, Triticum aestivum
  unsure (1)..(211): unsure at all Xaa locations
  Clone ID: PAT_TA_62933.pep
MAGGGEEEAKLLGTWASPFVLRAQLALSFKGVSFENVNEDLCNKSDLLLRSNPVHKAVPVLIHNGRPVCESLVILQYVDEAFGGPPLLPADPYERAIARFWAAFIMDKLVAPWQKVFTTKIEEEKAEWMEQTLAAVDVLEGGLKECSKGGSFFGGDNVGYVDVVLGGAVPWIYXTEALCGTRLFDTSRVPXXLAAWLERFGALDVAQLVMA

SEQ ID NO: 168516 - protein, 200 aa, Triticum aestivum
  unsure (1)..(200): unsure at all Xaa locations
  Clone ID: PAT_TA_62934.pep
MSGDSAEVAEDYRLALEDLSSNLRFEISNLTVIARENTEHALAIAEVLQQHILKAAPSKKLPALYVLDSIVKNVGTPYTLYFGRNLFKTFMESYXVDQPVRRKMEEMLRXWKEPVPGSMDSRPVFSHELVRPIENALLKARAATMPQAGMMPGRPRSAVPHRDTPTPPGMRFPPGHPAQQYTSNGGQSLSNDIRNLIVTT

SEQ ID NO: 168517 - protein, 281 aa, Triticum aestivum
  Clone ID: PAT_TA_62935.pep
VTLELDGVLFTRVFDAYKASYGVEDAEYAISQLAQTTMRSEIGQLTLDHVLKERAALNTNITAAINDAAEAWGVTCLRYEIRDIHAPGAVVEAMHRQVTAERSKRAEILESEGQRQSAINIAEGKKQSVILASEALRAERINEADGEAEAIRLKASATAQGIDAVSESIIRGDAGAQAAVSLRVAEKYVDAFGKLARESTAVVVPGNVGDISGMIATGLSVFGKVGQAQAQTMAKSLVEPKGDSQTAELEGQAKPDVKETVLESFNQRLPAIAERRHDLST

SEQ ID NO: 168518 - protein, 199 aa, Triticum aestivum
  Clone ID: PAT_TA_62936.pep
MAQPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDASTLESLRQKRMEPVSYEQALTCAKEIKAYKYLECSALTQRNLKSVFDEAIRAVLNPRPTPSKQKKNKCSIL

SEQ ID NO: 168519 - protein, 269 aa, Triticum aestivum
  unsure (1)..(269): unsure at all Xaa locations
  Clone ID: PAT_TA_62937.pep
NFANLGVYAGVSTLVALLLTYGIPLFLNEYFPWQSLYKQRHGKPTVTTKSYEGRTVLITGANGAFGSRAAKLFAHRDVDTLVLVDVRDCGELKQEIEKELSAAGKAKPTILVWQADLMNFSGCQEIARKAKDLKTLDHVLMTMGILSFNRRVSPEGWETSIQVNYLSGALLGXLLLPLLKPCSSNPNPPVMTFVTSFGIYPSSFTMGMPKNGSYLKMLSNNKDGMQQAHQYGRSKALLLYFTRELAERASKLPSQVTINSADPGSAWTP

SEQ ID NO: 168520 - protein, 168 aa, Triticum aestivum
  Clone ID: PAT_TA_62938.pep
MTDAEKLEPPKGSPVEDPGAHELAEESESDDQFMDAASGSGSPRISSPIPTTRVEKVDDQPSHGEVPGTQAYELRGQDAQPDEIAIAPETATSGDAPPTPKVSPPTTVVEEAPELPGARSRSYSIQYEERRRADASPDILVASDGQIKEIQGESTNVESNYGTRVAKS

SEQ ID NO: 168521 - protein, 66 aa, Triticum aestivum
  unsure (1)..(66): unsure at all Xaa locations
  Clone ID: PAT_TA_62939.pep
MSPMKXYGWAVSPWMARVLVCLEEAGAEYEIVPMSRSGGDHRQPDHLARNVRMLLASPDPVELLLI

SEQ ID NO: 168522 - protein, 135 aa, Triticum aestivum
  Clone ID: PAT_TA_62940.pep
MFSATRALRQAAVHTERTPLIKFLGPRTIPSNLDHTPKPHPASGAEKLPESWSGYGNGDAAASHKNFSSYRDHVQQHGPLQKSGFGGTSAASLGSVNAPKGVAFDLSELPARFHRARLNAAEVEAIESGGAALFG

SEQ ID NO: 168523 - protein, 274 aa, Triticum aestivum
  Clone ID: PAT_TA_62941.pep
SAPRLSYRGCRHAARNCCALLEAAGLKHVYSPSSDGYKTRTDSYFSISSQLHPYCIVQPEGTEDVSTIIKTLVPDTTCNLAVRSGGHTVWGANNINDGVTIDLGLMNKTTYTQETKVAHVQAGSIWRDVYEALEPFGVTAAGGRTSTVGVAGFLTGGGNTFYTARHGFGCDQVVNFEVVLGDGRIVNANKTENADLWKALKGGSTNFGIVTRFDLQAFDAPLLGGLVTYTTETTDAHVEAYKNWTDNIEGYQDGSVIPFGVYSSAGKMASRSRM

SEQ ID NO: 168524 - protein, 161 aa, Triticum aestivum
  unsure (1)..(161): unsure at all Xaa locations
  Clone ID: PAT_TA_62942.pep
RGARGPERGSPNLQKRMASREDMGEEVMRWVAPYEANXISMARSRXNIRKVGKAGFIIRRSKKSXSRYRERRGHEVKQKGRYSGYGKRRXMREERLPTKILGMRRMRDLGGLLEKNREAKKNDQFLTMTMKRQVXGNRFKKERGLMEETPQNSRCAKAKEK

SEQ ID NO: 168525 - protein, 106 aa, Triticum aestivum
  Clone ID: PAT_TA_62943.pep
MALAKAKEIVASASVVAFRKSNCPFWVKGKKLLTQFGKSLKAVEMDTESKGTEIHSALAERTGKRTVPNVFNKGKKIGGWDETIELNKVGKLVALLKKDGKISGTS

SEQ ID NO: 168526 - protein, 125 aa, Triticum aestivum
  Clone ID: PAT_TA_62944.pep
HTIVEGILILQAAAEHANTSHRLTPASRYAATTGRTSPPPRAETTDRLSAAQDRANCRASETRPSKTPGAPKWRKDGRPDLPETRTDDTCAEIKKPPPTECTRRITSVVMVSAFCERNTTPREKW

SEQ ID NO: 168527 - protein, 123 aa, Triticum aestivum
  Clone ID: PAT_TA_62945.pep
AARAGGRESDRGGKRISPTLPCMLHILPLFLLAAGTHAATFTITNKCQFTVWAAAVPSGGDKQLEPGAQTWNIEEPEETTGERVWECTARNFYEYVNSPVPHGRLRRSAAVHGVRTGALHAGR

SEQ ID NO: 168528 - protein, 112 aa, Triticum aestivum
  Clone ID: PAT_TA_62946.pep
REEVRQWPKAQVNWEAGEGDGELGSSSPWQSEAATGRWRGSRERRAREMGRWVWPLAARGERMRERTRGWGSPGTRLQEEEARPGGLRGKEWAGLVRLPLLPLDFFSAKKKN

SEQ ID NO: 168529 - protein, 72 aa, Triticum aestivum
  Clone ID: PAT_TA_62947.pep
MGAAAAGAFALYEKHEAKKDPEHAHKHKIEEEVAAAAAVGAGGFVFHEHHEKKQDHKEAKEASGEKKHHHFG

SEQ ID NO: 168530 - protein, 35 aa, Triticum aestivum
  Clone ID: PAT_TA_62948.pep
DEPFFFFFFFFFFFFFFFFFFFFFFFFFDMSNSSN

SEQ ID NO: 168531 - protein, 121 aa, Triticum aestivum
  Clone ID: PAT_TA_62949.pep
VFGAMTDEEFFSACTENDTESEGFDDVLTDEEKRQLESALKMDSSDAVGDSQSDTFVGPKHSCFEPREREIPIEDLSISGNGESKHDKKGCFSNWGKRGQTGISKLEMTQKMAPPRSSLCV

SEQ ID NO: 168532 - protein, 41 aa, Triticum aestivum
  Clone ID: PAT_TA_62950.pep
TRGQSHRAKLARQGRAQMIRHGHEFNTIAIDNDSYLGMDHP

SEQ ID NO: 168533 - protein, 30 aa, Triticum aestivum
  Clone ID: PAT_TA_62951.pep
ILLVTVHIQPAELLTKFRSPSFVNLHGNTS

SEQ ID NO: 168534 - protein, 55 aa, Triticum aestivum
  Clone ID: PAT_TA_62952.pep
ANIVFLETRYKRICLPTQGHTSPYQHTLHNPSTDTVTYINNQSRVASTTFSIIHT

SEQ ID NO: 168535 - protein, 125 aa, Triticum aestivum
  Clone ID: PAT_TA_62953.pep
KLAEHGLLLGFLMLLQGGVKHAAAKPREWYVGDQKGWTFGVEGWPNLPTFKPFREGDVLVFKYDRAAQNVMQVDDFGFGTCTRHPANATVYDSGNDRIRLSRGLINFISGVSDNCYKGGVKISLT

SEQ ID NO: 168536 - protein, 105 aa, Triticum aestivum
  Clone ID: PAT_TA_62954.pep
MPEKEIDDDNSTLPKEVDWRKKGAVVPVKNQGGCGSCWAFAAVAAMEGLNHIKNGKLVSLSEQELVDCDAEAVGCAGGFMSWAYEFVMDNHGLTTEASYPYLGVN

SEQ ID NO: 168537 - protein, 34 aa, Triticum aestivum
  Clone ID: PAT_TA_62955.pep
LLCKISDSTSKECILPHCSMTNWLCSQSIFTGFA

SEQ ID NO: 168538 - protein, 38 aa, Triticum aestivum
  Clone ID: PAT_TA_62956.pep
SDVCLLLKLLRPFQITYSVLGSMREREWKVTRGSMSRY

SEQ ID NO: 168539 - protein, 35 aa, Triticum aestivum
  Clone ID: PAT_TA_62957.pep
CFGLRRLVVHLWFLVPTVIRPSCALYKLKDCVWSV

SEQ ID NO: 168540 - protein, 43 aa, Triticum aestivum
  Clone ID: PAT_TA_62958.pep
RFSWAHFLKYPIYVGGNRGRGQIYPDGSKSNNTVYNATSTGIV

SEQ ID NO: 168541 - protein, 31 aa, Triticum aestivum
  Clone ID: PAT_TA_62959.pep
RSNHGAICKSTPYVHTLCIQMKVIIHELEER

SEQ ID NO: 168542 - protein, 84 aa, Triticum aestivum
  Clone ID: PAT_TA_62960.pep
GTETLETSGFKLIIKPSGIRFKRDTTENKTINVRSTTGIQNAAKVQNVQRTCSLDGSIDLRLARTRPLCGACLPLYINPQAAKH

SEQ ID NO: 168543 - protein, 55 aa, Triticum aestivum
  Clone ID: PAT_TA_62961.pep
MFCVPSFFPEEKLSKNKILNYIYFFYIIVHGLHLTRATETSRPQKRQSGDTTLTG

SEQ ID NO: 168544 - protein, 33 aa, Triticum aestivum
  Clone ID: PAT_TA_62962.pep
GVGFFQILIRLVVEFLQFFRCLESNIYFCLMIN

SEQ ID NO: 168545 - protein, 140 aa, Triticum aestivum
  Clone ID: PAT_TA_62963.pep
SIGFGPALASFRLGAVEYALRAIPLGGYVGFPDDDPESGFAPDDPDLLRNRPVPDRLLVVSAGVIANLIFAFLIIYAQAVTVGVPVQALLSGVLVPDVVPGSAAARSGLLAGDVILAVPGAAPDPSVPALVDLIKSSPNK

SEQ ID NO: 168546 - protein, 109 aa, Triticum aestivum
  Clone ID: PAT_TA_62964.pep
MSWDAEQTAVLAGGYYLISASLGSVSNGGRIRCMQVWPIEGIKKFETLSYLPPLSTEALLKQVDYLIRSKWVPCLEFSKVGFIFREHNAFSGYYDGRYWTMWKLTMFGC

SEQ ID NO: 168547 - protein, 56 aa, Triticum aestivum
  Clone ID: PAT_TA_62965.pep
LKTSVFQHSKIHLVASNYIGKQNLHKTIRFLLFKTKINKWFELDAQLQPCSGKQIA

SEQ ID NO: 168548 - protein, 89 aa, Triticum aestivum
  Clone ID: PAT_TA_62966.pep
AQCLVPMYVATKMASIRQASLFAPSPETYARAAVRYIGYEPRCAPYWPHALLWFLFSVVPEPLVDGYVLGMSLGIRKMGRAKEARKKAV

SEQ ID NO: 168549 - protein, 81 aa, Triticum aestivum
  Clone ID: PAT_TA_62967.pep
VYTDAIIWHTKKKEVAAIYKSLAVCNIATRSYCLLEFHFRTVGFILQTVSLEEDTLVRHIHKYKFNMWSDQIHIAYLILSI

SEQ ID NO: 168550 - protein, 77 aa, Triticum aestivum
  Clone ID: PAT_TA_62968.pep
VVHLTSLRCSKIKARRRLRWPRPRRKPPRHSSRRRCRSPRRLRRGQASQLASLSLASWRALAGCRSRRSHRPTPKET

SEQ ID NO: 168551 - protein, 42 aa, Triticum aestivum
  Clone ID: PAT_TA_62969.pep
LSFFYFLPFMQPWIFCDEGVQRTSCFDARTQCLPPGNSICMR

SEQ ID NO: 168552 - protein, 157 aa, Triticum aestivum
  Clone ID: PAT_TA_62970.pep
KLLKGDITMLSSILNVIASTMRLSMKRKIYQPHFTLSLHGIFKLCQAIDGNSRSIELKPSMELGTDVVLMNGPLPIFSEMDKSRTVMVVSWVTSNIFWLCKQKSAAEMSCEEPLNNECLLSKILRWLVASVILGRISRISPEKRGGLATSTNSPGTL

SEQ ID NO: 168553 - protein, 50 aa, Triticum aestivum
  Clone ID: PAT_TA_62971.pep
CRSGAYIKALDQVAVTWYGSSRSIRSMMHARHGACMIDDGSSSCSRSSNS

SEQ ID NO: 168554 - protein, 64 aa, Triticum aestivum
  Clone ID: PAT_TA_62972.pep
AFWLGQAGVEIGTSVGGAVQHAVRQLPVPFRGAQIRRRKLHPPPSADGAVGLLSSERAVDRCPL

SEQ ID NO: 168555 - protein, 139 aa, Triticum aestivum
  Clone ID: PAT_TA_62973.pep
GVVGGLWLLQLLLLGCLWRRLKSNGRRGDAVASGDGGRSGKSASGSGGVGGERFLVSDISEWLDKYRVFKVEELQRGTDGFDDAHLIQGSVYKANIGGEVFAVKKMKWDACEELKILQKVNHSNLVKLEGFCINTATGD

SEQ ID NO: 168556 - protein, 48 aa, Triticum aestivum
  Clone ID: PAT_TA_62974.pep
YPQNLGVLRYSVCKYHFKSGKKFKKNGRQRHNMCQLCHVLKSKFQSQI

SEQ ID NO: 168557 - protein, 128 aa, Triticum aestivum
  Clone ID: PAT_TA_62975.pep
HHEVGHEGDEGEVRHDPAAAGPPLPPPAAKEGAFPGPGHAKAPPARHSPRQGAAPLRELAPQEWLRHGEGPIWVPRRYLPGPWVEESVRAAAERGRSEESVLERGHGGERGIGEESPRNLWALLAFSS

SEQ ID NO: 168558 - protein, 34 aa, Triticum aestivum
  Clone ID: PAT_TA_62976.pep
MKQTCKFSHTPDELRFTILLASSIITSTSCAHVC

SEQ ID NO: 168559 - protein, 46 aa, Triticum aestivum
  Clone ID: PAT_TA_62977.pep
CSGYHLFNTIGTEMVFACVSAQIENSDEPFRLFSVQGDSSFYVIIL

SEQ ID NO: 168560 - protein, 63 aa, Triticum aestivum
  Clone ID: PAT_TA_62978.pep
MSKQGGKAKPLKQAKVAEKDYDENDLAYLQKKKDEQKALKELKAKAGQKGALGGSGLKKSGKK

SEQ ID NO: 168561 - protein, 42 aa, Triticum aestivum
  Clone ID: PAT_TA_62979.pep
SKLHIEKYILFPMGGADETIYMCMESISRNLELLIISYSCYS

SEQ ID NO: 168562 - protein, 44 aa, Triticum aestivum
  Clone ID: PAT_TA_62980.pep
RTRGRTRGWYWMMNVPELFVCQIFIRMRLNLLTFLLCGLKDLFY

SEQ ID NO: 168563 - protein, 76 aa, Triticum aestivum
  Clone ID: PAT_TA_62981.pep
KGPPFFYFFFFLFFFYIFFFFFFFIFFFFFFFFFFFFFFFFFFFFFFFFYSNCMHHACSIFPITDTKYNDQVSTEA

SEQ ID NO: 168564 - protein, 108 aa, Triticum aestivum
  Clone ID: PAT_TA_62982.pep
QEKKHHAPNTTKQTHHETNTNTNTDPQHGSFCPLGSAPRRTPCMCTRVTHSGAPARRWSTVPAWPSSAAACVPRWVTPTRVRTSVPSCSRSRSTHTGRVGGRVGGRVG

SEQ ID NO: 168565 - protein, 95 aa, Triticum aestivum
  Clone ID: PAT_TA_62983.pep
YYFYHIEKFYVEKEIRKDSAKKTDKKSRVKVLLKLVNFTHLMPTRYTLDVDLKEVASGAPDSLTSKDKKVGADKAAKAKLEERFKTGKNRWFFTK

SEQ ID NO: 168566 - protein, 157 aa, Triticum aestivum
  Clone ID: PAT_TA_62984.pep
ALSTLVPGVSYIHAGPVLRLRSPAAEALGPTHLLHSRYATKADLAAYAPHPAHVAAVQAHVAPNALDATAVDWVNAAGAPSPVGPGAAVRLTLAKVKEGVEVGQLVEKVAAATKDAGEASGSKVSFGENFSPARAKGYQFGMVAVFGSVEELDAVEG

SEQ ID NO: 168567 - protein, 80 aa, Triticum aestivum
  Clone ID: PAT_TA_62985.pep
SARRATAPLQIIWRLKRFFNVGDERKLRESVRLVDGFAAEVTRQRHKLGGAAFGSDLLSRVMGSISDEKYLRDIVVSFVL

SEQ ID NO: 168568 - protein, 99 aa, Triticum aestivum
  unsure (1)..(99): unsure at all Xaa locations
  Clone ID: PAT_TA_62986.pep
RGSSLMQLPAGNCRVDPRCDPPGGMDCSAHAVEFDXNTGAVRSFKILTDSWCSSGAFDVDGMLVQTGGYFEGVKVVRRLNPQGNADWVEFPNTLAEGRW

SEQ ID NO: 168569 - protein, 63 aa, Triticum aestivum
  Clone ID: PAT_TA_62987.pep
IRHNTITLFIQSCIKSMHHSSLCELSSSQLINKESVILVRKAENFTDNSLTNTTSLLPSPTIH

SEQ ID NO: 168570 - protein, 56 aa, Triticum aestivum
  Clone ID: PAT_TA_62988.pep
KINKQISQVVLIFQKNWSCRSIRELQITTDCFVFDRFCFRCIVCLSYSLYGLYCLI

SEQ ID NO: 168571 - protein, 71 aa, Triticum aestivum
  Clone ID: PAT_TA_62989.pep
LRKYLRHEQRKSLRRFISFVHGKDPPKNDERRSMSLLGSSTPATPMSSLTTLEIERPAMEVRNTSVIEMES

SEQ ID NO: 168572 - protein, 70 aa, Triticum aestivum
  Clone ID: PAT_TA_62990.pep
WVVRLLLPSEDLLDSDAAFIIPHHSFRSTILRAQFVNSLARFCSQILFLPDTVYILFMSCLNTPASFRCP

SEQ ID NO: 168573 - protein, 143 aa, Triticum aestivum
  Clone ID: PAT_TA_62991.pep
KMQESNSELLLAVKDLDEMLEQKNRDMSILQEETVEDPQEAEYEHALSNVHSAGHKMDMSETSSYQEKEDELMLDALVKKSDGVASSELQEKILELSDEIELYKKDREDLEMQMEQLALDYEILKQETPQFSRWEPHAWPDAW

SEQ ID NO: 168574 - protein, 60 aa, Triticum aestivum
  Clone ID: PAT_TA_62992.pep
YDPVTSHAVPSLLQLCDAVVSSFRSNRGENHTPSPARRGKHQGLDMPVLLATPGKLFKLG

SEQ ID NO: 168575 - protein, 108 aa, Triticum aestivum
  Clone ID: PAT_TA_62993.pep
RNCVLLLNAPPNATGLIDGADMARLREFGAAVRRIFGTDLAEGSRARASSERGGGFEAGKVLDGREETYWAPTAEDGWRNGYWIELRRPAGARAFNVVRVQEHVALGQ

SEQ ID NO: 168576 - protein, 29 aa, Triticum aestivum
  Clone ID: PAT_TA_62994.pep
NYSDDNFTPVASLALGIPLLTVKGNDFKH

SEQ ID NO: 168577 - protein, 92 aa, Triticum aestivum
  unsure (1)..(92): unsure at all Xaa locations
  Clone ID: PAT_TA_62995.pep
DGLRVPTYLYGAAHREGRKLAAIRRQLGYFKPQSSAEWHGPLPVAADTTALPVAPDAGPDAEXASKGVLVLGATDWVDNYNVPVRTDDVEAV

SEQ ID NO: 168578 - protein, 67 aa, Triticum aestivum
  Clone ID: PAT_TA_62996.pep
PLVTIKTYIVAILYNIMRPCIYIATDSIHIRACFLEPCSYMNMDIHIFLGTNKKDKWRRKAQKQCQS

SEQ ID NO: 168579 - protein, 110 aa, Triticum aestivum
  Clone ID: PAT_TA_62997.pep
SVKLVPFNPAYEDASVLWTESKDVGKGFRCIRMVNNTRLNFDALNGDKDHGGVHDGTTVVLWEWCKGDNQCWKIWPWAEAHAAVESGATMGNNAHAMGGGPPVHAVRVFC

SEQ ID NO: 168580 - protein, 87 aa, Triticum aestivum
  Clone ID: PAT_TA_62998.pep
MCEAPTEPRMSCCGGNCGGSTGCTCGNGCGGCNMYPEAEAGGATLLVCATDTHKASSRGMEMADENGGCGCNQCKCGTSCGCSCCSC

SEQ ID NO: 168581 - protein, 52 aa, Triticum aestivum
  Clone ID: PAT_TA_62999.pep
IKQDMCSGLKYSHFSRNHCIWERLRDGTKPTNVPINEPRTFYFYFLEENDYF

SEQ ID NO: 168582 - protein, 121 aa, Triticum aestivum
  Clone ID: PAT_TA_63000.pep
GIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 168583 - protein, 36 aa, Triticum aestivum
  Clone ID: PAT_TA_63001.pep
PFLFFFFFFFFFFFFFFFFFFFFFFFFFFFFFFFFF

SEQ ID NO: 168584 - protein, 79 aa, Triticum aestivum
  Clone ID: PAT_TA_63002.pep
GREGTGGFVYIGPSLSYILFPSRHATPLCVSCEYMPSWSLGWRDGYFARAYAHRPQTAARIQVLEGKDLVFELAHGPRP

SEQ ID NO: 168585 - protein, 92 aa, Triticum aestivum
  Clone ID: PAT_TA_63003.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLA

SEQ ID NO: 168586 - protein, 86 aa, Triticum aestivum
  Clone ID: PAT_TA_63004.pep
HASAHASGARSEAAMISDGCQWRKYGQKMAKGNPCPRAYYRCTMAAGCPVRKQVQRCAEDRTVLITTYEGNHNHPLPPAAMAMAST

SEQ ID NO: 168587 - protein, 132 aa, Triticum aestivum
  Clone ID: PAT_TA_63005.pep
NLDWYMGPTLVEALDQIIEPKRPSDKPLRIPLQDVYKIGGIGTVPVGRVETGVIKPGMVVTLGPTGLTTEVTSVEMHHESLLEALPGDIAGFNVKNVAEKDLKRGFVACNSKDDPAKEAANLTSQVIIMNHP

SEQ ID NO: 168588 - protein, 97 aa, Triticum aestivum
  Clone ID: PAT_TA_63006.pep
RDAGRQGELRGALRGGGHGRGWQVPVGAVRRAGAGRGRDRPPSPHRQGGQGEQEPPSPWLITYLVTLGSLLSTTRLNLEYYIYLPWLDIGDLVVNWW

SEQ ID NO: 168589 - protein, 53 aa, Triticum aestivum
  Clone ID: PAT_TA_63007.pep
GGTLGHTWGNAPGAPANRVALEACGQARHKGRDLVREGNEIMRAACKWSPELA

SEQ ID NO: 168590 - protein, 77 aa, Triticum aestivum
  Clone ID: PAT_TA_63008.pep
PRVRASPGYYDGRYWTMWKLPMFGCTDATQVINEVEEVKKEYPDAYVRIIGFDNMRQVQCVSFIAFKPPGCEESGKA

SEQ ID NO: 168591 - protein, 88 aa, Triticum aestivum
  Clone ID: PAT_TA_63009.pep
LPRSRPPAAPPASPPARAPAPGGARPRPRPAARARTTPSPSRAAKRTTAAAPNAARAPPSTPTPGRTPARRLPPPPWTGARPPSSSRE

SEQ ID NO: 168592 - protein, 120 aa, Triticum aestivum
  Clone ID: PAT_TA_63010.pep
LAFAHASAHASDQFSRRESERPTFPSSQAMALRVSTLPVAAVGRAGNYTVHGITESPGGIWDGLTIVGIVVTGVLLRRRLRSWSRHLFSGSRPHDPQHRDLRVRADRAENKGKREQWAET

SEQ ID NO: 168593 - protein, 117 aa, Triticum aestivum
  Clone ID: PAT_TA_63011.pep
SPTGVQKESHNTHYQERFCTRLRRHQEFTHTTRHNSACSLTRQPKRERHVWETTWQHFQPTPVRKLLCMHAYSSLSFDERVSTISLTTQDHPLVQSPAAARHFIIFLYGPPSFSYNE

SEQ ID NO: 168594 - protein, 79 aa, Triticum aestivum
  Clone ID: PAT_TA_63012.pep
APRGRPSSGPTARRSPPHAPGTPSTPTRTTTAGWSSRGRRCGPTPSRPPPPRRSPPTSGTPSSSAPPRRAPGRPGSRSR

SEQ ID NO: 168595 - protein, 59 aa, Triticum aestivum
  Clone ID: PAT_TA_63013.pep
GFCRGTLHQWSALRPCHSCPQLGLPCDRYMVLPLCTLLRVIEYASDRFVASWRVSTKEY

SEQ ID NO: 168596 - protein, 63 aa, Triticum aestivum
  Clone ID: PAT_TA_63014.pep
HMSQSHLFQGTCPCTSSARSICLLEGCTLLISVYAYCALTPKRNTLGTGVARAVWRAVQLNLP

SEQ ID NO: 168597 - protein, 67 aa, Triticum aestivum
  Clone ID: PAT_TA_63015.pep
QSLPDGIDRHSLLIYESEKGCTFQHICRQTRSTSPLLSEISDRYCTHTHLTGKNHLSASSQCPNCGS

SEQ ID NO: 168598 - protein, 87 aa, Triticum aestivum
  unsure (1)..(87): unsure at all Xaa locations
  Clone ID: PAT_TA_63016.pep
DVWARKLALQRWLEVIDPXHRYGHNLHYYYDCWLRCESREPFFYWLDIGEGKEINLEDRCPRSKLLSQCIKYLGPKEREEYEVVIED

SEQ ID NO: 168599 - protein, 37 aa, Triticum aestivum
  Clone ID: PAT_TA_63017.pep
GATQPNLARTGSTCHGSSGPGGRIRHNTGYGTTEIAA

SEQ ID NO: 168600 - protein, 72 aa, Triticum aestivum
  Clone ID: PAT_TA_63018.pep
EYVRGTWSRVCVRPIMHHSSICKHLWLLTKYKISTEIAGIQKYLYFQKKSTKLDLEVRFQQYESYTYDKNIK

SEQ ID NO: 168601 - protein, 55 aa, Triticum aestivum
  Clone ID: PAT_TA_63019.pep
ISPTVTSPALQRTYILSLLCCLLLVLVLYAERVCCGGVTRWSTLTIKLQSVRTRE

SEQ ID NO: 168602 - protein, 42 aa, Triticum aestivum
  Clone ID: PAT_TA_63020.pep
SSSTFTDCVNCLIAFTNSRFNKDIGLNAIGFLRFCAAKLAEG

SEQ ID NO: 168603 - protein, 60 aa, Triticum aestivum
  Clone ID: PAT_TA_63021.pep
YLSELAVNSMGMNMGPPVVRRDEFQLRKPDGRRHEMDRLNGRDRDRDRDREREHSRERER

SEQ ID NO: 168604 - protein, 51 aa, Triticum aestivum
  Clone ID: PAT_TA_63022.pep
LPKGGLRRDHHADRELLAADLHGSAGGGGWEEVAGVRCVSPERSCVCVGFQ

SEQ ID NO: 168605 - protein, 79 aa, Triticum aestivum
  Clone ID: PAT_TA_63023.pep
IQLASVCAVSPDDHQIWISSFPFGLWSTLLLGEHRRPAAGCSWSSYLEDEQQQQALASLRVPFPPFPSKSREEEGKEGS

SEQ ID NO: 168606 - protein, 57 aa, Triticum aestivum
  Clone ID: PAT_TA_63024.pep
TLCQKWSPLLPILLLAGMVGISQAGNIAVYWGQNGNEGTLVDACNFGLYAYVMVSFL

SEQ ID NO: 168607 - protein, 36 aa, Triticum aestivum
  Clone ID: PAT_TA_63025.pep
VVEGGGFFSSTASGYSHGLALLLLGRTEEDKPVKAW

SEQ ID NO: 168608 - protein, 125 aa, Triticum aestivum
  Clone ID: PAT_TA_63026.pep
VISVMKLPVFFKQRDLLFFPAWAYTIPSWILQIPITFVEVGVYVFTTYYVIGFDPSVSRFFKQYLLLLAINQMSSSLFRFIAGIGRDMVVSHTFGPLSLLAFAALGGFILARPDIKKWWIWGYWI

SEQ ID NO: 168609 - protein, 50 aa, Triticum aestivum
  Clone ID: PAT_TA_63027.pep
LALAMQAHPDRVAVAVFASAAMPAAGKPLKFVSEQFAQERGPGFFMDSVI

SEQ ID NO: 168610 - protein, 40 aa, Triticum aestivum
  Clone ID: PAT_TA_63028.pep
LLSHHAADAQSATTKRNPPRWPPRRRRRRSPTRGSYRGGG

SEQ ID NO: 168611 - protein, 66 aa, Triticum aestivum
  Clone ID: PAT_TA_63029.pep
QSHPPSPGGGVVARPSQTRACAEEHGPRRAWPGVPEAPPPSPPAWTAQGAWISGTRWWRACHGGQR

SEQ ID NO: 168612 - protein, 67 aa, Triticum aestivum
  Clone ID: PAT_TA_63030.pep
SRRARRTCGPPSPPGRRRRRPDAGAAAAPPPCTESRIGSRWERVPSPASCLIGRMAPIPHKALVQDD

SEQ ID NO: 168613 - protein, 49 aa, Triticum aestivum
  unsure (1)..(49): unsure at all Xaa locations
  Clone ID: PAT_TA_63031.pep
VVDLLAPYQRGGKIGLXFGGAGVGKTVPHMELINNVAKAHGMYFPGSLK

SEQ ID NO: 168614 - protein, 54 aa, Triticum aestivum
  Clone ID: PAT_TA_63032.pep
LEELKMNYELLDNTATHFVPKTLKTTENCLEVVNSFVSIFMVKMCHNLIHLTNS

SEQ ID NO: 168615 - protein, 121 aa, Triticum aestivum
  Clone ID: PAT_TA_63033.pep
SNPIPTLCFTIPYCICSQTSNKMSDELDLLREQKKILSEEAALQLSSLKRMSDEAAKSPQNEEINEEIKVLNDDIKAKNDQIATLERQIMDFVMTSHEALDKSDIMQVGSNCQVLCTDFFC

SEQ ID NO: 168616 - protein, 83 aa, Triticum aestivum
  Clone ID: PAT_TA_63034.pep
RDSICPDHNLKLCNQNLLLYLQSLKIHWLLKKVCFPCSSIGFFLIIGVFLVIFYLFVKLIIGCLGNKLYTIKVVQDSNLPVGT

SEQ ID NO: 168617 - protein, 63 aa, Triticum aestivum
  Clone ID: PAT_TA_63035.pep
VRTNKIKNFDLRNQLNEILRVPFYGAVREKLNHKQMIEFERPENAIIYNIKIYYINGVRKWLK

SEQ ID NO: 168618 - protein, 111 aa, Triticum aestivum
  unsure (1)..(111): unsure at all Xaa locations
  Clone ID: PAT_TA_63036.pep
LSRSFKWSSDHGLSPVHNIMDIPWFFRNENGLYGLKTNFVHGLNGLAHTVYGWPINFFNTSIXFFSSLSLGNDALSPGDKALSRRRPSSTSLSTPTPVSSTSLWVCPNFNC

SEQ ID NO: 168619 - protein, 59 aa, Triticum aestivum
  Clone ID: PAT_TA_63037.pep
KKMYQFRCIGSLFCRRGQLNEFKEEKESDACSSSSFLLKDQTPTNKTKGKPKRLSCETW

SEQ ID NO: 168620 - protein, 69 aa, Triticum aestivum
  unsure (1)..(69): unsure at all Xaa locations
  Clone ID: PAT_TA_63038.pep
TVLLQRPTDKVLAMALXKNLALCEVCGSFLVANDAAERTQSHVTGKQHVGYGLARDLIAEQKVSLRTNT

SEQ ID NO: 168621 - protein, 50 aa, Triticum aestivum
  Clone ID: PAT_TA_63039.pep
RAKKSTSASTDLKLVSIDYLRISNLLKYIFLILVLLLILVVLMSMRLFLA

SEQ ID NO: 168622 - protein, 83 aa, Triticum aestivum
  Clone ID: PAT_TA_63040.pep
LCIFMLKQSPTFNTPSVLSRHEPRGLHTVLVTGGAGSIGSHAALRLLKESYRVTIVDNLSRGNLAAVRILQELFPEPGRLQFI

SEQ ID NO: 168623 - protein, 101 aa, Triticum aestivum
  Clone ID: PAT_TA_63041.pep
MTKRKQQDTKENLTLTVFESNKRCSNSGGEYFDRIPADLVIKILSKLSAKSMAKCRCVCKLLSSIIRQPNYNQLFPIKYPDPPRFIFTFLGGGMLFSYTST

SEQ ID NO: 168624 - protein, 151 aa, Triticum aestivum
  Clone ID: PAT_TA_63042.pep
THDKSKGGNYVYDGLYLLEKYWQQVGSHGMNVFKFQLRRIPGQPELSWVEVKKSKSKYREGLCKLDISEGKEQSPISAVNEIDDEKPPLFTYTVKLIYPDWCRPFPPKSCCCTTRCTEAEARVCACVEKNGGEIPYNFDGAIVGAKPTIYE

SEQ ID NO: 168625 - protein, 66 aa, Triticum aestivum
  Clone ID: PAT_TA_63043.pep
YLKIIKLLMTERNQEITPHMRNYRISPLRSNNSIELSMIVCVIASTIPGISMNPIIAIAQDTLFSF

SEQ ID NO: 168626 - protein, 83 aa, Triticum aestivum
  unsure (1)..(83): unsure at all Xaa locations
  Clone ID: PAT_TA_63044.pep
APQVEILAXHKAIEGFVSHCGWNSILESLRFEVPIATWPMYAEQQLNAFTIVKELGFALEMRLEYVSKYGEIVKADEIAGAVR

SEQ ID NO: 168627 - protein, 57 aa, Triticum aestivum
  Clone ID: PAT_TA_63045.pep
TYLDKIIKLHEFPIQNHFKIICNKLTSTCILCLVPSNSQNDSDHMYWFFFFSLFGQL

SEQ ID NO: 168628 - protein, 81 aa, Triticum aestivum
  Clone ID: PAT_TA_63046.pep
MEPTNTSYPITTHTPNVQLTQNHQSFQLIYRSTRLRRKKTDESEPKPYKREIPSGQPRRIHAFQRSTPIQPRRDKGSHFVH

SEQ ID NO: 168629 - protein, 55 aa, Triticum aestivum
  Clone ID: PAT_TA_63047.pep
HLAFVFHTYSINSTYDPHSSYLFYYFVRPDFSVSICFAVSKFFVNPLIYYLIKII

SEQ ID NO: 168630 - protein, 142 aa, Triticum aestivum
  Clone ID: PAT_TA_63048.pep
VEDMTDVILGLQGEPPSNYLHGVPFVGGRDKVAACAKHYVGDGGTTRGVNENNTVTDLHGLLSVHMPAYADAVYKGVSTVMVSYSSWNGEKMHANTELITGYLKGTLKFKVCLLITTSTHILCVLAVVFLNEYFSLSMFIDS

SEQ ID NO: 168631 - protein, 40 aa, Triticum aestivum
  Clone ID: PAT_TA_63049.pep
MSYDCLYVILCRVEPSSHIYYLSWKSEQSRKPSNWPAINL

SEQ ID NO: 168632 - protein, 85 aa, Triticum aestivum
  Clone ID: PAT_TA_63050.pep
VNVACFHPSPGGGLVYGTKEGKLRIFRYNTAAASNLTAPNSSPDENLAEGRIWVSTILYTHSHRQILHCGTIYLPLFLFGLLLPV

SEQ ID NO: 168633 - protein, 84 aa, Triticum aestivum
  Clone ID: PAT_TA_63051.pep
KQNSINNFLVIIMLFINSPFWLPFTIIILFNSYVPLGSYLWPFSFFLVPFCYFSFIFLSFLLFITNQSLKSNYQSQKFYQKHHS

SEQ ID NO: 168634 - protein, 72 aa, Triticum aestivum
  Clone ID: PAT_TA_63052.pep
CSDLEKIRKLKKEAEFLEASFRAKAASLQEGGGDSDSQEYSEEQSQYLRGKDPKNSINSVDQGTRYVACSFS

SEQ ID NO: 168635 - protein, 42 aa, Triticum aestivum
  Clone ID: PAT_TA_63053.pep
SLLHCKNNFFINCIYYLLILKIIANYLKLIYAMPEKKNVSIL

SEQ ID NO: 168636 - protein, 51 aa, Triticum aestivum
  Clone ID: PAT_TA_63054.pep
PANIGFVYSDVRTYTVYNEKGGVLCERLNNIYTQNRKMLANTSPTMMDRSK

SEQ ID NO: 168637 - protein, 82 aa, Triticum aestivum
  Clone ID: PAT_TA_63055.pep
ICISVLRYVPLESLYPSLALGFYCRDKDDFDDFCLRALKLAEESNGAPLFTVTQTHTAINQSNYGFADDDSEDEREDDWQML

SEQ ID NO: 168638 - protein, 89 aa, Triticum aestivum
  Clone ID: PAT_TA_63056.pep
LLQVLFQNDSPASLLARDMEIVGSFDNEMLTKVRDSHKYFTKSRMLYDRTQESNRLEYLIPKRTSFRHRLPMGDQEITDIVAHLLEINP

SEQ ID NO: 168639 - protein, 76 aa, Triticum aestivum
  Clone ID: PAT_TA_63057.pep
MVKPSSSVSSVSMFALFSLVLCILIHCLYTKKPSFFQRFLSLLLPDLRLLEVDKEKQDPKSPRGALEACLTRCSIS

SEQ ID NO: 168640 - protein, 58 aa, Triticum aestivum
  Clone ID: PAT_TA_63058.pep
KRWYQFSTWILFCPLHCLNCYLIIIYVYILRERRHNMYVWDKLKTLIFYNNMFHVISL

SEQ ID NO: 168641 - protein, 78 aa, Triticum aestivum
  unsure (1)..(78): unsure at all Xaa locations
  Clone ID: PAT_TA_63059.pep
SFRFVNCLIKIIYFSYSFTDPQPSYSAFREASFGHALLEIKNRTHAHYTXHRNKEDEAVIADSIWLKNRYYLPEEEKI

SEQ ID NO: 168642 - protein, 177 aa, Triticum aestivum
  Clone ID: PAT_TA_63060.pep
PILDRTTKNSVISTTLNDLSNWSRLSSLWPLLYGTSCCFIEFASLIGSRFDFDRYGLVPRSSPRQADLILTAGTVTMKMAPSLVRLYEQMPEPKYVIAMGACTITGGMFSTDSYSTVRGVDKLIPVDVYLPGCPPKPEAVIDAITKLRKKIAREIYKDRIRPQQGNRCFTANHKLFV

SEQ ID NO: 168643 - protein, 94 aa, Triticum aestivum
  unsure (1)..(94): unsure at all Xaa locations
  Clone ID: PAT_TA_63061.pep
MKAHFCRTVLSLPPIINGALSAIPLQTKNVFIECTATDLTKAKIVLNTMVATFSEFCARKFEIEPVEVTYDDGKXHLXKDLAVYDMEVPLSVIT

SEQ ID NO: 168644 - protein, 99 aa, Triticum aestivum
  Clone ID: PAT_TA_63062.pep
KNTFVCLLLEKNHNAKCIYTFILGDYLILIFIKICMQGLKALVEKVVDNLRVNMIVLGGLLFKKIAVTSLQPIGCLPSYTSASSFKSCNESQSALVELH

SEQ ID NO: 168645 - protein, 144 aa, Triticum aestivum
  unsure (1)..(144): unsure at all Xaa locations
  Clone ID: PAT_TA_63063.pep
SHPGNPAIVXFDWTTSGTPRRSARISEKTKATPIPNKEPPKKRGRTKSAVSKKDAEGEKSEGGGEENSHVKDTEMNPPEGIAQNENVTDKNGSGETERVNDAKENIVAEETPNAAPVQEEGESMKEKALDSVDDKSKETDKEKD

SEQ ID NO: 168646 - protein, 79 aa, Triticum aestivum
  unsure (1)..(79): unsure at all Xaa locations
  Clone ID: PAT_TA_63064.pep
LRIKTRTATDLKSISIVSLLEDTMTKTHMDFGXTIKALRSKKHIKTRTATDLKSXKYCILVRRYIDKDSYGIRLNHPSF

SEQ ID NO: 168647 - protein, 145 aa, Triticum aestivum
  Clone ID: PAT_TA_63065.pep
MLFFFYVQLENYSKEESQLQTTSLHSSSSVSGIRRPSSSSSSRSTSRPPTPTRKSKTPAKRPSTPTSRATSTTTRAALTSSSTTSSTRSWRRPSSSSGTGTSRVTLTAARATSPTTSTDQHTTGSATSTRSNNRPMSAPNSKPGS

SEQ ID NO: 168648 - protein, 68 aa, Triticum aestivum
  Clone ID: PAT_TA_63066.pep
YGNVTAGHAVGGFQFPQHMIGPTVNRAQPQRYTAQYHSVQAAPMLVNPSPQVIFHGGPKNSLLLKARF

SEQ ID NO: 168649 - protein, 71 aa, Triticum aestivum
  Clone ID: PAT_TA_63067.pep
NLNHNLIKPAGLTGLVSLNVSNSRVSSSGLRHLKPLKNLRSLTLESCKLSANDIRKLQATDLPNLVNFRPE

SEQ ID NO: 168650 - protein, 62 aa, Triticum aestivum
  Clone ID: PAT_TA_63068.pep
LYSNPRKVSSTFLFPSYIKKIDIVFAHSSLLGFFSLLPISSSSKTFLLSNFCENMFDDEHHF

SEQ ID NO: 168651 - protein, 164 aa, Triticum aestivum
  unsure (1)..(164): unsure at all Xaa locations
  Clone ID: PAT_TA_63069.pep
WIVRVDALEDIIGGHVWLGSXICIFGGIWHILTKPFAWARRALVWSGEAYLSYSLAALSVCGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQ

SEQ ID NO: 168652 - protein, 99 aa, Triticum aestivum
  Clone ID: PAT_TA_63070.pep
GPAILQKHIDIFTYAKTFCSILKFDAVPWGLEGVLQHIKHRYNNPPIYILENGSPMKHDSMLQDTPRVEYIQAYIGAVLNAIKYGHPFSNFSPHVNIFD

SEQ ID NO: 168653 - protein, 116 aa, Triticum aestivum
  Clone ID: PAT_TA_63071.pep
WKLELIWGLIVYFWIGIVLGLFEDGRYKSESKKPSLKAVDIIGFGTGAEVEKKLKYAEDVSYGVIFGRELINSPANVLTPAVLAEEAAKVASTYSDVFTANILNEEQCRELKMGSY

SEQ ID NO: 168654 - protein, 141 aa, Triticum aestivum
  Clone ID: PAT_TA_63072.pep
ISHLLTIFLGYSSCNLCYIEQVTGFLGGVNWALLVARLCQFYPNAIPSMLVSRFFRVYTQWRWPNPVVLCAIEEDDLSFPVWDPRKNRRDRYHHMPIMAPAYPCMDSSYNVSQSTLRVMTEQFQIGNTICQVRKHNTRFCL

SEQ ID NO: 168655 - protein, 46 aa, Triticum aestivum
  Clone ID: PAT_TA_63073.pep
DIFQQIRPIKIFTSSKDVTQENMAQAMSKTEGSTGLHGIRGTQSPA

SEQ ID NO: 168656 - protein, 110 aa, Triticum aestivum
  Clone ID: PAT_TA_63074.pep
QVAAANPHFSGSFSARSKLDITDIDTVFMLTEALEIGLGQGIAARAQGINSGGHWVPSLHIGLARVQTSRSHTAEDLSGCCRECKGKNQGKNDKLSVWLHGFIYIERVFT

SEQ ID NO: 168657 - protein, 60 aa, Triticum aestivum
  Clone ID: PAT_TA_63075.pep
LLAIQWTGLTPCITASTCLCFRGIELNHTFTISRPEKPVYQFGAIANSLLHCYIQDIRNF

SEQ ID NO: 168658 - protein, 158 aa, Triticum aestivum
  Clone ID: PAT_TA_63076.pep
MIKNRLEFVKEFVYVNGWSKEWPLAADEERRKLLKEIRLLLVLLLERKILSCSIRDWMMRFPVKHLIAQFEVSENTITTECRLVETPQSICFLECDELNQILDLLKRIKCERDDGTELISMATDSLWRRTQVKEKIDINHECSLMLLDKRMLRGKNAL

SEQ ID NO: 168659 - protein, 50 aa, Triticum aestivum
  Clone ID: PAT_TA_63077.pep
MDGIKYAVFTDKSIRLLGKNQYTFNVESGSTRTEIKHWVELFFGVKVIAM

SEQ ID NO: 168660 - protein, 120 aa, Triticum aestivum
  Clone ID: PAT_TA_63078.pep
SLILVECVYVQEVPDPEIMVTFPVIGDQDNAAFVAWTTTPWTLPSNLALCVNAKFVYVKVRNKNTGKVYIVAESRLSALPTDKPKAKLSNGPAGDTKKANPKAKGEKPESAADSYEVLEK

SEQ ID NO: 168661 - protein, 114 aa, Triticum aestivum
  Clone ID: PAT_TA_63079.pep
AKEVSLDNAYSDQEIEKRSSVVLFNASKKEVKQESSFKQEPLLCEPQIEARVNPRVFRYNPKFKSPSTNNTSLHELRPIQIQESISMNSNRQKSPVDQESYDKENVDGHSTETG

SEQ ID NO: 168662 - protein, 46 aa, Triticum aestivum
  Clone ID: PAT_TA_63080.pep
SISSSFGVFLNSLTFGSYASSYYPPTFSSLNFTTCTEHTNQEFRFI

SEQ ID NO: 168663 - protein, 164 aa, Triticum aestivum
  Clone ID: PAT_TA_63081.pep
SLFLTTVLLFPLAIWSFFFSGSGDDSVSFGNLGWPLANTVVFGVLLSENYNDDKFSSSKKDSEREFLVTFLCTIVLELFYFPELSLWGLLLCGLLLYIAVRELESVYSDYQEIGMESPESFSTMFMKPIRHILSDKKSRKIALFLLINTAYMVVEFVAGFMSNS

SEQ ID NO: 168664 - protein, 124 aa, Triticum aestivum
  unsure (1)..(124): unsure at all Xaa locations
  Clone ID: PAT_TA_63082.pep
KIPKWMIDSXFHTRKNRRKWGDLTDSAYFSIVSHDQDNWLNPAKPFXEVHLISSFSKANRLRFLNNPHHFCLYCNKRFPFYVEKARLNNSDFTFTYGQFLTISFIHNKTFSSCGGKKKHAFLER

SEQ ID NO: 168665 - protein, 49 aa, Triticum aestivum
  Clone ID: PAT_TA_63083.pep
LNSSTFQKFFSKSKGWLKPYAAFCFLRDFFEASVHSPWGSLSDPPDDKV

SEQ ID NO: 168666 - protein, 57 aa, Triticum aestivum
  Clone ID: PAT_TA_63084.pep
ILKQMDLVLVNVLPIPVDFSQKCSLMSKQNKKERWSNHAFHTLSIWVNIHAPFEFQL

SEQ ID NO: 168667 - protein, 114 aa, Triticum aestivum
  unsure (1)..(114): unsure at all Xaa locations
  Clone ID: PAT_TA_63085.pep
VAIGCTKSDYFLDFRCATQPLTVMLPRYNDHPLTLCYGEEKASGKYWCDICERESNPKTWLHTXCKELWRSHLHVFCVVGDVIYTNPGAMIKCYIEKLSNNSSSRPLCHRCHCR

SEQ ID NO: 168668 - protein, 87 aa, Triticum aestivum
  unsure (1)..(87): unsure at all Xaa locations
  Clone ID: PAT_TA_63086.pep
ELKPQSYPKSLSFVFLFEDTKTETHIDFSXTINALRSKKKLELKPQPXPNSLSXCFLVRRYKDKDSYGLWLNHQSFEKQEEAWLVLL

SEQ ID NO: 168669 - protein, 39 aa, Triticum aestivum
  Clone ID: PAT_TA_63087.pep
KYSLISISIIVKKLHKFSYIKYTFRCNKLNQCVIQKLKA

SEQ ID NO: 168670 - protein, 94 aa, Triticum aestivum
  Clone ID: PAT_TA_63088.pep
ELFENALSLPMVKIRQCLVPRTEIEGLDISTPIEELKQQFITTQLSKLIVYDDNIDSIQGYVHQLDLFRKPGSIREILHPIMAVSESMSATDLI

SEQ ID NO: 168671 - protein, 91 aa, Triticum aestivum
  Clone ID: PAT_TA_63089.pep
RRRRYFKEEVVGNYGPQLICSLLWFCYISCIRDYSVTLNTLTPPHKNQIPLSYQAPSTLTPSKEKDHAKHFKECKELTNVNSKFCRIKADG

SEQ ID NO: 168672 - protein, 65 aa, Triticum aestivum
  Clone ID: PAT_TA_63090.pep
SHHVLIKIWTYYLQVTIRNPNYISSKIEVYYYFILFVCELINPIRLIKKAGQYLYFFQIYYITYL

SEQ ID NO: 168673 - protein, 160 aa, Triticum aestivum
  Clone ID: PAT_TA_63091.pep
LFPHLANGKPRKPTDGIAHVQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 168674 - protein, 160 aa, Triticum aestivum; identical to SEQ ID NO: 168673
  Clone ID: PAT_TA_63092.pep

SEQ ID NO: 168675 - protein, 163 aa, Triticum aestivum
  Clone ID: PAT_TA_63093.pep
FSDLFPHLANGKPRKPTDGIAHVQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 168676 - protein, 154 aa, Triticum aestivum
  unsure (1)..(154): unsure at all Xaa locations
  Clone ID: PAT_TA_63094.pep
FSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDXVFVNLESELTKRLESGEGTF

SEQ ID NO: 168677 - protein, 33 aa, Triticum aestivum
  Clone ID: PAT_TA_63095.pep
KRPSQGGLQFSLHRYLGLTRIAYQIRKIQPKST

SEQ ID NO: 168678 - protein, 92 aa, Triticum aestivum
  Clone ID: PAT_TA_63096.pep
RFAAFLGGHRLVLHGRCSGGAGGEGQAVGRHGGRGALRVRQRPALAPQPVGQLPRLRARRLTGFREVRASVGRGGLQQVWGDAQPGLLGGYG

SEQ ID NO: 168679 - protein, 81 aa, Triticum aestivum
  Clone ID: PAT_TA_63097.pep
KPRPADGGFLPERPPSAGRRWRGPRPVTMFREVSQMSTRPWRQSRSLKSHSAPPSSSYDKRSAGRRSGGSPTGLRRTARVG

SEQ ID NO: 168680 - protein, 93 aa, Triticum aestivum
  Clone ID: PAT_TA_63098.pep
MPAAGKSINVREFIDERAVSPFQWLVGFLTFVDISLDGWDTVIIGFVVPELIKEWGVTKSALAPVLSAALFGLAAGALLGGPIADRFGRKRVL

SEQ ID NO: 168681 - protein, 25 aa, Triticum aestivum
  Clone ID: PAT_TA_63099.pep
PHTSIQVPMDINRPTNCQGSLQLRH

SEQ ID NO: 168682 - protein, 72 aa, Triticum aestivum
  Clone ID: PAT_TA_63100.pep
GDHPRGFLLRVVGVERPMDRRRGGALVLAHLIEVDRVAHIVPVPGAELGHAGPIGHPLSSSRSLAGARRDRA

SEQ ID NO: 168683 - protein, 32 aa, Triticum aestivum
  Clone ID: PAT_TA_63101.pep
SDGCSWFNYVMYGVVCNKAICMIFGRVGGRVG

SEQ ID NO: 168684 - protein, 40 aa, Triticum aestivum
  Clone ID: PAT_TA_63102.pep
DLIGQNGDRHHHHQTLAVGLQTFHETKLCMCAMQRNRNKT

SEQ ID NO: 168685 - protein, 91 aa, Triticum aestivum
  Clone ID: PAT_TA_63103.pep
LDAWADAWARDAALQSRNTENQTGRAVPNNSEASSSCHTVQKRSGPLKLTPGAKHILVPSDSTHGDSMPVYSCLSFGSRSGNAAGSQNKGA

SEQ ID NO: 168686 - protein, 59 aa, Triticum aestivum
  Clone ID: PAT_TA_63104.pep
MSNKEHLAMKFKHEYIKLTCIVKFHKLLPKLGKLLHKLDKNIKFTKNKKTMERTRGRTK

SEQ ID NO: 168687 - protein, 104 aa, Triticum aestivum
  Clone ID: PAT_TA_63105.pep
LSTRTGQSIVPSRLPGPLDCTNVRAADYWYYHHSALRRDHGVQRERSAQHIGSHGHGGSDPAAAGAPPGAPCCRHGGRRLAPGLRGHGGRHLRGGSRWLCPFRR

SEQ ID NO: 168688 - protein, 72 aa, Triticum aestivum
  Clone ID: PAT_TA_63106.pep
TAGRGFDFGGPIEELFRWLAGGVSLGPLGRAALFFFFFFFFFFFFFWFFGFFFFFFFYFFFFFFFFFFFIYF

SEQ ID NO: 168689 - protein, 37 aa, Triticum aestivum
  Clone ID: PAT_TA_63107.pep
QQIIDVLEPILDSLPSFTSRITFPYVQAATEVFGRVK

SEQ ID NO: 168690 - protein, 38 aa, Triticum aestivum
  Clone ID: PAT_TA_63108.pep
TVKGILSLIHTIYESAQRYTHGTGENNNKSRKSTSQES

SEQ ID NO: 168691 - protein, 56 aa, Triticum aestivum
  Clone ID: PAT_TA_63109.pep
VIVRLVIEGKEGSQLRARLAALREEAEAALQEGGSSQAAFAQFLLDVDNLERQLSE

SEQ ID NO: 168692 - protein, 33 aa, Triticum aestivum
  Clone ID: PAT_TA_63110.pep
TSVISIVYQPRMSLGGMLNALDAALPGSSSTTP

SEQ ID NO: 168693 - protein, 44 aa, Triticum aestivum
  Clone ID: PAT_TA_63111.pep
FADLPHVMFACTGLLHQNLPRIIFPHGPDTENTHTWGPLCFGGP

SEQ ID NO: 168694 - protein, 51 aa, Triticum aestivum
  Clone ID: PAT_TA_63112.pep
ATKSSTIRKQHWSGHGSSTRARWYRELNTACRSWGLMAGFRRKGRDFKRER

SEQ ID NO: 168695 - protein, 90 aa, Triticum aestivum
  Clone ID: PAT_TA_63113.pep
KVKVKDCASALRAKAKIVWAKLAEKTEAATSRSHDERQLAHERGRAKVAATEAQLHQEKVAHREAAMEHRLHKHASVGGHNHKHGARGVH

SEQ ID NO: 168696 - protein, 42 aa, Triticum aestivum
  Clone ID: PAT_TA_63114.pep
TKQKDMNSLSSSQYLIQSTSQTRELGVQISEEWFGESPPIPL

SEQ ID NO: 168697 - protein, 48 aa, Triticum aestivum
  Clone ID: PAT_TA_63115.pep
LLADKVHLQMCRTTDPRGQLSQHVALVVTSCFLFRFTLNCVKASKKIN

SEQ ID NO: 168698 - protein, 83 aa, Triticum aestivum
  Clone ID: PAT_TA_63116.pep
GMVNQLSLQNIERAISKPELSLTSSARTVRLNNLSDGSAVPAIEDPSLRAILCSDQIHVIFLMCFYLCFWNVGASCAMPSKRR

SEQ ID NO: 168699 - protein, 117 aa, Triticum aestivum
  Clone ID: PAT_TA_63117.pep
LTPVVFPFSELQKFQELGKEEPITSLHDGGESSSCIHAGHEGASEASSSYRFGSEKMGEMELTSLDSEILNLVNNVEHLEIKLEEAKRILEVKETQIRELESTINVSETCNGGTEIG

SEQ ID NO: 168700 - protein, 130 aa, Triticum aestivum
  unsure (1)..(130): unsure at all Xaa locations
  Clone ID: PAT_TA_63118.pep
GFVPKQQFQGNYQQPPPPGFAPQQNQGPAAPDAEMKQMVQQLLQGQASSSMEMAKKLSELHHKLDCSYNDLNAKVEALNTKLRYLEGQSASTSAPKVTKLPGKSIQNPKEXTTANAITICQDRELPTRPV

SEQ ID NO: 168701 - protein, 102 aa, Triticum aestivum
  Clone ID: PAT_TA_63119.pep
ANMKTVDDVMRDVELEVFQKFGKGFGLGSNIRLLDTTGMSLLRPDGHPGPYRHPNPFAGVKNKSNVQNDCLHWCLPGPIDSWNDVMVETTLNRERELYDLTG

SEQ ID NO: 168702 - protein, 63 aa, Triticum aestivum
  Clone ID: PAT_TA_63120.pep
APGKYVDLKENINSFQGLLDGKYDDLSEQSFYMVGGIDEVVAKAEKLAKESAAQKLDPSLAYE

SEQ ID NO: 168703 - protein, 120 aa, Triticum aestivum
  unsure (1)..(120): unsure at all Xaa locations
  Clone ID: PAT_TA_63121.pep
YCRYVIDAADKNSVPISRSELNDLLTKPSLSGIPLLILGSKIDKSEALSKQALVDQLXKFLIQSPYKTIWIRVYDFEMIXCKGLESVTDREVCCYMISCKDSIDIDAVIDWXIKNSRTAT

SEQ ID NO: 168704 - protein, 45 aa, Triticum aestivum
  Clone ID: PAT_TA_63122.pep
TTFIPIFFQERLEPTKNCLEAVNSFVSVCMVKMCHNPMHLPNHKS

SEQ ID NO: 168705 - protein, 40 aa, Triticum aestivum
  Clone ID: PAT_TA_63123.pep
LQVPKRCNKLKFLHHSLLHIHHCFNLQPLIRSCERGEAKT

SEQ ID NO: 168706 - protein, 55 aa, Triticum aestivum
  Clone ID: PAT_TA_63124.pep
SKIKKVLRVYGGVMRLVRLLPANSRPYYAKHARENFVNCREVDQSKTSRNELFQR

SEQ ID NO: 168707 - protein, 64 aa, Triticum aestivum
  Clone ID: PAT_TA_63125.pep
KYVDLYAFVIGTYAFWTTISGARYAIEHVKSKRTSVLLNQIWKWCGIVFKSSVLLAIWVSVLCC

SEQ ID NO: 168708 - protein, 57 aa, Triticum aestivum
  Clone ID: PAT_TA_63126.pep
IFLYKIINKVIKESPNNRRNRDLQGKVPNTNSLESLHKHILLMLTSFFSNLKMNLPF

SEQ ID NO: 168709 - protein, 68 aa, Triticum aestivum
  unsure (1)..(68): unsure at all Xaa locations
  Clone ID: PAT_TA_63127.pep
TTNVIIHSNGLSFCTNRQVRFVKRFVEALSEGRVTXHEIRSIWISYWSQADKSLGQKLATRLNVRPNF

SEQ ID NO: 168710 - protein, 40 aa, Triticum aestivum
  Clone ID: PAT_TA_63128.pep
DLKGLRGYFLPLFSEERPIGGESLCENPHQRMCTPSDSDL

SEQ ID NO: 168711 - protein, 121 aa, Triticum aestivum
  Clone ID: PAT_TA_63129.pep
MHHHHHHLNSLQIHHHYLKPLQMHQYHLNPLQMHHHHHHYHPNLLQMNHHNHPNPSSEASVAGSPSFQHRGSVIFTVSFGTSITGRICTSATIMSLSLTRNPLPLASVPYQLQSEATKVRE

SEQ ID NO: 168712 - protein, 59 aa, Triticum aestivum
  Clone ID: PAT_TA_63130.pep
FGGFATKSRVVFRGYCIATNYPQIFSSPFGYEYIRGYVVAIFTTNFYMTNSWLYSHDLA

SEQ ID NO: 168713 - protein, 60 aa, Triticum aestivum
  unsure (1)..(60): unsure at all Xaa locations
  Clone ID: PAT_TA_63131.pep
ALARLSKGANIRIVKNLRICXDCYAVMKLTSKVXGVEILVRDRNRFHSFKDGSCSCRDYW

SEQ ID NO: 168714 - protein, 65 aa, Triticum aestivum
  Clone ID: PAT_TA_63132.pep
LFWIFLEHVVHVTIYVVKVSTIIWSIPNALAVYVTLDRVLRYKHCIIFLNDSDKLILIIINQYEK

SEQ ID NO: 168715 - protein, 103 aa, Triticum aestivum
  unsure (1)..(103): unsure at all Xaa locations
  Clone ID: PAT_TA_63133.pep
EFGFLQKPRPPLSILDNIVNGFFAVDIVLTFFVAFXDKVTYLLVDDPKRIAWRYASTWLIFDVVSTFPYEIFGSLLHESIQGYGIFSMLRLWRLRRVSNCFAR

SEQ ID NO: 168716 - protein, 39 aa, Triticum aestivum
  Clone ID: PAT_TA_63134.pep
RVLKKTEVANGLVLEKTSSPLGVLLIVFESRPNALEQVC

SEQ ID NO: 168717 - protein, 63 aa, Triticum aestivum
  Clone ID: PAT_TA_63135.pep
SGVALVLIGPESIDQANTFVEQTKFKGEVYADPNHTSYEALEFVSGVSVTFTPKVKCPLLSIL

SEQ ID NO: 168718 - protein, 84 aa, Triticum aestivum
  Clone ID: PAT_TA_63136.pep
KKLIYSCKPGAPKQWFHMLSSCLNQIDCRGEIGKKHKINKKRPSCICLDQDLSQDYKDAIRLCGRPTTQLFLEPQYRPPKQFLL

SEQ ID NO: 168719 - protein, 87 aa, Triticum aestivum
  unsure (1)..(87): unsure at all Xaa locations
  Clone ID: PAT_TA_63137.pep
SVLLPGREVPAEFDHRAQGNSLSILLPLGGNSQVYGSESLISPNHDITKMSNESELLCRINVKSSSXDEEFDIVEISKSRREHLFIF

SEQ ID NO: 168720 - protein, 76 aa, Triticum aestivum
  Clone ID: PAT_TA_63138.pep
EHFVGKFIEHLTLYQRTSYSEIIASLWLSLRLQLLGSMIVLFVAVMAVLGSGGNFPISFGTKGLIRNCSFHKYIGK

SEQ ID NO: 168721 - protein, 64 aa, Triticum aestivum
  Clone ID: PAT_TA_63139.pep
NSNMIHSVTHHYLVFCMYNRDNNHSYGLWFKLHLKRWLRTCNIKIRDFNNIRDSSIVSIDEFAS

SEQ ID NO: 168722 - protein, 47 aa, Triticum aestivum
  Clone ID: PAT_TA_63140.pep
QWAILSQILVYANKPEFTKREKRDKCRESMEAVLTNGVHYLVFIKKS

SEQ ID NO: 168723 - protein, 68 aa, Triticum aestivum
  Clone ID: PAT_TA_63141.pep
MQVGLLNVDGFYDSLLTFIGEAVDEGFVSSTARRIIVSAPNAPQLLQLLEVFLFAFHYFLIILFNTID

SEQ ID NO: 168724 - protein, 45 aa, Triticum aestivum
  Clone ID: PAT_TA_63142.pep
TTFIPIFLQKRLKPTKHLLEAVNSFVGFSMVNMCQNPMHLTNKKS

SEQ ID NO: 168725 - protein, 83 aa, Triticum aestivum
  unsure (1)..(83): unsure at all Xaa locations
  Clone ID: PAT_TA_63143.pep
MHMAISFQASLIIDIHLTFLFPQIKGPDCKTGDGTCVRDXIDVTDLVDAHVRALLKANPRKFEIPNVGPGKGIVETWQTLVLY

SEQ ID NO: 168726 - protein, 67 aa, Triticum aestivum
  Clone ID: PAT_TA_63144.pep
RPCRRGSHSGPMARLQRGGHRPLARHWDLGALRLESISLNSSSSITVSEHVQSRQLAFLADHLLGAG

SEQ ID NO: 168727 - protein, 85 aa, Triticum aestivum
  Clone ID: PAT_TA_63145.pep
GWSNGTSRRITVPAQRTSPCRRGSHSGPMARLQRGGHRQRARHWDLGALRLESISLNSSSSKTLSEHVQCRQLAFLAYHLLGAGR

SEQ ID NO: 168728 - protein, 121 aa, Triticum aestivum
  Clone ID: PAT_TA_63146.pep
SDLFPHLANGKPRKPTDCIAHVQTKKCCCCYSTRSILTSKRPDPNDELVDDVHHVAVAPWAPNANPVDMAWSVVPVLRSGDLTHSTIQFSPSSSALQSFAVTLQQVAPSKLFSHSRSGIEI

SEQ ID NO: 168729 - protein, 157 aa, Triticum aestivum
  Clone ID: PAT_TA_63147.pep
FSVLFPHLANGKPRKPTDGIAHLQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKD

SEQ ID NO: 168730 - protein, 156 aa, Triticum aestivum
  Clone ID: PAT_TA_63148.pep
FSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYK

SEQ ID NO: 168731 - protein, 136 aa, Triticum aestivum
  Clone ID: PAT_TA_63149.pep
CCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 168732 - protein, 154 aa, Triticum aestivum
  unsure (1)..(154): unsure at all Xaa locations
  Clone ID: PAT_TA_63150.pep
SPTLFPHLANGKPRKPTDGIAHELTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTXRLESGEGTF

SEQ ID NO: 168733 - protein, 157 aa, Triticum aestivum
  Clone ID: PAT_TA_63151.pep
FSDLFPHLANGKPRKPTDGIAHELTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKD

SEQ ID NO: 168734 - protein, 149 aa, Triticum aestivum
  Clone ID: PAT_TA_63152.pep
FSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLES

SEQ ID NO: 168735 - protein, 135 aa, Triticum aestivum
  unsure (1)..(135): unsure at all Xaa locations
  Clone ID: PAT_TA_63153.pep
CCCCYSTRSILTSKRPDPNDELVDDVHHVAVAPWAPNANPVDMAWSVVPVLRSGDLPHSSMPXSPIXVRLKRSSATLEQVAPSKLSSHSRSGIEILVLDVAPLPLDTVFVNLESELTKRLESGEGTFYKDHPTSP

SEQ ID NO: 168736 - protein, 136 aa, Triticum aestivum
  Clone ID: PAT_TA_63154.pep
MEGEAPQSHQLLLHGVSLDLRLDTATATHQLRGARRPASPAPTPVAFDQAGKEAFSCNYCHRKFLSSQALSGHQNAHKLERTLAKRSRDASSTAATAAQTATPSSHWPHAGGELWAYSASAAAPDSTTMAPLMGMG

SEQ ID NO: 168737 - protein, 149 aa, Triticum aestivum
  unsure (1)..(149): unsure at all Xaa locations
  Clone ID: PAT_TA_63155.pep
FSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLXTVFVNLESELTKRLES

SEQ ID NO: 168738 - protein, 132 aa, Triticum aestivum
  Clone ID: PAT_TA_63156.pep
MKCCCCYSTRSILTSRRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKD

SEQ ID NO: 168739 - protein, 153 aa, Triticum aestivum
  Clone ID: PAT_TA_63157.pep
MVSQDSQLTALFMSLTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSP

SEQ ID NO: 168740 - protein, 124 aa, Triticum aestivum
  Clone ID: PAT_TA_63158.pep
MKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLES

SEQ ID NO: 168741 - protein, 142 aa, Triticum aestivum
  Clone ID: PAT_TA_63159.pep
FPHLANGKPRKPTDGIVHDLTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILDLDVAPLPLDTVFVNLESELTKR

SEQ ID NO: 168742 - protein, 157 aa, Triticum aestivum
  Clone ID: PAT_TA_63160.pep
FSDLFPHLANGKPRKPTDGIAHDQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFLQD

SEQ ID NO: 168743 - protein, 115 aa, Triticum aestivum
  unsure (1)..(115): unsure at all Xaa locations
  Clone ID: PAT_TA_63161.pep
CCCYSTRSILTSKRPDPNDELVDDVHHVAVAPWAPNANPVDMAWSAVPVLXSGDLSHSTIQFSPFSWALQSFAVTLQQVVPSKLLSHSRSGIEILDLDVAPLPLDTVFDNLESEL

SEQ ID NO: 168744 - protein, 62 aa, Triticum aestivum
  Clone ID: PAT_TA_63162.pep
CCCCYSTRSVLTSKRPEPNDELADDVHHVVVAPWAPNANPEDMAWYDVPVLRSTYLAHSTIQ

SEQ ID NO: 168745 - protein, 155 aa, Triticum aestivum
  Clone ID: PAT_TA_63163.pep
FSVLFPHLANGKPRKPTDGIAHVQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFY

SEQ ID NO: 168746 - protein, 113 aa, Triticum aestivum
  Clone ID: PAT_TA_63164.pep
MKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVN

SEQ ID NO: 168747 - protein, 132 aa, Triticum aestivum
  Clone ID: PAT_TA_63165.pep
MKCCCCYSTRSILTLKRPDPNDELVDDVHHVAVAPWAPNANPVDMAWSVVPVLRSGDLSHSTIQFSPSSSALQSFAVTLQQVAPSKLFSHSRSGIEILVLDVAPLPLDTVFVNLESELTKRLESGEGTFYKD

SEQ ID NO: 168748 - protein, 152 aa, Triticum aestivum
  Clone ID: PAT_TA_63166.pep
FPHLANGKPRKPTDGIAHELTLKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYK

SEQ ID NO: 168749 - protein, 138 aa, Triticum aestivum
  Clone ID: PAT_TA_63167.pep
MKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 168750 - protein, 114 aa, Triticum aestivum
  Clone ID: PAT_TA_63168.pep
PTDGIAHELTKKCCCWYSTRSILTSKRPDPNVELVDDVHHVAVAPWAPIANPVDMAWSVVPVLRSGDLSHSTIQFSPSSWALQSFAVTLQQVAPSKLSSHSRSGIEILVLDVAP

SEQ ID NO: 168751 - protein, 95 aa, Triticum aestivum
  Clone ID: PAT_TA_63169.pep
MPRKPTDGIVHEQTKKCCCWYSRRSILTSKRPDPNDELVDDVHHVAVAPWAPNANPVDMAWSVVPVLRSGDLSHSTIQFSPSSSALQSFAVTLQQ

SEQ ID NO: 168752 - protein, 155 aa, Triticum aestivum
  Clone ID: PAT_TA_63170.pep
SPTLFPHLANGKPRKPTDGIAHELTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKPLESGEGTFY

SEQ ID NO: 168753 - protein, 100 aa, Triticum aestivum
  Clone ID: PAT_TA_63171.pep
MFVFENLLELEDRAIHMVLKEVESETLIIALKGAPPALRQKFLANMSQRAAELLAEDLDARGPVRVSEVETQQRRILQIVRNLAESGQIVIGGKAEDAYV

SEQ ID NO: 168754 - protein, 161 aa, Triticum aestivum
  Clone ID: PAT_TA_63172.pep
TLFPHLANGKPRKPTDGIAHELTIKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 168755 - protein, 98 aa, Triticum aestivum
  Clone ID: PAT_TA_63173.pep
RHCIYEQTKKCCCCYSTRSILTSRRPDPNDELVDDVHHVAAAPWAPNANPVHMAWSAVPPLRSGDLTHSTMQFSPSSPALNSFSVTLQQVGPSKLPSH

SEQ ID NO: 168756 - protein, 159 aa, Triticum aestivum
  Clone ID: PAT_TA_63174.pep
FPHLANGKPRKPTDGIAHELTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 168757 - protein, 158 aa, Triticum aestivum
  Clone ID: PAT_TA_63175.pep
VFSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKD

SEQ ID NO: 168758 - protein, 158 aa, Triticum aestivum; identical to SEQ ID NO: 168757
  Clone ID: PAT_TA_63176.pep

SEQ ID NO: 168759 - protein, 161 aa, Triticum aestivum
  Clone ID: PAT_TA_63177.pep
DLFPHLANGKPRKPTDGIAHELTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLSLDTVFVNLESELTKRLESGEGTFYKDHPTSPN

SEQ ID NO: 168760 - protein, 109 aa, Triticum aestivum
  Clone ID: PAT_TA_63178.pep
TRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESE

SEQ ID NO: 168761 - protein, 157 aa, Triticum aestivum
  Clone ID: PAT_TA_63179.pep
FSDLFPHLANGKPRKPTDGIAHELTKKCCCCYSTRSILTSRRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKD

SEQ ID NO: 168762 - protein, 157 aa, Triticum aestivum; identical to SEQ ID NO: 168733
  Clone ID: PAT_TA_63180.pep

SEQ ID NO: 168763 - protein, 157 aa, Triticum aestivum
  unsure (1)..(157): unsure at all Xaa locations
  Clone ID: PAT_TA_63181.pep
FSDLFPHLANGKPRKPTDGIAHELTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLXTVFVNLESELTKRLESGEGTFYKD

SEQ ID NO: 168764 - protein, 157 aa, Triticum aestivum
  Clone ID: PAT_TA_63182.pep
FSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKD

SEQ ID NO: 168765 - protein, 115 aa, Triticum aestivum
  Clone ID: PAT_TA_63183.pep
ISIGTVRSILALLSVGLSPPYALRTRLRGGAALWASGYGKMAVYGRFRCGVQYSSRWRAYTADAVAPSALRRAAASLSLSVSGSAAAEVDGGVCDGGSRRRGAGTAAVAAKAGAL

SEQ ID NO: 168766 - protein, 84 aa, Triticum aestivum
  unsure (1)..(84): unsure at all Xaa locations
  Clone ID: PAT_TA_63184.pep
TLKRPDPNDELVDDVHHVAVAPWAPNANPVDMAWSVVPVLRSGDLSHSTIQFSPSSXALQSFAVTLQQVAPKKLFSHSRSGIEI

SEQ ID NO: 168767 - protein, 111 aa, Triticum aestivum
  Clone ID: PAT_TA_63185.pep
ATHPALLALPPLPHEVGECSPHAPASKLQHRGHERRISRPRPASAQSVHRGSPHAAFGDGGRRHRGRAGGSGGEEGADGGGPAPASLVSPESPGGSDAGVLCSFSPRLVQK

SEQ ID NO: 168768 - protein, 80 aa, Triticum aestivum
  Clone ID: PAT_TA_63186.pep
SNKRSIQSSLKKLKISLPRIFQTSFNSMRRALLGASHQSMGHAFIFHPTNIEYIPGAARWCITLFTWIARLLDVACQTKF

SEQ ID NO: 168769 - protein, 44 aa, Triticum aestivum
  Clone ID: PAT_TA_63187.pep
SKKPADHGLLIFLTAGDECSYKRVAPLLDGMGKVNICNHKEALE

SEQ ID NO: 168770 - protein, 46 aa, Triticum aestivum
  Clone ID: PAT_TA_63188.pep
SPPPPPAPSSPPPPAPPGEPEAGRPSSSSSATRAPQSPRPSSPPAW

SEQ ID NO: 168771 - protein, 141 aa, Triticum aestivum
  Clone ID: PAT_TA_63189.pep
CYACGFIPLPEGARKKSIHKKVTLKYMANDSSRRSRFRKRLGGLMKKAAQLATLCDVKTCVVVYGEREAEPKVFPCHAEAVDILNEFKSMPQLGHCKKTMDQEAFLTQRIAKLRDQVDKARRECQDSEIRYLLYNIMHGNH

SEQ ID NO: 168772 - protein, 94 aa, Triticum aestivum
  Clone ID: PAT_TA_63190.pep
QDGRRIISKLRYEPEPVPSGIGLDMEESRNGSKVPESVVGIAPLPELNKSKRGSQTERYSKPSKPAGLLERMLMFSSGVGIGILSSSLSSKKDL

SEQ ID NO: 168773 - protein, 104 aa, Triticum aestivum
  Clone ID: PAT_TA_63191.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATI

SEQ ID NO: 168774 - protein, 47 aa, Triticum aestivum
  Clone ID: PAT_TA_63192.pep
SLVSNFPGEDPKMLSNFKDLLEKIFVLDPDKRITVSQALSHPFITGK

SEQ ID NO: 168775 - protein, 44 aa, Triticum aestivum
  Clone ID: PAT_TA_63193.pep
QKSGYGTVKVLFCMSLNHVAGSSFSSMCGTSKYASKTNCKFYFA

SEQ ID NO: 168776 - protein, 139 aa, Triticum aestivum
  Clone ID: PAT_TA_63194.pep
LIFFGGIANTFMLAAGLSIGKSLAEADLVNEAKAIIDEARERGASVPIPTDVVTAKEFSPTAAATVKQVADIEADDMILDIGPDTAKALASQLEKAGTIVWNGPVGVFEFDQFGNGTKTLAEAIAKSSAFSIAGGGDTL

SEQ ID NO: 168777 - protein, 84 aa, Triticum aestivum
  unsure (1)..(84): unsure at all Xaa locations
  Clone ID: PAT_TA_63195.pep
PDPSSPFLQPPPPISTPPNRPAPPXPPPSSPXPPRLPSPPRHPSPRWRPPGARRWCWPPTSVPTDAHVPGAHPAPRRRPAALDR

SEQ ID NO: 168778 - protein, 79 aa, Triticum aestivum
  Clone ID: PAT_TA_63196.pep
FSLRRKRKKKKKGEANRARSRDPRQPAPSPLPADPPRPARSAWRTGTRRRPTRRRGRRSRPRRRPRRSGGSAASSRGSG

SEQ ID NO: 168779 - protein, 93 aa, Triticum aestivum
  Clone ID: PAT_TA_63197.pep
GRVISFSRCKAKPRRVIFVVYIFFRCVGTHFEASFSFKSFIIIGPILHKTIDDTTLHWTYTIINFTNVTNGLSCNVTLWLTVWFKLWLVDVLG

SEQ ID NO: 168780 - protein, 125 aa, Triticum aestivum
  Clone ID: PAT_TA_63198.pep
FHASGAVSLVPGYLTKFYNKLLICFKEFDNELRVNRRYSIDHIKKKFQLLSSCQLQEAEWLHKNHKPRFEDKLHLGAMSVGAVGLCVYMMACMGDKMPKGALEWALAYPDVIMACAKIGRLMNDL

SEQ ID NO: 168781 - protein, 44 aa, Triticum aestivum
  Clone ID: PAT_TA_63199.pep
TTCLGKFNLDRKKQATIPENPHMHFSSLVLFCPNPYFIVDKHPK

SEQ ID NO: 168782 - protein, 115 aa, Triticum aestivum
  Clone ID: PAT_TA_63200.pep
RARDVREPDGDVVVLAGGAPAGVVGHEGEGERHDVVRRRHRRDRVDCHMAPGEPELELLGAEHQHRGPNDHCHGQHCHHGRRRPPRHVQPSEPLGRRLALVGGYHMHQSGTLEVK

SEQ ID NO: 168783 - protein, 126 aa, Triticum aestivum
  Clone ID: PAT_TA_63201.pep
SESKRHSRRSREKRHHKMQDFPVSNRSARKSDEKWHYTDSSARESDRHSRKPREKSRYSDPSASEYSDSDRPSRRSNEKRHYTDLSTRESDRHSRKPKGKSRCSDQSASEYSDSDWRNSHRRRRRK

SEQ ID NO: 168784 - protein, 135 aa, Triticum aestivum
  Clone ID: PAT_TA_63202.pep
LHHAPACRLHRHTKFTGHSYGRTKFQLYCNPSGSTVAKDGDPQLFGVMPKEKTMSLSLLFFERPTYHLAAAALEWLHLQMGEVSTSSWEKSRPAPGHACHCHLGPPPTAGAAVPQPFNYATSAVQYILEKKKKQQ

SEQ ID NO: 168785 - protein, 60 aa, Triticum aestivum
  Clone ID: PAT_TA_63203.pep
SVEFTRLHRSVPRTGPPDLFLPCHGSSSTEGAPERSYRQHVHRWCGRRGHVRGAAGRGHR

SEQ ID NO: 168786 - protein, 77 aa, Triticum aestivum
  Clone ID: PAT_TA_63204.pep
WKRSTHTAIEMSYEATRWLLRCSNIQLHRYLASCAPCLLCKLLRSQVLRSLPSLQTSSQVSGLRCSPLHQSRPLFLF

SEQ ID NO: 168787 - protein, 43 aa, Triticum aestivum
  Clone ID: PAT_TA_63205.pep
ATVRLRADLPLFVHSFTLYNRMSQRIMVSTPSKPDNVIDAVIL

SEQ ID NO: 168788 - protein, 96 aa, Triticum aestivum
  Clone ID: PAT_TA_63206.pep
PAAVLDQPTNTIPHIPLTRHYTEGLWGDEVMPSITYSFKYLDYRCYISDKMMLIRFTRIYLMSWEDRAGAKNHKEPGQATHKELVTIQRRPTHAVK

SEQ ID NO: 168789 - protein, 124 aa, Triticum aestivum
  unsure (1)..(124): unsure at all Xaa locations
  Clone ID: PAT_TA_63207.pep
VINHFNYQGCRGYVSDARGARCPSCGNEMATETQYVPPPAPALPEQSAATAKTGYVQGSVTYTVTDDLAVTPMSXLSIXRLGALAAVGGLAALQEKTVELGYREGLEILKASLRSKTVLTDVFL

SEQ ID NO: 168790 - protein, 99 aa, Triticum aestivum
  Clone ID: PAT_TA_63208.pep
KGLPDLGLELWDYLIGKGCVPHRHALDVLVTGLCCRDVVGEAYRCFRELVEMGMAPTERAFRVLEGFLKKKREFGKIDEIRQMMKAIQLEEHQAEEEAA

SEQ ID NO: 168791 - protein, 121 aa, Triticum aestivum
  Clone ID: PAT_TA_63209.pep
AGKFCVLPAEHYSRWCMNDTVHFLHLYIAPERLAREAVMRLDCEPRSLELRDRTYIHDDSLTDVCRALLDTDWNAPADRLAASSAAETVLHHLLLQGVARKAAPPARGGLAPAVRRRVMDY

SEQ ID NO: 168792 - protein, 89 aa, Triticum aestivum
  unsure (1)..(89): unsure at all Xaa locations
  Clone ID: PAT_TA_63210.pep
MEVAVAELPVLPQDVLMSIFAHLEIPDLMRASFVCSSWRSAYSSLRNLEQYQQRQTPCLLYTSESAGESVACLYSLLEKRXYKLTLPEP

SEQ ID NO: 168793 - protein, 101 aa, Triticum aestivum
  Clone ID: PAT_TA_63211.pep
SSILFDGWRTSGWTGYLLCLLALLLGAGLYQYLEAFRIRVKLLAGAKAYPLPPAGGSYARAPMIAPGSAAFLGGRWPARVATAALFRVNAGIGLLLMLAVM

SEQ ID NO: 168794 - protein, 83 aa, Triticum aestivum
  Clone ID: PAT_TA_63212.pep
FTRNRSPDFGALDPNFFFVQGFSGLGVALTGIAGRAIAGAIAGDTRAFDLFARLRHRRFPGGDAWRQPALELGMLYHRVRELF

SEQ ID NO: 168795 - protein, 104 aa, Triticum aestivum
  Clone ID: PAT_TA_63213.pep
SSTRPPTRPRTRGADERFEVVVPRNFALVCFRIKASGAMTEEDADEANRVLMDNLNKTGKAYLAHTVVGDKFVLRFAVGSSLQEERHIRSAWDLIKKTTSSIMD

SEQ ID NO: 168796 - protein, 73 aa, Triticum aestivum
  Clone ID: PAT_TA_63214.pep
RKKHLILINSEIETTNCTDAAMPRTLFFRIHMLMTRRNKLRKTVMLPVCFFFLMNIFVEKKFSTPLKKPKILE

SEQ ID NO: 168797 - protein, 56 aa, Triticum aestivum
  Clone ID: PAT_TA_63215.pep
EAKNKKWNLISDVTTQCLHLKTTASIPALDFLHTRYSLHGCMEGPPAVTKRTVEQR

SEQ ID NO: 168798 - protein, 46 aa, Triticum aestivum
  Clone ID: PAT_TA_63216.pep
HVIYRVLQHVNIRNTRFNKVTILINLVAANRSSISNAPRQCFHCTD

SEQ ID NO: 168799 - protein, 40 aa, Triticum aestivum
  Clone ID: PAT_TA_63217.pep
RTGEKNQHKQFPYVQSAANLSLQSNQFKPMQTGRVGGRVR

SEQ ID NO: 168800 - protein, 61 aa, Triticum aestivum
  Clone ID: PAT_TA_63218.pep
RSMEAPDCTVSYTCSALMMLWTEGLFLSSNVPGPVFLSSVAVCFSFLRAVTWPKKKKKYNR

SEQ ID NO: 168801 - protein, 32 aa, Triticum aestivum
  Clone ID: PAT_TA_63219.pep
VCKLSFTMVCMCHQYGSMVYPGYCALNKCTLS

SEQ ID NO: 168802 - protein, 83 aa, Triticum aestivum
  Clone ID: PAT_TA_63220.pep
CLQGDAPLVETRDHRVAATHGGPPRWERRDLIHAVERQPRHAAVAHAAYFRPDLEPSGENRLDGVGDGSGATRCARRATAAVL

SEQ ID NO: 168803 - protein, 125 aa, Triticum aestivum
  Clone ID: PAT_TA_63221.pep
KPLLRGGYNRLREFFSSKNLDVELTGDAENPMIVIGQAISVAAYVKNFDLIFLDKSHQGTPKKIFKLTHEVSGTREEVLGVMHESVHVGLFRIQEKKSKLFLAGYNFKDPENRKGRFPVFAREMS

SEQ ID NO: 168804 - protein, 51 aa, Triticum aestivum
  Clone ID: PAT_TA_63222.pep
FWTRGKMLISLIRSMYASLDQLGTQTLFFFPYVPYEFFVELIGKGIDRWIS

SEQ ID NO: 168805 - protein, 40 aa, Triticum aestivum
  Clone ID: PAT_TA_63223.pep
CSDPRSTCLGPSTVALAGLGPGGALVDMTTSDPTLAGEIA

SEQ ID NO: 168806 - protein, 54 aa, Triticum aestivum
  Clone ID: PAT_TA_63224.pep
CCCGGKQLYVETYHVLLIQKVFCLKPVRQLSPAQISILKRNLGRTRSNKISVPK

SEQ ID NO: 168807 - protein, 71 aa, Triticum aestivum
  Clone ID: PAT_TA_63225.pep
HYFFFYLERWGSSLFISIEGEGKGLSCLRNTMSRDQHSHRSNFSVAKNMTSSTRISINLNELTGDGNIIRP

SEQ ID NO: 168808 - protein, 25 aa, Triticum aestivum
  Clone ID: PAT_TA_63226.pep
TVAYTNGAPVAYTNGAPWPILMAHQ

SEQ ID NO: 168809 - protein, 97 aa, Triticum aestivum
  Clone ID: PAT_TA_63227.pep
GQNQMADKDEDLSNIAEEIRLLGLQWENIRQTIPINNPSLDRSNTINSQPPVFSLPPFSQQLTHDLSTETSDQEDSLARKSMNSVASSSASSTDEKN

SEQ ID NO: 168810 - protein, 101 aa, Triticum aestivum
  Clone ID: PAT_TA_63228.pep
QRSAKHHNNTIQVAISHRQYSATASSNQAPGRLAVHRVRLAIGTFTPTISPGCQFVPSRIPRFCSVVPSVPAFCNCSYPFGLQLARAYKSHLLYPRVSSPQ

SEQ ID NO: 168811 - protein, 34 aa, Triticum aestivum
  Clone ID: PAT_TA_63229.pep
ATARILSFRVTAICFLDGCCSNELAKMTLVLGES

SEQ ID NO: 168812 - protein, 62 aa, Triticum aestivum
  Clone ID: PAT_TA_63230.pep
LNPEIIQSHTHKSKYTSAHPTSAHTIKNKYTRVERCQLNSYKAAVVVSTMCGRNVQDLLFLI

SEQ ID NO: 168813 - protein, 57 aa, Triticum aestivum
  Clone ID: PAT_TA_63231.pep
FSVNEPSLDNCFVSSSYDATTHFETTVTDVLNMYTLITGKTVDLSVDLSAASAAEEY

SEQ ID NO: 168814 - protein, 67 aa, Triticum aestivum
  Clone ID: PAT_TA_63232.pep
VFSQLPAAVDLSGVQVVPERILERKMVKRHNKVQVQVLIQWSGLAAEAATWEDYDVLKNRFPDAPAW

SEQ ID NO: 168815 - protein, 87 aa, Triticum aestivum
  Clone ID: PAT_TA_63233.pep
KRKKKYIVKRISLHHEPVTRRIRSSIGPWDREPRENFFPVHSEQWVLADRRERGSRVFRFPWLVWRFPVCWYKWDTFWIFWLFEFQN

SEQ ID NO: 168816 - protein, 100 aa, Triticum aestivum
  Clone ID: PAT_TA_63234.pep
SYASGENITNFEENDFQILRVLMTVIDTSTDTTALAVACYDLSQFLQYHPSGRLVVADLKAKDRVMKLMNHDNAEVRKNSLLCVQRLFLGAKYASFLPDV

SEQ ID NO: 168817 - protein, 46 aa, Triticum aestivum
  Clone ID: PAT_TA_63235.pep
CFVYICLYVAQVEFFLLARRDKLLIVRVDAHLYIQPLIQLHLLLRW

SEQ ID NO: 168818 - protein, 40 aa, Triticum aestivum
  Clone ID: PAT_TA_63236.pep
FADLASRFGVSIGMEKPPTLFRKTAFKMGLKGVPGIRIRK

SEQ ID NO: 168819 - protein, 48 aa, Triticum aestivum
  Clone ID: PAT_TA_63237.pep
VVRPRVRCNSAVWRALRDVPAVSPPGPEEKACNPWADCVAKYPPKAYV

SEQ ID NO: 168820 - protein, 67 aa, Triticum aestivum
  Clone ID: PAT_TA_63238.pep
AGQPTPQKANNILQYTDLSLHGTHLSQHILWPYNQCARPGFQACANMTTACCQFRYSSQTSDRCSEG

SEQ ID NO: 168821 - protein, 30 aa, Triticum aestivum
  Clone ID: PAT_TA_63239.pep
RINGRLSNLINQIKYNTPTKLSKPSSTDST

SEQ ID NO: 168822 - protein, 54 aa, Triticum aestivum
  Clone ID: PAT_TA_63240.pep
MAGFGSLAPTTTNVEEAGGLTGIAFGGYYYTMWAVGSTDQLQVTMNKFEDLMKK

SEQ ID NO: 168823 - protein, 71 aa, Triticum aestivum
  Clone ID: PAT_TA_63241.pep
SPSRPPTRARATGAAFTPLDFSGGWWDYAPPAPAPAPSRHGSPLRLRRDQSPTAKPRPRPAPLLARVPLRP

SEQ ID NO: 168824 - protein, 49 aa, Triticum aestivum
  Clone ID: PAT_TA_63242.pep
FITPIQINDHIYKSPANLIYMRVEQIPFSNLKRSAPDIKPYPVQNYHVR

SEQ ID NO: 168825 - protein, 72 aa, Triticum aestivum
  Clone ID: PAT_TA_63243.pep
SLLLGWEDSFYFFNYLGLANKKHFKYTLHLQIKHTLSFSIYKKRHANSSPFPRFPFASVHPLQTNSLDFFQK

SEQ ID NO: 168826 - protein, 40 aa, Triticum aestivum
  Clone ID: PAT_TA_63244.pep
NLEHIHHSHRHSKCQLKQKVGTYEQHTDHQHSKPVYPNTR

SEQ ID NO: 168827 - protein, 116 aa, Triticum aestivum
  Clone ID: PAT_TA_63245.pep
RRLDSLYNSFDRSFLSISNIIQCSTAGKLNFHHGKHCLPSHTENFSLHKSFKVQLLIFVVRDCDRSSVLKLLLHSAMIIIHDAHLALFLVRIHRLLKLKSVGSHSSNLRDGRVTNL

SEQ ID NO: 168828 - protein, 76 aa, Triticum aestivum
  Clone ID: PAT_TA_63246.pep
AVLAVVVACGTRPSEGKGKKRVQYRTWIVVASAVGKQKCSGKIILLPLLLHVRMYIVLFIVLACKGGSIYIYIYYY

SEQ ID NO: 168829 - protein, 94 aa, Triticum aestivum
  Clone ID: PAT_TA_63247.pep
FHGTAQSPECKLQEMQQCHSYTANSELLMRGLRSRKRRRANYSHDPFELEGALCRLSFLGRLDEAGNLSVHHPPWPPVEHGRHDRHRLARVNHT

SEQ ID NO: 168830 - protein, 37 aa, Triticum aestivum
  Clone ID: PAT_TA_63248.pep
LDKATASHSHRCTKTTPVIREENDVNYCNNLHKRNKI

SEQ ID NO: 168831 - protein, 55 aa, Triticum aestivum
  Clone ID: PAT_TA_63249.pep
GHPPTPAASRGHQSIHSMCTLRGCDSADLVAGIDEAIKDGVDVLSLSLAPVCFLC

SEQ ID NO: 168832 - protein, 69 aa, Triticum aestivum
  Clone ID: PAT_TA_63250.pep
RFAWANGTRSGWPSLDPLKPWFPLKIAGSCPLFFVCLCFIPGICLISTFPYIVSTVAVCMYVQLCFLSR

SEQ ID NO: 168833 - protein, 52 aa, Triticum aestivum
  Clone ID: PAT_TA_63251.pep
LGCVHGGDKAQEVADGLTWWPWCLSKLIGQVLSSAGRSAEDQGDGWLRLCSS

SEQ ID NO: 168834 - protein, 48 aa, Triticum aestivum
  Clone ID: PAT_TA_63252.pep
YDLVISVYTAVRMHLLTKFTTSITNYLVKWIWPSPALSSYLVFSSKGP

SEQ ID NO: 168835 - protein, 31 aa, Triticum aestivum
  Clone ID: PAT_TA_63253.pep
RVGSCPSDYIRLSRIVICYVPMWSHIGYLCL

SEQ ID NO: 168836 - protein, 62 aa, Triticum aestivum
  Clone ID: PAT_TA_63254.pep
NRTILHALETRRAPKKQTKHEVYGQTRQTQSRTFIGRITAEKKIQKPSTDRHNTHSQTQSER

SEQ ID NO: 168837 - protein, 52 aa, Triticum aestivum
  Clone ID: PAT_TA_63255.pep
NITKFNTAICMYLQHSSLKNPLQSDDIQHRLTKYITQQSYEPVQSILHQQNI

SEQ ID NO: 168838 - protein, 40 aa, Triticum aestivum
  Clone ID: PAT_TA_63256.pep
ISAHFHEFDAIEVTCVDANLSFAFGLTILVGFFTILRLTV

SEQ ID NO: 168839 - protein, 47 aa, Triticum aestivum
  Clone ID: PAT_TA_63257.pep
LSQLAGHTALDFSLFYQSASRQSASSLFFGQPAADFSSQLWVAGLIS

SEQ ID NO: 168840 - protein, 56 aa, Triticum aestivum
  Clone ID: PAT_TA_63258.pep
AYLMASLFQRDPQRVIPHVDSSSYWSSITCNVKIINTVGTWALPNDVSMAISALRC

SEQ ID NO: 168841 - protein, 44 aa, Triticum aestivum
  Clone ID: PAT_TA_63259.pep
LIFWCSRLDSGIQQPCAAGCACFMNLCIAVFSRVPSGEETDHSP

SEQ ID NO: 168842 - protein, 82 aa, Triticum aestivum
  Clone ID: PAT_TA_63260.pep
SRFRDIWLGQLLAPKGTDLFVPVSSMHHDAASWGPTVDRFDPDRFKNGVSTACKNPQAAFMPLGLGACTCLGQNLAIVEVQT

SEQ ID NO: 168843 - protein, 90 aa, Triticum aestivum
  Clone ID: PAT_TA_63261.pep
GRWRTRPSARPWTGGSTAPTRTPTPMPSQAQATPRWPLRPCNRRRVLAPVSFIFLASSFLFFFLGLFPDPSLYMVAAVKVSRVWLLANCF

SEQ ID NO: 168844 - protein, 66 aa, Triticum aestivum
  Clone ID: PAT_TA_63262.pep
TRVERNGNVLQNCVNPAPYIYDEFIFALHCMNYGVVNQISDGLELLSDAGEVLPLVLRQSELGASK

SEQ ID NO: 168845 - protein, 46 aa, Triticum aestivum
  Clone ID: PAT_TA_63263.pep
LDQGAGCLIIWEDQKTEAIFPATLETISNVGKVVDSLYMRSDKIMA

SEQ ID NO: 168846 - protein, 106 aa, Triticum aestivum
  Clone ID: PAT_TA_63264.pep
VVGAQSLANAIDRHRNPPSLSSRLGSPRLASPTSPHVRPGDDAADGDHDGDGGCGRLRGAPLRLGLRRAQPVRQGVRRLGARRAGGRPPGARLAGGRGAGADHLLR

SEQ ID NO: 168847 - protein, 40 aa, Triticum aestivum
  Clone ID: PAT_TA_63265.pep
TSGSTSTSAMVEGKAGARTGERRRRCLQDEEERTRGQTRE

SEQ ID NO: 168848 - protein, 52 aa, Triticum aestivum
  Clone ID: PAT_TA_63266.pep
MYGVGRCGVGEKRGQSSEAKLAALLLRRGLADSRRGSQGHRVEVKQRCAERL

SEQ ID NO: 168849 - protein, 85 aa, Triticum aestivum
  Clone ID: PAT_TA_63267.pep
RVGAEKWGMLRQKPRACCGAPGVGVYNFNLTSKCGEPGAYACDDPSNHWSWDGIHLTEASYGHIARGWLYGPFADPPIVGNRNLE

SEQ ID NO: 168850 - protein, 76 aa, Triticum aestivum
  Clone ID: PAT_TA_63268.pep
EDRSRPSASAVLSTPGGRMNAPRYAVAAAKLLAKHLPVAPSEPPARERGLETIERAMQARAFRRRRRLLLGGGGFG

SEQ ID NO: 168851 - protein, 68 aa, Triticum aestivum
  Clone ID: PAT_TA_63269.pep
HRASRTTQRHQIPPTGAALRTADGNGQRRAAWGGAGGDGEVHAQVQGGGRRGGRRGGHAGRRRPDAVP

SEQ ID NO: 168852 - protein, 73 aa, Triticum aestivum
  Clone ID: PAT_TA_63270.pep
MPSLRQCSTLERQLLGHLSATKMKIAKAPVLLKKAVTMCKSKTGVLAARLLFLASLRRRMATVGVMSHKIHAL

SEQ ID NO: 168853 - protein, 81 aa, Triticum aestivum
  Clone ID: PAT_TA_63271.pep
RATPILQKINCSRCINQYDKIDSKRNQNMNMSASTLKIGNSAISHSKKEKTGSNMAIPRPPMGTQFSMIMQASMVHSDMKE

SEQ ID NO: 168854 - protein, 48 aa, Triticum aestivum
  Clone ID: PAT_TA_63272.pep
SVKHRPGVGVLIFICLNVKIVRWQEYGTEIVLWLPPLTQRARARRGVG

SEQ ID NO: 168855 - protein, 46 aa, Triticum aestivum
  Clone ID: PAT_TA_63273.pep
VNTHIYIVVPIIPSSTVPFFKFITASEEEYPCRLAVCRELPEGRPE

SEQ ID NO: 168856 - protein, 44 aa, Triticum aestivum
  Clone ID: PAT_TA_63274.pep
LLAVGVGCRGLLGLLALLLFLVLTSVGDSCWNLLHVLGFLRTRG

SEQ ID NO: 168857 - protein, 145 aa, Triticum aestivum
  Clone ID: PAT_TA_63275.pep
SLSSGSPRLLKSGSGSEWSVVAQRNVKSSLLLLLAISTVVAFSILYSSRSLTVARTAGEALTQSPLLAALDLSSRMPEDDDDQSDEPAFPADDSVTPEQSTPAEVVSLPAAAPSTGEAAMQLEEKCDISRGKWVREPNGPVYTNL

SEQ ID NO: 168858 - protein, 68 aa, Triticum aestivum
  Clone ID: PAT_TA_63276.pep
PTRPVKRAACVLTFHDKFTASIFWDQLVLVTIVQEPTIGISYGVCTAIQKVKLMPRWSPVSNKFFEFS

SEQ ID NO: 168859 - protein, 71 aa, Triticum aestivum
  Clone ID: PAT_TA_63277.pep
HRSVVFLFLLRLSSFFFLCILFSFLYLLALSYICFCMRLLPRPPANGCSTSAPASNPNSPSPVTTMVGPYP

SEQ ID NO: 168860 - protein, 64 aa, Triticum aestivum
  Clone ID: PAT_TA_63278.pep
VVDDDDDCPADPSGFGTGGGTGSGSSEANNDGDASYTNANASGNGGGEGGGKNGGTGGGTCSGN

SEQ ID NO: 168861 - protein, 46 aa, Triticum aestivum
  Clone ID: PAT_TA_63279.pep
KKRSSIAKRCSQQICCLKHEGSLLLHYYPFIDFSISILYMSKYNTE

SEQ ID NO: 168862 - protein, 42 aa, Triticum aestivum
  Clone ID: PAT_TA_63280.pep
IFAIITNPDPYNPLVESIARLYLTDRAKHDEIAAEWTLRFAR

SEQ ID NO: 168863 - protein, 68 aa, Triticum aestivum
  Clone ID: PAT_TA_63281.pep
MDQKAAPVKFAKVTKVLGRTGSRGNVTQVRVTFMDDDTRSIMRNVKGPVREGDILPLLESEREARRLR

SEQ ID NO: 168864 - protein, 42 aa, Triticum aestivum
  Clone ID: PAT_TA_63282.pep
GQSHVGQEYKVGRFTYLGIKKERDLTESLSIRLVYMILTKYT

SEQ ID NO: 168865 - protein, 98 aa, Triticum aestivum
  Clone ID: PAT_TA_63283.pep
SWALVADVPCPDRAVVLQVHHLPAVPPCGAFAWAPSLLTLQDRLTEEGKRTDRRNPCGLLKDIHALVKCAQRLAAVCSAMKDGLEPLERHVPEGFHRI

SEQ ID NO: 168866 - protein, 86 aa, Triticum aestivum
  Clone ID: PAT_TA_63284.pep
PPTRPCTESTVPGQSLLPPLPSVRSPSRPRPTPRRRTASPALTYHLQIRALPDQRRRELSCELDPSSGRRQRPTAARIDPATNLEH

SEQ ID NO: 168867 - protein, 110 aa, Triticum aestivum
  Clone ID: PAT_TA_63285.pep
IHNDPLQVAGAFQSFVQLVSLMALPMMMEIGLERGFRTALSDFVLMQLQLASVFFTFSLGTKTHYYGKTLLHGGAEYRATGRGFVVFHAKFAENYRLYSRSHFVKGIELM

SEQ ID NO: 168868 - protein, 120 aa, Triticum aestivum
  Clone ID: PAT_TA_63286.pep
LTRGLKTCFLYLSIFPEDHKISRDRLIRRWISEGFIQVKDETDSQLELGDSYFNELVNRNMIMPINIHADGRVEACSIHDIMLDLIYELASGENFVTILDVIKEDTPLERSSADCPSRRA

SEQ ID NO: 168869 - protein, 99 aa, Triticum aestivum
  Clone ID: PAT_TA_63287.pep
RALSEGVFSTFFITFPAAILVLLAVLFTGILAQPSGYFPKCCDNCRSFSGIDVCDDAHPECPKGCLQCRVVQTSPTKTFRCADYRGDSDDTCGPPCKKN

SEQ ID NO: 168870 - protein, 85 aa, Triticum aestivum
  Clone ID: PAT_TA_63288.pep
ERIIAWSYKLGTSPRHEAAVITEVRKGQRLDRRRRVPQRPHDHLLPSFLPKPMQPKSSDLVLQVKKQPSRRGRQREAPALPPRET

SEQ ID NO: 168871 - protein, 117 aa, Triticum aestivum
  Clone ID: PAT_TA_63289.pep
KDCPTPAKEHAIPNPGSGAVSREDAGGRTDRSDAETGEGGGTLPAAGARSGRWKGGQAGAGVYEAAGDVLAQGTAGRGRPAGEPKLDEAPRRAVRQIRPATAIMGSGAASPADPPKR

SEQ ID NO: 168872 - protein, 82 aa, Triticum aestivum
  Clone ID: PAT_TA_63290.pep
LALYTLGLNDDAYAPLFTPALDPLRRKSPRWREESPGEEIDERREARNGGRHGSKTQEVSPKKREPSQSSWKQAGEASLWWP

SEQ ID NO: 168873 - protein, 102 aa, Triticum aestivum
  Clone ID: PAT_TA_63291.pep
CRAPARRRAAPGTAALQRRRPTVCAKQPHALPPLTGAYTDGEALLAEARRRRDDTVNHGATYSHHHHPPRLLSLFLDPLLFLDFRAPAAANRSKREASKRGA

SEQ ID NO: 168874 - protein, 148 aa, Triticum aestivum
  Clone ID: PAT_TA_63292.pep
VAGSTTKDCEFPALQLKRPPKPASRKDERQVSVAEQTNGRTNAALSQGPVAENESEKVSKNMSSETADGKPFLQIGSNMVPVTVGNETKEAAQTVQQFVVYVGFEHECSYGHRFLLSEKYLKEIDYGRSYQNNEAESKHSSQKLPPNA

SEQ ID NO: 168875 - protein, 78 aa, Triticum aestivum
  unsure (1)..(78): unsure at all Xaa locations
  Clone ID: PAT_TA_63293.pep
RRGTTTASDVGPRAPGTPPPPPGSSAQPPRPIDHHRRPPLSLPPPGSSAPPPRPSGHPRMXPPLPKPPPPPGTPAAPP

SEQ ID NO: 168876 - protein, 79 aa, Triticum aestivum
  Clone ID: PAT_TA_63294.pep
MTGWFLKTANWKSSPCIHMNARSKRRGSSLCFIMLWMLVLPNLWIICSGSIHKHVLLPGFSGSEMDYIDNNGIFLLSNG

SEQ ID NO: 168877 - protein, 59 aa, Triticum aestivum
  unsure (1)..(59): unsure at all Xaa locations
  Clone ID: PAT_TA_63295.pep
EAPCATLGYLGNYLAELTLTDYSCLKYHPSVVAASAEFLARWTLDQXYLAWNCTLEHYT

SEQ ID NO: 168878 - protein, 52 aa, Triticum aestivum
  unsure (1)..(52): unsure at all Xaa locations
  Clone ID: PAT_TA_63296.pep
MADQLTDDQIAEXKEAFSLFDKDGDGCITTKELGTVMRSLGQNPTEAELQDM

SEQ ID NO: 168879 - protein, 97 aa, Triticum aestivum
  Clone ID: PAT_TA_63297.pep
FLRSSTSQPQVGATTNNTTRTHMTFSVSPAMEGGQGHEYMIRFDSHFDDPSPSTATAEPSPFAGRSISPEQEHGAMVAALLHVISGYTTPAPDFFFP

SEQ ID NO: 168880 - protein, 68 aa, Triticum aestivum
  Clone ID: PAT_TA_63298.pep
FFASAHASAKMRIPCYLLLATKVNPRMKQIAADIERVLKGIVAKRENAMRAGEATSDDLLGVLLESNM

SEQ ID NO: 168881 - protein, 107 aa, Triticum aestivum
  Clone ID: PAT_TA_63299.pep
RLIVEASQGGADEVRVDGLPGGARAFEICAKFCYGMVVTLNPYNVVAARSAAEHLGMTEDVDKSNLVFKIEVFLNSGVFRSWKDCIIALQSTIALLPWSEDLRLVAR

SEQ ID NO: 168882 - protein, 79 aa, Triticum aestivum
  Clone ID: PAT_TA_63300.pep
LISNPYSAVVLWEQEEHACFLSTSRVHTARLTGLNSGFTRIYVNISVRGLVAMLQNHCRREYPDCTTAGRFLRLRTTGL

SEQ ID NO: 168883 - protein, 90 aa, Triticum aestivum
  Clone ID: PAT_TA_63301.pep
SQAICARRPLPARAVVERPNRAHARGGDRTSVAPLAIARPRSTAGGAAGCSELGQRQQHGALAGGRGRGWRHCRHGTEARRRGRGRTRDK

SEQ ID NO: 168884 - protein, 82 aa, Triticum aestivum
  Clone ID: PAT_TA_63302.pep
FSRGRGHNLRSLPDGVRNCYTLRSLVSGLKYLIRASFLYGNYDGLNRPPASFDLHIGVNFWKTVNISTWGADQGNTAVVEAI

SEQ ID NO: 168885 - protein, 105 aa, Triticum aestivum
  Clone ID: PAT_TA_63303.pep
LYRSTALFASYNSFLLRFFHHQKRIAENFLTTAQRNRKISDFFPQWISFLRLLIPRRDAGVGVHHRSSSARSYQQPPSARESSARWSVEAARQPPSFRWHREVSN

SEQ ID NO: 168886 - protein, 130 aa, Triticum aestivum
  Clone ID: PAT_TA_63304.pep
CLPVYDTEFAGENSLEDSEKEIITINDHSCEAISDAKSSPEVTTDRELVVSSHQAVDDTERSPQPSERELVGTSGHPPELVSLDREEAASTNGQSDADDKRSPEHPEQKFVLVEGHSHELISDVWKEIAG

SEQ ID NO: 168887 - protein, 71 aa, Triticum aestivum
  Clone ID: PAT_TA_63305.pep
MGRSPCCEKEHTNKGAWTKEEDQRLVAYIRANGEGCWRSLPKAAGLLRCGKKLRLRWMNYLRADLKRGNFT

SEQ ID NO: 168888 - protein, 91 aa, Triticum aestivum
  Clone ID: PAT_TA_63306.pep
ISEQVAAFSDSSTQVTSVVNMVRMHNSTYFISFLLCTVTYNMDHMYRLSFRFSLLWRILLEFVAANLWSCMVFSFVSMHSLEVRKLVHVLF

SEQ ID NO: 168889 - protein, 58 aa, Triticum aestivum
  Clone ID: PAT_TA_63307.pep
LLSANELTAKARNGISRCENNSDQRKAHRRTRDGLNKLSEVTSTTHQTQHQQTPRTPT

SEQ ID NO: 168890 - protein, 102 aa, Triticum aestivum
  Clone ID: PAT_TA_63308.pep
VHASAEVIKWMERFDCIVVGPGLGRDSFLMDCISNIMRHARQANIPTVVDGDGLFLITNNIGLVEDNSLAILTPNVYEYKRLVQKVLNCEVNEENASEQLTA

SEQ ID NO: 168891 - protein, 106 aa, Triticum aestivum
  Clone ID: PAT_TA_63309.pep
RTYAIDTKSWREGYSRNLPGATLQNLYLRKSMADSRCQSSTEHGYKFCQEYTLPNKQPQQQYKLEDPEWVADDARLARAQDRLRNYLRSQQPEEFDVFPESLRLEL

SEQ ID NO: 168892 - protein, 37 aa, Triticum aestivum
  Clone ID: PAT_TA_63310.pep
MAYAAGSPAVPDWLNKGDNAWQLTAATMVGIQSMPGL

SEQ ID NO: 168893 - protein, 123 aa, Triticum aestivum
  Clone ID: PAT_TA_63311.pep
MTEMHILVQSTMASKSNSSNSNSNSNSNGGSSKGGNGGGNIASKQHNASLSGTTTRGREFEDPETKAYMKANAAKALWHLAKGNAAICKSITESRALLCFAVLLEKGEGDVQYNSAMALMEIC

SEQ ID NO: 168894 - protein, 73 aa, Triticum aestivum
  Clone ID: PAT_TA_63312.pep
AESKLQHHAAVNIVGDGFNWRKYGQKQVKSTDNSRSYYRCTNSSCLAKKKDEHCPDGRVIQIIYRGAHSHEPP

SEQ ID NO: 168895 - protein, 71 aa, Triticum aestivum
  Clone ID: PAT_TA_63313.pep
HSLEYFFLRNHSCVCMWVCLLVEHGPPHSSAISGRRISCLMRFQPSDQATEGPRPLDRPGNTATINSYLPL

SEQ ID NO: 168896 - protein, 126 aa, Triticum aestivum
  Clone ID: PAT_TA_63314.pep
GNIPPGLSNCSMLKLLGAGYNNLNGTLPDELFKVTSLEHLSLPSNGLEGAINGISKLTNLVALDLGGNELTGSIPESIGELKRLEELHLEHNNMSGELPSTLSNCTYLVTIDLKSNQFIGELTQVN

SEQ ID NO: 168897 - protein, 61 aa, Triticum aestivum
  Clone ID: PAT_TA_63315.pep
MFVQELRVVLPKEVEAARSAVENGTAAHQNRITECRSYPLYRFVRKELGTEYLTGEKTRSP

SEQ ID NO: 168898 - protein, 55 aa, Triticum aestivum
  Clone ID: PAT_TA_63316.pep
MATETETFAFQAEINQVLSLMINTFYSNKEIFLRELICNSSDALDKIRFESLTDK

SEQ ID NO: 168899 - protein, 39 aa, Triticum aestivum
  Clone ID: PAT_TA_63317.pep
MAMASSSGLRSCSAVGVPSLLAPSSRSGRSGLSFCAYAT

SEQ ID NO: 168900 - protein, 61 aa, Triticum aestivum
  Clone ID: PAT_TA_63318.pep
MAAPRGAALVLAMVLAAMVVAPPATVHAISCSTVYRTLMPCLQYVQQGGSSARGCCTGIQN

SEQ ID NO: 168901 - protein, 137 aa, Triticum aestivum
  Clone ID: PAT_TA_63319.pep
VRVAASPPSQTAAAARLQVSPWTGSSPPSPEHAARSSSLPIELSGEQSLLRRLLFLHSSRSSSLTSPPLDFSAQGAMAPPKLQLQVVVRRSMAPVEVAQGSEAAPCARAAANGWICGGLMCEGDGGGMPVLGRPRWD

SEQ ID NO: 168902 - protein, 57 aa, Triticum aestivum
  Clone ID: PAT_TA_63320.pep
KKIFFMQWRKRKSSWQFCIYIMMARNMDCKSVCYFYYINEDLKMWINPCHHVEQKQR

SEQ ID NO: 168903 - protein, 89 aa, Triticum aestivum
  Clone ID: PAT_TA_63321.pep
LGITAGATTEAAMAERGVESVLFRGKKLMPQTNDKRLDRVVEQLLFGAAIFHSVVGWFYFSPIWPRTKSRFDLNFDANMDWDVMHVLAY

SEQ ID NO: 168904 - protein, 122 aa, Triticum aestivum
  Clone ID: PAT_TA_63322.pep
SDSDSDGSEATTALVPAQHPHRHLRSGHSARDIFCATPTHAVFNSGGAPRRQVRQLRDGPAHGMMPARSGSTKFTGAKQRCRTVERRVGLQKRDRAWSTSGAGTSASARASSRSGCTTTSTT

SEQ ID NO: 168905 - protein, 129 aa, Triticum aestivum
  Clone ID: PAT_TA_63323.pep
SGREGGHAMCLAFQVKGASSLDQVGEREGPGRLPRRRRDRRRLMVARSMRTCWISPDLVGWRADLSPILSQIFSCYLGFPTAGAPRQPSRRPLPPAGGTRRRRTSWYDVRRRRTDELKDQERHTGRDNL

SEQ ID NO: 168906 - protein, 143 aa, Triticum aestivum
  Clone ID: PAT_TA_63324.pep
SSQTPERSQHVRLRSPRPPWPEPPCQRSGRRRRQPAHLQDLLQGRRGLVPFNPEYLDESVMWTESGDVGKGFRCIRMVNNIRLNFDALNGDKDHGGVHDGTTVVLWEWAKGDNQSWKILPWGEEAYAGGSANAPRGGSTEPTV

SEQ ID NO: 168907 - protein, 33 aa, Triticum aestivum
  unsure (1)..(33): unsure at all Xaa locations
  Clone ID: PAT_TA_63325.pep
MSSAEPTRDXSVYMAKLAEQAERYEEMVEFMER

SEQ ID NO: 168908 - protein, 38 aa, Triticum aestivum
  Clone ID: PAT_TA_63326.pep
MDSEKSGDGRTRAYKFVAYSAVTFSIVAVLSVVCTLPM

SEQ ID NO: 168909 - protein, 84 aa, Triticum aestivum
  Clone ID: PAT_TA_63327.pep
LVERSIEDTSTAPAMASAYDRTADLRALDATCSGVRGLVASGVTRLPRIFRVPYGVHRPQPPPPHAPSQEAPSVPVIDLSGADR

SEQ ID NO: 168910 - protein, 59 aa, Triticum aestivum
  Clone ID: PAT_TA_63328.pep
MKLIAAYLLAYLGGNSSPSAADVKNILDSVGAQADEEKLEFLLAELKGKDITEVIASGR

SEQ ID NO: 168911 - protein, 39 aa, Triticum aestivum
  Clone ID: PAT_TA_63329.pep
ASKSHLGVRGAIWKRNRSIDGPASPHRSRHRAAPCRVHA

SEQ ID NO: 168912 - protein, 66 aa, Triticum aestivum
  Clone ID: PAT_TA_63330.pep
LLYSVDRRREAYATILHSASEYVCGAIAAAQSIRQAGSTRDFVILVDDTISDHHRKGLESAGWKVR

SEQ ID NO: 168913 - protein, 46 aa, Triticum aestivum
  Clone ID: PAT_TA_63331.pep
LLRVRLNWLQCAPCLDCFHQTGPVFDPAASASYRNVTCGDARCGLV

SEQ ID NO: 168914 - protein, 74 aa, Triticum aestivum
  Clone ID: PAT_TA_63332.pep
KSDTGHVTQVICSTIDAKSLENVNSENSFDSIKIDLGDQNVSSSLDIKKGNSFAAGQSCSDNNATEALNHLANA

SEQ ID NO: 168915 - protein, 60 aa, Triticum aestivum
  Clone ID: PAT_TA_63333.pep
VVRASGGGGFRAAFFYLPFLLGSSRSRSRSAPAGDESMTPAQDPFYIVKDEIQDSIDKIQ

SEQ ID NO: 168916 - protein, 37 aa, Triticum aestivum
  Clone ID: PAT_TA_63334.pep
HLFSCKGFPERPQTISCIVFHFTGLSRLFPYLRTRRQ

SEQ ID NO: 168917 - protein, 43 aa, Triticum aestivum
  Clone ID: PAT_TA_63335.pep
GHGSKFDHVGSSYTQLYMHVSFCVVGNYMITLLHRTPPRCSYI

SEQ ID NO: 168918 - protein, 50 aa, Triticum aestivum
  Clone ID: PAT_TA_63336.pep
RHVLLAVVLLLLRLLLRRRCRPAVVVVSELGVRPHEVLPQVAHASAHASA

SEQ ID NO: 168919 - protein, 118 aa, Triticum aestivum
  unsure (1)..(118): unsure at all Xaa locations
  Clone ID: PAT_TA_63337.pep
VQKRLAASVLKGCLRMVWLXPNESSEIGLANSRQNIRKLVKDGFDIKKPQVIHSRARFTKRNEAKRKGRHTGIGKRRGTVNARLPFKDIWMRRMRVLPSFLRKYRDAKKIDSHIYHEL

SEQ ID NO: 168920 - protein, 55 aa, Triticum aestivum
  Clone ID: PAT_TA_63338.pep
LFLIFISEYRGTGAHISLPVCPPRCRNLPSHSVLSSSYVVFMDMVNDILSGKKIA

SEQ ID NO: 168921 - protein, 127 aa, Triticum aestivum
  Clone ID: PAT_TA_63339.pep
RSLPRLGTTLHYNYTAEGNSVAVAFRAPQTSKAGGWVAWGLNPNGTGMVGTQAVVAFRHSNGSLVAYPTMLDSYAPSMAPADGAELAFPVSDVAAEYAKNGKEMVVYATVALPGKGSKFTHVWQQGG

SEQ ID NO: 168922 - protein, 76 aa, Triticum aestivum
  Clone ID: PAT_TA_63340.pep
FICPALPCVGRSGPLAMLHPILRHLGAYTKPVTGTRVSLPVTHIRLLEPSAWPTWAGSSRAEHSLRRTRFSPDPGE

SEQ ID NO: 168923 - protein, 62 aa, Triticum aestivum
  unsure (1)..(62): unsure at all Xaa locations
  Clone ID: PAT_TA_63341.pep
LFKHKEAVKAALDAVEKKKEEEDASKAGEDDDDXDDEDAYDEDTDDRAGSDVEFDDEKHDEL

SEQ ID NO: 168924 - protein, 39 aa, Triticum aestivum
  Clone ID: PAT_TA_63342.pep
FVSASLASEQARLGGDRKCRSVGSPWGATVRCTRWAPSR

SEQ ID NO: 168925 - protein, 64 aa, Triticum aestivum
  Clone ID: PAT_TA_63343.pep
LRTVLHRDIKPGNGMLDMDFTAKLCDFCLVTQLTRAATSRSTDNIIGTLGYMDPLYQQNGQVTK

SEQ ID NO: 168926 - protein, 128 aa, Triticum aestivum
  Clone ID: PAT_TA_63344.pep
MDAAQSKWGFLMQVFKMPPDTNRTKLFPPANFKISGGSSLNPDYSCGQPVPVSPTGFPNPSGLDSTTLAVATWQVVCNITTAKGAKPKCCVTFSAHYNDSVIPCNTCACGCSVNRRGPTCSTTAPSMI

SEQ ID NO: 168927 - protein, 90 aa, Triticum aestivum
  unsure (1)..(90): unsure at all Xaa locations
  Clone ID: PAT_TA_63345.pep
GILSRALQSPEALLVQNAILFLKVIGAFDQNEEFTVLGKPLSMLPVEPNIGKMLICGAIFNCLDPILTICCMDLSXRDPFMTPFDKKDLA

SEQ ID NO: 168928 - protein, 46 aa, Triticum aestivum
  Clone ID: PAT_TA_63346.pep
CVDAVVLYRQQHACYVLERGEMLFHQKQMKELTMSHFIFSRLGRNK

SEQ ID NO: 168929 - protein, 104 aa, Triticum aestivum
  Clone ID: PAT_TA_63347.pep
VHVVRRALHADADANAGTVRAWGGWGFVFGIRRRTGGRERLSLSPSCLAATACPGISLTFTSGATENPPVAAFDLQHALESFASEIGLCVWLAGHVIYVVSQVS

SEQ ID NO: 168930 - protein, 140 aa, Triticum aestivum
  Clone ID: PAT_TA_63348.pep
EGLGRHVVSSGAVQANWDKKLQVAWKKARPAPTTPEEAGRLVVLTLKNHQKADVDGLLAFYGLPHPNEAGSAPPPAAGHHAPPAQHSAPAHKPQGVKFELHTLPVDAKAVADGDTVTVYVDTNDAPSEIKKAAAERTKAR

SEQ ID NO: 168931 - protein, 108 aa, Triticum aestivum
  unsure (1)..(108): unsure at all Xaa locations
  Clone ID: PAT_TA_63349.pep
LSTRPPTRPGPRRGGFSLGRVPSPPLPRRSPPPPPPPPRGSHPWLSAAPSGPSPSARRHHTASAAPPPRPPPSXPPAPPPTSXPPPGHRPTPLLRRPAPARQEGGQAR

SEQ ID NO: 168932 - protein, 104 aa, Triticum aestivum
  Clone ID: PAT_TA_63350.pep
MERGGLEPKQLQLANQLQESLVHKRCLIVVDDIWDKETWTLIENVFEDSAGSKIITTTRNRKFAEEFGGIYEMKPLCTDDSRKLLRTKAKVKGHDTEFDILSDK

SEQ ID NO: 168933 - protein, 129 aa, Triticum aestivum
  Clone ID: PAT_TA_63351.pep
LYYYNSNPYYVPTVPTHDAITTTETINPEVDLWDDGSNYHVICDLPEVAKHNLHLHCTNQKLIIFAEIESTNEYNPITNRIRERRHKRYRRRVRLPSQVDETKIDAKLEGGVLKVVLPKTKEHQGENKQ

SEQ ID NO: 168934 - protein, 106 aa, Triticum aestivum
  Clone ID: PAT_TA_63352.pep
QTTNKFSLLADMMGKMQLSLGYKNSTNIQTRRNVLGIEHVNGSLYETTQTKTVWLSIFCGTNILKLCSFEAAQYYMVLLRSREKVAKIFAMPFSLEINKYCNLFIT

SEQ ID NO: 168935 - protein, 123 aa, Triticum aestivum
  Clone ID: PAT_TA_63353.pep
VAWADAWADAWADAWANHTNPPKPPRISRLSAAAAAAEDTELLPRPIAMAAPTAFAAARFLPSAHLDSSARLAPLAAIRPSLWREDRSCLEWLRGREPRSVVYVNFGSITTMTGQELVEFAWG

SEQ ID NO: 168936 - protein, 127 aa, Triticum aestivum
  Clone ID: PAT_TA_63354.pep
VETRIGTNIENTDVPSVSQPDILMQGALDVSGLQYNPPSVSDHVYPNTTQPSIMESQQGNAQAQHLSHFSSLLAQQANTLQSNFLGSNLTQHRDFDFSPFLSAQSAMKYNPAVPTTSYPISMQENLN

SEQ ID NO: 168937 - protein, 83 aa, Triticum aestivum
  Clone ID: PAT_TA_63355.pep
MAQKDAANGNGATTRPPPTPSPIRFSKFFQANMRILGTGGAGFIGSHLVDKLMENEKNEGIVADNFFTGAKDNLKKWIGHPRF

SEQ ID NO: 168938 - protein, 138 aa, Triticum aestivum
  Clone ID: PAT_TA_63356.pep
LDAWVVLLSSIRHRHVVSLIGYCNEQAEMILVYEYMQRGSLRQHLYGSGEPALPALSWKQRLEICIGVAMGVHYLHAGCSENIIHRDIKSTNILLGDSNRGMIAKVADFGLSLTGPSFGHTHVSTIVKGSFGYLDPEY

SEQ ID NO: 168939 - protein, 83 aa, Triticum aestivum
  Clone ID: PAT_TA_63357.pep
FLTPALNLAGGCDPMYGNGNVFSSDITTCQSNGVEVLLSLGGGAGSYGLSSTEDAQSVATYLWDNFLGGSASHRPLGDAALDG

SEQ ID NO: 168940 - protein, 121 aa, Triticum aestivum
  Clone ID: PAT_TA_63358.pep
LLPVRRAAWPGALRPLSPKPVSPPIRPIMWWNVLAASRCTTRSRRVVGAAVPPICAADRARFSPKRRAVWVSTAKSTSPLRPVTSSSAAKRCAEQCSTTAAAEGKSQSANGQTAGAVNSGE

SEQ ID NO: 168941 - protein, 128 aa, Triticum aestivum
  Clone ID: PAT_TA_63359.pep
KVKNWKMSAYKKFEELENSGGLIPDYFLSNGHLVPAAPPNNGASTSKNQTTAEFGEQQPFLQESGFPLAQIFAKNVAAPSNQEGPPFTQCSYEQVAHQELYQQDPSILCNGIPPYLTHGNINGQGIIL

SEQ ID NO: 168942 - protein, 143 aa, Triticum aestivum
  unsure (1)..(143): unsure at all Xaa locations
  Clone ID: PAT_TA_63360.pep
PDADEPKPKPVAAPEKRPGVDAAEEAPKILGVLAAAVVAPKRPGVAAGEETAPKRLGVVAADEVAGAPKGLGVVVAAPNMLGVVAAAEVAGAPKRGEADEVAAGXENPKPVAPKPKGDGEEAVAVAMAATACVRSPIWGGLLK

SEQ ID NO: 168943 - protein, 73 aa, Triticum aestivum
  Clone ID: PAT_TA_63361.pep
GAIAGASDVGRRGPRRGNTSCHPLLAFTTTSGRAAAGAEALAAGGVIGASSSSSSSSPSAAREVHDSGSAHAS

SEQ ID NO: 168944 - protein, 103 aa, Triticum aestivum
  unsure (1)..(103): unsure at all Xaa locations
  Clone ID: PAT_TA_63362.pep
FTRPLYGNLKRICETNLGLISQCCLTKHVKKTTPQYLANVALKINVKVGGRNTVLVDALSRRIPLVSDRPTIIFGADVTHPHPGEDSSPSIAAXWPEVTKYAG

SEQ ID NO: 168945 - protein, 144 aa, Triticum aestivum
  Clone ID: PAT_TA_63363.pep
CAIFRSMAILGVDGFSSLPKNCLTLCYIFFVGAIVVNLIRDLVPKKVSNFIPIPMAMAIPFYIGSYFAIDMFIGTVILFVWQRLDRAKSETFAPAVASGLICGDGLWVLPQSVLALAKVKPPICMKFLSRGMNDKVDAFITTLS

SEQ ID NO: 168946 - protein, 69 aa, Triticum aestivum
  Clone ID: PAT_TA_63364.pep
VGTGQLALVGTPCHRNPAPLRHAHHYREIPPHQRSISLLVKPPVPKRSTCLPGGPHKQTCSTETDKHKF

SEQ ID NO: 168947 - protein, 88 aa, Triticum aestivum
  Clone ID: PAT_TA_63365.pep
GTGWDSSKGVIVMDNEWWKKARKDIPGCGKFRKKPLQNLEHLSKMVGDILNDEQDHWNPMSDNPIIPPSQENFVDVDNVVGVGEKEGS

SEQ ID NO: 168948 - protein, 149 aa, Triticum aestivum
  unsure (1)..(149): unsure at all Xaa locations
  Clone ID: PAT_TA_63366.pep
KSSDESSKEIVSSQPEGSSPPEPEKASDSNSDGSSSPGKKTSGSKLSASAPPFKPGSLLSVSHPYSTVAIYDASVVLQPIPSQAMEILPHAVDTXRYLRGPRSTLYYRTGHSFQRKQGYTQSQSTILRGSTSPPTMNPHAAEFVPGKTV

SEQ ID NO: 168949 - protein, 124 aa, Triticum aestivum
  Clone ID: PAT_TA_63367.pep
FGSRRCPAPPPPPLSLPAPRCFHAPPPAPCFHAPPAAPLLLAATVGSHHSATNRHDQSSLPPPWRPTPTPRRGPSLRVTASGGHSVPSNSAVQLLAPRGRSSSCVQANISTGDKFFFHNLLLLL

SEQ ID NO: 168950 - protein, 49 aa, Triticum aestivum
  Clone ID: PAT_TA_63368.pep
FWAVRSLTTWAEGGPTPRLSTTHSTTPRSSRRLRLLIRSRARMLDGTAN

SEQ ID NO: 168951 - protein, 70 aa, Triticum aestivum
  Clone ID: PAT_TA_63369.pep
PAGNKPFLGAAPEGGDRGRVRRHRRDAGAPLVAGAVWGEMRLDVPLPSRLGEVWGGAGWRRAGAGQSWVR

SEQ ID NO: 168952 - protein, 122 aa, Triticum aestivum
  Clone ID: PAT_TA_63370.pep
DSSSALFRLWLNSRSGGAFLIPYYVCPSARSLRTHLQSGSSPTNHAFPPPLQRSPTRRMSPSATLIEAWDSIGRAAPVSPVCPWLILCSESPFGSMNRSMEQAPRSRSEGGRRTGERSSRET

SEQ ID NO: 168953 - protein, 56 aa, Triticum aestivum
  Clone ID: PAT_TA_63371.pep
GGMPLWCAGVGRFMVSTAVGAAVRSDGLVRVRAEQGKAGARWAGGGWWRLCACVRA

SEQ ID NO: 168954 - protein, 82 aa, Triticum aestivum
  Clone ID: PAT_TA_63372.pep
CGRVGRNVASGQVLFTSDQTLMDETPTTGNKTAVMVADNAANPITWMVKFAVAMVKMGGIQVLTGTDPGEVRKVCFATNNAS

SEQ ID NO: 168955 - protein, 89 aa, Triticum aestivum
  Clone ID: PAT_TA_63373.pep
IRPRGCSNLVSDSMSGAEPTTEYQFTLPDTKIWALHQEQLATLQEQLHDMSTRMAAYETRPLTSVPLAAGVGIMGPQPTSLTDPSHPPV

SEQ ID NO: 168956 - protein, 96 aa, Triticum aestivum
  unsure (1)..(96): unsure at all Xaa locations
  Clone ID: PAT_TA_63374.pep
CNPAFAIVNKATGLAVKHSLGQSHPVKLVPFNPEYLDESVMWTESGDVGKGFRCIRMVNNXIRLNFDALNGDKDHGGVHDGTTVVLWEWAKGDNQS

SEQ ID NO: 168957 - protein, 47 aa, Triticum aestivum
  Clone ID: PAT_TA_63375.pep
WTRGFGSGFGGKVRPGRGGRPTSQFGILFLPFRPGIPALGGWPNGLV

SEQ ID NO: 168958 - protein, 121 aa, Triticum aestivum
  Clone ID: PAT_TA_63376.pep
PPAPGLPPRTPLQTPAARPRRLFARRPWLRLRAPTQLLIESNHHTDEAFSCKNSRISSLLSQFHKQMACMLPVAGTGSKIPLSINLGIRPTDHPLQPRNHPSKAKPQSSVRISKTAARIVT

SEQ ID NO: 168959 - protein, 69 aa, Triticum aestivum
  Clone ID: PAT_TA_63377.pep
PQPARKRKRKRIEPARARARTMAALRLAGRRFCDRALGRSAGIHELKAAKEFPDIDPGHLKAARKHPKL

SEQ ID NO: 168960 - protein, 80 aa, Triticum aestivum
  Clone ID: PAT_TA_63378.pep
ALLPASGSGGAGGGERLSIDDALALHAGEFGRWQLWHFLLVTAAWTLEAMHTMVMIFADREPAMWCPAGDRAVPRPLRRR

SEQ ID NO: 168961 - protein, 53 aa, Triticum aestivum
  unsure (1)..(53): unsure at all Xaa locations
  Clone ID: PAT_TA_63379.pep
RLIPTHLKRSPVRFRIRFEGEXAPQQRFPGTIVGSDSLDQLWPESNCSSLKKR

SEQ ID NO: 168962 - protein, 65 aa, Triticum aestivum
  unsure (1)..(65): unsure at all Xaa locations
  Clone ID: PAT_TA_63380.pep
AIESSSSNPLTDLGMPTDLLLAQGVGRGGGGGXAARSEPPREMGRWVAAPMWCCVWVWVGEPDTW

SEQ ID NO: 168963 - protein, 49 aa, Triticum aestivum
  Clone ID: PAT_TA_63381.pep
MESKGGKKSSSSSSLMYEARLGYSIEDLRPAGGAKKFSAAYSNCAKKPS

SEQ ID NO: 168964 - protein, 110 aa, Triticum aestivum
  Clone ID: PAT_TA_63382.pep
SMVRRSTTSLFFARAAFPFFFLASLSMARRSSSIPRMHVSYPSSIISSNISRAPVSSLSGIISLLLLAVSASRSSSSYLYLRPRRPLPDVGVPFAASSFLTMKPRSFSLQ

SEQ ID NO: 168965 - protein, 99 aa, Triticum aestivum
  unsure (1)..(99): unsure at all Xaa locations
  Clone ID: PAT_TA_63383.pep
MAEAGEWLPCVSTLASCLLGFALYFYAPYWGVRGVPGPPALPVVGHLPLLALHGPDVFGALARKYGPVFRFHLGRQTLXVIVADPELCXEVGVRQFKSI

SEQ ID NO: 168966 - protein, 30 aa, Triticum aestivum
  Clone ID: PAT_TA_63384.pep
ELTVSCSGMPSRPKSSITHSNESNMTYSCL

SEQ ID NO: 168967 - protein, 113 aa, Triticum aestivum
  Clone ID: PAT_TA_63385.pep
STFEPPFSTSSLWSPSLSSSEGATRQDAGGQGQQPAAPGPVLCRRPSASTRPTAGGARAEAEERGLDPDLTAYWSSWREVVDPTGLESLITGRGGCMTREGGSRLSKMEWPFP

SEQ ID NO: 168968 - protein, 120 aa, Triticum aestivum
  unsure (1)..(120): unsure at all Xaa locations
  Clone ID: PAT_TA_63386.pep
ANHRVVLLYDVQTHNVDMQLPDNSSLPGSGRGVQPIIHFSPSDDMLLWNGVLWDRRSPTPIHQFDQFTDYCGGGFHPAGNEVILNSEVWDLRKFKLLRSVPSLDQTVIKFNXRGDVIYAI

SEQ ID NO: 168969 - protein, 132 aa, Triticum aestivum
  Clone ID: PAT_TA_63387.pep
SHASAPAVDQVIDHRPMRRRTSGSTLLLHLPTNAPGPSCCSPPPHICINKTWQPLQSTSFNSSRSTPPRSHKLAAKSPRSIEPEMALDAAVAGHLDRSHQPTSDRGGLVAAPLRGLGTICSYKWHRPAAAGA

SEQ ID NO: 168970 - protein, 103 aa, Triticum aestivum
  Clone ID: PAT_TA_63388.pep
ASFTKILLIMHLIAFIALTIFLGVQASSHPNPTYKPFAHFIPLASSVILSIIAACFWTILAVTNPAKAIKTSLWTAPVSALGCDVVILLVGDGEALGIGVLIV

SEQ ID NO: 168971 - protein, 87 aa, Triticum aestivum
  unsure (1)..(87): unsure at all Xaa locations
  Clone ID: PAT_TA_63389.pep
CPHKATGSALAWRCLILRNRLKGAFTYREQXTMLMQSYIMVDGKGRTDKTYPAGFMDIIAMPKTGENYRLLYDTKGGFRLNYTRDED

SEQ ID NO: 168972 - protein, 147 aa, Triticum aestivum
  Clone ID: PAT_TA_63390.pep
LHCPDSDEKLDGKGRNFLHIAVEYKKWKVVWHFCGTPELERMVNVMDYEGNTALHLAVKNADQMIVSLLMANKNVLPNIVNNKGLTALDLAVLATDKGMSYTLNPQVIILRCLAWTGAVLTPRRLDHFIDEFHIGKASGNELKKFSN

SEQ ID NO: 168973 - protein, 103 aa, Triticum aestivum
  Clone ID: PAT_TA_63391.pep
MAMPSLILPKELPYEFLKKITDDFSDDRKISDSPFGILYKGINPDDGKVIAVKKLQENAPMPPNKAFAQEVQNVMALKHDNIVQLVGFCSETTKRLVQFDKRY

SEQ ID NO: 168974 - protein, 76 aa, Triticum aestivum
  Clone ID: PAT_TA_63392.pep
MEHSDGETAAKRAKLSSSGSEDLLSALSDDVLIHILLRLRNTAVAARTSVLSSRWRRLWALLPGLDFLPDTNPYSI

SEQ ID NO: 168975 - protein, 69 aa, Triticum aestivum
  Clone ID: PAT_TA_63393.pep
DSTESRRLDRSDRASLGRALAMDSSSWIHGYYGPSSGAGGGNSGFMCGYADSCVVLEELHNRKEEEERT

SEQ ID NO: 168976 - protein, 42 aa, Triticum aestivum
  Clone ID: PAT_TA_63394.pep
FVFGRVGCFFFFFFFFFFFFFFFFFFFFQEKLQGFSYAFMGN

SEQ ID NO: 168977 - protein, 62 aa, Triticum aestivum
  Clone ID: PAT_TA_63395.pep
KLLRKEPSGDGGRAKTRSRRGSKAGCRSGRERDGCLRWLVWVCGLPATPRLYIATAGRLGGG

SEQ ID NO: 168978 - protein, 67 aa, Triticum aestivum
  Clone ID: PAT_TA_63396.pep
RTRGRTRGSVAVTKFLDDLAKIDFPGAKLVSDAVAKSGTTPLSPAIVFILDKVAPFVPAPKEEPKAE

SEQ ID NO: 168979 - protein, 152 aa, Triticum aestivum
  Clone ID: PAT_TA_63397.pep
FESVGDIPDAEVKPPDNVLFVCKLNPVTQDEDLYTIFSRFGSVTSAEIIRDFKTGDSLCYAFIEFEEKEACERAYFKMDNCLIDDRRIHVDFSQSVSKLWGQFRQSKRNGNKDGCFKCGAPDHIARDCDQDGEQKPKAPNYVLKDDNTQRGG

SEQ ID NO: 168980 - protein, 136 aa, Triticum aestivum
  Clone ID: PAT_TA_63398.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYN

SEQ ID NO: 168981 - protein, 87 aa, Triticum aestivum
  Clone ID: PAT_TA_63399.pep
DNFLQGTCGAEVFIQSSNDTNPVAERNVCACGALRKDGMPNEFVQHQIVNFEFFSIQGALVMSLFQPGFDAATAEQVLFRCTIRTSG

SEQ ID NO: 168982 - protein, 100 aa, Triticum aestivum
  Clone ID: PAT_TA_63400.pep
MRAPASLLHRVALAKTGPGEPSSSPMSMKAPENQQTAPVMAVNSDMVLILASLLCALVCVLGLALVSRCTGRRRRSPSFFDHAPPAPKGLKKKAIHALQP

SEQ ID NO: 168983 - protein, 113 aa, Triticum aestivum
  Clone ID: PAT_TA_63401.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKA

SEQ ID NO: 168984 - protein, 130 aa, Triticum aestivum
  Clone ID: PAT_TA_63402.pep
LKLHIANCRSLTSVGQGQPPIRAFKSLTFLIIDNCENLATLDGLLTELCLPAIRKIDVRNCGKLQFLFGERPGSFPSLEDLLLHDCPSLKWPRELVLPSSLKKLHLVRCGDISSWFSSCLQNLKSLAELA

SEQ ID NO: 168985 - protein, 67 aa, Triticum aestivum
  Clone ID: PAT_TA_63403.pep
LQFWNYLQECAAAFVFFKTRYGALVASDVLQTSNPTKWVTDPAPEPNDVYWSNIWLPYKQLWIRRIA

SEQ ID NO: 168986 - protein, 112 aa, Triticum aestivum
  Clone ID: PAT_TA_63404.pep
PCAAAEASDDGRTDDGRDVAALRSRRGIRLRPRRRGRRVTRRRPRRRAVPKTGAAAQTPCHGRDEDLLADIGACSSLIHNFERLLHVAAVLLSQPDLNLTSFHESLSSEQRE

SEQ ID NO: 168987 - protein, 95 aa, Triticum aestivum
  Clone ID: PAT_TA_63405.pep
STRREASPVLLLASCFLLLLQSPATNEGEAGNHIHIHNPYLYASYCLLESFLLAYSEMGGYEFQRAELDALEGRRTRSNCGANESDVAASQAHNK

SEQ ID NO: 168988 - protein, 115 aa, Triticum aestivum
  Clone ID: PAT_TA_63406.pep
LLTRVSSHSPNTQMGRATTCLATLLLAVTFLFASAATKSLTAMQTDQAGTKSGSTLPAHCCKQEEKAVAKPQLVVGDLVDLASAEEQGQKPSPHRSNKKKIHHHHHDDDDDDDDG

SEQ ID NO: 168989 - protein, 137 aa, Triticum aestivum
  Clone ID: PAT_TA_63407.pep
LLGIASTNLRKPLPIREVIARIVDGSHFSEFKRDYGTTLVTGFASIYGHRVGIIANDGILFGTSSQKGAHFIELCSQRGIPLVFLQNISGFMVGKDSERDGIAKHGAKLVTAFACADVPKFTVVVGGSYGAGNYGMC

SEQ ID NO: 168990 - protein, 110 aa, Triticum aestivum
  Clone ID: PAT_TA_63408.pep
SPYHSQTIPRTLATHYPYNSLRAFSSSNGRAPAPAAPWLLVVTPTRGAGAAAPRPCHGCLLRPQRGWTAAPMCRGRLFRACVPRVGPNPTPSPLPAGSTPPRRWLPAPRT

SEQ ID NO: 168991 - protein, 137 aa, Triticum aestivum
  unsure (1)..(137): unsure at all Xaa locations
  Clone ID: PAT_TA_63409.pep
LLASGDYEDVHVRLMRAYPEVSEYWYFGVLVVAAATGMAGIDTYPTYTTIGVVPYGIILALLFVVPTGIIRAMTGVEVTLNVLAEFIGGMWVXEGNALAMNFFKSFGYVTCAHALSFSNDLKLAHYLKIAPRQTFAA

SEQ ID NO: 168992 - protein, 80 aa, Triticum aestivum
  Clone ID: PAT_TA_63410.pep
TAWELAELFVLRPILVVFFALSFILLNPSGWYVAWRTVLVHVPLVQEVAGLRPKKKPAKPKPPNRGRIGRFYQSQAQAQR

SEQ ID NO: 168993 - protein, 138 aa, Triticum aestivum
  Clone ID: PAT_TA_63411.pep
MSKQQDKPALKPAVFTTVDQLRPGTNGHNLNVKVVSCTIVIEKQRADGTKIRVAEAVIGDQTGVVTLTARNAQIDVVVPGSTVVLRNAKVDMFNGFMRLAVDKWGLVKAAPEPAKFEVNTENDLSSIEYELVTVDDAQ

SEQ ID NO: 168994 - protein, 156 aa, Triticum aestivum
  unsure (1)..(156): unsure at all Xaa locations
  Clone ID: PAT_TA_63412.pep
SCSARPGPSCAGRYVYMYDLPPRFNADLARDCRMLSASTDMCRHVVNDGFGPPITDGGALPESGAYATDQYMLELIFHARMWQYECLTPDPAAAAAVYVPFYAEFDLAMRIDNSDMSARNALPGDVAXWLVRRPEWRXMGGRDHFMLASRPTWDLL

SEQ ID NO: 168995 - protein, 108 aa, Triticum aestivum
  Clone ID: PAT_TA_63413.pep
HASRPSSVPSPPPSRPTAAAPTSPLPHPAWPHPPPGENRPRPRPRLGKKREGGGSRRNPPPPLPGFSSHGGSAPTAYSASPVASTPPPAPAPAPAKANCFYPASPDRY

SEQ ID NO: 168996 - protein, 89 aa, Triticum aestivum
  Clone ID: PAT_TA_63414.pep
MAAKGDGPAIGIDLGTTYSCVGVWQHDRVEIIANDQGNRTTPSYVAFTDSERLIGDAAKNQVAMNPINTVFDAKRLIGRRFTDSTVQSD

SEQ ID NO: 168997 - protein, 134 aa, Triticum aestivum
  Clone ID: PAT_TA_63415.pep
MELLFFCTIVLILIVSSVYLLGLLADGRRNLPPGPRSLPLVGNLLSLGAQPHRSLARLAESHGPIMALRLGTVTTVLASSADAARDILQRHDAAFSGRFVLDGPTCRRTTRTHGLAPGQQPRWRALRKVCRVSS

SEQ ID NO: 168998 - protein, 80 aa, Triticum aestivum
  unsure (1)..(80): unsure at all Xaa locations
  Clone ID: PAT_TA_63416.pep
MWEMDALLYCAVVALALHCVGCGCSAINLEGSALLKFQSRVEXDPHGAMAGWSARDAXPCGWNGIRCADDRVVMLNQKIS

SEQ ID NO: 168999 - protein, 118 aa, Triticum aestivum
  Clone ID: PAT_TA_63417.pep
FAAVVDAKPQAVENKWVSPKSTLDAAFWESESDTDEADDEPSHGAAERRISALACPASALPDWDSDEGWIDVLSGPTEAVAVPAKVTCGIIVDDAITSEEESIDPESGALDITVDVEY

SEQ ID NO: 169000 - protein, 72 aa, Triticum aestivum
  Clone ID: PAT_TA_63418.pep
KFEKIYLKQRKNPNILNKLQKYNRHLKKFQKFSKKKPYILLVNCAKSYTDKESLMELLKASAGLNPKAIAAS

SEQ ID NO: 169001 - protein, 85 aa, Triticum aestivum
  Clone ID: PAT_TA_63419.pep
MVEKPASQADVGGEVEAHKERKGLWSPEEDERLYTRITRHGVSTWSSVAQLAGLRRSGKSCRLRWMNYLRADLKKEPISKREEET

SEQ ID NO: 169002 - protein, 112 aa, Triticum aestivum
  Clone ID: PAT_TA_63420.pep
MAPNGDNTVANVHSGIDSTNKTLLKSDALYTYILDTTVFPREHECMRDLRLITDKHPWGYMQSSSDEAQLLGMLIKMAGAKKTIEVGVFTGYSLLATALALPEDGKGGGHRH

SEQ ID NO: 169003 - protein, 116 aa, Triticum aestivum
  Clone ID: PAT_TA_63421.pep
SDTSPAAVACVASAPPNSTAAVHGQFLRWEKVEKQKCDDVLTSTVFVLTAEGTATLEFGVAELGWWLNGTCGAGGGERCAANASCTDVKTPSGELGHRCGCVAGMEGDGFLAGDGC

SEQ ID NO: 169004 - protein, 117 aa, Triticum aestivum
  unsure (1)..(117): unsure at all Xaa locations
  Clone ID: PAT_TA_63422.pep
FLADGLSGVDGILIDLGMSSMQVNRSDRGFSVLNDGPLDMRMDPKATLTAEDILNSWPELEVGRILRDYGEENNWQSLQRRIVKERXKGGLHSTSELVKLIQRTCTISRGRQGWIKT

SEQ ID NO: 169005 - protein, 109 aa, Triticum aestivum
  Clone ID: PAT_TA_63423.pep
VTSKEVKICGALGPCISLHRQNSSVSHKEIGEGGTNYWRMSTLNSKTCIAFFFRADCSRDTDPPTVFFIQFMTRYRHGDGSNRLRVTTVARRWAGPRSPEIAAGFDQEA

SEQ ID NO: 169006 - protein, 107 aa, Triticum aestivum
  Clone ID: PAT_TA_63424.pep
LGRVGPLAAAASILLPTAPAAPHSGSSPAPALEEPHSDSSPAATRPLSWASLADEDNEDDEEELAPLTPPASKSPVSAADPTIPCVGHEEETSGGWHEVLPRRGRRC

SEQ ID NO: 169007 - protein, 98 aa, Triticum aestivum
  Clone ID: PAT_TA_63425.pep
APVPRPRCSPPARTSRAAAPNHLPPSGAPAARTRPAPTELEAEAARGPKVVPVDGRGEKETADADGAMAISSVACLARKILLRGFFAFGLVGRVGGRE

SEQ ID NO: 169008 - protein, 121 aa, Triticum aestivum
  Clone ID: PAT_TA_63426.pep
HTEQSRPPLPSLPWHQDEEGRSGQLPTLATRMTSASWGPSTALKLPVFIVILAHPRDRHRHGLYQWASTTSPAVLVSVADANSVDKLDHLLCVEGVQLPPLSRSEPEVVAIWIWISGSPDA

SEQ ID NO: 169009 - protein, 142 aa, Triticum aestivum
  Clone ID: PAT_TA_63427.pep
LQAAAEGNLQLFKRTASALDGGKGRLRDAVEAVTLQGRGSGALHFAARRGRMAVCVYLVQELGVDVDATDETGYTPLVHAIIAGTVDTFQYLLDHGANPDKPDGQGSTPLHLAAAGGNCEIVKALLSKGVNVDSLCHTGTPL

SEQ ID NO: 169010 - protein, 83 aa, Triticum aestivum
  Clone ID: PAT_TA_63428.pep
MAGRLLGQLLVMGGAVVGRAVVQAYRQAIVNAQRTGAAQEAVNGIRRASKVMTEQEARQILGIGEKTSWEEIVQKYDTMFEKN

SEQ ID NO: 169011 - protein, 31 aa, Triticum aestivum
  Clone ID: PAT_TA_63429.pep
EPFTLSQFHMVHRCTRVDASFNLAYEHRPDA

SEQ ID NO: 169012 - protein, 163 aa, Triticum aestivum
  Clone ID: PAT_TA_63430.pep
SGGHKEKQIEESPHVKGFNLKDPRIMDGNWIHEPNKDVIRDFFRLLAICHTCIPEVDETDKVSYEAESPDEAAFVIAARELGFEFYKRTQTSIFIRERDPSQNVADYQYRKYELLNVLEFSSSRRRMSVIVKEPEPEGRILLFSKGADSVMFTRLAPDGRKFE

SEQ ID NO: 169013 - protein, 168 aa, Triticum aestivum
  Clone ID: PAT_TA_63431.pep
VKYRATFVCYKGGIARIKPGLKARRRLVAKTGCKAMMVVKYNASENHWEVVFVELEHNHPCNPEMVRFMMCFKDLPDWQREHRPFNAKTRLNPKIHSGRGRPPNQNKDFMVRSFAQSNYSIEAAAKCGKLRFAEGDVEALLVFFDKMQAQNSNFFYNWDMDDEGRLKN

SEQ ID NO: 169014 - protein, 128 aa, Triticum aestivum
  Clone ID: PAT_TA_63432.pep
FHASAHASAQFSHPREDERRLDGGAGVCNPRGRSAADTTPDRAPGRVGRRSSRRHGRGRPSVGSAPRTACPPASSSTPSPSTATPQVLRRDPRVHSPRDGDINIRGLSLPSASRPEGTASGGLQASER

SEQ ID NO: 169015 - protein, 122 aa, Triticum aestivum
  unsure (1)..(122): unsure at all Xaa locations
  Clone ID: PAT_TA_63433.pep
LFFAVGLAHYVVLFVTLYQRLPTNAQLPKELHPVFFLFVAAPSVASMAWTRICGEFNDGSKLLYFVSLFLYVSLVVRINLFRGFKFSLAWXXAYTFPMTSVALATVLYASEVDNVLTRALAV

SEQ ID NO: 169016 - protein, 88 aa, Triticum aestivum
  Clone ID: PAT_TA_63434.pep
ITTLNGARTLESTGETSRVEKVLPFHGFHGPRERVPHRVPLRALVAGELPGREVLGREEGEAAEVGGAEGEVRGRPALRREARPGEPR

SEQ ID NO: 169017 - protein, 91 aa, Triticum aestivum
  Clone ID: PAT_TA_63435.pep
VHTGGAAGGCDGHRTVRVGDERAVQHRGRAQRRHKAHERVQHARAHAVARQPRRAAVTAVRLAPEAERHIRPHRRERAHRARLIYRVYKLK

SEQ ID NO: 169018 - protein, 61 aa, Triticum aestivum
  Clone ID: PAT_TA_63436.pep
WYLHPISQSWTSLNNWNCLLIIVSMTVLISLQYQIPRAQSTYSLPFVPTQDQLTRHKRNLK

SEQ ID NO: 169019 - protein, 100 aa, Triticum aestivum
  Clone ID: PAT_TA_63437.pep
SRTRGRTRGRGRARRGAGAFGLRRRRSDAGSGIALAAPDPDLKASVYFNQGCLRWSCFRRPLSSELYRFGGWRWEGGSGEIRGQQCWSRRRRRPRAPYPS

SEQ ID NO: 169020 - protein, 92 aa, Triticum aestivum
  unsure (1)..(92): unsure at all Xaa locations
  Clone ID: PAT_TA_63438.pep
PRVRFFHAIQRFREPFEQFFAGECPDAVVADSHFQWSVDAAAEHGVPRLAFLGTSMFARACTDSMLRNNPLASCPDAVVSLPGLPXRVDMLR

SEQ ID NO: 169021 - protein, 102 aa, Triticum aestivum
  Clone ID: PAT_TA_63439.pep
PTRPVVVRDSGPERGRPAGRPPRNQTTSRLRPRPPPPPPARASPPPLLLQEPPSPACAAAYAGESTSLSSSGRGISRAPPGIRRRRSEGQRHGHGGRSRRPV

SEQ ID NO: 169022 - protein, 73 aa, Triticum aestivum
  Clone ID: PAT_TA_63440.pep
MTLSFCTDRISRLEGNPLCSKVNDTYCSNKKKNTTSTVLIAVIVPVVLISLLVVMCIIWKLCWKGEPRVHEDY

SEQ ID NO: 169023 - protein, 115 aa, Triticum aestivum
  unsure (1)..(115): unsure at all Xaa locations
  Clone ID: PAT_TA_63441.pep
LAVVTDTAYVGFSAATGVIFTRHYVLGWSFALNGPAPPLDTSKLPSLPRFGPKPRSKVLEIVLPIATAAFVLALAIAFLWFVRTRIRYAEVREDWXRVEFGPHRFAYKELYDCMP

SEQ ID NO: 169024 - protein, 94 aa, Triticum aestivum
  unsure (1)..(94): unsure at all Xaa locations
  Clone ID: PAT_TA_63442.pep
MMHRATIVGVVALIGVLLVGGGVRAQPPQRFDYPAARAPTTWANTDAGLXDHVVYTDGSVARVALLRLNPGRLXGPSYAFGFFCTGHGAAPCAD

SEQ ID NO: 169025 - protein, 109 aa, Triticum aestivum
  Clone ID: PAT_TA_63443.pep
VASFYMRCCAHILNLIVKDGLDVLEESIEKIRDSVAFWTSTPKRIENFQEVAKMLKVDQSKKLSLDVKTRWNSTYFMLSVALRYKSVFNRLRQREKTFTCAPSDDDLIF

SEQ ID NO: 169026 - protein, 87 aa, Triticum aestivum
  Clone ID: PAT_TA_63444.pep
VLVDRSLCRRHRGRPDRHVAVYDEHLCCWRGWRCAAGVHDAHDSGLQDQPERPERRARDPRNCARPAVRRARTEAREARAGHRHELG

SEQ ID NO: 169027 - protein, 58 aa, Triticum aestivum
  Clone ID: PAT_TA_63445.pep
GERDDVVRAARRCTASAVIGLDGPGREHGDLHGDKCKVTYKENKNLVSLYVYDRGRVR

SEQ ID NO: 169028 - protein, 73 aa, Triticum aestivum
  Clone ID: PAT_TA_63446.pep
QVSYGTLKGGNKISIYLTAMINIKCAEEPADLVDARHQVRRFARVEERDYHLAAWDVVVAVDDRCCPVAQSRT

SEQ ID NO: 169029 - protein, 106 aa, Triticum aestivum
  unsure (1)..(106): unsure at all Xaa locations
  Clone ID: PAT_TA_63447.pep
FLSSRKKRKASNKFEDDTVKGFRRMRDLIGSNRTPRLQLGAGSYXHGYHDLPDLESGPSFGYELPSTNGINKNKQSHSLTKRKRSNIGQAYENSRKKDKRLSLSKL

SEQ ID NO: 169030 - protein, 62 aa, Triticum aestivum
  Clone ID: PAT_TA_63448.pep
FLRPPTRPVQKYMCRRFAMPMQMVHTQAAHDAFFQSDREPSCSCWSPFMIWLSELSICNIAN

SEQ ID NO: 169031 - protein, 95 aa, Triticum aestivum
  unsure (1)..(95): unsure at all Xaa locations
  Clone ID: PAT_TA_63449.pep
GSMASQLESLMKRLWSYLPPSLSSSRSDPPQPIPDPTGDPPAAQAGDTPAGQELSPALQGVNSGLSYLSTLSTHAYVTHXFLLMISPERCDNNLW

SEQ ID NO: 169032 - protein, 116 aa, Triticum aestivum
  Clone ID: PAT_TA_63450.pep
HLLRLICQMLDKLIPWTIKNTMTIFLLAKQTRVNGDFAGCNNSKIGLTGLYLEKTSVPFEALTRSLDLRHEVFDFFCVQQNVGLRPLIDPVFDLEDQLPELLHTHFGPTRPPTRPR

SEQ ID NO: 169033 - protein, 140 aa, Triticum aestivum
  Clone ID: PAT_TA_63451.pep
RIELVVQMIKEMRANRFESDLATSTMLIHLLCRSHRFEEACAEFEDMFRRGHVPQYITYRMLMKELKRLGLVQLEEKLTDLMRSVPHSTKLPGSYREKEGDNAKEKRKLILEKAQAVSNVLKECKDPKELHKLKDDEETD

SEQ ID NO: 169034 - protein, 82 aa, Triticum aestivum
  Clone ID: PAT_TA_63452.pep
GQEGELGEEADGRHQEEECCGHGEVALGPGFRGRWSEDVIEVLGFKEGEGAAGVDQGEGGKEEEGSPPDGFRSRPTRPRTRG

SEQ ID NO: 169035 - protein, 78 aa, Triticum aestivum
  Clone ID: PAT_TA_63453.pep
ATEEDTTRLCDLPEACVAHVLALTSPRDACRCAAVSPCFRDAAESDVVWARFLPPDYRAILQLHEAPARRFPLSRSGS

SEQ ID NO: 169036 - protein, 112 aa, Triticum aestivum
  Clone ID: PAT_TA_63454.pep
FFPFLHIEEITFLKRAWVWSPHVQSRVARLEHDSIEKGLLYHIPSKVVCAEQQAVDVMGNALREYFFYGKKKYDERKAAFERVIARKGLGDYFPGFVSFETCVETYKQGSEH

SEQ ID NO: 169037 - protein, 80 aa, Triticum aestivum
  Clone ID: PAT_TA_63455.pep
MIPRAAAPGGGGCKVAYVCRQPKDMVVSRWHFHRRLHPELAFADVFGAVCSGLVAYGPAKTCFRVYASGYFLFNHSFLHH

SEQ ID NO: 169038 - protein, 90 aa, Triticum aestivum
  Clone ID: PAT_TA_63456.pep
LPSLLDLSPSAATNPSSLSYDPVVAAAAPSDLPHQPPPTLRLLHPPTLSVQATSFLPPRPSPLSPSSSSVPCCSRCSSAHAARKQREEGE

SEQ ID NO: 169039 - protein, 106 aa, Triticum aestivum
  Clone ID: PAT_TA_63457.pep
AEAIAEGIKSNSTLISLSLAKNPIRDEGVHSLCKAFSNFPIIGDELTAQRKKNIAELEKQRKELLANNNANPFQADEPFQIKREQNPPKMHCEDPPSWIHEQVKLM

SEQ ID NO: 169040 - protein, 79 aa, Triticum aestivum
  Clone ID: PAT_TA_63458.pep
AKKSRIKSKKKRITTKSMTQMLLHFKKKSNRIKATRITTKSMTQMLLHFKKKSNRIEATRITTKSMTQMLLRFKSQMEY

SEQ ID NO: 169041 - protein, 83 aa, Triticum aestivum
  Clone ID: PAT_TA_63459.pep
LTAMAELLQSGCTTSSDHLYIYPNGSRLDDSIGAAQRIGMRFHASRGAMSVGQRDGGLPPDSVVEREPDILRDAQRLIETYHD

SEQ ID NO: 169042 - protein, 42 aa, Triticum aestivum
  Clone ID: PAT_TA_63460.pep
SVAGIILYLHRLSADYSRSTFFSQSVFMLLCSFSFLSVVCST

SEQ ID NO: 169043 - protein, 80 aa, Triticum aestivum
  Clone ID: PAT_TA_63461.pep
LHGSAPRSRAWAWARRAGDRCGELGGFDTGMRRVLGGGGRTGTWWWRKEDAAWSRLRVHPAVRRLDSVDAEAGRVSGRVE

SEQ ID NO: 169044 - protein, 96 aa, Triticum aestivum
  Clone ID: PAT_TA_63462.pep
MMRHLRAAVDAEGVEHDAAVTDGEQLLRQLIDAAAAHHVVLAELKSAVARADVFHLVSGMWLPAAERCFIWIGGSRPSDLIKVMARHMEPLTEQQA

SEQ ID NO: 169045 - protein, 92 aa, Triticum aestivum
  Clone ID: PAT_TA_63463.pep
SLRLHHIPPRVGLIRYDCRARLRPAPRPPSTMHGDLPGRAAARAVGAGAEGADGSDEEEDGFEFEIGTLGKFMKPQGTVNVSATYNTWHHTV

SEQ ID NO: 169046 - protein, 89 aa, Triticum aestivum
  Clone ID: PAT_TA_63464.pep
SVEVKTPRRGELAEQAGEERQLGGGQGQGGDELGRGRGTAKRGCGGTQVRHDTWGRYKLCAKVDWPDSCVVDEPFRPDLPFRDLILSEK

SEQ ID NO: 169047 - protein, 49 aa, Triticum aestivum
  Clone ID: PAT_TA_63465.pep
MPVSRIAVGSHREVYEVGALKAALAEFICTLIFVFAGQGCGMAFSKLSP

SEQ ID NO: 169048 - protein, 94 aa, Triticum aestivum
  Clone ID: PAT_TA_63466.pep
FHASGWIVVMEIIPGFSLYRGLYEFGQYAFSGTAMGTSGMEWTNLSDPVNGMRTVLIIMVIEWAILLPLAFYLDQVSSLSGGLRKRLVDLLEML

SEQ ID NO: 169049 - protein, 75 aa, Triticum aestivum
  unsure (1)..(75): unsure at all Xaa locations
  Clone ID: PAT_TA_63467.pep
HVVLAPPPPXHRRPPVTLYRFRRASARSLGRTDMAGLVAVVSLSRARGGVGGESKTLARRRGSGGGEERARADEW

SEQ ID NO: 169050 - protein, 54 aa, Triticum aestivum
  Clone ID: PAT_TA_63468.pep
AEATYIIYVHQVPRELLIASWKDVLENLFGGRQRARVYLCLTNRVDRFTTRLID

SEQ ID NO: 169051 - protein, 33 aa, Triticum aestivum
  Clone ID: PAT_TA_63469.pep
LHKVYQSVLFRHYSPLMRYLLRVKYMVTHSVNT

SEQ ID NO: 169052 - protein, 73 aa, Triticum aestivum
  Clone ID: PAT_TA_63470.pep
VVATSSPSPPPPSAASRPQAASQTRPMEAPTGLHRLRGPSPIVWAMRTRVAPPPRLAGPIPRPVYPAHPPPRA

SEQ ID NO: 169053 - protein, 69 aa, Triticum aestivum
  Clone ID: PAT_TA_63471.pep
SSRPTDTGSCRVRTATSKMVPGRPSPSSSASWRRRPSSSSSSPSSEEPAPPMAKAKLRVAAGMVATRHY

SEQ ID NO: 169054 - protein, 71 aa, Triticum aestivum
  Clone ID: PAT_TA_63472.pep
MVLNGALFLLVCAAARAAASGGDGPLLNGNFEHAPNRSQMNGSRVTGKYAIPHWKATGFVGYFECGAKQDH

SEQ ID NO: 169055 - protein, 82 aa, Triticum aestivum
  Clone ID: PAT_TA_63473.pep
PPGHSNPTGLDVRGSKASSFNRVCHNHSVESIHSTSAERQQPLPPPAVERPMLMLCSNSTRGLAPCLTHDGRGCGTNNREDT

SEQ ID NO: 169056 - protein, 89 aa, Triticum aestivum
  unsure (1)..(89): unsure at all Xaa locations
  Clone ID: PAT_TA_63474.pep
GSHARGVQIAMTPTFAVRRREPVLVVPASPTPRETKRLSDIDSKESLRVLMPGVFVYRGGPXXGDDDPVDVIGRALSEALVHYYPLAGR

SEQ ID NO: 169057 - protein, 30 aa, Triticum aestivum
  Clone ID: PAT_TA_63475.pep
MGWAIALHGSAGDIPRTLPPERREPRLATL

SEQ ID NO: 169058 - protein, 69 aa, Triticum aestivum
  Clone ID: PAT_TA_63476.pep
SHSSGGERPSAEKGRRKRAPGDSERCRQQQQPAGRLVVVGRRGRDGERDVGRAAPGGCGARRRAARRRG

SEQ ID NO: 169059 - protein, 74 aa, Triticum aestivum
  Clone ID: PAT_TA_63477.pep
LKRTLSIAQLALSWPMHLDPSMAAIGGHPYSPSDLELPGFVPQQLSPIELVVPLIGTSLLVITGDLACLRPCPQ

SEQ ID NO: 169060 - protein, 51 aa, Triticum aestivum
  Clone ID: PAT_TA_63478.pep
VSEIPSCPSFPEPNVRRGAWFDVIAVKLPCTRVAGWSRDVARLHLQLSAAK

SEQ ID NO: 169061 - protein, 123 aa, Triticum aestivum
  Clone ID: PAT_TA_63479.pep
FLSSGSFFQTLRQGPRTHCIMHDLIHDLAVSVSTNDCFQIEPGMTRSIPSTVRHISVTTDGVQDINAAINMLPKKLRTLLVLRTRSFSSYCLQGDFLAKLKTWRVLDISHSDYTELPMSISCL

SEQ ID NO: 169062 - protein, 93 aa, Triticum aestivum
  unsure (1)..(93): unsure at all Xaa locations
  Clone ID: PAT_TA_63480.pep
FLSSGGERPSAEKGHRKRAPGDSERRRQQQHATGRLIMVHIGQPDIQVDNACXELYCLEHGIQHDGTMPSDTTXSEVAHDAFNTFFSETGAGK

SEQ ID NO: 169063 - protein, 36 aa, Triticum aestivum
  Clone ID: PAT_TA_63481.pep
QQHVMSRGVGLPARVPTVAGSDGRSAPSGRVVAQHV

SEQ ID NO: 169064 - protein, 53 aa, Triticum aestivum
  Clone ID: PAT_TA_63482.pep
MAGSVASGFFPTPGSSPAASARGSKNMSGELPESLSVRGMVAKPNTPPASMQV

SEQ ID NO: 169065 - protein, 70 aa, Triticum aestivum
  Clone ID: PAT_TA_63483.pep
PQPQTIHRFLFQYFLYQANPIRRHHLGFRLEAGKSGKSRWRRRQGWQAPSPPTPSRSSTCCWRRTPTTTG

SEQ ID NO: 169066 - protein, 64 aa, Triticum aestivum
  Clone ID: PAT_TA_63484.pep
MEPAAPSAYSVSPAASPAGRRRTAPEAAELRVRRRTLETVLEQCQRALELMRDAEGEDGDPEEE

SEQ ID NO: 169067 - protein, 95 aa, Triticum aestivum
  Clone ID: PAT_TA_63485.pep
MLHMMPSLSSSRASSNVPSEKGDGDESEDDDDEVLIPGLPTRFTFVDLETATNGFKWQIGSGGFGFVYRGELPDRTTVAVKRMNNLCMQGRREFL

SEQ ID NO: 169068 - protein, 87 aa, Triticum aestivum
  Clone ID: PAT_TA_63486.pep
ALNIPNTSADRRRPADAGEEVGASSALHDQSLQVGTVFKARRSRNRFSSPSIDKAAVNTHRWLNNAEIMVMEENMEDSGGIRHSHTD

SEQ ID NO: 169069 - protein, 119 aa, Triticum aestivum
  Clone ID: PAT_TA_63487.pep
DLEHPERPTKYGKYWCWCFWSVDVEVLDLLGAKEMAVRAWDEALNTQPERLIWNLMGMMNNCWFRVKINVCRPHKGEIGLVFDHPTQPGNQSGGWMARQKHIETSETTQGTLKRSTCTP

SEQ ID NO: 169070 - protein, 70 aa, Triticum aestivum
  Clone ID: PAT_TA_63488.pep
AISELARGADAPSVPPVWGREMLMARQPPQTCTYPDLEYREPAGGLEPDPMLTTPPGDKGCVPFFFGARE

SEQ ID NO: 169071 - protein, 106 aa, Triticum aestivum
  Clone ID: PAT_TA_63489.pep
CARWPVRSTSVNCESRNDEEEEIEGRCPRPGPQWRAGRTFVFPAEHRLAGAEKLTDPWSSKSRRPDALIFPFAPTDQQDRSLVLLSRGDPSASDRGPKRIGRGGCA

SEQ ID NO: 169072 - protein, 128 aa, Triticum aestivum
  Clone ID: PAT_TA_63490.pep
GRPHAQRLSTALFAPTTRSILGTGCQILFNKCIVRWHFREVRHQAAVHNHCQEFLATLFEDLTTIEEIFAQCVHHHIDTLLLRTHHLGGDVIQETFLNRIVLQFRNMGSRLRRENPRPNSRRKPPRYP

SEQ ID NO: 169073 - protein, 89 aa, Triticum aestivum
  Clone ID: PAT_TA_63491.pep
MAKGEREGRLPLLLLLLLVLCLLAQSRIAVVATHPQDAAALKSLMRKWSNVPASWRKKSNDPCGDKWDGIECNGANSRVTSLNLFGMNM

SEQ ID NO: 169074 - protein, 80 aa, Triticum aestivum
  Clone ID: PAT_TA_63492.pep
VVLRFSYAELDQATGKFSDEQLIGVGGTSKVYRGQLADGKVVAVKKLRPLGGADEDYEFLSEIELLSRLNHCHVVPLLGY

SEQ ID NO: 169075 - protein, 49 aa, Triticum aestivum
  Clone ID: PAT_TA_63493.pep
KETSEPYGSYGHENRKEISATYGSKDQGIRKEASGSYGLKGERDLKEIS

SEQ ID NO: 169076 - protein, 102 aa, Triticum aestivum
  Clone ID: PAT_TA_63494.pep
SPSSFFKVQTHIFCLYSPSSLPISSCVCVRPLATLMACLSSSPSGRRLSELLEERQEPFFLDLHLLEKGCSGWLLDGYDTALCWPAAAAGNDAASVLKRLTS

SEQ ID NO: 169077 - protein, 107 aa, Triticum aestivum
  Clone ID: PAT_TA_63495.pep
PRVRGRVGEKVQDLLLLDVTPLSLGLETAGGVMTVLITRNTTIPTKKEQVFSTYSDNQPGVLIQVFEGERTRTRDNNLLGKFELSGIPPAPRGVPQITVCFDIDANG

SEQ ID NO: 169078 - protein, 96 aa, Triticum aestivum
  Clone ID: PAT_TA_63496.pep
VRVLLLPCVSYCLLDCATTIFTEESEWPPLAYPIQVFSSRTWRWEERSLARRGEAAGTIADMDPYRDYEHRYAVYWKGAIYVHCQNDSILRITLTD

SEQ ID NO: 169079 - protein, 97 aa, Triticum aestivum
  Clone ID: PAT_TA_63497.pep
KPPRYKQPEYLISRLYQASVLNGDTAQANGQICFTRNTSSLVKPPKYKQSEDLKSRHSLTPQLPINCPAASKPLVHPITNENTLNTLVSSLPVLEHA

SEQ ID NO: 169080 - protein, 62 aa, Triticum aestivum
  Clone ID: PAT_TA_63498.pep
AHVHVAQRRRQHRPPPPGPSPRNADKGGRFRRPSARRGGGQGPHGAVDGERGRARHGRGRCA

SEQ ID NO: 169081 - protein, 54 aa, Triticum aestivum
  Clone ID: PAT_TA_63499.pep
LKGGLVISFMNMASLVNLDLSHNNLTGAIPDYQIKSLKVLDLSYNQLDGPIPDS

SEQ ID NO: 169082 - protein, 44 aa, Triticum aestivum
  Clone ID: PAT_TA_63500.pep
QIVNVPSKGWQIIKFPSINLHLWPPSPDHRSRRPTPRRRSRSPA

SEQ ID NO: 169083 - protein, 79 aa, Triticum aestivum
  Clone ID: PAT_TA_63501.pep
PTMELHMKLLLASLSCVLLIQGAFCDNTAGGTGATSRTCVCADHPLGESNSNSNLPCTCNCSCHWLPDENGGTRSWNCS

SEQ ID NO: 169084 - protein, 66 aa, Triticum aestivum
  Clone ID: PAT_TA_63502.pep
MSGVTVDEDKKPADDGGGAHINLKVKGQDGNEVFLRIKRSTQLKKLMNAYCDRQSVDLNSIAFLFD

SEQ ID NO: 169085 - protein, 150 aa, Triticum aestivum
  Clone ID: PAT_TA_63503.pep
CLSGSRAARQKERRKEEEQRRGGCPGPGTAAGFGAAGGGPRNPAGLRVNSEQSRHAIRRAGGANVASLQRAVGRSRIRVFLVQVPISLTSQRLASPVASNQVHPSIASVHLVGRHGRGGLLVGAADEVLPLRRPLQLRQGAVRRLRRAVQ

SEQ ID NO: 169086 - protein, 139 aa, Triticum aestivum
  unsure (1)..(139): unsure at all Xaa locations
  Clone ID: PAT_TA_63504.pep
FSRPVEKCLRDAKMDKSTIHDVALVGGSTRIPRVQQLLQDFFNGKELCKSINPDEAVAYGAAVQAAIXAVRGTRRNTTIPTKKEQVFSTYSDNQPGVLIQVFEGERTRTRDNNLLGKFELSGIPPAPRGVPQITVCFDI

SEQ ID NO: 169087 - protein, 91 aa, Triticum aestivum
  Clone ID: PAT_TA_63505.pep
MADPGDEQRAGLLAAAYLFPVPDGATFSYGTVGFRADGSTMAPAVCRAGIVAALRSVKLGGAAVGLVITASHNPVGDNGVKIVDADGGMMS

SEQ ID NO: 169088 - protein, 82 aa, Triticum aestivum
  Clone ID: PAT_TA_63506.pep
PPQRHVSQLPPRCRPPLDAGRAPQPRGGAPCSTSTSRGSSLDVGTRRACDGTVRLGRSGWAASEGRATRILLGRGGRERTHK

SEQ ID NO: 169089 - protein, 61 aa, Triticum aestivum
  Clone ID: PAT_TA_63507.pep
YHSTLDIAHREAPKGFLQLFSALNPMPCQLRCMQYAPRRNISPEWPPMERALSLDCLILRA

SEQ ID NO: 169090 - protein, 73 aa, Triticum aestivum
  Clone ID: PAT_TA_63508.pep
LTRGGRVGSMSCPHVSGIGELLRQARPEWNPAMIKYGLMTTAYNMDSAGGVIRDMCTGQVITLFARGARHVHP

SEQ ID NO: 169091 - protein, 80 aa, Triticum aestivum
  Clone ID: PAT_TA_63509.pep
FFSDYFEFSFPPGVIVQPYVERVVLVYHNLGELSEKYYPLPGYTYLSPILGLLVYDAANLSAVGLSELSIVASGSPISVS

SEQ ID NO: 169092 - protein, 56 aa, Triticum aestivum
  Clone ID: PAT_TA_63510.pep
KGALIHNLTADQQQTIEINQESEQGSIPWEAVEEEEINQELSREDLDHGQALAVSP

SEQ ID NO: 169093 - protein, 86 aa, Triticum aestivum
  Clone ID: PAT_TA_63511.pep
MPRSSKKKQRSAWGSLLGSCLGGGGWKTGKQVRPGPGPRKRESSSAAVGAGVGQRLSFTDVMSMSAASEQELSVSLVGSNLHVFTV

SEQ ID NO: 169094 - protein, 103 aa, Triticum aestivum
  Clone ID: PAT_TA_63512.pep
IVFQPGAMPKAEHVDVTAHWAVVKEEASGNNGADWFDPGIGMGNLPSLRKVKVRVDSHKMTVGEAKQAKAALENALRAHPNRPLFCVEFRWSIKEGAHDDDLC

SEQ ID NO: 169095 - protein, 108 aa, Triticum aestivum
  Clone ID: PAT_TA_63513.pep
YGIRVAIKRAQSGSMQGAPEFKNEIELLSRVHHRNLVSLIGFCFQQGEQMLVYEFVAGGTLRENLVVRGTYLGWKKRLRIALGSARGLAYLHELADPPIIHRDIKSTN

SEQ ID NO: 169096 - protein, 94 aa, Triticum aestivum
  unsure (1)..(94): unsure at all Xaa locations
  Clone ID: PAT_TA_63514.pep
AAGLVLREVDIADLWPQLLWWKSEALPVISGLCHNLAALRLRQAWLSVDGLSIMPNVTHLALXSIRLHIENLSTLNECFPCNHTLNLIEVGVLV

SEQ ID NO: 169097 - protein, 90 aa, Triticum aestivum
  Clone ID: PAT_TA_63515.pep
MGRRRSPALPLLLIFGVLAVVLAALPSSTPAQHHQQQHHQQQQLDREQYHHPPSQEQQQPPHQQHLQIQVHQQQEDGGGGGGKGAAAAAA

SEQ ID NO: 169098 - protein, 123 aa, Triticum aestivum
  Clone ID: PAT_TA_63516.pep
CRWLQEGPPRRDQLLLRAPAAHLHPTAKLCRAPSLELQISQPKTPQHPPLRGACPTSASARSRRRRPPTGFAHRRAPTAARGGEGEGAAVAAFRVPPEPPLRGDAGAKGRKGRSIQLVRAEVP

SEQ ID NO: 169099 - protein, 130 aa, Triticum aestivum
  Clone ID: PAT_TA_63517.pep
CGREGLVDTAVKTAETGYMSRRLMKGLEDLSVFYDQTVRNASGGIVQFVYGDDGMDPVKMEGKGGNPLNLDQLFMKVMATCPQRGHETLSPEGISQMLNDKLSEQDPSAGGCSDRFKELLTKFVGNRIKM

SEQ ID NO: 169100 - protein, 80 aa, Triticum aestivum
  Clone ID: PAT_TA_63518.pep
MARDGASAERRRVALRVLLARGEGSSSSSPPPRGPEEEARRGKQQWLALRLRDLGCASAAASRAHAPVAASASVRPAPDA

SEQ ID NO: 169101 - protein, 133 aa, Triticum aestivum
  Clone ID: PAT_TA_63519.pep
PTRPPTRPRTRGGLHYLHEECHIVHLDLKPQNILMDATMVPKIADFGLSRIFGEKQSQIITQNCQGTRGYMAPEYIIQGIVSIKADIYSLGVIIIEILTGSRSYPLREDNSRECTDKSIQQFKEQILETWGKR

SEQ ID NO: 169102 - protein, 113 aa, Triticum aestivum
  Clone ID: PAT_TA_63520.pep
PPGPTSPDLTPGRRSPLDHPPACARAPTTPPAQKGPKSQGLERCPPIPHGRSGSTRRRGGPPRQAEDQAAAGVDVSKAASAGPGQRSPGAAPARRGAGAAPGARVEPKLVIER

SEQ ID NO: 169103 - protein, 96 aa, Triticum aestivum
  Clone ID: PAT_TA_63521.pep
LVKIGLIKPNKIRSFMKLCGGRAGRQGWYLQGEDIQVHLSHYTILEETTEFMHLEKKGPRGALLGEIQQVPPHGAGRWRWMIITPEGEWGWAWQPA

SEQ ID NO: 169104 - protein, 74 aa, Triticum aestivum
  unsure (1)..(74): unsure at all Xaa locations
  Clone ID: PAT_TA_63522.pep
LHENLVKLVGYCSDSDSNXLLVYEYMPQGSLENHLFRRGSQPPLPLSTRVSVAVDVARGLAFLHSRDVIFRDLK

SEQ ID NO: 169105 - protein, 133 aa, Triticum aestivum
  Clone ID: PAT_TA_63523.pep
ERRHESFNKLRIFQVLSVAFLAGLLWWRTPAAHLQDRTALIFFFSVFWGFFPLYNAVFVFPLERPMLLKERSSGMYRLSSYFAARTAADLPMELGLPTAFVLILYWMGGLDPRPASFLLSLLVVLYSVLVAQS

SEQ ID NO: 169106 - protein, 114 aa, Triticum aestivum
  Clone ID: PAT_TA_63524.pep
FSSPWPPPPPPPRGRAPPPPPRGLACSPTAASPPQPRPDRCPTWQARGSRPSAATSPSPPPPPAPAAGRGTVSRCSPSRPSTTCWPSWSGSGRRNARIGARPGPAAAARGRGTR

SEQ ID NO: 169107 - protein, 68 aa, Triticum aestivum
  Clone ID: PAT_TA_63525.pep
FLSYAAPFHHLPLVFSRVVFSQHKSCSFVISNFAPCKGLYLVCFLRKKVLVTLPLLTFPKLPNLELNI

SEQ ID NO: 169108 - protein, 99 aa, Triticum aestivum
  Clone ID: PAT_TA_63526.pep
TEDQLTGLKAHSSWVESLAMDPSRSFVLAASADCLIKLWDWENDWTSVRTFSEHSDNVQQVMLHQQETNTFGSVSKDCTAKDSSITSGDSLATLSSKSQ

SEQ ID NO: 169109 - protein, 61 aa, Triticum aestivum
  unsure (1)..(61): unsure at all Xaa locations
  Clone ID: PAT_TA_63527.pep
MSEEKHHHLFHHMEGEDFQPAADGGVDTYGYSTETAVTATDNDXHDERITKEEKHHKHKEH

SEQ ID NO: 169110 - protein, 82 aa, Triticum aestivum
  Clone ID: PAT_TA_63528.pep
PRVRGKELCKSINPDEAVAYGAAVQAAILTGEGNEKVQDLLLLDVTPLSQGLETAGGVMTVLIPRNTTIPTKKEQVFSTYSD

SEQ ID NO: 169111 - protein, 130 aa, Triticum aestivum
  Clone ID: PAT_TA_63529.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIIFAPSKDA

SEQ ID NO: 169112 - protein, 70 aa, Triticum aestivum
  Clone ID: PAT_TA_63530.pep
LSNYGPFELRAKPRGVLNVVIYLSTWTFVCRGLSAIKQHMTILFWPSDVCMFELFVFVVVHEAGFIVMAL

SEQ ID NO: 169113 - protein, 68 aa, Triticum aestivum
  Clone ID: PAT_TA_63531.pep
KNKVGQVQNRDIVQMTNSELTARECVLGVCKIYVTIEASMAFVRNGVTIKATVVLAQIGFQINRVTER

SEQ ID NO: 169114 - protein, 116 aa, Triticum aestivum
  Clone ID: PAT_TA_63532.pep
LQVWDSSSDGDISSGIHFISSAILEASARRSQRPQAGGLPERRLRQRQEQRQRLRRQPRRPAQVPPPPGRPSRLSRLALLPGQWLAVAPSSGWTSTTRRRRHTAPAFRTTTTCRRT

SEQ ID NO: 169115 - protein, 66 aa, Triticum aestivum
  Clone ID: PAT_TA_63533.pep
MKTTGGGSGQPAMSGLVFFLFLFSLFTAAASTTKQSQVYIVYLGEHAGAKSKGTILDDHHALLSVK

SEQ ID NO: 169116 - protein, 66 aa, Triticum aestivum
  Clone ID: PAT_TA_63534.pep
AAQLLREPFERFLADNRPDAVVSDSFWHWSADAVAEHGVPRLAFLGTSMLARSCTESMLRNNPLET

SEQ ID NO: 169117 - protein, 129 aa, Triticum aestivum
  Clone ID: PAT_TA_63535.pep
SLKPPPASPSSSRSSSTFSSSSSSMASGHQEDRSSVACLPLLRMLEEGKGAGGDHDHPAPPVKEEIMGSGAAEVLGPGVDLNIGLPVGGSCDDDIMEEESQEEDDDHDCDEEEEEEMDELEPNHGGCKV

SEQ ID NO: 169118 - protein, 63 aa, Triticum aestivum
  Clone ID: PAT_TA_63536.pep
MDTAEAAWGVASLRLGSRRLGSRSSYRERGADVFSRAFSAAGAGSEDDEEALMWAALERLPTH

SEQ ID NO: 169119 - protein, 93 aa, Triticum aestivum
  Clone ID: PAT_TA_63537.pep
MAPTKGEGPAIGIDLGTTYSCVGVWQHDRVEIIANDQGNRTTPSYVAFTDSERLIGDAAKNQVAMNPINTVFDAKRLIGRRFADASVQSDIKM

SEQ ID NO: 169120 - protein, 105 aa, Triticum aestivum
  Clone ID: PAT_TA_63538.pep
PSYQLQLFAVAEAPLAPFPAFSVMASHLRLRSSTSSSEMWFPEFLPSTTRSPSGQRLPLSKALPASSSAEAISAAGSHLRRRRRLSPNFASKPYLLPLQSIENHD

SEQ ID NO: 169121 - protein, 79 aa, Triticum aestivum
  Clone ID: PAT_TA_63539.pep
TMYTTLMHQGIEKERVSPAPASAPSPALRNTHKEFDILRGENDQLRECLYAITACLERQSKTIKHLVDGGDLHTARDEY

SEQ ID NO: 169122 - protein, 56 aa, Triticum aestivum
  Clone ID: PAT_TA_63540.pep
MAVGFRRALDALTSPKSALLECARPKKLSSYARVRSISLPVRLHPLVAALHDSARA

SEQ ID NO: 169123 - protein, 104 aa, Triticum aestivum
  Clone ID: PAT_TA_63541.pep
RVGGRVGEGGTFALYSLLCRHAKMSLLPNQQAADEELSTYYQPGVDRTAMSSPFKRFLEKHKKLRTCLLLFVLLGACMVIGDGVLTPTISVLAALSGLQDRGTG

SEQ ID NO: 169124 - protein, 53 aa, Triticum aestivum
  Clone ID: PAT_TA_63542.pep
MDRVQFVLLGLPILLFCSDVVTLFAPYPSAGPKSHRHPQPVCGAFQPGDSYRY

SEQ ID NO: 169125 - protein, 132 aa, Triticum aestivum
  Clone ID: PAT_TA_63543.pep
AYASAHASAHASARSGHTVTRAGPVLILFGGEDTKGKKLHDLHMFDLKSLTWLPLNYKGAGPSPRSNHVAALYDDRILLIFGGESKSKTLNDVHALDFETMLWSRMRTHGHHPSPRAGCCGALCGTKWYIAG

SEQ ID NO: 169126 - protein, 109 aa, Triticum aestivum
  Clone ID: PAT_TA_63544.pep
ASPLPQKRPRRRLNPPCSARDSARPAMPASPVYFARGDLVPIWPPRGRARSGGPTGGGARSGRRRPARPRCCTDASFLRRPGPRRLSSSQPPAMRRPLLLGRLSPPLEK

SEQ ID NO: 169127 - protein, 138 aa, Triticum aestivum
  Clone ID: PAT_TA_63545.pep
MLSFTLAITIVGVPVGLPAVVTTTMAVGAAYLAKKKAIVQKLSAIESLAGVEILCSDKTGTLTKNKLSLAEPYCVAGVDPEDLMLTACLAASRKKKGIDAIDKAFLKSLRFYPRAKSVLSKYAVKEFFPFDPVSKKVT

SEQ ID NO: 169128 - protein, 54 aa, Triticum aestivum
  Clone ID: PAT_TA_63546.pep
FVGSFCVWIIYVVRLHFELDAVYVTVLQIEAYKLLPPLLFTPLLVLTLVQLYKD

SEQ ID NO: 169129 - protein, 52 aa, Triticum aestivum
  Clone ID: PAT_TA_63547.pep
HHNGTRGSHVSKINRTKPEESNSNVGVYLYEIHCERGTELNGFVRTRGGRVG

SEQ ID NO: 169130 - protein, 92 aa, Triticum aestivum
  Clone ID: PAT_TA_63548.pep
MAPSGDNTVANVHSGIDSTNKTLLKSDALYTYILDTTVFPREHECMRDLRLITDKHPWGYMQSSSDEAQLLGMLIKMAGAKKTIEVGVFTGY

SEQ ID NO: 169131 - protein, 64 aa, Triticum aestivum
  Clone ID: PAT_TA_63549.pep
ILQTSNPSMMICVLPMYTCKLTASGHLRTQMASLLGYFGQVAVHSFHDKAGNTDHLTPFRRTRR

SEQ ID NO: 169132 - protein, 35 aa, Triticum aestivum
  Clone ID: PAT_TA_63550.pep
GTAPPRRPQAPLRAPLSGSTLCSPWREAVTWGWCC

SEQ ID NO: 169133 - protein, 113 aa, Triticum aestivum
  Clone ID: PAT_TA_63551.pep
RVALHTKLIGHLSTTKMKIGKAPELLKKAVAMCKSKTTRLLILASLQRRRMSMGVVVSRKIGALIVADWERADRHKALALQTVEKRPVIIQESDLEANFSRHLAMFGQENGHG

SEQ ID NO: 169134 - protein, 92 aa, Triticum aestivum
  Clone ID: PAT_TA_63552.pep
HIKISPRKSGNRSSSSSSTIVLSLVAVALLSLSGFQLSGRARSLAEGVPRAINGGGGRAARGLLGEAGRRVEERPVDNPGGQAAPRPCRPAR

SEQ ID NO: 169135 - protein, 65 aa, Triticum aestivum
  Clone ID: PAT_TA_63553.pep
RVHARKVIVSGDDAARGLVQLVDDHGVAELVMGATADRGYTRKLRTPKSKKAVTAHRKANPCCRI

SEQ ID NO: 169136 - protein, 59 aa, Triticum aestivum
  Clone ID: PAT_TA_63554.pep
VSAAPHGGVQGGGPALGRRQRGAVPPGDHDHARPGGRRRPVKLSRGRLLAGPRHAEPSR

SEQ ID NO: 169137 - protein, 76 aa, Triticum aestivum
  Clone ID: PAT_TA_63555.pep
KGLIVSDVPYAETCPFRNEAIKNNLELVLLTTPATPAERMKKITSASEGFVYLVSVNGVTGPRPNVNPRVKDLLKE

SEQ ID NO: 169138 - protein, 83 aa, Triticum aestivum
  Clone ID: PAT_TA_63556.pep
FPCVRYNIHVNCSSLADPPTDYYLVSESTQLGIIMPACHSVNGPLEDYISHIVEWLSRPHVLAIIIAWAVTFTADCSLILCLG

SEQ ID NO: 169139 - protein, 44 aa, Triticum aestivum
  Clone ID: PAT_TA_63557.pep
SPSSKQTLIAQTESESAELARGASLAAVVVGSPSSCCLSCGARR

SEQ ID NO: 169140 - protein, 72 aa, Triticum aestivum
  Clone ID: PAT_TA_63558.pep
SHASVQPHAYVETAAGRKPLVGVHGALGHKVLRWFMDDHKCDTVKIISMVGPVGVGKTAIAMEVYRRLQSRG

SEQ ID NO: 169141 - protein, 64 aa, Triticum aestivum
  Clone ID: PAT_TA_63559.pep
VEQEQEEPGQQEQDRDERHVPFSAFQQRDSRLPQPGHATGLHPGHRGGDFAGQGLHDDMLLHAA

SEQ ID NO: 169142 - protein, 118 aa, Triticum aestivum
  Clone ID: PAT_TA_63560.pep
MSNLRCVTLFRTDDNLIRSSFKPPTAACVGLYQVVIFGKVATKSDLRCMEKLLHLRYLGLLDTRVDALPIEIGKLQSLQTLDFRTSKSLEAPSSVVRLGKLMCLYVNENMRLPVVIDN

SEQ ID NO: 169143 - protein, 38 aa, Triticum aestivum
  Clone ID: PAT_TA_63561.pep
MAPLHFLVVAFPGQGHINPARALAERLARATPGARVTL

SEQ ID NO: 169144 - protein, 75 aa, Triticum aestivum
  Clone ID: PAT_TA_63562.pep
WIAFVASLVAIILVQTDILVRHHVLEAAMILDLFGLIGAYAAGSCRDVNTSIYAIALAGAVLVYVVIHIVFFTLD

SEQ ID NO: 169145 - protein, 74 aa, Triticum aestivum
  Clone ID: PAT_TA_63563.pep
MDLLRKRMEPEEKCLRDAKMDKSTIHDVVLAGGPTRIPIVHQLLQDFFNGKELCKSINPDEAVAYGAAAQAAIL

SEQ ID NO: 169146 - protein, 62 aa, Triticum aestivum
  Clone ID: PAT_TA_63564.pep
SLTRGPSTNCEWIDGSRVNSEVEPKLRSLLLEMGSDKILGLQVCAYKDGKVIIDTAAGTLGK

SEQ ID NO: 169147 - protein, 59 aa, Triticum aestivum
  Clone ID: PAT_TA_63565.pep
MAVTVEITQRTVLEPSRDSARGGGKKVPLTVFDRASTDGYIPAVFAWNAPAPTNDALKA

SEQ ID NO: 169148 - protein, 28 aa, Triticum aestivum
  Clone ID: PAT_TA_63566.pep
FVTAKQYCLVHKMLFSMLSKNSTHVELF

SEQ ID NO: 169149 - protein, 101 aa, Triticum aestivum
  Clone ID: PAT_TA_63567.pep
SFDQKKMETSRRGGFADEALAPTESDIDETFQRMVGGLGKTPQEVFDALRAQTTDLVFTVHPTQSIRRSLLEKHASIRTCLTQLCVEGVSENEKQEIDEAL

SEQ ID NO: 169150 - protein, 95 aa, Triticum aestivum
  Clone ID: PAT_TA_63568.pep
AHASAHASGQLSEKIGNLKSLSFLSLVNNNLTNITSTLPILARSKSLTTLLIGLNFMNETMPDDDIIVSFENLQVLAITDCSLLGKVPHWLSKLT

SEQ ID NO: 169151 - protein, 135 aa, Triticum aestivum
  Clone ID: PAT_TA_63569.pep
IDFSHKNKLGPIESLKNYPRQNGPKLTMQNMHEAKGANTEISTHGNNEAPGVGTVSSSLQNAVAQNNYQSMLRSSSANQGLLQQEASQNAAALNNYQSMLRSSSANQGLLQQEASQNAAALNNYQNMLRSSSANQ

SEQ ID NO: 169152 - protein, 50 aa, Triticum aestivum
  Clone ID: PAT_TA_63570.pep
CCHPNSPQMRAPLTCQTAAEPGRHGHRLDRRPLGLRCRPGRLDRGACPPA

SEQ ID NO: 169153 - protein, 60 aa, Triticum aestivum
  Clone ID: PAT_TA_63571.pep
ASMAMEAALVSVATGVLKPVIGKLTTLLGNEYKRFKTVRKELKSLTHELAAMEAFLLKMS

SEQ ID NO: 169154 - protein, 106 aa, Triticum aestivum
  Clone ID: PAT_TA_63572.pep
MGAYKFVSELWRRKQSDVMRFVQRVRCWEYRQQPAIVRITRPTRPDRARRLGFKAKQGYVVYRIRVRRGGRKRPVPKGIVYGKPKHQGITQLKFQRNKRSVAEERA

SEQ ID NO: 169155 - protein, 94 aa, Triticum aestivum
  Clone ID: PAT_TA_63573.pep
HFGQVSIPPSVKKAIEVILLVNRQHVTCTNTDRSLLELGQELGTQLVMIRSIMYTISPMTSRTIWLAGHLRHSSSRNKQQWWQPTGRGRGHSAE

SEQ ID NO: 169156 - protein, 109 aa, Triticum aestivum
  Clone ID: PAT_TA_63574.pep
SRVRFQIINCPNLTTLPESMKGLTSLTYLYIKKCQELAVLPQSLGQLITLQDISIINCPNLTTLPESMKGLTSLTELWIEECQGLAMLPECLGQMISLQKICIIDCPNL

SEQ ID NO: 169157 - protein, 86 aa, Triticum aestivum
  unsure (1)..(86): unsure at all Xaa locations
  Clone ID: PAT_TA_63575.pep
MNHVKSALLXGHRAHRLAAAAPQQLAATASFHSTPPLQRKRKTQWRHRFNLYAKRMRNRDTKXTMIRNMPEYAEQLFNSWRDEDEK

SEQ ID NO: 169158 - protein, 74 aa, Triticum aestivum
  Clone ID: PAT_TA_63576.pep
CPTEKQNWACPPPEDSSLYSLLHLSVQREAELVMVMIILYSYDACRLGVYLYFMLMSYDESFLWHYIQSVGKGH

SEQ ID NO: 169159 - protein, 102 aa, Triticum aestivum
  Clone ID: PAT_TA_63577.pep
GSRRARPARGPAAEGWWIWAPFQLGFRGGGGDWGKRVVVVWSDPRLGCCFAAACRCGGMGSFVDPGVGDLLEFAFRFNLEIKTTEAVRVSGALTTHHFRTRE

SEQ ID NO: 169160 - protein, 103 aa, Triticum aestivum
  Clone ID: PAT_TA_63578.pep
ALLNLALAQPAVARRPPSSPLHKPACRFYAAPPLYEHRFSPLLAASRRLVLTAPCAFPQPAALHPSMVVPSRPLPSCARSRPMSPSWALSTSSARQAHPSARG

SEQ ID NO: 169161 - protein, 104 aa, Triticum aestivum
  Clone ID: PAT_TA_63579.pep
LAPTSTSLQFVNHRMPSDDVPPWRHWRHALTTRDKDLLDTSSGPLFMLPRREELLGPTCFGLRSATENLLRPCCPTDLCRPAEVWWNENVHLNDSVVQVFFLAG

SEQ ID NO: 169162 - protein, 124 aa, Triticum aestivum
  Clone ID: PAT_TA_63580.pep
PLSSQNQIVLGLKKHLLLSTCPQHSKTSTPCSRARCNHWCRNRTSSTSNPPRAPPWCSTCRISTSSCGGHGAPALRALLQAWLLLQRTPSSPLHVPPPSWFSTRRSVGSWRGRGQRRDKGERAT

SEQ ID NO: 169163 - protein, 95 aa, Triticum aestivum
  Clone ID: PAT_TA_63581.pep
AMAAEICLQGDRTGGGCGRSKILIDGGGTPLITTTEWLSESRCGRSVLSGHQRSSAGPSLKHGEVTAPWRPNDRKIVVEELPAISSFLCEVSAET

SEQ ID NO: 169164 - protein, 77 aa, Triticum aestivum
  Clone ID: PAT_TA_63582.pep
DNTWKFTSGLSVLTIENKQHLKQICNFTMHMLISLYSEFNIYLLQIQKVLHVRVQYMYHLHKLVSYSDYMHLLGFIM

SEQ ID NO: 169165 - protein, 115 aa, Triticum aestivum
  Clone ID: PAT_TA_63583.pep
FEEDKNFHVVLNSVIAGRYHVTEYLGSAAFSKAIQAHDLHTGMDVCVKIIKNNKDFFDQSLDEIKLLKYVNKHDPADKYHLLRLYDYFYYREHLLIVCELLKANLYEFQKFNRES

SEQ ID NO: 169166 - protein, 92 aa, Triticum aestivum
  Clone ID: PAT_TA_63584.pep
SGVSRRRRPLHRRGRAAVLFFRTSSCPLACIFVDRARCLSTHVWAASTPVQLPASSSAPVGLRQAGQPRLSSASCRAEAHGPSGDDVCATRT

SEQ ID NO: 169167 - protein, 116 aa, Triticum aestivum
  Clone ID: PAT_TA_63585.pep
LISLLLLLPPIPIQGGTRREAGKGREEEITEPSARTGQQAPRSRAGAEMGLTFTKLFSRLFAKKEMRILMVGLDAAGKTTILYKLKLGEIVTTIPTIGFNVETVEYKNISFTVWDV

SEQ ID NO: 169168 - protein, 136 aa, Triticum aestivum
  Clone ID: PAT_TA_63586.pep
VCHRQRYDRRDATMLVKYPIMDLSITRDCFAICGGGGSLKSGIRNTVDIYELSDTDPSGFEKTITADTGLELASGVAFSHDGQLIAVSVNASCWIYALDREAKTLTLLVKFRSDFADIESSQTSVCFVGNSTLLTG

SEQ ID NO: 169169 - protein, 128 aa, Triticum aestivum
  Clone ID: PAT_TA_63587.pep
LRVRDSCSASPAGAAAAAAAPAAGAAAATDRYTFRPGLRWQPEVDEYFASAYGREHFARISQALAHPSCYSCIRVNTLKSSTDTVMQKLLKLVNENELSCGFNGLKIGEQNGGEQAHEGSYLVHKCPY

SEQ ID NO: 169170 - protein, 54 aa, Triticum aestivum
  unsure (1)..(54): unsure at all Xaa locations
  Clone ID: PAT_TA_63588.pep
IKTEXCSATQHMTTFLALTPSNPYQPAPVLTKSSRKNTVESSINNTYMTTRNAY

SEQ ID NO: 169171 - protein, 137 aa, Triticum aestivum
  Clone ID: PAT_TA_63589.pep
QSGCLLSVSGSHFLLLLLAAVIAPVHAYGKLKVGFYRQSCPDAEAIVRRIVTMAVEDDLTVTAPLLRLHFHDCFVRGCDGSVLLNSTKTNIAERDAKPNLTLDAFNVIDAIKEKLEKKCPGTVSCADILAVAARDAV

SEQ ID NO: 169172 - protein, 130 aa, Triticum aestivum
  Clone ID: PAT_TA_63590.pep
FVSSCSGSRSALSRVTSSTGPRRARRSSSRARPTSGAETNHSTACGTRPSGTTGRPASRKSSASASPYSRTGCRTFSFTWPSSSRSCWASCTISACGSPCVVVPSTSRILHRTSRRPSGQPSTFCSVTTL

SEQ ID NO: 169173 - protein, 125 aa, Triticum aestivum
  Clone ID: PAT_TA_63591.pep
FGGPRRGGDGGGKVAEGRRGRPRRCLATEMACAESSARRACKQEACFTVPAARRSDVGLERSSAELRRHVRHQQASVGGCDGSRRRHWGARKVIMFLLSSSLPRGTTGTQALSNYSTFSLCIDDS

SEQ ID NO: 169174 - protein, 34 aa, Triticum aestivum
  Clone ID: PAT_TA_63592.pep
MARERREIKRIESAAARQVTFSKRRRGLFKKAEE

SEQ ID NO: 169175 - protein, 133 aa, Triticum aestivum
  Clone ID: PAT_TA_63593.pep
LRVRRTILTSNKSIDSESHRSTILICISVVLAMPSSAREEDRNAPVVRNAAPPLVASEAKMIVAIGHDHCQQLKDVLSKEDPSTMVVVMASSNQTPKPPKPRSPVMDSRLLAVACSGSWKKLQSFLSGEDRQT

SEQ ID NO: 169176 - protein, 113 aa, Triticum aestivum
  Clone ID: PAT_TA_63594.pep
VWHNHFTVTHYTHSTNIRRLSQVISNVPTLQITVFTCNCICGMVLNAGPVLKMYIHSPFCAYIPHITLINSSGHRINPKVINNDSTLQITVFACHCDCDLVSNMILVLKYTSA

SEQ ID NO: 169177 - protein, 121 aa, Triticum aestivum
  Clone ID: PAT_TA_63595.pep
FIRPRTRGFLPSRQGRSRVTERYIEVERSQLQTGSSDSLDSRGHGGTCHSGCFSGVRAGGAGPGVRRPPRGLAPGGLAAGARWDPGARRGDPSLLRPRTRRAPRPRRRARGRARQQEAQVV

SEQ ID NO: 169178 - protein, 114 aa, Triticum aestivum
  Clone ID: PAT_TA_63596.pep
MQRYTTRDIWEMEDRQSPRMGCSVVLGVDGGASNTVCVCIPAVMPFADPLPVLARAVAGCSNQNSVGEDKARETLERVMAHALHKARRRRSNVSAVCLAVAGVNHPIDQHRMLD

SEQ ID NO: 169179 - protein, 58 aa, Triticum aestivum
  Clone ID: PAT_TA_63597.pep
MSTEVAAGDIPVPEVEVASDADGDTPAAKPGKAPKAAKAKKSTGPKKPRVTPAHPTYA

SEQ ID NO: 169180 - protein, 129 aa, Triticum aestivum
  Clone ID: PAT_TA_63598.pep
QTAKTIGASSVFLLCLLLPLRLPPPPPSSSQPHFNYRSTSTSSGFPWRRPPETLIPTPTPTSPSSSAGSSSLPQTLTTPQPCRPPLASSRAPRPARRWSPGRRAPTPTRPPPRPSTATSTSTTPPIPTP

SEQ ID NO: 169181 - protein, 121 aa, Triticum aestivum
  Clone ID: PAT_TA_63599.pep
MASTAAGLYGRLNRTSTRAFLAYVAAGGVCAAVLACFVVSSADPAAAPNGAPRLSSRSARVWPDLEFNWRLVVATVVGFLGSAFGTVGGVGGGGIFVPLLNLVLGFDTKSAAALSKCMIMG

SEQ ID NO: 169182 - protein, 92 aa, Triticum aestivum
  Clone ID: PAT_TA_63600.pep
WTRGFPLPSSPFASLLPSIPIASQPPHRRVSRASTVLRACLPGRASARAVAGLERGRGRGDRGREGGDAMARERREIKRIESAAARQVTFSK

SEQ ID NO: 169183 - protein, 93 aa, Triticum aestivum
  Clone ID: PAT_TA_63601.pep
PLGLLPHQSVKIIAFLCFASTPVESRARREGTGRSGEVRPPDLCRSVGLFACCTVTGTTRRRCEVEEEEERTDSVTLSQLPPRVRPRVRPRVN

SEQ ID NO: 169184 - protein, 35 aa, Triticum aestivum
  Clone ID: PAT_TA_63602.pep
SGLPMFRQDFTCPALLKDNECSTCTGLSPATAGHI

SEQ ID NO: 169185 - protein, 71 aa, Triticum aestivum
  unsure (1)..(71): unsure at all Xaa locations
  Clone ID: PAT_TA_63603.pep
SRHSFFTMNNVCSSTGAVLPXVGNQRIHATNSSTEINFQFDPRANHEPQVFLAPMPKRRRLLLLVVSESKS

SEQ ID NO: 169186 - protein, 86 aa, Triticum aestivum
  Clone ID: PAT_TA_63604.pep
MAETEDFASGDGEVWRAELGAYDRRIAVLDKPDLLDADYFYRHDLPLLLHGRDPDPYLAKPELVQFMQWKLYRGKRRPRLMDFVKS

SEQ ID NO: 169187 - protein, 73 aa, Triticum aestivum
  Clone ID: PAT_TA_63605.pep
SLAEGGGVEGCWALRGMVLGGWRAWMRWWVRSEWRRGFPRSDLDGGGSSGRLFAGGMGCGGLGLPAARGGCYA

SEQ ID NO: 169188 - protein, 93 aa, Triticum aestivum
  unsure (1)..(93): unsure at all Xaa locations
  Clone ID: PAT_TA_63606.pep
AARTKXGMVGFEEHVDAWTPFLPEEKETLSSTGSKREHERGINTAMDDLLSRGSPLLQVPSQGLHIQYPLPTHTRCASICLKATMEAEKSLQE

SEQ ID NO: 169189 - protein, 110 aa, Triticum aestivum
  Clone ID: PAT_TA_63607.pep
LIFGGEGASSENQSAEVTNKILKKCGGVPLAIITIASLLVGKRCEDWSKVYDAIGFGHEDNKVAHNTRKILSFSYYDLPSHLKTCLLYLSMSPEDSLIGKRTLIWRWVCE

SEQ ID NO: 169190 - protein, 78 aa, Triticum aestivum
  Clone ID: PAT_TA_63608.pep
FLPRVRPRVRKKEDCEGSENDKAKKGKDKKSESKEKDKNSAKETGPDADDSCPKNKKKDKDKAKKKDESDEKQEKDKD

SEQ ID NO: 169191 - protein, 41 aa, Triticum aestivum
  Clone ID: PAT_TA_63609.pep
RQADNYTNHISFVPATIGVRYSDLIHPYLDKSKTRILGRRE

SEQ ID NO: 169192 - protein, 71 aa, Triticum aestivum
  Clone ID: PAT_TA_63610.pep
FLPCPNPSPSSGQAPRLAHPRLALSHRMAAAPAAIAGPSGDSERDLSASAVSVEAFGAVESSGDGSGRKEP

SEQ ID NO: 169193 - protein, 54 aa, Triticum aestivum
  Clone ID: PAT_TA_63611.pep
GLAYRYVGDVLGDAQVYADHADKPQLDADDVRLAIQANANFFFFQPPTRKVLLE

SEQ ID NO: 169194 - protein, 129 aa, Triticum aestivum
  Clone ID: PAT_TA_63612.pep
MPSSVSNADASTSGTDAPFYQLRKDATKLVAYTFERGRRNLWQLATSRLSVLLACSAVSSTSIYQFLKNYEDLTIFILAGEAFCGFEASEFRQKLKTVCLNYIVTFHRQNIYALKMVLEKESWTIMSAE

SEQ ID NO: 169195 - protein, 59 aa, Triticum aestivum
  Clone ID: PAT_TA_63613.pep
YLFGNGGHEHGLAAVATRAVMLVRVNTLLQGYSGIRFEILETVVALFNANVTPCLSLRG

SEQ ID NO: 169196 - protein, 85 aa, Triticum aestivum
  Clone ID: PAT_TA_63614.pep
MAMAPSKVVVLMAFMAAALSSVSMAAGLQHGFYYSSCPQAEDTERNVVQGMINNDPTMGAAFVRLFFHDCFVRGCDASILLDPTT

SEQ ID NO: 169197 - protein, 102 aa, Triticum aestivum
  Clone ID: PAT_TA_63615.pep
SQFKPEFYERTDSIIARYKQGQVCMPVFVEHLKDEVIGLKKVEAQKTRVFSGSPADFAVVMRKYLLTTVRVIQNNRYVFECAPGTNATSLEWCEIYHYLIQH

SEQ ID NO: 169198 - protein, 69 aa, Triticum aestivum
  Clone ID: PAT_TA_63616.pep
TPRPARCRATTSSASAGPSPPPRPSASRRPGPSGGAGTPSSPLPWPPASSSARGAAGDLDGGEDRGGLT

SEQ ID NO: 169199 - protein, 82 aa, Triticum aestivum
  Clone ID: PAT_TA_63617.pep
VFSERLQRLATPSAPAEDDVDVDADGDSTTYRDIHPSPAPAPLRQPSWDVASQRSLSFYCDEQFMSSSMGREFMAMVDAGGA

SEQ ID NO: 169200 - protein, 38 aa, Triticum aestivum
  Clone ID: PAT_TA_63618.pep
CCKPVHPASTTFTCCTKQASKQLGANQPGRRGEHGMLP

SEQ ID NO: 169201 - protein, 74 aa, Triticum aestivum
  Clone ID: PAT_TA_63619.pep
KSTDFIDLRIRFPSCLKCLLSRRNIAQGNKSSTSDTKLHVFAISMIRYNSNLIKKYRSGSIHAQRKKQSQTSCY

SEQ ID NO: 169202 - protein, 135 aa, Triticum aestivum
  Clone ID: PAT_TA_63620.pep
MLDKCSLGYLGWICDTSLMAPSGMPLLPRDTNHDCPPELKHLSKEIVNKCKGLPLVIVLVGSLLRVREKTVEEWRKINDQLGWELINNSRFDHIRNVLHLSFMYLPTHLKSCFLYCSLFPEDYIFKRKELVRLWI

SEQ ID NO: 169203 - protein, 71 aa, Triticum aestivum
  Clone ID: PAT_TA_63621.pep
VIEREPICLRSDSVPCLSPSLPLSLTHRRCRQGRDGDIGCEGSSRKRWRCARPVPWSTGRGTPVTRKGIQI

SEQ ID NO: 169204 - protein, 113 aa, Triticum aestivum
  unsure (1)..(113): unsure at all Xaa locations
  Clone ID: PAT_TA_63622.pep
AVANAIPTYVMSVFKLHXSVCDELTKMVRRYWWGVEKGKHKTHWIAWEKLILPKNQGGLGFRDMGLFNQALLSRQAWRLIERPDSLCTRLMKEKYYRRGNLIDTVFTGNSSAV

SEQ ID NO: 169205 - protein, 72 aa, Triticum aestivum
  Clone ID: PAT_TA_63623.pep
LRVRGRVGSSASSHLATKRRRRGAPAPSRPPRPSDLCRIREYMLLLFETPSGFAVFLFCGSLINPPRSLEDI

SEQ ID NO: 169206 - protein, 74 aa, Triticum aestivum
  Clone ID: PAT_TA_63624.pep
TRSRDFISNGVDGIWNDMNEPAMTTTTKTMPESNIHRGDADIGGVQNHSYYHNVYGMLMARSTYEGMVMSNTEK

SEQ ID NO: 169207 - protein, 97 aa, Triticum aestivum
  Clone ID: PAT_TA_63625.pep
SEMEQYEKLPKGDMVLEALYNNCLQLVDTSLSHLATEPSVDKAHETHSVPFSLYALSRMGFNLLKRKNETEKEISSCAVCVGATKSVEAAVQESFLY

SEQ ID NO: 169208 - protein, 55 aa, Triticum aestivum
  Clone ID: PAT_TA_63626.pep
PAAPPPLLAPAEDDVSVPRTVEPAELTADGASSDAAPRTKSASPRKFGCFASAKE

SEQ ID NO: 169209 - protein, 58 aa, Triticum aestivum
  Clone ID: PAT_TA_63627.pep
MDVAVAKQLRRIRTLGRGASGAVVWLASDEASGELLAVKSAGAGGAAQLEREGSVLTG

SEQ ID NO: 169210 - protein, 35 aa, Triticum aestivum
  Clone ID: PAT_TA_63628.pep
TSPSPRTPAAQTKGPSTEGILPQQPMPPGKRTRER

SEQ ID NO: 169211 - protein, 80 aa, Triticum aestivum
  Clone ID: PAT_TA_63629.pep
FNIQKSVQLQPWKYNNTTNLHVFLFFYFLGINFHSSILFMAFHFFTLDRNNTAAHNPPCTRHQAHSIVGGIKICRMHAWS

SEQ ID NO: 169212 - protein, 94 aa, Triticum aestivum
  unsure (1)..(94): unsure at all Xaa locations
  Clone ID: PAT_TA_63630.pep
VGVFASVSADGSVRVFDLRDKEHSTIVYESPRPDTPLLRLAWNRYDLRYMAALLMDSNAVVVLDIRAPGVPVAELHRXGGCVNAVAWAPQAARH

SEQ ID NO: 169213 - protein, 90 aa, Triticum aestivum
  Clone ID: PAT_TA_63631.pep
AGFTPSVPEYKVYWFPCKSNLHLFDFSKNKYTLYKGTEGVLFINERIYLAVPSDILSADDRRKSAARTVFVFWPMKAMSLKEGSLKWFFH

SEQ ID NO: 169214 - protein, 67 aa, Triticum aestivum
  Clone ID: PAT_TA_63632.pep
HPHPASEGGCRRAQPHTTARPRVVALQKTVAALRRSRRRRRIPWRRNPRLGVMGFGLWKVLVFPPRD

SEQ ID NO: 169215 - protein, 53 aa, Triticum aestivum
  Clone ID: PAT_TA_63633.pep
LPRVRPRFQHFFQEGEMRFVHRQLVCTWQWSGDVWFSFLCLNLGTLVFKINSP

SEQ ID NO: 169216 - protein, 67 aa, Triticum aestivum
  Clone ID: PAT_TA_63634.pep
SLSCAISMGSNRPPPRLEMKLATRRIDQASEPRIGTLARVEDTSADFGLVWFARHLGSAAVRGRKEQ

SEQ ID NO: 169217 - protein, 95 aa, Triticum aestivum
  Clone ID: PAT_TA_63635.pep
CSSLGTLPNLVYLDLGVNRLEAGGWSFLTSLTNCTQLVELFLDANILQGDLPSSIAGLSKSLEVLLLTANKISGTIPQEIEQLTNIKRLYMEKNL

SEQ ID NO: 169218 - protein, 124 aa, Triticum aestivum
  Clone ID: PAT_TA_63636.pep
MAPTKGEGPAIGIDLGTTYSCVGVWQHDRVEIIANDQGNRTTPSYVAFTDSERLIGDAAKNQVAMNPINTVFDAKRLIGRRFADAPVQSDIKMWPYKVIPGPADKPMIVVQYKGEDKQFSAEEI

SEQ ID NO: 169219 - protein, 137 aa, Triticum aestivum
  Clone ID: PAT_TA_63637.pep
MSFDDFEVEVPIVPQSSYKGAKKDIIKKYRVNAIRSNLDSEVNEGKGPVSSVLSNISSIASSLYSIPMLAPVAGPTAWMTNLASGVASAFGWCKPVLDSQVIRVYQQPHAYNANINESDVTNSLGLFVTIRFALCLM

SEQ ID NO: 169220 - protein, 136 aa, Triticum aestivum
  unsure (1)..(136): unsure at all Xaa locations
  Clone ID: PAT_TA_63638.pep
RKNPDAHPTPSFPNLPTTTSLLSPEPLPPXAPPPLPEAPPTSAPSPPGAPSHQCVTAAPKPLRPTRRHRPDPPTTNAPPXPDPPPTSTPPPAPSPSHQRVAAAPIPLPPVHHGRPKPPSMTISPAPSAAPPSCMPP

SEQ ID NO: 169221 - protein, 83 aa, Triticum aestivum
  Clone ID: PAT_TA_63639.pep
TARSSMNPFAANTAKTFFDLIKSERDLYSLEPDREPSQSQLRLFERICVLLNGEHTSKSRSTRTRHEKEQSRIQRMYEKLPSD

SEQ ID NO: 169222 - protein, 117 aa, Triticum aestivum
  unsure (1)..(117): unsure at all Xaa locations
  Clone ID: PAT_TA_63640.pep
MVYIKNQKTRAYSKRFQVKFKRRRQGKTDYRARLRLTNQDKNKYNTPKYRFVVRFTNKDVTAQIVYATIAGDIVMAAAYSHELPCYGLEVGLTNYAXAYCTGLLLARRVLKNRDLDE

SEQ ID NO: 169223 - protein, 92 aa, Triticum aestivum
  Clone ID: PAT_TA_63641.pep
LSLGYCDEREEGVLVFEYAPNGDLHERLHRSGQKRAALPWARRMAAAFQVAMALEYLHESQDPAVIHGDVKASNVLLDANMDVKLCDFGFAH

SEQ ID NO: 169224 - protein, 41 aa, Triticum aestivum
  Clone ID: PAT_TA_63642.pep
MASSAPGGGSGKIERLSSIDAQLRLLVPAKVSEDDKLIEYD

SEQ ID NO: 169225 - protein, 81 aa, Triticum aestivum
  Clone ID: PAT_TA_63643.pep
VAHASAHASGDALFAKKCDGLPLALGVLGGYLSKNLNAQIWSDILFDWPATKDGQMMSVILARSYKDLPNHHLRSCLLYFA

SEQ ID NO: 169226 - protein, 100 aa, Triticum aestivum
  Clone ID: PAT_TA_63644.pep
FVSNLTYTMDDRTKLSERFHTVSDSVGMKSEVKVVPVREQATFLRKRFVPGAFGTLPVPSFGRVLSKLPVRANFNASVTDDDYMAGKLLSAAYEHRHIAS

SEQ ID NO: 169227 - protein, 67 aa, Triticum aestivum
  Clone ID: PAT_TA_63645.pep
VIGVQEQTSCWTSCEQLDECKDWLGSRGHCFAKCYFCQSCSSMGWPGNIPWRTQTFNLWLAYGFCWP

SEQ ID NO: 169228 - protein, 103 aa, Triticum aestivum
  Clone ID: PAT_TA_63646.pep
SVVAEPKEELIWCVPLVGGDARSPTVLLKFLRAREFKVKEAMAMLKAAVLWRKSFGIDALLGADLGVPELENVVFYRGADREGHPVCYNVYSEFQDKDLYEKA

SEQ ID NO: 169229 - protein, 60 aa, Triticum aestivum
  Clone ID: PAT_TA_63647.pep
APDVVRSIDAVMTPAAQMNRDESSDPIAREDAVVWSRIIYSWVVSKVFSGTIIFWWEQRR

SEQ ID NO: 169230 - protein, 121 aa, Triticum aestivum
  Clone ID: PAT_TA_63648.pep
DSREHGGPLLVRERPLGRRADLFPGVPAQRFPFIGGHSGGAPQAGQRGGKVPQPQPAGGRRVPQPRVLCLERAEVRLREAALQVRVGHNDQPVESHRVPCSAAAAAAPRPRAVLGGMRKSN

SEQ ID NO: 169231 - protein, 124 aa, Triticum aestivum
  unsure (1)..(124): unsure at all Xaa locations
  Clone ID: PAT_TA_63649.pep
GYLAGKITVFDRRGHVAKLCAVILPLLVAALIAISRVDDYWHHWQDVFAGGILGQKLAPILCYLXTLFFFTIPVFAGNLQTLFVADEVCHVREGMVVASVCYLQFFPPPSDDKGFWPHAHFRDI

SEQ ID NO: 169232 - protein, 80 aa, Triticum aestivum
  Clone ID: PAT_TA_63650.pep
LLHLLETALHLVELVQLGGVVAPGAHVDVLAVDGDLLAVHLVLLVLHGRRVLSSRSNLLSPRPSLTKGRFLSGRVDGREA

SEQ ID NO: 169233 - protein, 75 aa, Triticum aestivum
  unsure (1)..(75): unsure at all Xaa locations
  Clone ID: PAT_TA_63651.pep
RYACAHASAGVGSCLPLRGTITDSGDLVPLCYIAGLITGRPNAQATTVDGKKVDAAEAFKAXGIEGGFFKLNPKE

SEQ ID NO: 169234 - protein, 88 aa, Triticum aestivum
  Clone ID: PAT_TA_63652.pep
SFATRPLRGMYGYAPTPAPDRPASPPVPPLPAPSRQQATARRTADEVWREITGGSGGEEEAAPASAGGAGEMTLEDFLAREDGAVVRG

SEQ ID NO: 169235 - protein, 73 aa, Triticum aestivum
  Clone ID: PAT_TA_63653.pep
SRSPNPTVVLDACLVVGHLIPMVELAKLSLGRGVPVVIADPTPPASTADLFCSSDFAAAAIEAANPCIAFHHL

SEQ ID NO: 169236 - protein, 118 aa, Triticum aestivum
  Clone ID: PAT_TA_63654.pep
FQQLQTVETVHASKDLSLQLKKMNKLQNVRIDDINASHCDDLCQALSDMPLLSSLFLSACDDKETLCFQALKPVSKRLHTLIIRGSWGDEALKCPIFQGHGKNLKYLALVWCNLGNED

SEQ ID NO: 169237 - protein, 54 aa, Triticum aestivum
  Clone ID: PAT_TA_63655.pep
LDSAVLSGMLLLSAMNKLKKMALRVIAENLSEDETAGLKEMFKMIDSDNSGQIT

SEQ ID NO: 169238 - protein, 99 aa, Triticum aestivum
  Clone ID: PAT_TA_63656.pep
MSSALSLPATVRPASSGLGRQLYGSPPRHGPVLRPRRPQAEPCHGLLALRPRTRRCGAFGQDHYGGALVDEGMAVLRRRIREARMAVTNYEAPAGWADW

SEQ ID NO: 169239 - protein, 91 aa, Triticum aestivum
  Clone ID: PAT_TA_63657.pep
HANIVTFVGMCSEVSALVYEWLPKGNLEDRILCADDTPPVSWHIRTQIIREGCCALLFLHSHKPNASVHGDLRPCNILIGADYRSKLYNFG

SEQ ID NO: 169240 - protein, 115 aa, Triticum aestivum
  unsure (1)..(115): unsure at all Xaa locations
  Clone ID: PAT_TA_63658.pep
MDLELLWSGPPALSVLPWICGGLVASVLLWQAARLLDQLWWRPRRLERALRSQGLRGTRYRFLLGDVNDYARQTKEASSGAXPMPLRCHDVGPRAMPFLYSTIKEHGTPCIFWFG

SEQ ID NO: 169241 - protein, 112 aa, Triticum aestivum
  Clone ID: PAT_TA_63659.pep
SSPYEYIVCRQGIPGLDGGDAPKRKSMLVVSEFIGCSPSLSGAIRVNPWNIDTTAEAMNESIALSENENQLRHEKHYRYVSTHDVAYWSKSYIHDLERSCRDHFRRRCWGIG

SEQ ID NO: 169242 - protein, 112 aa, Triticum aestivum
  Clone ID: PAT_TA_63660.pep
MAPNGDNTVANVHSGIDSTNKTLLKSDALYTYILDTTVFPREHECMRDLRLITDKHPWGYMQSSSDEAQLLGMLIKMAGAKKTIEVGVFTGYSLLATALALPEDGKVVAIDT

SEQ ID NO: 169243 - protein, 89 aa, Triticum aestivum
  Clone ID: PAT_TA_63661.pep
LALWAPRLPARQQLLARSPWPPLSQRRPAPPPWSPQPRRGQTPRPRPPRARGPPPSSGPPRRPPVSPPRAPPPSARPSGCGHHRWPLPS

SEQ ID NO: 169244 - protein, 77 aa, Triticum aestivum
  Clone ID: PAT_TA_63662.pep
LASRERERASEQANHIAEPRQQPHRRRWFASCRPTKPRIKAGAAPPSLLLVLVYRAAGRGRCRVLRRGGPEGAEHGR

SEQ ID NO: 169245 - protein, 72 aa, Triticum aestivum
  unsure (1)..(72): unsure at all Xaa locations
  Clone ID: PAT_TA_63663.pep
FSIDDIWSISEWNIIKCALLENNCSSRVITTTRIIEVARSCCMGQDDRMYEMQPXSDFNCKRLFLRTIFGSK

SEQ ID NO: 169246 - protein, 80 aa, Triticum aestivum
  Clone ID: PAT_TA_63664.pep
YCGRVGPSSPPPPPLPPAHDGPDAAAPPPETRRGRPLRRRSGRGGVQPRRADLGGEARGPEPARRGGRWRRRGALQRGLR

SEQ ID NO: 169247 - protein, 100 aa, Triticum aestivum
  Clone ID: PAT_TA_63665.pep
SFVAGGPDGEKGLLSNIMHGVAGAHGGGHGYPSGGHGYPPQQHGYPQQGYPPQHGYPPQQHGYPPQQHGYPPAGYPGSSGHSGSHGGGGMGMGGMLAGGA

SEQ ID NO: 169248 - protein, 89 aa, Triticum aestivum
  unsure (1)..(89): unsure at all Xaa locations
  Clone ID: PAT_TA_63666.pep
MKGTKLAAILILQAALVMGVLSHVNADYLPKCXNNCRSFSGVDVCDDAHPKCPTGCSACRVVSTSPEMWRCADMKSTGDGTCGGPCKKY

SEQ ID NO: 169249 - protein, 54 aa, Triticum aestivum
  unsure (1)..(54): unsure at all Xaa locations
  Clone ID: PAT_TA_63667.pep
SFTTXATLEWGMTELVRHPRILQKAQEEVRWVVGGKGRVEESDLAELHYMRAII

SEQ ID NO: 169250 - protein, 86 aa, Triticum aestivum
  Clone ID: PAT_TA_63668.pep
IPPSFFSVTVCCPMVNTRKLPLPLPLQPVIWSISPRWIDPQHARPRRRMKKNNKQVSAAGPGSCVEPRHERQDDRGCGLCGWLDQE

SEQ ID NO: 169251 - protein, 140 aa, Triticum aestivum
  Clone ID: PAT_TA_63669.pep
SGQRCDAPTAPADVGAEAGGGWNRRVRRGRIPDEREPDAQRVSALEKALTGFAERQTDVVVNPTVGTCFDSITEAYDFYNLYSWEMGFGIRYGKSRRNAKGGKCMHEITCVNSGKPNMGGKSRMCECTALIRLLRTDDNG

SEQ ID NO: 169252 - protein, 135 aa, Triticum aestivum
  Clone ID: PAT_TA_63670.pep
FLNHLSGLIIGQDNNDPEGCDLIHLRAMSELRYLQIERLDRATSGASALANKPFLKVLHLSEQAALIEEEENEEEQENQEGAEKEEKDKHEVKSAQWIRDDSAKVSEKIWNELTPPNSVEKLVIKNYQGRKFPNW

SEQ ID NO: 169253 - protein, 74 aa, Triticum aestivum
  Clone ID: PAT_TA_63671.pep
SFVAAPPPPATHPPSLSPLPAAANSPRRAKPARIWRRWAAIFRVARSRAGGAPCGGYRRGVTPARSGSSSGGWG

SEQ ID NO: 169254 - protein, 146 aa, Triticum aestivum
  Clone ID: PAT_TA_63672.pep
FRPLLPSLPPPLPLHRLSAQHPSRSPPSLLHPPPLPSPVPSTALLPLSPSTPATPSRPSRPLLSPRQPTSALRPRAPTIPTRSRSSPLPHPNPASTALPLAPRCARTARPRWSCARGHRGSHSLASPSVLSPAVLLLVPGPPLTSG

SEQ ID NO: 169255 - protein, 42 aa, Triticum aestivum
  Clone ID: PAT_TA_63673.pep
AHLPLQFLAFRCWLALWRSPVRAIGEATSAYCTVSIALRDLP

SEQ ID NO: 169256 - protein, 151 aa, Triticum aestivum
  Clone ID: PAT_TA_63674.pep
FKDVLPRIGQWNMRHKKMVNGGRVKEWICINFARNVQDSAARSFCRQLADMCEISGMDFSKDPLLPPLCTRAEHVERALRAHYRDAMNILKPLGRELDLLIAILPDNNGPLYGNLKRICETDLGLVSQCCLTKHVFKTTQQYLANVALKIN

SEQ ID NO: 169257 - protein, 129 aa, Triticum aestivum
  Clone ID: PAT_TA_63675.pep
FTRPHGTNKSPPNLVSDRLHARRILLPYRLKMQISAKTLTGTTITVEVERSHTIDNVKAKIQDKEGIPPDQQRLMFAGKQLEDGRTLADYNIQKESTLHLVLRLRGGMQIFVKTLTGKTITLEVESSDT

SEQ ID NO: 169258 - protein, 40 aa, Triticum aestivum
  Clone ID: PAT_TA_63676.pep
LFRPTEGGISGTDDAAEALISSLPMGRAGGRMDYEAGKRA

SEQ ID NO: 169259 - protein, 67 aa, Triticum aestivum
  Clone ID: PAT_TA_63677.pep
GLQVPLFKYENDLFANFNAKWLVSLEQLHVYILSSYAIDATSRLHFSSLFLFLGVERSHSRIEQMQL

SEQ ID NO: 169260 - protein, 104 aa, Triticum aestivum
  Clone ID: PAT_TA_63678.pep
PRVRLNLSFNWFHGEIPASLGRLRRLQRLDLNDNSFSGKFPVNLSSCIRLNKMGLHNNKIGGHIPAELGEKFISLAVISLRNNSFTGPIPGSMANLSYLRYLDF

SEQ ID NO: 169261 - protein, 102 aa, Triticum aestivum
  Clone ID: PAT_TA_63679.pep
MSPDDVSRKSPVPPPSPPPMDSWARGGRRSRRRGSSGSASSGGGVESEEEYLALSLLMLSRGVRGEVEDGGIGGVKGLGAAPTKAQGYGCSVCGKVYASYQA

SEQ ID NO: 169262 - protein, 46 aa, Triticum aestivum
  Clone ID: PAT_TA_63680.pep
LETGLNDWKNTLRLEESGALFTILENQRERMIFSPSGTDNRSRSSR

SEQ ID NO: 169263 - protein, 45 aa, Triticum aestivum
  unsure (1)..(45): unsure at all Xaa locations
  Clone ID: PAT_TA_63681.pep
FVAWHSSLFHLLLLFLEEVLSVXVRPPLSNVTKHPGDSPXLLTGK

SEQ ID NO: 169264 - protein, 33 aa, Triticum aestivum
  Clone ID: PAT_TA_63682.pep
VTCYYFRHTYRIGPLPSHPVNVTPSLNPHITHA

SEQ ID NO: 169265 - protein, 118 aa, Triticum aestivum
  Clone ID: PAT_TA_63683.pep
FSTCLTLYNETGLFDKLGGFPAPLLMNTVHFALQAALSKIILLFQAKGIDTAVEMSWKDYFMRVVPTALGTALDINLSNASLVFITVTFATMCKSASPIFLLLFAFAFRLESPSIKLL

SEQ ID NO: 169266 - protein, 80 aa, Triticum aestivum
  Clone ID: PAT_TA_63684.pep
VKVRSPRRSAPELESLSVVRRTRDPQRAFRESMSEMIASSGGTDARPEELERLLACYLAFNADEHYDCIVKVFRQVWFDQ

SEQ ID NO: 169267 - protein, 104 aa, Triticum aestivum
  Clone ID: PAT_TA_63685.pep
MANQPRERGSRAARKGRPVRTPATLLALNPTPDPDLSAQASDDVSPWGRSTADELEDRLLKRLEEAYAAALAGLAELGYAEDSALRAVLRAGHCYGKLDDPVDN

SEQ ID NO: 169268 - protein, 100 aa, Triticum aestivum
  Clone ID: PAT_TA_63686.pep
PPPPPPRPYRPPWRHRPPPARPPGQARRRPAPPRPRRWRPLPLRKRPATPERGDRGPAPAATRARRPSPLRPPRARPCRRPPWQLLRRWRAWARGEERGW

SEQ ID NO: 169269 - protein, 134 aa, Triticum aestivum
  Clone ID: PAT_TA_63687.pep
MAACLRCRRRLPLSPPAAPLEDDGLLSENLLRLPPQPSSLPRASAVCSRLLSDPAFRRRFRIHHRGSALLLGSFIHYPGITFQPAPDAPDRLPLEQFRLKLDDHYIALGCRHGLALFFLPIRLQVLVWDPLAGH

SEQ ID NO: 169270 - protein, 114 aa, Triticum aestivum
  Clone ID: PAT_TA_63688.pep
LTRPLSLPLPSGLTDTRDWAADGFPASPDSGAGNDDDACSVCLERPCNVAAEVCGHELCLKCAMDLCTVMKAYEVPGLAGTVPCPLCRSGIASFRKAVAAATASPEDDQQSMSG

SEQ ID NO: 169271 - protein, 112 aa, Triticum aestivum
  Clone ID: PAT_TA_63689.pep
MGMGWKVLSDVKPYLAMVLLQVGFAGMYIIAGASLKAWMSHLVLVVYRNLIATAVMAPFALYFERGRRPKMTTTIFLKIMGLAILEPMIDQNLYLLGAKLTSAGFATALLNT

SEQ ID NO: 169272 - protein, 105 aa, Triticum aestivum
  Clone ID: PAT_TA_63690.pep
FSLLQDIMGCGGMGIIYGGYGDRWRQMRKICIVELLSSKQVRRMEGIKANEVGNLLHSMAAAGATVNVSAKMATLSSNVVTRAVFGGKFTRQDEYLHELSKVNEL

SEQ ID NO: 169273 - protein, 68 aa, Triticum aestivum
  Clone ID: PAT_TA_63691.pep
MEKMRAAWEAPPTQQLPPGFRFHPTDMELLLQYLRRMALDRPLPAAVIPVVHAADMPDPWDLPGASEG

SEQ ID NO: 169274 - protein, 59 aa, Triticum aestivum
  Clone ID: PAT_TA_63692.pep
MGRAGTHTPKSSLGKQGLSIGFVKKTSLVNMGTCTCFCNSLDSCCSDYATPEIVLRKTV

SEQ ID NO: 169275 - protein, 90 aa, Triticum aestivum
  Clone ID: PAT_TA_63693.pep
PTITLLHAEGGAGQRRRLRHPEPLRRQPQLQGRHAVGHQQRGDPQRRPARALRPVERPGRGGCARTSLVVLVLLCVDRFTTIIFNGHLFH

SEQ ID NO: 169276 - protein, 48 aa, Triticum aestivum
  Clone ID: PAT_TA_63694.pep
HWSPHCTQVVVEVCPVRRKKKQSSKRKIMSSPSIKFELQRYHLDEYVI

SEQ ID NO: 169277 - protein, 44 aa, Triticum aestivum
  unsure (1)..(44): unsure at all Xaa locations
  Clone ID: PAT_TA_63695.pep
MVPVVERLKTGFXKFKTEVYDQKPDLFEPLKAHQSPKYMVFACA

SEQ ID NO: 169278 - protein, 94 aa, Triticum aestivum
  Clone ID: PAT_TA_63696.pep
FTRPRTRGGRVGKNVAVEVADKLCESGAASLLGKKLGSFTRISCSVQAAMEEALVRILTPRRAIDVLTDAHAANDRGTPYVIPFVGVNGVGKST

SEQ ID NO: 169279 - protein, 137 aa, Triticum aestivum
  Clone ID: PAT_TA_63697.pep
FFLKRMVEFHADSETTDIYVIKKVDNRVKSSVADSSTPADSAIIGTTPDGSKRQKICASWENTITGVGQVFEGPKEFRDALHKYAIAHRFHYRFVKNDSSRVTVECTDEGCPWRIHASKSSANQEFMIKKVVGSHTC

SEQ ID NO: 169280 - protein, 50 aa, Triticum aestivum
  Clone ID: PAT_TA_63698.pep
PLLGSLAPELAGLHGRRVAQLRHHASRCRMGEPSPRRCGQARVWGAQEAT

SEQ ID NO: 169281 - protein, 122 aa, Triticum aestivum
  Clone ID: PAT_TA_63699.pep
FCKGDRVRFKSDALEFNKMSELFNQRSSVEGKIPSGQFNACFDLDSGSWAQDASSTKSLAMDGYFISLLDLRLDRRPLALAAHVLRDVPAAWDPAAIASFIEKYGTHVVVGLSMGGQDVVCV

SEQ ID NO: 169282 - protein, 71 aa, Triticum aestivum
  Clone ID: PAT_TA_63700.pep
KNRRSTRLAWPACAHAGLLAAASCCGDRSQGSSSGVGGDMGRRRHRFTSFLGSDATTPPPSTSGAENATNP

SEQ ID NO: 169283 - protein, 83 aa, Triticum aestivum
  Clone ID: PAT_TA_63701.pep
FLRGQECCWVSATHTKLGPWRQPEDALPICSCSPSCCPSSSPTPRTGATWSTPARAPGDSSVAYRGSAADRRVEPEVPEAWAP

SEQ ID NO: 169284 - protein, 94 aa, Triticum aestivum
  Clone ID: PAT_TA_63702.pep
ARQHVHDLQHAGPEAAAGASAAAVARGGSQGQRPRPRRTPGLGCGASEHRHAGAGHGGHLADCFRTWRLPPSAGPAGLHDKHGLEGDTYRARVY

SEQ ID NO: 169285 - protein, 122 aa, Triticum aestivum
  Clone ID: PAT_TA_63703.pep
SIPSETRVIINAWAIGRDPGYWDKPDDFVPERFLEGGAAAAVDLTGKDFQFVPFGAGRRICPGLNFGLATVEIMLANLAYCFDWELPVGMERDDKIDMTEVFGLTVRRKEKLMLVPNTHVVA

SEQ ID NO: 169286 - protein, 78 aa, Triticum aestivum
  Clone ID: PAT_TA_63704.pep
MSCCGGNCGCGTACKCGNGCRGCNMYPEVEADGATLLVYVTDTHKASSGGMEMAAENGGCGCTQCKCGTSCSCYCCSC

SEQ ID NO: 169287 - protein, 98 aa, Triticum aestivum
  Clone ID: PAT_TA_63705.pep
LASAHASAHAWGHSYVAGRSHHPHAHPHPHPPPHHPHPHHHMPPPPQFAKHYAPGPPPPPAAAGRRTPTPPAAGSGGNGCEENKTIWVGDLQYWMDEN

SEQ ID NO: 169288 - protein, 89 aa, Triticum aestivum
  Clone ID: PAT_TA_63706.pep
MEHKETGCQSREGPILCVNNCGFFGSAATMNMCSKCHKEMAMKQEQAKLAASSFDSIVNGGDAAKEHLAAGSTAVAVAHVEAKTLITAQ

SEQ ID NO: 169289 - protein, 61 aa, Triticum aestivum
  Clone ID: PAT_TA_63707.pep
PLAHPDLQRPETVGQLGQRVGPTPKHRMRRRSQRGGHHHQWAPPLPNPIHPAVRVFREEEA

SEQ ID NO: 169290 - protein, 37 aa, Triticum aestivum
  Clone ID: PAT_TA_63708.pep
CPRGWSVRLNNSCEGASPGSMERTSALAHVSAHASAE

SEQ ID NO: 169291 - protein, 25 aa, Triticum aestivum
  Clone ID: PAT_TA_63709.pep
MSYLLPHLHSGWAVDQAILAEEERL

SEQ ID NO: 169292 - protein, 69 aa, Triticum aestivum
  Clone ID: PAT_TA_63710.pep
VSASIEGDVKNLWEGKTSTALEEMQNQIEYQMRSGTAKVDVYWLAILKRLHIYKAKACLLEIHAPLLRK

SEQ ID NO: 169293 - protein, 116 aa, Triticum aestivum
  Clone ID: PAT_TA_63711.pep
IKSAAGAAHCGGIVISSSNPHKRTRRGHKGVLQLHHLPLDTLSDIVSLLSFKEAARMSVLSSQWRHLWRSCIRDLVFTRETMCCPMPMSRVEHDREAFIRNVECVLCQLDPTIARD

SEQ ID NO: 169294 - protein, 94 aa, Triticum aestivum
  Clone ID: PAT_TA_63712.pep
LLETKNEKPPSSPSDILSPEQRKIPIADAPSSQCGLLSRDQRKAPPVDFIKPSEPPACHMEADMVITAATPSSEAQGTTGKKGLLERIQILWTG

SEQ ID NO: 169295 - protein, 33 aa, Triticum aestivum
  Clone ID: PAT_TA_63713.pep
HWSTHWLPWCERLCFQCLFSITASEVLVLRHKE

SEQ ID NO: 169296 - protein, 97 aa, Triticum aestivum
  Clone ID: PAT_TA_63714.pep
CFFLRIGSLTWLSLLYFEIEGHSMMVVEADGHYVRSFAVRGLFIYSGETYSVLVKADQDPRRNYWAASHVVGRNPSQTPTGKAVVSYAFNGNNPWMP

SEQ ID NO: 169297 - protein, 109 aa, Triticum aestivum
  Clone ID: PAT_TA_63715.pep
SFAHASGKTQRNNSAPLQLQLPRQLTGGHRSTPPPPIPAALPSARSPPAGDATGPRPRRGDTGSQLDLARRRFPGGMGRFAGLRWLLLLWVAAGALAAEEDSKAAVGAP

SEQ ID NO: 169298 - protein, 83 aa, Triticum aestivum
  Clone ID: PAT_TA_63716.pep
EHPGPRRASDLPGPNLVDAVHVLEAHRRPGVTAAAAEAGQRAADLVADVRAQPLPGARPGIVVVVVVSGSHEDLIPVHGQHGA

SEQ ID NO: 169299 - protein, 76 aa, Triticum aestivum
  Clone ID: PAT_TA_63717.pep
MMASRTMWVNGPIIVGAGPAGIAAAACLHTRGVPSVVLDRDDCLASLWQRRTYDRLRLHLPKHFWQLPGMPFPDHY

SEQ ID NO: 169300 - protein, 77 aa, Triticum aestivum
  Clone ID: PAT_TA_63718.pep
SVGQLRRNALLDEAPCTFLWGISCYGPVQLERCFFGQLSCRCHVPVPAAGSFGRQYSLVAESLVFSDNKSWIMPDMI

SEQ ID NO: 169301 - protein, 69 aa, Triticum aestivum
  Clone ID: PAT_TA_63719.pep
TLSSTAHTTFLIDSLFSGVDFYSTITWARFEELNMDLLRKCMEPVEKCLRDAKMVKITIHDVLLVGGST

SEQ ID NO: 169302 - protein, 103 aa, Triticum aestivum
  Clone ID: PAT_TA_63720.pep
PEIARAASICVYGLIPQIFAYAVNFPIQKFLQAQSIVLPSAYISTATLVLHVMLSWVLMYKVGLGLLGASLVLSVSWWIIVGAQFVYIVVSPTCRHTWTGFSW

SEQ ID NO: 169303 - protein, 67 aa, Triticum aestivum
  Clone ID: PAT_TA_63721.pep
YLFAYLGGNSSPSAGDVKNILDSVGAEADEEKLEFLLAELKGKDITEVIASGREKFAAAPSGGGAIA

SEQ ID NO: 169304 - protein, 22 aa, Triticum aestivum
  Clone ID: PAT_TA_63722.pep
SHGAYQGRGAGHRHTPRHHLLV

SEQ ID NO: 169305 - protein, 95 aa, Triticum aestivum
  unsure (1)..(95): unsure at all Xaa locations
  Clone ID: PAT_TA_63723.pep
GYPPLFLYITGATVMGCKHQAYPGGPNAANAACSAVGILGIIWAFGGMIFMLAYCTDGVCGGHINPAVTFGLFLARKGSLVRAXLYIIAQCLGAI

SEQ ID NO: 169306 - protein, 73 aa, Triticum aestivum
  Clone ID: PAT_TA_63724.pep
HPWCSQNRPHSPPHGPPSETPLVKSHSLPWTEASSSMTVLLSWSGGLSLKTSSSSRCPISWLRSDAWANAMDA

SEQ ID NO: 169307 - protein, 107 aa, Triticum aestivum
  Clone ID: PAT_TA_63725.pep
RVQAGPHTRTCHLSLTSKAEGPTEPSVRSRAQTGPTHSHVLSPPSSTRPSLEQIDVSTLAGPLPSMPPRRQTTTSTYASLGRSSAIDATTTPNVDLHERESICKQRT

SEQ ID NO: 169308 - protein, 121 aa, Triticum aestivum
  Clone ID: PAT_TA_63726.pep
MFALLSNLLRKPAVPSGILLPAAPDDHRNSSSGGVDPHHVLRWLDDQPPKSVIYVALGTEAPLTLENIHELALGLELAEVRFLWLLGKPAGSNKVAGPLPAGFEERTRARGVVCTGWVPQM

SEQ ID NO: 169309 - protein, 96 aa, Triticum aestivum
  Clone ID: PAT_TA_63727.pep
GVPVAPRPPRHSPGAPGAAEKEEGRAGPGRRAEHLPRHRGRGAQDGPDGGHAAGDEEAYGGARRGGGGGDQPAGHGSSGGGDGHRQGGRWGMGNTT

SEQ ID NO: 169310 - protein, 122 aa, Triticum aestivum
  Clone ID: PAT_TA_63728.pep
SGLVCDVRARELRRGTRRHLLAPAPGAVPGARRRQGWRGAGRRARLHPAGTLRPRRGCGVPGTRSRAPGGRDGVHVAEQGGVAPGAGVRRGCAAAPRRRRHGRLDLDGDQSGAAGACRRDRP

SEQ ID NO: 169311 - protein, 75 aa, Triticum aestivum
  Clone ID: PAT_TA_63729.pep
YKPSSRARFNCLGGPVIAFSIICCYLHQTICHMSHLSILTFKFNLSKLRFKPFRTAGRLLSAQGPAAVRPDDVQA

SEQ ID NO: 169312 - protein, 149 aa, Triticum aestivum
  Clone ID: PAT_TA_63730.pep
CSRGARLARPGPPRRPLPPRPRRARRLHGLHRGRRLRPAFPGAASCSRQSPTPSPSPSTTPTSSAAATTGGSSRAATRSSWLLAATTTAARSCRSPSSGWRAAEGSWSRSPSALDLGNGARFRRRCTTRSACGGSWVSDWGSATMPTGA

SEQ ID NO: 169313 - protein, 147 aa, Triticum aestivum
  Clone ID: PAT_TA_63731.pep
VFSAVTQSIGPSIHKLKRFDNLDGSYFGFPPDPFSASRSRQQVAISSELEQRNCLMFEHSAARQSHGYPQSTNGKGTKNFNLNEALSDGLEELVEQDGRSVGSLQHSKGEGSVFGISWLKNKATCADPTRLEKQRKMLGHSNGTAAD

SEQ ID NO: 169314 - protein, 95 aa, Triticum aestivum
  Clone ID: PAT_TA_63732.pep
CIHFSRRPGTWSVLCNTFCPVPDCRLDRVTVDDRLHFLVGKAFPCKLLLRPPATTQSSTTLLQLARPRQAAFIIDRQVTLCACINVQTRTLIKGW

SEQ ID NO: 169315 - protein, 54 aa, Triticum aestivum
  Clone ID: PAT_TA_63733.pep
GTNMEHITRLYSLTRCINPRIRRARSFINCCTYLHYVRHATQDGLFFSCLQARC

SEQ ID NO: 169316 - protein, 133 aa, Triticum aestivum
  unsure (1)..(133): unsure at all Xaa locations
  Clone ID: PAT_TA_63734.pep
MGQRFRFFCCGCGANAADGDMEVDDESECGGGKGGRGXGARQLSWAQVERMTGGFTSAVVGEGGFSTVYLARLSGALAAVKVHRSSERIHRVFRQELETLLRIRHPHIVRLLGFCEQQDEGVLVLEFAANGNL

SEQ ID NO: 169317 - protein, 36 aa, Triticum aestivum
  Clone ID: PAT_TA_63735.pep
MIQHNFSIDRVPIYTELLTTEGRTRATHEVSRIYCP

SEQ ID NO: 169318 - protein, 73 aa, Triticum aestivum
  Clone ID: PAT_TA_63736.pep
MAPVKLFGATLSCNVTRCVAALEEAGVEYELVPINFGSGEHKGPDHLARNPFGQVPALQDGDLYVFESRAICK

SEQ ID NO: 169319 - protein, 75 aa, Triticum aestivum
  Clone ID: PAT_TA_63737.pep
ADDGHPARHGCFWRNNARPLPVNVSWSDWAEESDSYVAWQPVSICLRRHQRLVQIQKKGPSWKFDIRQETWRGHC

SEQ ID NO: 169320 - protein, 96 aa, Triticum aestivum
  unsure (1)..(96): unsure at all Xaa locations
  Clone ID: PAT_TA_63738.pep
AVSPWALILLLAAVFTAGAGATTFSITNRCSYPVWPAAIPXVGGGRRLNSGDTWNLEVPGGTSAVRIWGRTGCNFNGDRGSCATGDCAGALYCGLS

SEQ ID NO: 169321 - protein, 53 aa, Triticum aestivum
  Clone ID: PAT_TA_63739.pep
RLPATSRCWPPPPRYSSCSAACTALKRGRRTPDCAVAQTAFGDCTGYVAGVED

SEQ ID NO: 169322 - protein, 65 aa, Triticum aestivum
  unsure (1)..(65): unsure at all Xaa locations
  Clone ID: PAT_TA_63740.pep
MGKIKIGINGFLMGSXGSVARVALQSDDVXLVAVNDPFITTEYMTYMFKYDTVHGHWKHSDIKLK

SEQ ID NO: 169323 - protein, 53 aa, Triticum aestivum
  Clone ID: PAT_TA_63741.pep
FPRCPSCDYRFTTGSPPITVVGLPHSEMVGSKPDSGSPTRFGGSPRPSSVVCA

SEQ ID NO: 169324 - protein, 59 aa, Triticum aestivum
  Clone ID: PAT_TA_63742.pep
DGARDDKYGGSICSRRYGPDRGGERYSGSRDGGSPGSGGGDRYSRDRPGPYDRRSRDEY

SEQ ID NO: 169325 - protein, 73 aa, Triticum aestivum
  Clone ID: PAT_TA_63743.pep
AGADPVLAASCTIISLQSLVSREADPLDSQVEPVAMVNCSGGDPADPLVLGGTFRAFSNASFYTLRRRIEEVM

SEQ ID NO: 169326 - protein, 64 aa, Triticum aestivum
  Clone ID: PAT_TA_63744.pep
TSARHPPPLPPSITCVPPPSSPSPQLAAATTTEAHSRGHAEQNAASNSSYRITWQRAEICCPAT

SEQ ID NO: 169327 - protein, 100 aa, Triticum aestivum
  Clone ID: PAT_TA_63745.pep
NCSGGGNELFKLKVISGRTYMLRLINAALNDELFFAVANHTLTVVQADASYVKPFAVTTLVILPGQTMDVLLTEATNPVSTVFAIAVAPYTNTVGTFDNT

SEQ ID NO: 169328 - protein, 92 aa, Triticum aestivum
  Clone ID: PAT_TA_63746.pep
IGQRESRRRPWVPLSAPAAAYPGRQPRQEPATKPERRRREEKREPILPPLPLLATLGESSDDRRQCTMFQGCGLFACVSRRGADVRKRGEAG

SEQ ID NO: 169329 - protein, 63 aa, Triticum aestivum
  Clone ID: PAT_TA_63747.pep
QGTFLSPKDKGAAEEPLKAVGTKRLHTDAPSSPAYHNVYVRRKVATEHNKVNSPPEMKVIGKD

SEQ ID NO: 169330 - protein, 67 aa, Triticum aestivum
  Clone ID: PAT_TA_63748.pep
MGMGMASPLLSCAIMALLAAVLSPPSVAGDPDLLQDICVADLTSAVKVNGFACKATVTDDDFYFKGL

SEQ ID NO: 169331 - protein, 63 aa, Triticum aestivum
  Clone ID: PAT_TA_63749.pep
MPPVPDMLVRLLVASVLLGAASGAFTPADTYLVLCGTSASATVAAGRTFVGDARLPAKSLAAP

SEQ ID NO: 169332 - protein, 156 aa, Triticum aestivum
  Clone ID: PAT_TA_63750.pep
LLGGLEVADMVVDIFFAVDIVLTFFVAYIDSRTQLLVRDRRRITFRYLSTFFIMDVASTIPYQGIAYLVNGEVREGMVYSLLGLLRLWRLRKVKQFFTRLEKDIRFSYFWVRCARLIAVTLFLVHCAGCLYYLLADRYPDRDKTWIGAVIPNFRQE

SEQ ID NO: 169333 - protein, 87 aa, Triticum aestivum
  Clone ID: PAT_TA_63751.pep
RYVALMTYGDDIIMGVSCAVRGFDHTGMQIELAKIGVVYTMADKEAESVPFMDISEVYFLKRTWVISPEVGSHIAILEHDSIDKGLL

SEQ ID NO: 169334 - protein, 48 aa, Triticum aestivum
  unsure (1)..(48): unsure at all Xaa locations
  Clone ID: PAT_TA_63752.pep
MYDIGAVFGHFAIAHEDVPKLSETLKXYDRCKITRDPGPVKGGSTVIA

SEQ ID NO: 169335 - protein, 100 aa, Triticum aestivum
  Clone ID: PAT_TA_63753.pep
MEGKEEDVRLGANKYSERQPIGTAAQGSEDKDYKEPPPAPLFEPGELKSWSFYRAGIAEFMATFLFLYVTILTVMGYSGATSKCATVGIQGIAWSFGGMI

SEQ ID NO: 169336 - protein, 105 aa, Triticum aestivum
  Clone ID: PAT_TA_63754.pep
LSMIPLHLERAGPLDSLGYTPHKNHSQEDQITRPKPKPKQIPSHSQPARQAREQKNPPHPPCNSKHAEKNGGMNTPSYYSSLSCVPGYPYPVDSPWAPPPCSLRE

SEQ ID NO: 169337 - protein, 119 aa, Triticum aestivum
  Clone ID: PAT_TA_63755.pep
KPGFLLQIREPGKFIQMVEPTISPTSPGSVLWSASDEESTAIRRWPPLASSKHPSPLRKGKRRNETTNTTTSGHTPLPSPLRPAAPAEERGRGGPNLTSLAPPKLQQRPPERGKKETRE

SEQ ID NO: 169338 - protein, 71 aa, Triticum aestivum
  Clone ID: PAT_TA_63756.pep
LQPKFGVGVIDRSNLFHQLLESRSTILDSLTNLKQKCQWNIKISLRSKGFTRLNAKINPHEKSMNVSPRER

SEQ ID NO: 169339 - protein, 118 aa, Triticum aestivum
  Clone ID: PAT_TA_63757.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAG

SEQ ID NO: 169340 - protein, 117 aa, Triticum aestivum
  Clone ID: PAT_TA_63758.pep
SSPGPPWTPTSRACLRWGPKEWARPIVRIAVDGAVDLVDHAVARAFGQCHSFNYLRIQAKRESMPPCGPDGEYDPTQANVQALLAAADEAMKQRNVESVLFEGRRIGEQTNAEKLEW

SEQ ID NO: 169341 - protein, 137 aa, Triticum aestivum
  unsure (1)..(137): unsure at all Xaa locations
  Clone ID: PAT_TA_63759.pep
FTRPPTRPPTRAPTRAPTRPVFFFHDTXEARVHDHSDHPADHLHAGASLRQRRRLHPIHHRAPLRHHHDVRAGVTHDDQRDTVDAGHLRAPTDAPRPESRLRHLPRVPRRAAGVPAWEAKRARVLRRGSAHGCRGDT

SEQ ID NO: 169342 - protein, 73 aa, Triticum aestivum
  Clone ID: PAT_TA_63760.pep
FFTIPAPPRGQGGFHIGRALDPTAPSPLVPIHSFHLWRVWVQPSGISHGCRRSGAQPARPVGVSGAGTAVWDG

SEQ ID NO: 169343 - protein, 98 aa, Triticum aestivum
  Clone ID: PAT_TA_63761.pep
LPKIWFLAVIYFILGCPGAYYLWYRPLYRAMRGIFPSISLIGKSVAVGVFYFLGFAMFCIESSLSMWVIQRVYHYFRGSGKEAQMRHQAARATTRAAF

SEQ ID NO: 169344 - protein, 138 aa, Triticum aestivum
  unsure (1)..(138): unsure at all Xaa locations
  Clone ID: PAT_TA_63762.pep
VLQNYLLLGYRWPYFKAGGTQGRIIFHKWKEGKWAILFSHPGDYTPVCTTXLGMTAKLQPEFSKKNTLVIGLSVDNVDDHHWWVKDIXSTQNCTVNYPIVADPDRTVAETYCMIHPNSPLTMAGKLTVRTVWIIYPNN

SEQ ID NO: 169345 - protein, 96 aa, Triticum aestivum
  unsure (1)..(96): unsure at all Xaa locations
  Clone ID: PAT_TA_63763.pep
FIANQYVPFIVAGGKKSYFTTGAVARIALADGVLVIALILVGLFSLRQKRTNTELKXRITNPFASWGAAHKDSGGAPQLTGARFFSFEELKICTDN

SEQ ID NO: 169346 - protein, 104 aa, Triticum aestivum
  Clone ID: PAT_TA_63764.pep
SDRVSRILFGPLASGHSSGRTTLTKKTEREKQRRVATSCPLQAMSLFSVLGDLRWHKLCRVYRFHAYSHARSSAVGRSLWRGTLSALPCCFGCFCSPSAPGACC

SEQ ID NO: 169347 - protein, 44 aa, Triticum aestivum
  Clone ID: PAT_TA_63765.pep
LKMDHSKGTTLAFFFLINCISSKFLVPSLITWQLATYVIKNDSL

SEQ ID NO: 169348 - protein, 42 aa, Triticum aestivum
  Clone ID: PAT_TA_63766.pep
MWMPCNCGSGCSCGSDCKCGKMYPDLTEQGSAVAEVDTVVVL

SEQ ID NO: 169349 - protein, 76 aa, Triticum aestivum
  Clone ID: PAT_TA_63767.pep
FTRGRTRGIVLFLYVYGYSITCAGVVTLKKIKCTGVVYVRTCASYTCSIRARRQPQARSFDLIIQYSYMSRTCVCA

SEQ ID NO: 169350 - protein, 33 aa, Triticum aestivum
  Clone ID: PAT_TA_63768.pep
FIHLYRPMSGTTTASRTQPCTGAAMWTTPWPEP

SEQ ID NO: 169351 - protein, 91 aa, Triticum aestivum
  Clone ID: PAT_TA_63769.pep
CDHAIVMGLTESCYQLSCMTVRHICLVQECSSVCDQIFLGCIVDGHVCLLLSWQEIFLEYSALMIFIINQMLHKLFIVLSNTAADFGDHHC

SEQ ID NO: 169352 - protein, 123 aa, Triticum aestivum
  Clone ID: PAT_TA_63770.pep
TPRCKVARTISEETQSQSFPELPAGARHLARDPPRRCRSRRRSRRMRRCVLLCDDSPWVATVGAPDVRVGPASAAAQRPQSRAGHEPSLLQPARLALAMARLRPSRLVSQFHPEPFNSTDLYI

SEQ ID NO: 169353 - protein, 141 aa, Triticum aestivum
  Clone ID: PAT_TA_63771.pep
SFNVRSVEEARSIRLMEKQRIKELSLQWSGGVSSVEHMELLTELVPPSSVKNFKITRYKDVMFPHWFMHINKYLPNLVSLEMWGVLCHSLPTTLVPLPNLRKIVLSNMHNLEEFNTACSIGEDGANELTLAKLEYLAYITC

SEQ ID NO: 169354 - protein, 51 aa, Triticum aestivum
  Clone ID: PAT_TA_63772.pep
RSRVRAAALAYGLDRKASSAGEKIVLICDLGGGTLDVYLLTIEVGLLEVKA

SEQ ID NO: 169355 - protein, 123 aa, Triticum aestivum
  Clone ID: PAT_TA_63773.pep
MMMDLGAARATPPSAHEAAEAAVRAVGCGYDLADDLRLFRAKDRLLDLGGGGERDLCLPGGAVVTSVPAGVVADKGERARFRSDVLSFTQMAEHVNQSLSLTGKIPSGPFNAMFDYRGCWHRD

SEQ ID NO: 169356 - protein, 63 aa, Triticum aestivum
  Clone ID: PAT_TA_63774.pep
IMMATQSSQSAVGEEILVAEAGRHGRFALLFDVGQGQVMWVTVACSRSGDVGHGRLLEVHRSG

SEQ ID NO: 169357 - protein, 90 aa, Triticum aestivum
  Clone ID: PAT_TA_63775.pep
MSPVHVPELSSGGSGSGSGSLTLNPVQRALTRLSSSSALTPRSPPPSYGSIVTVLSIDGGGVRGIIPGTILAFLEEKLQELDGPDVRIAD

SEQ ID NO: 169358 - protein, 85 aa, Triticum aestivum
  Clone ID: PAT_TA_63776.pep
LSAAVITPSNAASFLSSFTQLRRRRLPSVPLHPATRPAAVVAPCGGVPEERPSCYYRRRHAELPLAEATPRSTTHLLCHWSHPSI

SEQ ID NO: 169359 - protein, 128 aa, Triticum aestivum
  Clone ID: PAT_TA_63777.pep
HLIRERAADIRKIINLRNDAGLTALHMAVVGCVHPDLVELLMTTPSIDLNVEDADGMTPLALLKEQLRSTTSERLIKQIVSAGGVLSSSVLRSRSAVVSQIKMRGGIAISPGTMFRISDAEILLHSGI

SEQ ID NO: 169360 - protein, 70 aa, Triticum aestivum
  Clone ID: PAT_TA_63778.pep
MRRAIRSEEDLPHSTAPSGAASSQRHAGQGRGYRQRDERPHCHLSLPFLARTFTHVWWWFLHRVVQINIT

SEQ ID NO: 169361 - protein, 76 aa, Triticum aestivum
  Clone ID: PAT_TA_63779.pep
SLTRGTCCFLHTHCKAQVRSLQREGMGQEGAAASLLDGKLKARRNDYGHRKAAAATRKKKWWPCLLDAEEAAGQVA

SEQ ID NO: 169362 - protein, 98 aa, Triticum aestivum
  Clone ID: PAT_TA_63780.pep
HGILQKLTPWADGPSMVTQCPIQPNGCYTYRFNVTVHEGTLWWHAHSSFLRATVYGALIIRPRNGTAYPLPAPDQEVPVVLGEWWSQNVVDVEKDAVM

SEQ ID NO: 169363 - protein, 86 aa, Triticum aestivum
  Clone ID: PAT_TA_63781.pep
EVAGVRIQIGAGWAGQKTGLWEQAQSRNVWRAGDASGSVRAGDKARRPLAADEIDLAGSRVQPMQGSSRNWTAGWTVGARGQSNAW

SEQ ID NO: 169364 - protein, 86 aa, Triticum aestivum
  Clone ID: PAT_TA_63782.pep
LTRLSYVHLDQLVLCPYLGVLSPATPFFIAAEQEVVVDFCHDLRSSQLAFCCGNLGCDVGRGITIFGAPLSCPADRPSQLQFLFIS

SEQ ID NO: 169365 - protein, 106 aa, Triticum aestivum
  unsure (1)..(106): unsure at all Xaa locations
  Clone ID: PAT_TA_63783.pep
MAIGKNKRLTKGKKGGKKKASDPFLRKEMTTIRSPSMFSVRNAGKTIVTNTTGTKIASESLKGRVFEHSLADLNGGDESQGYGKIRLLSEDVXGTNLITNFHGMDI

SEQ ID NO: 169366 - protein, 48 aa, Triticum aestivum
  Clone ID: PAT_TA_63784.pep
LGHGILQKLTPWAVGPCMVTQCPIQPNGSYTYRFNVTGHEGTLWWHAH

SEQ ID NO: 169367 - protein, 51 aa, Triticum aestivum
  Clone ID: PAT_TA_63785.pep
LVLGVGLEYWRVFYFLSHHPESLHTFFFLFDDVGIPTDYRHMDGFGVNTYT

SEQ ID NO: 169368 - protein, 35 aa, Triticum aestivum
  Clone ID: PAT_TA_63786.pep
TSSPHPSMSGAVTRWQTASRAVNTLYQDHAPGRVR

SEQ ID NO: 169369 - protein, 74 aa, Triticum aestivum
  Clone ID: PAT_TA_63787.pep
LMLGQWRWSGQRQIIFWSPIRTCWSLLLGDRRRSCSSWRLACQRGFLVLAWTRLTRPVFRNRSRADASAYAWRG

SEQ ID NO: 169370 - protein, 74 aa, Triticum aestivum
  unsure (1)..(74): unsure at all Xaa locations
  Clone ID: PAT_TA_63788.pep
RPRDRPRERHATTHATGTPAERGPDGKTNEAEAAQGTETRHDREHQKGGETSTNSRSHKTGRXTRGRAHRAKRD

SEQ ID NO: 169371 - protein, 109 aa, Triticum aestivum
  Clone ID: PAT_TA_63789.pep
MGLKGFVEGGAASVVAGCSTHPLDLIKVRMQLQGEAARAPAPAMRFALVFPPGVQHHHHNDHLLQPPRRPGPIAIGAQILRAEGPAGLLSGVSATVLRQAVYSSTSMGL

SEQ ID NO: 169372 - protein, 131 aa, Triticum aestivum
  Clone ID: PAT_TA_63790.pep
AETTQGDATDFKRGEGGYWPDYKGKLEDGQEIAVKTLSQASTQGPDEFKNEVMLIAKLQHRNLVRLIGCCICGQEKILIYEYMANKSLDFFLFDKSKIMLLDWQTRYRIIEGIARGLLYLHQDSRYRIVHR

SEQ ID NO: 169373 - protein, 70 aa, Triticum aestivum
  Clone ID: PAT_TA_63791.pep
PGVRRVVVLRVRPGVGGVVRGRAVVLARVGAPPLLRRLLALLRGVRLVRLPGRCRGGRVRLGCLVRSRGR

SEQ ID NO: 169374 - protein, 66 aa, Triticum aestivum
  Clone ID: PAT_TA_63792.pep
LFADARTRRRARFLQRSAPPPTRRAPAARRPPERTPGRRSRRTTARRRRTRAHTTKTTAATRRPTG

SEQ ID NO: 169375 - protein, 93 aa, Triticum aestivum
  Clone ID: PAT_TA_63793.pep
MAPTKGEGPAIGIDLGTTYSCVGVWQHDRVEIIANDQGNRTTPSYVAFTDSERLIGDAAKNQVAMNPINTVFDAKRLIGRRFADAPVQSDIKM

SEQ ID NO: 169376 - protein, 97 aa, Triticum aestivum
  Clone ID: PAT_TA_63794.pep
CSSQADVAVLVIASGTGEFEAGIAKNGQTREHAFLAFTLGVKQMIVAVNKMDDKSVNWSEDRFNEIKNETSGFLKKIGYNPEKIPFIPISGFNGDNM

SEQ ID NO: 169377 - protein, 57 aa, Triticum aestivum
  Clone ID: PAT_TA_63795.pep
KYVVGGDNSEPSDCVSDFKNPATPEKKKLRGTKGHVSCSPPQSLNCMPQTRNWVITG

SEQ ID NO: 169378 - protein, 61 aa, Triticum aestivum
  Clone ID: PAT_TA_63796.pep
MASASPAPATLLAVCALLAAMALFQGARAQQLSPAYYDESCPHVYDTVRRVIQEARTADPR

SEQ ID NO: 169379 - protein, 64 aa, Triticum aestivum
  Clone ID: PAT_TA_63797.pep
CTLRVKDSGCGLSSPLLDCSSCGATVRIWDYKCVPLSSDLNLGNIDAPDAGTKPMLARLISATS

SEQ ID NO: 169380 - protein, 49 aa, Triticum aestivum
  Clone ID: PAT_TA_63798.pep
RSTLGGLHPRIVSNNADCTMDIHKIVGSMRSPDGHVCYPTTRLICLENT

SEQ ID NO: 169381 - protein, 134 aa, Triticum aestivum
  Clone ID: PAT_TA_63799.pep
SLPPPSSSTEAPWPTSPAALPTPSTTSHRDVPSAHHGVPSCGAPPVHPARRRSHPRPPRDEPMPNPVSRGLPRRAVDGSNHPRPSAMRSLRICPALLPRSPPTSRPNPSTLYTDSPPVARAAVASTPHLSWSSQ

SEQ ID NO: 169382 - protein, 57 aa, Triticum aestivum
  Clone ID: PAT_TA_63800.pep
IVPQFTPSPTAAGSPARLSSSRSTSRGATATTAMVKAAKLSSEPHSHARTHAGRVHE

SEQ ID NO: 169383 - protein, 50 aa, Triticum aestivum
  Clone ID: PAT_TA_63801.pep
PNLSHRYHILLYVSILVLLLVVPFPHKHEYTVLITGAISYNLLSSIKSTK

SEQ ID NO: 169384 - protein, 157 aa, Triticum aestivum
  Clone ID: PAT_TA_63802.pep
SLTRGDKLIWRWIAEDFIHDKQRGNLYKQGENYFNELINRNMLQPVDIDTHGSAKTCRVHDMVLDFITSLSAEENFVTILGGQQPLSTGNKIRRLSVQKNNGEHNMLDKSMDLSHVRLLFVLRSAIDMIPSLLSFQVLRVLDLEECQHLDSCYLKDI

SEQ ID NO: 169385 - protein, 91 aa, Triticum aestivum
  Clone ID: PAT_TA_63803.pep
SFPPAAATPPKNKISRYNSGCSSCCLLHSTRGDLEESMTGSAVFNRKHCATLDKKKTPTAGYIKSVFDDPCSSIASLAICTPMGISESIQQ

SEQ ID NO: 169386 - protein, 78 aa, Triticum aestivum
  Clone ID: PAT_TA_63804.pep
GSGLYSGWSYGTERSWRSASSLWSKLAGRGTSSLVEPRATLAQVSTKSAAPRASTTEWCSASPSTTPPQRRHVTCDNK

SEQ ID NO: 169387 - protein, 154 aa, Triticum aestivum
  Clone ID: PAT_TA_63805.pep
SLTRGFVFECAPGTNATSIEWDGIYHYLVQHGRDRIIAGDYSKFDKRMSAILILAAFKVIVNILAAAGWNDEDLHIVWTMAFDIAFPVADHNGDLVQFLGSNPSGHPLTVIINSIVNSLYVRYAWCTSNHNLEDFVKYVALMTYGDDNIMGVSR

SEQ ID NO: 169388 - protein, 119 aa, Triticum aestivum
  Clone ID: PAT_TA_63806.pep
DASPPALPIIGHLHLVGDLPHVSLRSLSRTHAADGLMLLHLGSVPNLVVSSPRAAQAVMRTNDHLFASRPPSRIADALLYGWSSDIAFSPYGEHWRQARRLVTTHLFTVKKVQVVPHRP

SEQ ID NO: 169389 - protein, 74 aa, Triticum aestivum
  Clone ID: PAT_TA_63807.pep
MVKFSREYEASIIPEWKGAFVDYKCLKKLIKKIKVARRDAESEGDSSPESAALAAGVESARYGAGFSVLDPVRA

SEQ ID NO: 169390 - protein, 123 aa, Triticum aestivum
  Clone ID: PAT_TA_63808.pep
MRDAGHSRYRRRAGLPMLSLLLALALFAGGASGQPPVPPEMRGVQAQLTGLTNDVAHTISDRFSFCVSDTQEDWNGAFNYSSDLGFVQRCLADTRGDMPQRLCTPAEAKFYFTSLYNPKGEKN

SEQ ID NO: 169391 - protein, 143 aa, Triticum aestivum
  Clone ID: PAT_TA_63809.pep
SLRAWCRLFSPLEPLPEPSFPASLPSSSGSSGRRQGGGEGWGQILCILGRLLSCLFCRFLVSQEMASCIRCLLAAIVLATVLQGLELKLRAGFAAAVSNKKLAKSLIWRAAFCWLSARQITMVVDGDRGGSRRLKLSDRVRAH

SEQ ID NO: 169392 - protein, 133 aa, Triticum aestivum
  unsure (1)..(133): unsure at all Xaa locations
  Clone ID: PAT_TA_63810.pep
RTRGRTRGRLPPDLRRPLPTPIPAPLTPAPIPPTRRRVSRGGAARSEPXPPPARLQPAPARRSAGDLDEGDPAGPWPAPASPTPTASTPPRPTPASAPAPLPPPPSPASRTDVALLLYGLHQQATVGPCNVPK

SEQ ID NO: 169393 - protein, 130 aa, Triticum aestivum
  Clone ID: PAT_TA_63811.pep
CLQSPNGGTGAGMVRILPVFPQYLSDSVDGFDGVQDGLEDDMIIPIEEESSTMNSHQASQLPAFSGAYSSAQVREVIEESELDQDSSDRDGASTIYEENESVSVGEVMKSPVFSEDEMSEGSFWVDLGNS

SEQ ID NO: 169394 - protein, 89 aa, Triticum aestivum; identical to SEQ ID NO: 117642
  Clone ID: PAT_TA_63812.pep

SEQ ID NO: 169395 - protein, 91 aa, Triticum aestivum
  Clone ID: PAT_TA_63813.pep
PRSQPPPDRRSVVQISPARAMAVGDPMPVAEPADGDEIVYEYMPCIRIYKDRVERYFGSEFVYACGDTDSGTGVAYRDRVISPEVYARLYL

SEQ ID NO: 169396 - protein, 156 aa, Triticum aestivum
  unsure (1)..(156): unsure at all Xaa locations
  Clone ID: PAT_TA_63814.pep
TVNTFRSLEPRAMDTILAGLCAXSGLRTPAVYCVGPLIKSEDVGVKRGDECLAWLDTQSKGSVDFLSFGSLGRFSAKQTRKVAAGLEASGQRFLWVVRSPPSADSSKNCEKPPEPDLDALXPQGFLERTQGRGLVVXSWAPQRDVLAHDAVGCFVT

SEQ ID NO: 169397 - protein, 145 aa, Triticum aestivum
  Clone ID: PAT_TA_63815.pep
DEEDSDDEEEEEIGEMPSPERRIQGVEPGEEAELARVTEEAREACKSKRSAGPLPDEADHPSQFIRDIARDVRSKRKMVKVSSLVRRNRVKKGKLVVLDEEGEASESEDDQEEDKESGDEEDFDDEEEEEIGGVPSHERRTQAVE

SEQ ID NO: 169398 - protein, 78 aa, Triticum aestivum
  Clone ID: PAT_TA_63816.pep
LRFRFSNIMLIALLVAQYALLGSGLLQKYVFSIMLQCSLVVCMAAFIRGVIKHYKLTTYVFIFHRMIGNIWNKQFLSN

SEQ ID NO: 169399 - protein, 81 aa, Triticum aestivum
  Clone ID: PAT_TA_63817.pep
EQEPLVGPPPQNRRKVLIVSSAQYRSQSCDWLLSWSREVKLGWSRPSINPQVYNGQYLMSIWFYIASKGKGFSWISVWVVL

SEQ ID NO: 169400 - protein, 112 aa, Triticum aestivum
  Clone ID: PAT_TA_63818.pep
LVVGQARRAQRRGQVDPLARLRHDAIRARPPPRRRRPERARSLACFGRRALPGGVEWGDLCRARAEPRGVAMGDCGLGAGLPATPTSAARKRKRKRQARRQPRSPLHHECGV

SEQ ID NO: 169401 - protein, 124 aa, Triticum aestivum
  Clone ID: PAT_TA_63819.pep
MVHILHKHSRKRVSSAHPPGPAGHPILGNLLYVIGPLRNNPHTTLAYLAQTYGPILSLRLGLTRTIVVVSSAAAAHEALAKNDTALASRLVPDTVRAMSYGTTSMVLPSSSNPLWKQDRAIMGA

SEQ ID NO: 169402 - protein, 80 aa, Triticum aestivum
  Clone ID: PAT_TA_63820.pep
GMSVSLDSGQHKGNFDPTLLMRQITYKIALSLYTSSHSRTSLLLFVHRDNVQSTSTATLFPPPPILVLTSSSSMCNPGES

SEQ ID NO: 169403 - protein, 43 aa, Triticum aestivum
  Clone ID: PAT_TA_63821.pep
TITSRTKRCTVQRHWKHSDIKLKDDKTLLYGEKPVTDFGVRNP

SEQ ID NO: 169404 - protein, 119 aa, Triticum aestivum
  Clone ID: PAT_TA_63822.pep
LIRLMDSCLGYTYVMSTPNTCTSDMKIVDSTDTELKGYRKSPSWRRSACTKNMASGLSEAHKLISYRGHWNSIILLFSDGLINKGDYFDGAKDFVSKVPVHTFTLGGDANNHVLHAMAK

SEQ ID NO: 169405 - protein, 126 aa, Triticum aestivum
  Clone ID: PAT_TA_63823.pep
HASAPVEDEGAEMEGDQGQSAPGLSEAKDGPEEMEEQQEESAQDMSEAEEMKERQEHSGQDMSEAEDEPAEVEEHQEHSAVEMSEAEDEPAGVEEQQEESGLGMSEDAGDPAEMKGHQGQSAEDMP

SEQ ID NO: 169406 - protein, 118 aa, Triticum aestivum
  Clone ID: PAT_TA_63824.pep
FSRPVLFVLAAGYLPFNDASLINMYRKIYAGRFRCPNWFSPALRHLLRRILDPNPGTRIDTDGIMEHPWFRHGASGDGELEKLMRGHEEEAWFETEFKEDMVRDMTAFDMLAFSPGSD

SEQ ID NO: 169407 - protein, 133 aa, Triticum aestivum
  unsure (1)..(133): unsure at all Xaa locations
  Clone ID: PAT_TA_63825.pep
PRVRDERLLVYEYMKNGALYDHLHPKGGGADADAASPVVSSWKLRIKILLDASRGIEYLHSYAVPPIIHRDIKSSNILLDGGWVARVSDFGLSLMGPPETEGXGGAXAPEQHLSMKAVGTVGYMDPEYYGLHH

SEQ ID NO: 169408 - protein, 43 aa, Triticum aestivum
  Clone ID: PAT_TA_63826.pep
MAAAPATTAEVVPRMKLGSQGLEVAALGLGCMGMFAYYGPAKP

SEQ ID NO: 169409 - protein, 39 aa, Triticum aestivum
  Clone ID: PAT_TA_63827.pep
MKLMGSRRSGGGLSRSLKEHMARLYIIQRCVVMLLCWHD

SEQ ID NO: 169410 - protein, 128 aa, Triticum aestivum
  Clone ID: PAT_TA_63828.pep
FLRTRGEMARDIAQKLGFSEQCIEDAKDTIQKLYTIFREKDSTQIEINPLSETSDHQVLCMDAKFGFDDNAEFRQKEIFEWRDTTQEDPDEVRAAQSNLNFIKLGGDIGCLVNGAGLAMATMDIIKIN

SEQ ID NO: 169411 - protein, 161 aa, Triticum aestivum
  Clone ID: PAT_TA_63829.pep
MAMPNTNSMLSFSCIAYAAIVVLALGSRTCSCLQFTYPNFNAINMDDFTFSPGSTIADGALQITPSTGNMRHRSGRVVYARETLKLWNNKRMAPTSFRTDFLLNIQPGQNGAGEGMAFVLTNNPSLPSNSNGQWLGICNDTTDGTNTDPVVAVEFDTRKSY

SEQ ID NO: 169412 - protein, 115 aa, Triticum aestivum
  Clone ID: PAT_TA_63830.pep
LLIPATTHDFPAPRSGAPPPTSVGHRRAAHPKPPAPRLHPPPPAAAPRSPHCRLPSAGPPPIPTRRVLPSYSMRRRGPPQPPTGLLPRRCRRPLNRACPPHPPNRAPSPAPTTHA

SEQ ID NO: 169413 - protein, 29 aa, Triticum aestivum
  Clone ID: PAT_TA_63831.pep
SPGPARQDHGGPRRRRAPRPEGLLADHLC

SEQ ID NO: 169414 - protein, 68 aa, Triticum aestivum
  Clone ID: PAT_TA_63832.pep
MPCGRWWEQAGRGRARTPSRAAPAAADAASRSSARSCRRWERESGRPRHVRRKQSSARDSPLVRVGEQ

SEQ ID NO: 169415 - protein, 112 aa, Triticum aestivum
  Clone ID: PAT_TA_63833.pep
SHASDSLSPSTVRRGDRAGDFVSSGEPCSLSSSRWPLCCWRWEGGRLAGRILVQVGCLGVGVAYLASSSVPAGWRWWRGHLRLGSASAAASLRRLRRCGRLQVTCFRVRWIE

SEQ ID NO: 169416 - protein, 67 aa, Triticum aestivum
  Clone ID: PAT_TA_63834.pep
PGASFAISFQQVIQSEEEGAPAPWPKPTTGFRSADLVRRAVGGAGVLWSARRRLRPMEEGYRQPRSG

SEQ ID NO: 169417 - protein, 51 aa, Triticum aestivum
  Clone ID: PAT_TA_63835.pep
YQLHRLRRPIRAPPPAGSSGRGRKGRASLRAATAPDPQPPRSRSRSHASEA

SEQ ID NO: 169418 - protein, 93 aa, Triticum aestivum
  Clone ID: PAT_TA_63836.pep
SPTLSRGSCISVNRRVWSAARRRHGRGRLIPPPPPLPSSIPGTTYLYLQVSDPHHHTSGPISEGKGREQELERRGGDGGGRRSRPAGILQRAH

SEQ ID NO: 169419 - protein, 35 aa, Triticum aestivum
  Clone ID: PAT_TA_63837.pep
MEGKEEDARPGANRNSEREPIGTEAQGADDKDYKE

SEQ ID NO: 169420 - protein, 173 aa, Triticum aestivum
  Clone ID: PAT_TA_63838.pep
LFFGDDEDELEEEPSPPTTPMTGSWQSQPEQQVSPILEQTTVEAETVESPPSLEDVFGGLTADELGKESLSPVAEVDFVDASLETLSLVQAVEEAFDSLPPLATTPATIPQAEVEAVAAPAPPVERTHERRAMPREQNPANLSIRVDFQRLERMNNWVGELAINRNSLSLQNQ

SEQ ID NO: 169421 - protein, 114 aa, Triticum aestivum
  Clone ID: PAT_TA_63839.pep
TLKSIDLADASIGRGSLDIWNWAVTLAFPDIIKEGNMAGIIVGMQPWVSSSSIVFPDDIATTDIDSSLHLEGFFQWAVSDNLSITPGIVVVPNADYNNANGTLVMGVIRTTFSF

SEQ ID NO: 169422 - protein, 150 aa, Triticum aestivum
  unsure (1)..(150): unsure at all Xaa locations
  Clone ID: PAT_TA_63840.pep
QTLYIGKFAGXFNSNFSSLSPQWFGASSQAKKVKTLTLQSLIDQEKIDKITCLKLDIEGWEWAVIKQLENIESYLLPAVVMFEYGGGVNRGQNQKGWAPEFFENTLNILKSLKTLGYGSGILLDFAPDCQEITFDLSQLQTSELDKLFPP

SEQ ID NO: 169423 - protein, 158 aa, Triticum aestivum
  Clone ID: PAT_TA_63841.pep
RKVDCYHQVYRLVGNDGGIEQLLRRAEEDITKALVNEARTECDRYVRESPRFYDEGTFSIYQFRQTLQQTSQGYDAQAIVEAEPAIKELLKLDFEPKVFNTVRKNFRQTVNNTLKTHLLPMAEEQAQIILEQYDVARKYREQTLEQDAEEKIARNSRL

SEQ ID NO: 169424 - protein, 144 aa, Triticum aestivum
  Clone ID: PAT_TA_63842.pep
FKKYLRYWSSGFLPQPAIFVKNEMADQCFPLSVELYYAMDFQFFLRVLNQEPKSVWIQEKLTRLRWHEDSKTMGTISRIDFHAIVPEPEVHKVALAEAENLPTWLEKIFFRIQAFDYLSLQPYINSLDNFHWLQITKTIVKRPT

SEQ ID NO: 169425 - protein, 146 aa, Triticum aestivum
  Clone ID: PAT_TA_63843.pep
DVHLDQTRSIYHWLHQRLRKLLPPPQCQFLTDSEPLGRSLQDYLGQPFTVMPIPHTDFAEVVPLFTEADPILCWWPGAPREEKGWSVMRHLVSLPRPNSPRLQLIAAAASGLKSDREGIEVHLIGDRLTREEYAGWLNKAQIILLP

SEQ ID NO: 169426 - protein, 135 aa, Triticum aestivum
  Clone ID: PAT_TA_63844.pep
GLMIGNSRLHWAYCSGNAPLQTWVTDYNPKSAQLPVLLGKVPLMLASVVPEQTEVWRVYQPKILTLKNLPLVNLYPSFGIDRALAGLGTGLTYGFPCLVVDGGTALTITGFDQDKKLVGGAILPGLGLQLATLGD

SEQ ID NO: 169427 - protein, 87 aa, Triticum aestivum
  Clone ID: PAT_TA_63845.pep
ADCLHHAQAAIVMVGTDTEQFVGLGKPELSFPGQGPQYNPYFVRRQTWLLGESLMLLNSPDQTGEALQQVLHDVERLEAIVCNGRQR

SEQ ID NO: 169428 - protein, 81 aa, Triticum aestivum
  Clone ID: PAT_TA_63846.pep
MSVNSIHLVGRAGRDPEVKYFESGNVVCNFTLAVNRRTSKKDEPPDWFDLEIWGKTAEIAGNYVKKGSLIGIQGSLKFDHW

SEQ ID NO: 169429 - protein, 46 aa, Triticum aestivum
  Clone ID: PAT_TA_63847.pep
LGGLFTSTALTLLVLPALYAQFGRFLRPSASVTTPASTPINVLTKV

SEQ ID NO: 169430 - protein, 53 aa, Triticum aestivum
  Clone ID: PAT_TA_63848.pep
VQREKPQSLGRWQFVVRTGILVATFILALGSLASPSLALDYNRGNLVGADFSH

SEQ ID NO: 169431 - protein, 40 aa, Triticum aestivum
  Clone ID: PAT_TA_63849.pep
ITAFMVQLNARIKAAIPNILVSVCPATYNLAYNTFLQDWL

SEQ ID NO: 169432 - protein, 76 aa, Triticum aestivum
  Clone ID: PAT_TA_63850.pep
IFGPDLEQLRTLGKSVETAMADIPGLVDLQLEPQVPVRQVQIQFDRLAAGRYGLTVGQLSELVETALNGRVASQIL

SEQ ID NO: 169433 - protein, 107 aa, Triticum aestivum
  Clone ID: PAT_TA_63851.pep
KKGGTTTIKCREPHLYSCLLDIKVYSFFFGLNETRNMLKFIGIALLAALVGYAFGVMAGIFIVNNFSTNVQDKPLELAMTSIFFFGPLGALIGFTIAVVNQLLHQYL

SEQ ID NO: 169434 - protein, 122 aa, Triticum aestivum
  Clone ID: PAT_TA_63852.pep
PKLAMVLGSYLLVLLLRIYLPLQFTWPFNWGLIFGSSGLFFLQGLYIFDLPQWPFRAMGSSLPELGNSLPGTGLLNPFFASALIPIVLLLLLLGNPSGKQWSLGVCFGVTVFLLISAFLGTP

SEQ ID NO: 169435 - protein, 119 aa, Triticum aestivum
  Clone ID: PAT_TA_63853.pep
MHIPAYGPMPVLTYKAQLETLLAAGQWYRDSRGSNQFEGQPQMLSCGLPLPNLGAIKAQFLATGGQPADFEEHYHRRSQREVLQNFGRQRANRYPRQQFTHFIITGDPQHNTIHDLGWV

SEQ ID NO: 169436 - protein, 106 aa, Triticum aestivum
  Clone ID: PAT_TA_63854.pep
PDIVLVGELRDLETIALAITAAETGHLVFGTLHTNSAAGTIDRMLDVFPANQQAQIRAMLSNSLLAVFAQNLVKKKSPKPGEFGRALVQEIMVITPAIANLIREGK

SEQ ID NO: 169437 - protein, 107 aa, Triticum aestivum
  unsure (1)..(107): unsure at all Xaa locations
  Clone ID: PAT_TA_63855.pep
SAAVYLGFXTQTQGISLEAQAQRAIPLATALDNGRPTLVEFYADWCTSCQAMAPDLAELKKNYGGSVNFAMLNVDNNKWLPEVLRYRVDGIPHFVYLDDTGTAIAVT

SEQ ID NO: 169438 - protein, 53 aa, Triticum aestivum
  Clone ID: PAT_TA_63856.pep
TWISRCLRVFDTVEATPTPVLNTLFLAALVMLVLVSGGILYLTTLEWRDRRRQ

SEQ ID NO: 169439 - protein, 111 aa, Triticum aestivum
  unsure (1)..(111): unsure at all Xaa locations
  Clone ID: PAT_TA_63857.pep
GGLLACDRWGVGRLAXSAQIMHRLQALLFTGGQEDLRGKRILITAGGTQEYLDAVRFIGNPSTGKMGLALAQSAGDRGARVTLIHGPIGDLPIPMGVISMAVVNAEQMEQA

SEQ ID NO: 169440 - protein, 157 aa, Triticum aestivum
  Clone ID: PAT_TA_63858.pep
IKNTLFSPFGLGRSKLSSLTMPWVTYTDPEIAHVGLNETMAEALDIGYKIIKIPFSQVDRAIAADETEGFLKIIHVANSDEILGATIVASHAGEMISEITTAIVNKIGLSKLAGVIHPYPTQAEAIKKAADTYRRTLLTNNTKNLLKLLTKFPSKLF

SEQ ID NO: 169441 - protein, 59 aa, Triticum aestivum
  Clone ID: PAT_TA_63859.pep
QQALAGLEERTRRIVEFVFLHDFTHKEAAEMMGVSVITVSRRIKQGIGALKKALNTEIF

SEQ ID NO: 169442 - protein, 72 aa, Triticum aestivum
  Clone ID: PAT_TA_63860.pep
MNSSLYHGEKIRHWFPNSSLDFVSSLHAMLDNLSKWFRNLPIPNFSNNSLFLRGVSKVPNSPQFNDPIQNLA

SEQ ID NO: 169443 - protein, 132 aa, Triticum aestivum
  unsure (1)..(132): unsure at all Xaa locations
  Clone ID: PAT_TA_63861.pep
GYQRVLAWSLAHRWWIVALALVSLMAGLAIIPLIPQGFVPTLDRGEFNVIFQSAPPKIAGALSTPPRGNNNDTSAGGAFGWIDQLATNPEAVLLRRGXRRVAEQLNPPILADQAVTETFTVVGIQGNPLQGK

SEQ ID NO: 169444 - protein, 149 aa, Triticum aestivum
  unsure (1)..(149): unsure at all Xaa locations
  Clone ID: PAT_TA_63862.pep
SLSLQNQQLQTAVGALGQRFGTFQTMALKLRQLADQLAIRPQGEAMLRAQPRSQGWLEHNFDALEMDSYGTLSAQLQEILEEIMQLEXSVDDVVLLSRPAHQTVHVQKQMVFSLRDELMWARMLPLGEILQRFPRLHRPMASQFNKPVQ

SEQ ID NO: 169445 - protein, 158 aa, Triticum aestivum
  Clone ID: PAT_TA_63863.pep
LSSGNLEDYGPIAGSFQPVLGATEPEDGNLSNSVLYYTFPATENIRLWAMGAGGAFDDFTNTVNVLDGDGAFGALTTFGTRSPIYFLGEGTGAALQGTWDKLQLSLGYLAPAGNDPSQGEGLFNGSFGTIAQVNYDFSDNLTVAVTYSYGYNTLDTST

SEQ ID NO: 169446 - protein, 84 aa, Triticum aestivum
  Clone ID: PAT_TA_63864.pep
ILSGIISELQRSTTSKVPILGDLPVIGALFRQSTDTTDRSEVIILMTPKIIHDSTEAQFGFRYNPDAATAEFLRQKGFPVQAQP

SEQ ID NO: 169447 - protein, 122 aa, Triticum aestivum
  Clone ID: PAT_TA_63865.pep
AFKIMDDRFGALTFTRIYSGTLSKGDTILNTATGKTERIGRLVEMHADSREEIESAQAGDIVAIVGMKNVQTGHTLCDPKNPATLEPMVFPDPVISIAIKPKKKGMDEKLGMALSKMVQEDP

SEQ ID NO: 169448 - protein, 150 aa, Triticum aestivum
  Clone ID: PAT_TA_63866.pep
VDQVKAFIQGGYPLTQAGDGGDTALHIACLEGYQSMVTILLEKGPKDMVNAVNQAGDTALHLAIAQGHVEIVTQLLNAGADGNFSSNGDPPLLTALTATHGNAQTQAVMVNALGRAGVDLDQTLWEGKTPLMLAAMANHAAVITSIANYS

SEQ ID NO: 169449 - protein, 71 aa, Triticum aestivum
  unsure (1)..(71): unsure at all Xaa locations
  Clone ID: PAT_TA_63867.pep
DRDGKXILIEQMEALMDRFTIFMKRFELSDDFMAKMTVEQMKTQLGQFGISPQQMFDQMNLTLERMKAEIK

SEQ ID NO: 169450 - protein, 69 aa, Triticum aestivum
  Clone ID: PAT_TA_63868.pep
LSNSLKKITRGFENKTDSSNVVKKHLWQLTKHPKVQVRKYLVIRIRIRLQTQLGESSVHPTKIPGYRAR

SEQ ID NO: 169451 - protein, 66 aa, Triticum aestivum
  Clone ID: PAT_TA_63869.pep
SLVVDWQAQSLVWAEIDQKLADSSIHQQLAAMAQAYRRHHSLESYATTLQEIWLSRHNADMEVNNM

SEQ ID NO: 169452 - protein, 49 aa, Triticum aestivum
  Clone ID: PAT_TA_63870.pep
GAGQWFSFLLFRRRELCSVQTYFLFYSTRSTSVKSQGKLPKIMGKSQQG

SEQ ID NO: 169453 - protein, 117 aa, Triticum aestivum
  Clone ID: PAT_TA_63871.pep
SSVPGDPAKETWTGIRYGVEGVQSSFGSDIAYPIGELDEHLPKYLEKADKIHYHLGRDEALNQTILKHWQKQLAAYPRQGYGPQALVNSHPLVHPLRQVKSETELALLRRACDLSAI

SEQ ID NO: 169454 - protein, 51 aa, Triticum aestivum
  Clone ID: PAT_TA_63872.pep
LLHSPDQSGEALQQVLHDVEGLEAIACNGRERLGQAGSARRIAEILRDQWC

SEQ ID NO: 169455 - protein, 74 aa, Triticum aestivum
  Clone ID: PAT_TA_63873.pep
MVAQTPSSPPLWLTIIYLLRWHKPAGRLILMIPALWAVCLAAQGLPPLPLLGTIALGTLATSGLGCVVNDPWDR

SEQ ID NO: 169456 - protein, 136 aa, Triticum aestivum
  Clone ID: PAT_TA_63874.pep
SSVPGDRSGEGIRLNNIALLYDSVGEKDEALTYYKEALKISQETGDRLVEGAILSNIGYVYDGLGELNQAMDYYQQALVLRREIKDRDGEALTLNNIGTIYYAREDYDQALNYYEQALSLSRAVKNVGLEATILSN

SEQ ID NO: 169457 - protein, 98 aa, Triticum aestivum
  Clone ID: PAT_TA_63875.pep
SSVPGDLSGANLAKADLRQASLIKTFLLKVNLQGAHLNNALCAGALLTRANLEDACLHGALLTGADLTGAKLSKAKYNQQTQFEAGFRPENFGLIKET

SEQ ID NO: 169458 - protein, 93 aa, Triticum aestivum
  Clone ID: PAT_TA_63876.pep
MVDSLATVWLIGGTVDSRAVAEGLIAQGINCLVTVTTSEAKHLYPIHQCLTVHVGALTPQEIPKFLKRHSIAVNVDASHPFAAQITTTVTAIL

SEQ ID NO: 169459 - protein, 159 aa, Triticum aestivum
  Clone ID: PAT_TA_63877.pep
EFFDPVSAATFPEHKLRFRNDRLLPMLGLEPSQVKDDNFVEAFGLFHGVRPFLALRYHGYQFGEYNPNLGDGRGFLYGQVRGVNGELFDFGTKGSGQTPYSRGGDGRLTLKGGVREVLAAEALHRLGVTTSRCLSLVETGDSLWRGDEPSPTRASVMIL

SEQ ID NO: 169460 - protein, 116 aa, Triticum aestivum
  Clone ID: PAT_TA_63878.pep
RIAIVLVLLIAVVLLRGNQFPLMVTQYSWRNTNIGAQTQALTMTFNHPVDPDVMESGLVIDPPLAGKTIWQGRRWFYTLTDIPRYGTNYQLTLPLPAMVRGPRGQDFTSLIPGYRA

SEQ ID NO: 169461 - protein, 87 aa, Triticum aestivum
  Clone ID: PAT_TA_63879.pep
SVQLQQAKVGLSTRAAENLTIAEVSEPEMVLKILKASARSVPNDSLNYYGAGHVNAGEAVKQAQQGEISFRDFMRWLRDNGYLNPIF

SEQ ID NO: 169462 - protein, 119 aa, Triticum aestivum
  Clone ID: PAT_TA_63880.pep
VCLHGFEITPHAGDRSQIARWHIVEAIRSGFTTGSAIAEKLGCSRRNVTDVLTNGGATLTKVTKALLDTTELGSSSYKSPIRLGSHLEDLPSEILALLGINLPEAIAEVVEIIQAVGGD

SEQ ID NO: 169463 - protein, 52 aa, Triticum aestivum
  Clone ID: PAT_TA_63881.pep
AKLGMQTMEQGLATLVVSGVISLEEGLAKSGKPDELQRLIGGMTPQVAAKRR

SEQ ID NO: 169464 - protein, 70 aa, Triticum aestivum
  unsure (1)..(70): unsure at all Xaa locations
  Clone ID: PAT_TA_63882.pep
RARYPGITTAGDQLKVQFHTQSVHQANPVRALGELLMFQPQTGCLSLNWEMTXKNLFQLLGGKLIVRRRS

SEQ ID NO: 169465 - protein, 134 aa, Triticum aestivum
  Clone ID: PAT_TA_63883.pep
CRSTLEDHRDSYEDLVHFVEIVANAGCQRFTVHARKAWLQGLSPKENRTIPPLRYEDVYQLKKDFPQLLIEINGGITQTEQIQQHLSHVDAVMVGRAAYENPYLFATVDRDIYHKTNLVPSRAEIIERMLPYVE

SEQ ID NO: 169466 - protein, 155 aa, Triticum aestivum
  Clone ID: PAT_TA_63884.pep
QVETPESVELEFTLAGIGNRLYAVLIDYVCLGSVVLILLIIWAVLAYNLSLYASGEWQLWLTAIQIFLIFAVYVGYFVFFETLWQGQTPGKRRAKIRVIRGDGRPVGLQEASLRALFRPIDDFLYIGALLIIFGRREKRIGDLLAGTLVIRQSRD

SEQ ID NO: 169467 - protein, 79 aa, Triticum aestivum
  Clone ID: PAT_TA_63885.pep
SAEFAPEAEGLNVWLLTGVNGAGITTTIGKLAFMAKQSGYDCVIAAADTFRAAAVEQVKVWGERSGVPVIANPGQNTDP

SEQ ID NO: 169468 - protein, 35 aa, Triticum aestivum
  Clone ID: PAT_TA_63886.pep
TWTAKIAKQDLPDSLPLAPVPDLIAQVSKQKRPHQ

SEQ ID NO: 169469 - protein, 137 aa, Triticum aestivum
  Clone ID: PAT_TA_63887.pep
AGQCVNVEHFRPVIGITPGELNFLGLKPTENQVVIANVRDLDGFAIAVFSRDSIADMIFQVVEADVPVLGRLGIHSQVRMRLKPGHQVLLHHQWPYEAVPYKIVDELFFSIHGVGSGQAIGRINYNPELLLSVLDGS

SEQ ID NO: 169470 - protein, 127 aa, Triticum aestivum
  Clone ID: PAT_TA_63888.pep
SLPIVITSLWNLFFVRVLPTNRENYIFRHQRLNLSQLIALTLLTLLLSLGFAQAQSAQTLLSQLPPQIDLVDPVKSDFPLQNKAFNLGFESDLSGRIGNLDYTTVRVDGEPIFLIAVPTGNASKEGD

SEQ ID NO: 169471 - protein, 46 aa, Triticum aestivum
  Clone ID: PAT_TA_63889.pep
SAGYLHNLKLDYAEDLMGGGFRFTNPNAAQVCSCSLSFAPNLEKNL

SEQ ID NO: 169472 - protein, 62 aa, Triticum aestivum
  Clone ID: PAT_TA_63890.pep
IMRTSLVVCITLKNQPLNALTPWVNGGEVPNFRLADYRGLEAFLLGCSEQPGGDRQCRMGGY

SEQ ID NO: 169473 - protein, 98 aa, Triticum aestivum
  Clone ID: PAT_TA_63891.pep
VSEIESIVAQTQISYQQITLEVTESLMLYEPGETINRLNQLNEMGIQIAIDDFGVGYSSLSYLKDLPLQTLKIHKSFLDDLLTREKNQVILQSIIELG

SEQ ID NO: 169474 - protein, 96 aa, Triticum aestivum
  unsure (1)..(96): unsure at all Xaa locations
  Clone ID: PAT_TA_63892.pep
SSVPGDLWTMPAEMEAAEITYEWLNFSAQPSSLEQMATFSNALAVPYQNLEVSALSTNPLLAFSPELLERCPFLAPLDIATVXNQYKQLWQTMRSA

SEQ ID NO: 169475 - protein, 76 aa, Triticum aestivum
  Clone ID: PAT_TA_63893.pep
SINIGNARSVHLQEDLGLTGVQYNTASTVFFVPYCIFEIPSNIFLKRFSPRIWLSMCGLRFGAVTVFMGLCQNFSG

SEQ ID NO: 169476 - protein, 64 aa, Triticum aestivum
  Clone ID: PAT_TA_63894.pep
SLTVDSSLLCCLAIPFVWSLLFDFRPDDNSIKSALACIDAPLILSDGNQLLLISTDLNFLSLTS

SEQ ID NO: 169477 - protein, 95 aa, Triticum aestivum
  Clone ID: PAT_TA_63895.pep
MRFPILVFVWAAAVLLAVAAFSAVADASPRPSKSLKVGFYKHTCPQAEYIVRDAVRRAVSRNPCLAGGIIRMHFHDCFVRGCDGSLLINSTPGNS

SEQ ID NO: 169478 - protein, 101 aa, Triticum aestivum
  Clone ID: PAT_TA_63896.pep
RGRVGEPCSLAAQHPRLLRAPKAATPDAIIPQRSPEQSHPLSLPASPHKREERDQRWAAATATPRTSAPPPTGTPATPLPPLAARAAAAAGSSTGTSRTRR

SEQ ID NO: 169479 - protein, 88 aa, Triticum aestivum
  Clone ID: PAT_TA_63897.pep
SRTRGRVPTSATMGTGTGTALGPAMAAAASSTAHRPGPLPAAATANRSASRPTACAPPGRTLVCSAPRQSEACAARRRDHGPGGGGRG

SEQ ID NO: 169480 - protein, 81 aa, Triticum aestivum
  Clone ID: PAT_TA_63898.pep
CRSQQPALHRGTCCSCSQHSSFPPPAVTGTLRHSAGALILSYASPDRKPRARHNRRPRERTGQNSFPRAEICRPDLTSEGG

SEQ ID NO: 169481 - protein, 116 aa, Triticum aestivum
  Clone ID: PAT_TA_63899.pep
MEGKDSRERISKAEPKHQHSHLEKSDSVPKPAEKPSPVSAEVSGKETPRVQRTKEKGGIAEKEREKKDKEASRRLEEAKERQKILEKERENAEVSERKKLEEEEREREKERVKDKL

SEQ ID NO: 169482 - protein, 128 aa, Triticum aestivum
  unsure (1)..(128): unsure at all Xaa locations
  Clone ID: PAT_TA_63900.pep
VPRPAPPPSSGRARSARPPPATARRARPTXAVTPEAATPSPXTASPPHAHAVPPVARXAPWPRPRPCPPCXPAPPPPPRVQRLPPRGPARPGGHAAPAGRRHDGRGGAGGRRGRLAGLSGGRRAARGG

SEQ ID NO: 169483 - protein, 85 aa, Triticum aestivum
  Clone ID: PAT_TA_63901.pep
MSLRRSSAAALAALLALAVLLGTSADDGGQGQPIVARVSKDASTSLYTIAIKVGGVPLLVDLAGPMLWLANCPTPHRIIPCVSHD

SEQ ID NO: 169484 - protein, 121 aa, Triticum aestivum
  Clone ID: PAT_TA_63902.pep
SAALFHPTTVVLPLLYSPRRRLFAAVGSYISRCVPSAFTFTHTRPGTSQLLRSHLHSSSLAAAHRASVHPWRPCSCSSSSVAYAPYSPWATAARAAPRSAATSTARRPRVTTGSKKPRPAR

SEQ ID NO: 169485 - protein, 112 aa, Triticum aestivum
  Clone ID: PAT_TA_63903.pep
ADAWARWRGSCETNATDFPSSMCNRKLIGARGFFRGFGAGGRNGSSHGTTELSSPRDHDGHGTHTASTAAGAVAADASLLGYAHGTARGMAPGARVAEYKVCWKQGCFRSDI

SEQ ID NO: 169486 - protein, 81 aa, Triticum aestivum
  unsure (1)..(81): unsure at all Xaa locations
  Clone ID: PAT_TA_63904.pep
EFAAFCRVFKDGHGKPFVPMCSDRTKXSLTPGLYTPSFAGFVDTYISSGTISLRSLIDRPAAASSGAGGKTCILSRVYPSM

SEQ ID NO: 169487 - protein, 46 aa, Triticum aestivum
  Clone ID: PAT_TA_63905.pep
SLGSCLALYAVSPKPSYPMHRAGSSRISGGTPSCGGLLLTRRHPPP

SEQ ID NO: 169488 - protein, 100 aa, Triticum aestivum
  Clone ID: PAT_TA_63906.pep
MALVLHSGSGNKNAFKALIAAEYCGVKVELTKNFEMGVSNKTPEFIKMNPLGKVPVLETPDGAAFESNAIARYVARSKGDSLLWGGSLIEYARVEQWMDF

SEQ ID NO: 169489 - protein, 79 aa, Triticum aestivum
  Clone ID: PAT_TA_63907.pep
MASVGTHAAGAGEQTPLKKAGEAEQDEELQAPSGWTKKLNSTRGGKPEDASCAPTGEEVKTKRALTTYLKAHPGGPALS

SEQ ID NO: 169490 - protein, 104 aa, Triticum aestivum
  Clone ID: PAT_TA_63908.pep
TIPIHRHLTNRITHHSPSESNHGTAALRLHTWPRGQPTPTTSVADRSIGPAQPILTSSYSSSSAGFSLSLLTLSSHGCTSTGYGNEASLLLVGLAQQLLIFSPA

SEQ ID NO: 169491 - protein, 103 aa, Triticum aestivum
  Clone ID: PAT_TA_63909.pep
RETDFARFPDSAPIVIDNGASTFRIGWAGEAEPRVSFRNIVQRPRHRSSGETVTVVGDTDPALMKYFDCTRTSIRLAFDDDVVYQFEYMEYILDYAFDRFGAT

SEQ ID NO: 169492 - protein, 101 aa, Triticum aestivum
  Clone ID: PAT_TA_63910.pep
PSPLPSGSLLYPSLHDVLPSSSYPPPGTTGSLFPSSNFGPNSSYPPPSAPATAYPPPPPSCTACPAPPAQYISSYPPSLPSYYPPPPPSGYPPSARMNPEF

SEQ ID NO: 169493 - protein, 104 aa, Triticum aestivum
  Clone ID: PAT_TA_63911.pep
YGRGITVVERAMAKRNGSPVISDFEIGVEEFHSEGRSAIKGFNFRDERVMDGNWVHQAHSGVIEMFFRLLAICHTCIPEVDEVTGKISYEAESPDEAAFVVAAH

SEQ ID NO: 169494 - protein, 106 aa, Triticum aestivum
  Clone ID: PAT_TA_63912.pep
KCQANNANAGFNAGYLSGFPESEITAVEDRTLTSGNVPWYSLHKTMAGLLDVWRHIGSEQAKTVLLNMANWADTRTAKLSYAKMQTMMDTEFGGMNDVLTEIYYYT

SEQ ID NO: 169495 - protein, 97 aa, Triticum aestivum
  Clone ID: PAT_TA_63913.pep
STPRRSRGSFAPRKGGNPRKGEGDDATTTSASSRKQSRDFPWGATGGADADAGAGARSGRRLHLPHAAAASRRSRVQLRPPPPQQQGVAVAVALLLP

SEQ ID NO: 169496 - protein, 85 aa, Triticum aestivum
  Clone ID: PAT_TA_63914.pep
MPLFVLAETPAGYGLFKAKDKKLLSRDDITKSLDGADAINSALSLKKMIKFEDSAQALGEYSSLCEGKVTPMLQQLLDDIKEERK

SEQ ID NO: 169497 - protein, 73 aa, Triticum aestivum
  Clone ID: PAT_TA_63915.pep
TKAPKVSIRFVGTELGVKPAPAVAYFSARGPTQMSPAILKPDIVAPGVDILAAWVPNKEIMEIGKQKLYAKYM

SEQ ID NO: 169498 - protein, 33 aa, Triticum aestivum
  Clone ID: PAT_TA_63916.pep
LCYDPLNRTHSLRVITTTYISIKEEVLVYEVNC

SEQ ID NO: 169499 - protein, 113 aa, Triticum aestivum
  Clone ID: PAT_TA_63917.pep
DKFAKIWDMQTKTCVQTFGEFKSSVISVVSHPSLPVLIIGTRDGAIHLWGTNFRYKRQLSIGGPGGANGLTCLTALGRVVMGNESALFMMEILDEEPDAPVGSEEAVGSSGSN

SEQ ID NO: 169500 - protein, 64 aa, Triticum aestivum
  Clone ID: PAT_TA_63918.pep
MAEEEGTQQLPFVRETVLKKRKDNEEWATKNRERKAAKRKRRRHDAEGAIKRAEDFEREFRNKE

SEQ ID NO: 169501 - protein, 90 aa, Triticum aestivum
  unsure (1)..(90): unsure at all Xaa locations
  Clone ID: PAT_TA_63919.pep
LAPKPXAEDTTAEAQDHDENYDIEEQPTDGDGEEKPSGGGSEYVSQLFAALWGLASKLGKGPLHYVMRPIAFAVKAPRKMLTVVPGMSGM

SEQ ID NO: 169502 - protein, 61 aa, Triticum aestivum
  Clone ID: PAT_TA_63920.pep
CRYQRTAAAAVAVNATTAIAIGFLFFSGKLLSPEIHRWTVIWWRLLLVRLVQTKSFCFKFM

SEQ ID NO: 169503 - protein, 89 aa, Triticum aestivum
  Clone ID: PAT_TA_63921.pep
IRSRSPSAALTAKFAIMSVPVPRIAEDMMPWSLFTHRWISRQSSLFCLTVSAACLIASARRRISVGMPTTSAILAGSWPPERTGHADDD

SEQ ID NO: 169504 - protein, 85 aa, Triticum aestivum
  Clone ID: PAT_TA_63922.pep
RWELVYMGSLNGTFLNSQAVTHRDVGSSRWSAPPELADGDIITLGSSSKVSVQISLQNQQVPVGVGMVSDTMITRRPGKKLPMED

SEQ ID NO: 169505 - protein, 65 aa, Triticum aestivum
  Clone ID: PAT_TA_63923.pep
VPRPRPQHPRLSRPSCPSPIPFPLTAASRFRGLRPFRNLRSLVCESLQDLSTTGNSLLHPSVGTW

SEQ ID NO: 169506 - protein, 90 aa, Triticum aestivum
  unsure (1)..(90): unsure at all Xaa locations
  Clone ID: PAT_TA_63924.pep
TREEGDAEWVISRVIDLQNLLPPAALVDAEAEVMVLGFAEGVNVIFVNTVAGLFTIELQSERVKKVCDNXAFCNLIPVVSFCTPVDRLKY

SEQ ID NO: 169507 - protein, 95 aa, Triticum aestivum
  Clone ID: PAT_TA_63925.pep
THRAQAVGTVAAPALASEQLRLRRLPQLLRPRLAPEEREPAAALVALPLHGPRAEFSTSTTPNRPVAAMDRDLPDHAPPSHIPSSPLELRRCFRL

SEQ ID NO: 169508 - protein, 99 aa, Triticum aestivum
  Clone ID: PAT_TA_63926.pep
HTHSLHVPCVLSRQLGMIINETLRLYPPAVATIRRAKADVRLSDGCMIPRDMELLIPIMAIHHDARHWGQDAAQFNPARFAGGAARAAKHPLAFIPFGL

SEQ ID NO: 169509 - protein, 57 aa, Triticum aestivum
  Clone ID: PAT_TA_63927.pep
NYTSGTTSAPKGVVHCHRGIFVVTMDSLVSWSVPEQSTYLWTLPMFHANGWSFPWGM

SEQ ID NO: 169510 - protein, 37 aa, Triticum aestivum
  Clone ID: PAT_TA_63928.pep
GTQNNWCGFPWFALIAKYFHFILGVQVIKCCMPIICV

SEQ ID NO: 169511 - protein, 87 aa, Triticum aestivum
  Clone ID: PAT_TA_63929.pep
SSTPGKFVRCKERFVISDDWTITPASTSLIHRFSSESEAAFPGFEEVEVRVSWPKVISMLKASLSSDTIFTDIFLPMGTGGQDARAT

SEQ ID NO: 169512 - protein, 45 aa, Triticum aestivum
  Clone ID: PAT_TA_63930.pep
MSCGSDGCRDGGSGGGSEGFGRSRPSKVAADDSVEPARCSDATSP

SEQ ID NO: 169513 - protein, 57 aa, Triticum aestivum
  Clone ID: PAT_TA_63931.pep
RRRGPCQRPYPRRGRSKMRNTQRKPSILNFDAGCGSSLSFIVIGLVGCTLIVCLFFI

SEQ ID NO: 169514 - protein, 108 aa, Triticum aestivum
  Clone ID: PAT_TA_63932.pep
KPEYTDLLFYKLKHHPAQIEAAAIMEHILEGSSYMALAKKLGELDPLMKPKQDRYALRTSPQWLGPQIEVIRAATKSIEREINSVNDNPLIDVSRGKAIHGGNFQGTP

SEQ ID NO: 169515 - protein, 66 aa, Triticum aestivum
  Clone ID: PAT_TA_63933.pep
KAPSAGRTLAFSSSGSAKERRRQIERARHELVRHAVVHRAEEPGGLARLAHGLGGPGARARVVGVS

SEQ ID NO: 169516 - protein, 43 aa, Triticum aestivum
  Clone ID: PAT_TA_63934.pep
TVRVKPNNRSSYKSCLMLLSWPKNILIAQCVMHYVSTMPICSI

SEQ ID NO: 169517 - protein, 100 aa, Triticum aestivum
  Clone ID: PAT_TA_63935.pep
PAAISSLFSLSAQRSPARPASSRSDISLHIVLQHSSSNPLSSRCLTYNSLPSSRFSSAKHLHRLFRLLSFPLSASSLVQLSSASGFHLLFRLIHQPRIIF

SEQ ID NO: 169518 - protein, 89 aa, Triticum aestivum
  unsure (1)..(89): unsure at all Xaa locations
  Clone ID: PAT_TA_63936.pep
DPCPHRRPPPAGALHRPPPQPPPPCSSSPPPXPAXAPPASSSSPLSSGRSSRASAPPRHRRRRARRSPPPRASPPGRPRRPRRPPCRAG

SEQ ID NO: 169519 - protein, 106 aa, Triticum aestivum
  Clone ID: PAT_TA_63937.pep
VGVAEACFWQWPAWRHVFRGRYGRRNRISSIVSEEMFSSLFLHKDDTACPASGFYNYSSFVSAAEWFPEFGSGAHHVDWDTRKREVAAFLAQISHETTGGWATAPD

SEQ ID NO: 169520 - protein, 96 aa, Triticum aestivum
  Clone ID: PAT_TA_63938.pep
MFDDHGAKLVKSLRGAAQKYVGVGFFLGFFLVLLTYFTLSEQFAIAAPNAIRRTSAAHPTPTAPAVAEKTVQQQQQLPVKKEEAPLPEHEQVQEKP

SEQ ID NO: 169521 - protein, 54 aa, Triticum aestivum
  Clone ID: PAT_TA_63939.pep
KHGSCFLGSHLERVVKPNVKLLAECGLGACDIAKLFIQIPMIFTASPERALEMV

SEQ ID NO: 169522 - protein, 101 aa, Triticum aestivum
  unsure (1)..(101): unsure at all Xaa locations
  Clone ID: PAT_TA_63940.pep
PLLRQLLLLFGXISEDVLSGVLSGCHVLANLYLSEIREVGSLRICSPTLRIIVITCLFEGKGELVIMEAPRLERLLLRPPVLGSEIIRVVKAPKLEMLGLL

SEQ ID NO: 169523 - protein, 88 aa, Triticum aestivum
  Clone ID: PAT_TA_63941.pep
SDPRSWGVLVNSFAMLDEDYVSAFISFYQPDARAWLVGPLFLAAGDVPDRVGEQDPEGCLAWLDQMAERSESVIYVSFGTQAHISDEQ

SEQ ID NO: 169524 - protein, 95 aa, Triticum aestivum
  Clone ID: PAT_TA_63942.pep
GYVSNYALARLPIHLSWRVMLGIGAVPSALLALMVFGMPESPRWLVMKGRLSDARAVLAKTSDTPEEAVERLDQIKAAAGIPRDLDGDVVVMPKT

SEQ ID NO: 169525 - protein, 73 aa, Triticum aestivum
  Clone ID: PAT_TA_63943.pep
LGPATANGSGAFLTEVGINDTILLGYDSNHAFARLTMHLIWRVMLGIGASPDDLLALMQLGMPKWPRWLGIKG

SEQ ID NO: 169526 - protein, 75 aa, Triticum aestivum
  Clone ID: PAT_TA_63944.pep
LSFYFLRLLICCHRTGDWAAATGFVGAPGGQGYGRSRSGQGRRSSQGAQMSRRAGRTGGSGEPPGRLGSRRRPVT

SEQ ID NO: 169527 - protein, 106 aa, Triticum aestivum
  unsure (1)..(106): unsure at all Xaa locations
  Clone ID: PAT_TA_63945.pep
KFFWGLGFGVPGXIMLLALLVFLLGTRTYRFYDSGGGEGDSAFSRVGKAMKAWRKRSPEGDCAEDAVLMEEVRGLARLFPIWATCLLYGVVFAQPPTLXTKQAATL

SEQ ID NO: 169528 - protein, 118 aa, Triticum aestivum
  Clone ID: PAT_TA_63946.pep
NNPVVAGDAGTYYSGTSSSPIRPVAGDQSSAQEDGWVICRVFKKKNILVNQGQNGGGGAASSKLAGAAPMERSQSNCSSTVTTISNHIKAAQQQDQQHQLLHYSASDDALDHILNHYM

SEQ ID NO: 169529 - protein, 56 aa, Triticum aestivum
  Clone ID: PAT_TA_63947.pep
WPHTPAAEITTRHTDTINWTYCHSLLYLRKLSQPLMTNTERKPRKKIHNHFRNLYF

SEQ ID NO: 169530 - protein, 39 aa, Triticum aestivum
  Clone ID: PAT_TA_63948.pep
WCTRTRSGPSSAIHVLRSSGRCPDPGKSWPEADWRLVSA

SEQ ID NO: 169531 - protein, 73 aa, Triticum aestivum
  Clone ID: PAT_TA_63949.pep
MMSCSCGSGCSCGSDCKCGMMYPDLEEQGSTTAQVAAVVVLGVAPENKAGLFEMTAGESGEGCSCGANCNCNP

SEQ ID NO: 169532 - protein, 30 aa, Triticum aestivum
  Clone ID: PAT_TA_63950.pep
DSWVDAWADAWADAWADAWADAWADAWPKL

SEQ ID NO: 169533 - protein, 92 aa, Triticum aestivum
  Clone ID: PAT_TA_63951.pep
GFFFFLLVLIFFDWPIFYNILIGWLLFFLNLFFFDHFLTLSFCLYWTRFLFYRLFFYNGTLIWILGRLPFLLFFSSFFLFRLYIPLTCLRPT

SEQ ID NO: 169534 - protein, 116 aa, Triticum aestivum
  Clone ID: PAT_TA_63952.pep
RLSVSAATPPPAPAPAPGGRTNPDHGAPDPRVRIADVCGEDTGAYGHVARGGSGMFQARGKAPRGRSSVPPVVRAREARFQGGGALAIHPHRDCCGPDKVRPKAHTVSVSRTDRID

SEQ ID NO: 169535 - protein, 80 aa, Triticum aestivum
  Clone ID: PAT_TA_63953.pep
MAPTVMGSKDTYDAPFQGLKSTDGLPVRRRSNGASLGSVSNGGRIRCMQVWPMEGIKKFETLSYLTPLSTEALLKQVEYL

SEQ ID NO: 169536 - protein, 69 aa, Triticum aestivum
  Clone ID: PAT_TA_63954.pep
SIPNGQHRPATQRSPKFTSYHKVQSALITITLITITSKARAAKGTQGSCLQEQQTSGSPPQENLHSKHA

SEQ ID NO: 169537 - protein, 59 aa, Triticum aestivum
  unsure (1)..(59): unsure at all Xaa locations
  Clone ID: PAT_TA_63955.pep
MAETEYRCFMGGLAWATDHNNLQXAFSQYGEILDAKIINHRXTARSRGFGFFTLGIEET

SEQ ID NO: 169538 - protein, 73 aa, Triticum aestivum
  Clone ID: PAT_TA_63956.pep
QSSAQKLKSSIPVALFFCVSIGVTQSSPLMVRDHQLSKLPSNIIYVCGKFACSSLDYDDVPLELAMHTKVEKL

SEQ ID NO: 169539 - protein, 98 aa, Triticum aestivum
  unsure (1)..(98): unsure at all Xaa locations
  Clone ID: PAT_TA_63957.pep
KKGAPRRLPIGFCGFAVNSTMLRDPQRXNRPTMDSAIVQSGGRGGLXESRFDLMFGKNERKIKSLTDNXXRIMVWNFPLEPPQLKYPCPMATEAPPCT

SEQ ID NO: 169540 - protein, 46 aa, Triticum aestivum
  Clone ID: PAT_TA_63958.pep
KFLCFSNEECYRGINPGRGGGLTGSLGPFCLHSRVFWQGENYHLEG

SEQ ID NO: 169541 - protein, 69 aa, Triticum aestivum
  Clone ID: PAT_TA_63959.pep
CHCGFVNSDIALGFPSSFICVACSYFYAYVHVDVTTCIEKACSNANAMGGYVYAHAHHIFIQCVGYVFG

SEQ ID NO: 169542 - protein, 71 aa, Triticum aestivum
  Clone ID: PAT_TA_63960.pep
GLCTVQVNHGVTVVGYGETSAAGDEGSGKYWIIKNSWGAGWGEAGYMRLQRDAGMPTGLCGVSLLASYPVM

SEQ ID NO: 169543 - protein, 30 aa, Triticum aestivum
  Clone ID: PAT_TA_63961.pep
AKILHTNVKSYSLSSSTQYNLKTQIIEKID

SEQ ID NO: 169544 - protein, 127 aa, Triticum aestivum
  unsure (1)..(127): unsure at all Xaa locations
  Clone ID: PAT_TA_63962.pep
GAVPAVFGADTLACDEGMRQAIEVMNGQDLDGRNITRNEAHTHRSRGSGGRFSGGSGGSYSGHRSEGSGGGYCGSSCSYRGGRLRGXGGYGSHEGRCGYGGYARRYSGRRXGAGGGNWRERMVGPLA

SEQ ID NO: 169545 - protein, 124 aa, Triticum aestivum
  Clone ID: PAT_TA_63963.pep
ADHPAWTDRRLVTTRRRASGALSVDPLDSAPHRPLHLALHVVHLVVQQPFLPVQLHVRLVGLARGRGRALVVLQCLEAGGVAPQVERAAAGAAPGGFGGGVVVGPLGLDGAVEERLVGDRVEGA

SEQ ID NO: 169546 - protein, 58 aa, Triticum aestivum
  Clone ID: PAT_TA_63964.pep
GRSLAEGGVARRKTTLTLNRYFQIWGSLVISSSFTWSEIIPQRQINRNGGSTSVCFSY

SEQ ID NO: 169547 - protein, 115 aa, Triticum aestivum
  Clone ID: PAT_TA_63965.pep
MNILNQPISPGGAHAAFPAAAAAKDGGMPASLRFDVGPSTAHRAPRRQTQTLLRASSSSYVGAGHADEAAVIKSAEQQKGAVVPPFQPVTLNFLRSLLDRDSMTSIAEEGGEGAG

SEQ ID NO: 169548 - protein, 60 aa, Triticum aestivum
  Clone ID: PAT_TA_63966.pep
FTTQFIKQSIPPPDASIHYIIHEVMTQIVTQTVVSRQVSRLISVIKTVYHSRFPSRLNMA

SEQ ID NO: 169549 - protein, 61 aa, Triticum aestivum
  Clone ID: PAT_TA_63967.pep
HNEFIWYYYKPHPPITLVQQAKIFIFMGKEGLHSVAYVVGSFFNLFSLTCYFFIIFILYTH

SEQ ID NO: 169550 - protein, 79 aa, Triticum aestivum
  Clone ID: PAT_TA_63968.pep
MTALDFMPAEKAPQAGTVAIDNNAAGAAVPVQQQHRRLEGKVAIVTGGARGIGEAIVRAFVRHGARVVIADIDDAAGEA

SEQ ID NO: 169551 - protein, 90 aa, Triticum aestivum
  Clone ID: PAT_TA_63969.pep
VLNDLWCLNKMECLILKKTYNKCTRLLKPALDSHICSRGRLYLSQKKKKWTLVQDSLLLPLELIPGAAHQHPHLADLLDGAFSFRGRQRR

SEQ ID NO: 169552 - protein, 87 aa, Triticum aestivum
  Clone ID: PAT_TA_63970.pep
SSLGAVGHCSDDSPLSASVTTASIGALRSPRALRPLVLLPLPPRTLRGLSYPRAAFSLVPPTAPAGPSPRTAQRSSPAAPRSPHNSP

SEQ ID NO: 169553 - protein, 153 aa, Triticum aestivum
  unsure (1)..(153): unsure at all Xaa locations
  Clone ID: PAT_TA_63971.pep
AGRGWRQNPXAARHRHDRQRPEHALENPHGLGSPRRPVPRGRLLQRVSRRGARRGRQQRRGRETENGVHGRHGRHGRRQPRPFALGVDRGVGHCISGRRELPAVPRDVRRELPAVPRSGRRELPAVLRSGRREQPAVPRGGRRCSLPRPRMCA

SEQ ID NO: 169554 - protein, 154 aa, Triticum aestivum
  unsure (1)..(154): unsure at all Xaa locations
  Clone ID: PAT_TA_63972.pep
LLLTSKTNLQRSINDQDARPLRRRRRHHLFHHKEGEDFQPAADGGVDTYGYSTETVVTATGNDGEYERITKEEKHHKHKEHLGEMGAAAAGAFALYEKHEAKKDPEHAHKHKIEEEGAAAAAVGAGGFVFHEHHEKKQDHXEAKEASGEKKHHH

SEQ ID NO: 169555 - protein, 90 aa, Triticum aestivum
  Clone ID: PAT_TA_63973.pep
PRVRPRVRPRVRLGAADAHYASSFRGSCDEKVAAVRPVPFSEDAVVFELRDGRLAELRRAAEGRGGWEWARIIGTPASACMTSYWTAVAT

SEQ ID NO: 169556 - protein, 76 aa, Triticum aestivum
  Clone ID: PAT_TA_63974.pep
KKREKPAQGSAPGKSRVCLASQAIAPATCLILGKSPKHTSCPRSANDRLKCGTHTPRSEAYEPAFSITQTYDTDHA

SEQ ID NO: 169557 - protein, 113 aa, Triticum aestivum
  Clone ID: PAT_TA_63975.pep
EGRWRRQSKLVCAWAASPRHGTDDGRRQRRPPCRRAASGEATSEPPSCQWCGGENCAPHARWPNMMPACVADRGAPTEGGAMLTLCGRRRCTQPCLRKPWVPPQHIRMQGEKV

SEQ ID NO: 169558 - protein, 33 aa, Triticum aestivum
  Clone ID: PAT_TA_63976.pep
RVEQNRVRLKIHRNVLTCTAFGNSGSTHFEFCR

SEQ ID NO: 169559 - protein, 138 aa, Triticum aestivum
  Clone ID: PAT_TA_63977.pep
MASKGLLVFALLLAASILVASTEQTQAKKEEKKAGVEGYPGGGGGGYPDHAGGGGGGGYPGHGGGGGGGGYPGHGGGGGGGYPGHGGGGGGGYPGHGGGGGGGYPGHGGGGGGGYPGGGGGGYPGHGGGGGGGYPGHR

SEQ ID NO: 169560 - protein, 83 aa, Triticum aestivum
  Clone ID: PAT_TA_63978.pep
RKNKKERPEKRGPGFLRGHRTLARWRLGYQPFVGGPPDLHRGHWEHPDSPNFGVSTLIWLGPMALFPGARSDRRSVRPPFLNV

SEQ ID NO: 169561 - protein, 88 aa, Triticum aestivum
  Clone ID: PAT_TA_63979.pep
YAWAGRSRGFGFVTFGSEESMRQAIEEMNGKELDGRNITVNEAQSRRSGGGGGGGGGYSGQRVGGGGYGGGGRYGGRGSYRCERRLLM

SEQ ID NO: 169562 - protein, 43 aa, Triticum aestivum
  Clone ID: PAT_TA_63980.pep
PTRPPTRPPTRPPTRPGKGPFENLQQHLADPWHNTIIQTISGQ

SEQ ID NO: 169563 - protein, 125 aa, Triticum aestivum
  unsure (1)..(125): unsure at all Xaa locations
  Clone ID: PAT_TA_63981.pep
PCRCPRRPSXSSSPVADVASCVSRQQRDPAVLAPCSDDCSSVAAARRLAGPAHRLAVAARRSSSPAGPARRLDGCSKNQLLKKLVPNLLQAVPAKSNARCSKIKTWFQQKAQITAQKKMPRHRTS

SEQ ID NO: 169564 - protein, 68 aa, Triticum aestivum
  Clone ID: PAT_TA_63982.pep
QLLQASESEVQIQHDSIREGRGSNSKHPPLLCRAQFIHHVTDKQIQPQSGTTRPTRRQPLRTRGRTRG

SEQ ID NO: 169565 - protein, 37 aa, Triticum aestivum
  Clone ID: PAT_TA_63983.pep
KGPFFFHLFVLYFFYDYFISIIFFFIFFFFFFFFFFF

SEQ ID NO: 169566 - protein, 39 aa, Triticum aestivum
  Clone ID: PAT_TA_63984.pep
FYRENEKMSCVRPDYMSSQEDINEKMRSSGSTPVTLMKN

SEQ ID NO: 169567 - protein, 75 aa, Triticum aestivum
  unsure (1)..(75): unsure at all Xaa locations
  Clone ID: PAT_TA_63985.pep
FMKPHXXSSXXRXLHXHLHFHLHGWVHPTIRLTTTSAATAGSCRGMSAMFRPTTLAVLSWWGPNPIHDGALALVV

SEQ ID NO: 169568 - protein, 49 aa, Triticum aestivum
  Clone ID: PAT_TA_63986.pep
PSSWGRMIVNLTTRVRSTSGTNFWNSHEGCFFYINKTVGASAHGVSFFF

SEQ ID NO: 169569 - protein, 100 aa, Triticum aestivum
  unsure (1)..(100): unsure at all Xaa locations
  Clone ID: PAT_TA_63987.pep
SSYPPPPPXTCPPPRAPSRGPRSCAPRSSPRPPAPARPARPPPRPPPARPPSPSPSSSSSRRSGPGPPLSCPRXPPPPPAAPLRPRTRRVGRPGIRVGPA

SEQ ID NO: 169570 - protein, 83 aa, Triticum aestivum
  Clone ID: PAT_TA_63988.pep
PRRPGGASRLPMRVTAPAPVLLQRMLSVFEEEQEDAPLCHLMLLRDITCGMRSSPASKQVHLPRNSYAALLGVKLCRVSLAGG

SEQ ID NO: 169571 - protein, 87 aa, Triticum aestivum
  Clone ID: PAT_TA_63989.pep
IVPLRASWYPLLVNIVRRLLRSVSGNSIQDHITYLGVSMHAEAWSSCRIVMDYAELRYKMDLHGNVVLSKQHQQPGLSDERRRHSAQ

SEQ ID NO: 169572 - protein, 133 aa, Triticum aestivum
  unsure (1)..(133): unsure at all Xaa locations
  Clone ID: PAT_TA_63990.pep
GGPYFPRPARPEHAQSILXFWACQVVLMGAVEGYRVAGGPLGEIVDPLYPGGSFDPLGLAVDPEAFAELKVKEIKNGRLATFSMFGFFVQAIFTGKGPLENLFVHLVDPSNNNDWAFFTNFFSWQVSCGQLNL

SEQ ID NO: 169573 - protein, 55 aa, Triticum aestivum
  unsure (1)..(55): unsure at all Xaa locations
  Clone ID: PAT_TA_63991.pep
LLLVITWLSHFVHMEVDLSLXIEDLVSSIISSGGDRTFSLLGLGHHILLEDMTRM

SEQ ID NO: 169574 - protein, 156 aa, Triticum aestivum
  Clone ID: PAT_TA_63992.pep
MAAKQPLADVEDGLLAHLNANAEIPDSRYFASSLGVPHKDVEDVIKRLSAFRIVESADITKETWMLTDEAKGYAARGSPEVQLVAAIPPEGASKGALKERLGDAFDIGMKAAAKNKWIGFEKGNKDLVLRKVEDTKDELQEQLKRLENWEVFADKV

SEQ ID NO: 169575 - protein, 43 aa, Triticum aestivum
  unsure (1)..(43): unsure at all Xaa locations
  Clone ID: PAT_TA_63993.pep
SFRVPLLAVLPVXGGESALPRTGRVGGSKGGRVENPGIPVQSL

SEQ ID NO: 169576 - protein, 62 aa, Triticum aestivum
  Clone ID: PAT_TA_63994.pep
RMYSLIRRSPRAVSNPAHALDVAVGEHPLGDRAGGGSPVGNHLSFAAAVTALAAGSAGGPGP

SEQ ID NO: 169577 - protein, 56 aa, Triticum aestivum
  Clone ID: PAT_TA_63995.pep
HPTLFHIKIKKTTYEIQIIHRITSGLHNKSSQEYISLHRNIEGAEGICNKTIMDVV

SEQ ID NO: 169578 - protein, 59 aa, Triticum aestivum
  unsure (1)..(59): unsure at all Xaa locations
  Clone ID: PAT_TA_63996.pep
YGLFIFFFFFFQSKIKLYIVRKALVQKQAKTIHCNITNTIARSWHVLIKQYAMRDHXXC

SEQ ID NO: 169579 - protein, 110 aa, Triticum aestivum
  Clone ID: PAT_TA_63997.pep
ERSSPESEKGREREDAKLGAGGDHGATGRAARARASGETPRLARVGTGRQPEHHGHALPESTPSTTWMTQGSAISSSWCTSPPTINRLSSINFVRQLQSKCCSTYTFFFF

SEQ ID NO: 169580 - protein, 49 aa, Triticum aestivum
  Clone ID: PAT_TA_63998.pep
TYVVCKHVRYSVMKTLLLHCSACLNNGAISIWAEVTQKCPSSHQFTESS

SEQ ID NO: 169581 - protein, 103 aa, Triticum aestivum
  Clone ID: PAT_TA_63999.pep
MGEQAAAVSSCETPAPAEVGTGVGQRSLPTPFLNKTYQLVDDPAVDDVISWSEDGSAFIVWRPAEFARDLLPKYFKHNNFFSFVRQLNTYGFRKMVPDRWEFA

SEQ ID NO: 169582 - protein, 77 aa, Triticum aestivum
  Clone ID: PAT_TA_64000.pep
GERARLRAWRAKWAMPVLRFFHLFFIFYTSFLVGCVPGSLSIECVHFYLFELSMNNLFSDGIFPFSFLAKVKKKKYK

SEQ ID NO: 169583 - protein, 71 aa, Triticum aestivum
  Clone ID: PAT_TA_64001.pep
GNPCGRALASLAFYRPMRSQQHILSVTYYSLLSVLLFRDVYLRTSFFICRTFRVPVKTGIKMNNLVVERIK

SEQ ID NO: 169584 - protein, 103 aa, Triticum aestivum
  Clone ID: PAT_TA_64002.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYRFGG

SEQ ID NO: 169585 - protein, 101 aa, Triticum aestivum
  Clone ID: PAT_TA_64003.pep
GAVLILHQDGTPITAEKIATVVKAAGINVEAYWPALFAKLLEKRSVHDLILSVGSGGGGAPAAAAAAPAAGGAAAAAEKKEQKKDEAYEESDDDMGSSLFD

SEQ ID NO: 169586 - protein, 54 aa, Triticum aestivum
  Clone ID: PAT_TA_64004.pep
RHPVVFSGVLSNDCAVDQTDKHSICEDSFESATYVSISDMAMNGARLGCSKRQL

SEQ ID NO: 169587 - protein, 31 aa, Triticum aestivum
  Clone ID: PAT_TA_64005.pep
RTVLCHGIHHNGDLSPPGKKLSHHRGVPAGV

SEQ ID NO: 169588 - protein, 75 aa, Triticum aestivum
  Clone ID: PAT_TA_64006.pep
RGVVAQALWLVLVFEVRSADTLSLEPAAPRQCHRVLVLTDTANHAGFLNKKKKLGSGFRWIHAPIGLHRHALRLL

SEQ ID NO: 169589 - protein, 27 aa, Triticum aestivum
  Clone ID: PAT_TA_64007.pep
KLTNEDIKWFHYSLSVTTSKRGISSFS

SEQ ID NO: 169590 - protein, 48 aa, Triticum aestivum
  Clone ID: PAT_TA_64008.pep
FRCRPKFEKAISASLPNDLHLFHMRFSTAVFRSNFFAAAFKNPHNRTK

SEQ ID NO: 169591 - protein, 83 aa, Triticum aestivum
  Clone ID: PAT_TA_64009.pep
SDAEHPSIIPMDSTATHPTPQGPMTRARARALETEVTSLLSQFPFDSHETWLLPQMETLCILRYQGVHREEARKQGEPEAEDM

SEQ ID NO: 169592 - protein, 101 aa, Triticum aestivum
  Clone ID: PAT_TA_64010.pep
DISMALLAARIVVVVSGLVMMMMMMACLLAPAGADECMDLCLHDCAVKGKNLTQEQCQYACNYGCPFGAAQHALSNAPAIARNGGKTVHVLIHVLAATMWL

SEQ ID NO: 169593 - protein, 93 aa, Triticum aestivum
  Clone ID: PAT_TA_64011.pep
GLHPLRGHFYISHCSSLPPNNYIYRPPDMCARRRLPSAGHVGAWRVHGALRGQGVQSCPTRFKRHPPPSPSPTSLRSQSLLSPPSHRAGRRAP

SEQ ID NO: 169594 - protein, 139 aa, Triticum aestivum
  Clone ID: PAT_TA_64012.pep
NLTDFGVAYAVRRVVRAAAEGIARCPGCKTSLITFLRTYSPDHFEQGSWFDGGYCNRTAPLQEREVSMESIAWELRRVQREEMRRVRATKRRFGVLDVTKAMMMRADRHPDNHFDSRWRRNGSDCLHWCLPGPVDMWNG

SEQ ID NO: 169595 - protein, 72 aa, Triticum aestivum
  Clone ID: PAT_TA_64013.pep
PQYTMLGSRQVLPVPPLSKGAANQWSCVAPFISLTALPAPCFPWSSKRVAASSRTSSRMLFRLGVLPLRFGS

SEQ ID NO: 169596 - protein, 47 aa, Triticum aestivum
  Clone ID: PAT_TA_64014.pep
QIKYGSFKVAPSRPSVVRRPGKPRGCHHVGRPSHVGTRFFFFLSSPF

SEQ ID NO: 169597 - protein, 51 aa, Triticum aestivum
  unsure (1)..(51): unsure at all Xaa locations
  Clone ID: PAT_TA_64015.pep
WTALQRSDCENHGVTQVKHLAAHTCLVSWRNSXEGRTDRPSKQIGKLNGEW

SEQ ID NO: 169598 - protein, 50 aa, Triticum aestivum
  Clone ID: PAT_TA_64016.pep
GASALCSLCLAHAHRGHHTIQIRRSSYHDVIRVSDIQRFMEIAADAVGLH

SEQ ID NO: 169599 - protein, 97 aa, Triticum aestivum
  Clone ID: PAT_TA_64017.pep
IAEVHVRGGLILPLLLLDPLARGGSDGVSSVCFNIMQYSVLTQYLMPSGSVRGLVCPHGICSFGRMSLLVLLWTLCTVMSGSIPSHGLYWLSAPVDF

SEQ ID NO: 169600 - protein, 161 aa, Triticum aestivum
  unsure (1)..(161): unsure at all Xaa locations
  Clone ID: PAT_TA_64018.pep
LPLGQHSQQPFFQPQEPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPILRXLFQLAQGLGIIQPQQPAQLEGI

SEQ ID NO: 169601 - protein, 69 aa, Triticum aestivum
  Clone ID: PAT_TA_64019.pep
IYIYVGLQINRSRRRSGSIIRVEDAEGAGEVTGDGHDGSRRCHTCRSSWARRTRSQASRRKSNWSHPPS

SEQ ID NO: 169602 - protein, 51 aa, Triticum aestivum
  Clone ID: PAT_TA_64020.pep
RSKALSLFFALVSPKLRTTQVSFESALEQIVELANSRSTMLSSFSQIKRRS

SEQ ID NO: 169603 - protein, 83 aa, Triticum aestivum
  unsure (1)..(83): unsure at all Xaa locations
  Clone ID: PAT_TA_64021.pep
KDKEHAKEAXPAKEKKDKKEKKEKSKEKKEXKVGEVTDTAKLRAKLEKIDVKIDDLKAKKQEIVARLLELEGKAAEAAAPASG

SEQ ID NO: 169604 - protein, 168 aa, Triticum aestivum
  unsure (1)..(168): unsure at all Xaa locations
  Clone ID: PAT_TA_64022.pep
DETCWSDYVFCKETGNMYCCSKIMAEITAKEEAANRGLDLAVVVPSMTIGPALQQKLNLGIAFINRYLTGAKKTCPNAVAGYTDVRDVARAHVVVYERPDARGRYLCMGAVLHRAHFLQLLRDLFPQYPITDKREDDGKPMAKPYRFSXQRLRDLGLEFTPLKRVCTT

SEQ ID NO: 169605 - protein, 43 aa, Triticum aestivum
  Clone ID: PAT_TA_64023.pep
KIPAYLVNISASYMEGEVLELGVRLQKLLVGEGNHGHKLVVVF

SEQ ID NO: 169606 - protein, 76 aa, Triticum aestivum
  Clone ID: PAT_TA_64024.pep
LSLSLSLVSSLSLSVSPSPCGGMDHTALRFSWRLNGYLGLLSIACMLTFSCMGHLSYYIEASRADILSELLQALRA

SEQ ID NO: 169607 - protein, 42 aa, Triticum aestivum
  Clone ID: PAT_TA_64025.pep
VNCETIQIFIYMWSTYLSAPLLNSNILPSGSGSFTYYRHPSS

SEQ ID NO: 169608 - protein, 91 aa, Triticum aestivum
  Clone ID: PAT_TA_64026.pep
MRKEVLLAAMMLALVVAAPGGARAACVVGQLTVCMPAITTGAKPSGACCANLRAQQACFCQYAKDPSLGAYIRSPHARETLVTCGLAVPHS

SEQ ID NO: 169609 - protein, 98 aa, Triticum aestivum
  Clone ID: PAT_TA_64027.pep
METTSDTPRSVVRADGHGGGGGHVLLLAFPAAQGHLNPMLQLGRRLAYHGLRPTLVTTRHLLATVPPPLPPFRVAAISDGFDEGGMAACPDFREYGRR

SEQ ID NO: 169610 - protein, 125 aa, Triticum aestivum
  unsure (1)..(125): unsure at all Xaa locations
  Clone ID: PAT_TA_64028.pep
MATAARSAPGENGNGGGGGVSLEMPEIRYTRLFINGAFVDAVSGKTFETRDPRTGDVIASIAEGDKEDVDLAVKAAREAFDHGKWPRMPGSERGRIMMKYADLVEQHAEELTLLESLDXRKPRMA

SEQ ID NO: 169611 - protein, 78 aa, Triticum aestivum
  Clone ID: PAT_TA_64029.pep
SCAATPSPLHLLPPTCTHEKELDQSRSLNLNQEECPLNMMVCRSRRVASASVDSYLEVPWRKACEDAGAVGGVGLIVG

SEQ ID NO: 169612 - protein, 90 aa, Triticum aestivum
  Clone ID: PAT_TA_64030.pep
LCFLPFNFFFFFFFFELVTIKTYIVDILYNIMRPCIYIATDSIHIRACFLEPCWYMNMDIHIFLGTNKKDKWRRKTQSNVRVDKTAMALY

SEQ ID NO: 169613 - protein, 107 aa, Triticum aestivum
  Clone ID: PAT_TA_64031.pep
CCLRRVSVYYCVWGNAGDYSWQTSSGKLDHGRWRCTLRCWTKDVALGYWGSLMLQEACGGSLTEAYAVTSIRAPTTEYMRASARKTTQTREGRSGARPGTHDLPQIQ

SEQ ID NO: 169614 - protein, 146 aa, Triticum aestivum
  unsure (1)..(146): unsure at all Xaa locations
  Clone ID: PAT_TA_64032.pep
TKKCCWCYSTRSILTSKRPYPNDELVDDVHHVAVAPWAPNANPVTXDWSDEPVLRSGDLCHSTIQLWPSSWELQRFGATLQQVAPWKLCSHSRSWIEILVLDVATLTLDTVFVNLESELTKRVESGEGTFYKDHATSPNGKDVGNM

SEQ ID NO: 169615 - protein, 83 aa, Triticum aestivum
  Clone ID: PAT_TA_64033.pep
WRHGPQRRTPRNASGTMNRTAISGTWAINHTVMALLRGPKKIWRYPGTSGQLKVVQPQSKLGIRSSFSTLVLLQRHGVPQTGE

SEQ ID NO: 169616 - protein, 141 aa, Triticum aestivum
  unsure (1)..(141): unsure at all Xaa locations
  Clone ID: PAT_TA_64034.pep
MLVRLKGPVRMPGESHAYQQGEQWRGMMVDTTILALXDDARAKEKPYIDSKGIYVIRRHVKVNLVRKHCSGANDLGSEDMPGATSHGMRVQAYLXDGYXQDIGTTEAIYKATVGITKKPIPDTRFYDRSAPIYTQSRDLPP

SEQ ID NO: 169617 - protein, 116 aa, Triticum aestivum
  unsure (1)..(116): unsure at all Xaa locations
  Clone ID: PAT_TA_64035.pep
RPDPNDELVDEVHHVAVAPWAPLANPVDMAWSVVPVLRSGDLSHSTIQFSPSXSRSLXSSAGTLQQVAPWKLFSHRLSGIEILVLDVATLPLDTEFVNLESESTKPLESGEGTFYK

SEQ ID NO: 169618 - protein, 72 aa, Triticum aestivum
  Clone ID: PAT_TA_64036.pep
INLAKSNQGAHMVPVSSVARFSCSLKEITAANKFTPGHGLLGSPAINVRIHVSFPCGSQTHSVQLAANIAPI

SEQ ID NO: 169619 - protein, 87 aa, Triticum aestivum
  Clone ID: PAT_TA_64037.pep
CQSLGFDVIISPPPLQATRTSYVRHSAQPGLHLRSVVPPTSSDVRTLLLSSWSPPHSNNDPPGPYSSHLVRPTDVIRGQLNTHRAGY

SEQ ID NO: 169620 - protein, 51 aa, Triticum aestivum
  Clone ID: PAT_TA_64038.pep
WWCIADRQEFVSDTLACNGPWAHWHLGGMHGNDELNGHLPTWVINHTVMAL

SEQ ID NO: 169621 - protein, 72 aa, Triticum aestivum
  Clone ID: PAT_TA_64039.pep
SKKPPLIIRSVTTNPNLDSPSIPQSLVSVCEVNFQFSRVFSEGLYQQRTCIMQFLFALCELDSTRWLLYPSR

SEQ ID NO: 169622 - protein, 60 aa, Triticum aestivum
  Clone ID: PAT_TA_64040.pep
SPVHSTGTTGQSKYKGVGNPGRMSKLQRREHSSQARRWCLGAIKLVSLSLKSNSTHFLKS

SEQ ID NO: 169623 - protein, 171 aa, Triticum aestivum
  Clone ID: PAT_TA_64041.pep
VFSDLFPHLANGKPRKPTDGIALEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPMPGRCHMT

SEQ ID NO: 169624 - protein, 142 aa, Triticum aestivum
  Clone ID: PAT_TA_64042.pep
LATVLSHEIGHAIARHLPEMITKGMWFTILQLIVLQFIYMPDLINAMSTLLLRLPFSRRMEVEADHIGLMLQASAGFDPRTAPKVYEKLGQIAGNQSVLKSYLSTHPSSKKRSELLSRAKVMEEAMQLYREACAGHGTEGFL

SEQ ID NO: 169625 - protein, 164 aa, Triticum aestivum
  Clone ID: PAT_TA_64043.pep
SVFSCLFPHLANGKPRKPTDGIALELTKKCCCCYSTRSILTSKRPDPNDELVDDVHHVAVAPWAPNANPVDMAWSVVPVLRSGDLSHSTIQFSPSSSALQSFAATLQQVAPSKLSSHSRSGIEILVLDVAPLPLDTVFVNLESELTKRLESGEGTFYKDHPTSP

SEQ ID NO: 169626 - protein, 156 aa, Triticum aestivum
  unsure (1)..(156): unsure at all Xaa locations
  Clone ID: PAT_TA_64044.pep
MPTDGIALELSKKCCCCYSRRSILTSKRPDPNDELVYDVHHVAVAPWAPNANPCYMAWPVVPVLRSGDLPHSTIQFSPSXSVLKRSAATLQHVAPSKMLSHSRRGIEILVLDTCSLSLDTEFVNLVSELTKRLESGEGTFYKDHPSSPNANDVGNM

SEQ ID NO: 169627 - protein, 84 aa, Triticum aestivum
  Clone ID: PAT_TA_64045.pep
CSTRSIITYGALAHRQELGDDHHGEMALGPHKANSEDMHWNDELICHLRYLAIQPYSDGPPTGTFKDLALPWNKLTVESCATTA

SEQ ID NO: 169628 - protein, 36 aa, Triticum aestivum
  Clone ID: PAT_TA_64046.pep
PLDHTDPLLSLQTTTRVLACLCSFRLLHLDVFYLSL

SEQ ID NO: 169629 - protein, 109 aa, Triticum aestivum
  Clone ID: PAT_TA_64047.pep
SGCYSYSLGSCPYTIPYMNSDDGLQRLLTVLDFLWCLGILSPRVSVPSRYGSECNSLVVFPFKHIRSQSIHAQLVLFRTKCANCSSMRHCLCHYAPVTSYQGLSQYDLN

SEQ ID NO: 169630 - protein, 108 aa, Triticum aestivum
  Clone ID: PAT_TA_64048.pep
QVRNGTLDIGAPRICLRFVKMEMNVCFKGSSPVLADWAFWSSLCRRGAPRGSMDNSVVVDIDNLLIVDTGRYKPVESPLCCECNNGRGGRGSSVIQSVSTRNAPSVGI

SEQ ID NO: 169631 - protein, 142 aa, Triticum aestivum
  unsure (1)..(142): unsure at all Xaa locations
  Clone ID: PAT_TA_64049.pep
MATPRKASDGIAHEQTKKCCWCYSTRAILTSKRPDPNDELAYYVHHLALAPXAPNANPVYMAWYAVPVLRSGDLSHSTIQISPSSVALQSFNETLPQVAPSXKLCRHRRHEVEILVLDVAPLPLDTEFANLESELTNRLESG

SEQ ID NO: 169632 - protein, 152 aa, Triticum aestivum
  unsure (1)..(152): unsure at all Xaa locations
  Clone ID: PAT_TA_64050.pep
PPFPDLANGKPRKPTDGIAHELTTNCCCCYSTRSIVTSKRPDPNDELVDDVHHVAGAPWAPNANPVDMAWAVVPVLRSGDLSHSTMQXSPSSPALXSFGATLQQVAPSKLFSHSPSGIEILVLDVGPLPLDTVLVNLESELTKLLESGEGTF

SEQ ID NO: 169633 - protein, 60 aa, Triticum aestivum
  Clone ID: PAT_TA_64051.pep
EKVAVSRSSDRKNHIKSSKGAGICKDNHEFLLAIVDGQKPLALECSKQVHQLLKESASAR

SEQ ID NO: 169634 - protein, 70 aa, Triticum aestivum
  Clone ID: PAT_TA_64052.pep
CSGITLASIRPFKELQELADGTLSGMCGFHGERLPAGPTAVAVRSAVPIYQTVRNQYTSLCTCWSTLCWA

SEQ ID NO: 169635 - protein, 74 aa, Triticum aestivum
  Clone ID: PAT_TA_64053.pep
FVRISRAFAHLHNWEELFLLFGNSKTFTRLFLLMQLTSPRVGYLNLSLREPLFYFSLKHIPTQSLSDHLGLSSP

SEQ ID NO: 169636 - protein, 48 aa, Triticum aestivum
  Clone ID: PAT_TA_64054.pep
MTRGIEMLLVDVAPLPLDTELFNLQSELTKRIESFEGTFYKDHTTSPN

SEQ ID NO: 169637 - protein, 71 aa, Triticum aestivum
  Clone ID: PAT_TA_64055.pep
RPIPDLSDGTARKPTDCVAHEHTKKCCCCYAPGSIVTSKRPYCMDVIVDNVHHVTWRAYRAPNANLCRLGL

SEQ ID NO: 169638 - protein, 51 aa, Triticum aestivum
  Clone ID: PAT_TA_64056.pep
HFIPELNLTKTYQTLTGCMRVEGKARVGCCDNCCHLARQLRGFKRVNKMHV

SEQ ID NO: 169639 - protein, 45 aa, Triticum aestivum
  Clone ID: PAT_TA_64057.pep
GYDSSIIGHGYIMVSSRAGSPVSRPVVRVVDTGVIAFALCVACSG

SEQ ID NO: 169640 - protein, 112 aa, Triticum aestivum
  Clone ID: PAT_TA_64058.pep
ARLSAKGPPAAGSWLVSVALTRRARCACTNRTSARISSLAMRTSPYRRGSQRAIMAPVERTGPRQGHRPSSLVPIRSWSLPCRAAAHIQCLVMRTDARRLRAGARTRSGIRP

SEQ ID NO: 169641 - protein, 91 aa, Triticum aestivum
  Clone ID: PAT_TA_64059.pep
MVAWCESTHCGTGSLKQSHVGGDCIRGTMEQLSRWWTSKTTLVSRVRALGGENRSRRTAAAAYLGKITVQCRQLALVAYHVIGTAKARSAV

SEQ ID NO: 169642 - protein, 109 aa, Triticum aestivum
  Clone ID: PAT_TA_64060.pep
LRRVHLLQGHVESQELLLGGLQLNGRMVQVYASQYRLIEPDHVDGDRIQGPWRDHNVVVIDDDLVSRIRALGGENRSRSTSAPAYLGKSRELPTVSNSGHKMCKAIQMS

SEQ ID NO: 169643 - protein, 105 aa, Triticum aestivum
  Clone ID: PAT_TA_64061.pep
YILSLKKHVLWAQIISRHLYFHRAKNVTFIIQAQARPKHPQACITIRKNLVDGKHSMHCISYSTWQENLTIKFTHPTEHSIEQHLEILQGPYRSTIISNESQNYN

SEQ ID NO: 169644 - protein, 153 aa, Triticum aestivum
  unsure (1)..(153): unsure at all Xaa locations
  Clone ID: PAT_TA_64062.pep
FSDLFPHLANGKPRKPTDGILHEQTKKCCCCCSTRSILTSKRPDPNDELVDDVHHVAVAPWAPYANPVDMAWSVVPVLLSGDLSHSTIQFSPSSXVLQSFTVTLQQVVPSKLAKHSRSGIEILVLDDAPLPIDTVSVDLESDMTKRLVSGEGT

SEQ ID NO: 169645 - protein, 59 aa, Triticum aestivum
  unsure (1)..(59): unsure at all Xaa locations
  Clone ID: PAT_TA_64063.pep
HMIASNVSQVCEDGDESMLHLLKYCPARLGIWVQSVPPRVTYGVHGESLFXWLYVYHLC

SEQ ID NO: 169646 - protein, 115 aa, Triticum aestivum
  unsure (1)..(115): unsure at all Xaa locations
  Clone ID: PAT_TA_64064.pep
QRGEPRKPTDGIAHEQTKKCCCCYSTRSILTSKRPDPNDELVDEVHHVAVAPWAPNANPVDMAWSDVPVLPSGDLCHSTIQFWPSXWELKRSAGTLQQVAPWKLFSHSLSWIEIL

SEQ ID NO: 169647 - protein, 59 aa, Triticum aestivum
  Clone ID: PAT_TA_64065.pep
VSGKEFVTKVQRSNKHLFISSGIIEDTPASIQFLAHRITESYLIKTVQATKHPLRLCHH

SEQ ID NO: 169648 - protein, 51 aa, Triticum aestivum
  Clone ID: PAT_TA_64066.pep
YDLFPHLANDPNDELVDDVHHVADAPWAPNANPVDMVWTAVPVLRSGDLSH

SEQ ID NO: 169649 - protein, 57 aa, Triticum aestivum
  Clone ID: PAT_TA_64067.pep
LMSRPDEYHIQGVIKISLARSYPVAKVSARNCLILYEAPRPVLLVEHRPSTLQINQT

SEQ ID NO: 169650 - protein, 59 aa, Triticum aestivum
  Clone ID: PAT_TA_64068.pep
ARVCEPLLIIESTPFLFVYKHIRTQRLSAHLVLSSPKNVNYYFVRRCLCGDEHNTLYQV

SEQ ID NO: 169651 - protein, 73 aa, Triticum aestivum
  Clone ID: PAT_TA_64069.pep
VSVELPKDSLSQRSRQTFLAPNRTTRTVWLYGQSLPDSRTGTAFQTIRQRFAFWGSRSLYNLVDLINELVIGI

SEQ ID NO: 169652 - protein, 50 aa, Triticum aestivum
  Clone ID: PAT_TA_64070.pep
LRPVPAPSKEGSARNAQPDRHMLHGGYSPEDACCLLFNVIDSNLKVAHDP

SEQ ID NO: 169653 - protein, 41 aa, Triticum aestivum
  Clone ID: PAT_TA_64071.pep
KKGDHIEGELVSSKTKVSSLIEEKEFLLAIGDGQEPLTLKC

SEQ ID NO: 169654 - protein, 46 aa, Triticum aestivum
  Clone ID: PAT_TA_64072.pep
QEPSSFKSKRLTFVLLLTKLSFLYDTLFFFKHINQVTPTYPSRRKQ

SEQ ID NO: 169655 - protein, 75 aa, Triticum aestivum
  Clone ID: PAT_TA_64073.pep
GNPQLHNREEINSLAQSEKMVFVTDCQHYKALGVQECEDKVCISDGMDYHVRGLLCNVMRKLYVCLKKSALDSLL

SEQ ID NO: 169656 - protein, 50 aa, Triticum aestivum
  Clone ID: PAT_TA_64074.pep
VLQRNAAAAIQRDDYLSANQAAAHVHLIPWPKQPHWLSWRLTALSSLSLL

SEQ ID NO: 169657 - protein, 86 aa, Triticum aestivum
  Clone ID: PAT_TA_64075.pep
TYKEMLLLLFNEIDSNLIAPRCKRQAGRLCAPRCTSPMGSQGEQSRHGHFHWDGTEIRGVAPYHHPDMGLLHCASELCRDPVTCGP

SEQ ID NO: 169658 - protein, 70 aa, Triticum aestivum
  Clone ID: PAT_TA_64076.pep
QLTTVGLTHERPGLWCSCYRSRELFILLSKATTDTRLYVVHQLTSPPGSYLAISCEQALVRCACNRIPAT

SEQ ID NO: 169659 - protein, 82 aa, Triticum aestivum
  Clone ID: PAT_TA_64077.pep
SNLFSDLFPHLANGKPRKPTDGIAHELTKKCCCCYSTRVLPKAPSNAARTCPPRSAPWPNAPLTWLSWRLIRLSSPSSASVA

SEQ ID NO: 169660 - protein, 78 aa, Triticum aestivum
  Clone ID: PAT_TA_64078.pep
FLNAAAAIQRDRFPKRRPSSCTCHTCMPGPSTRTGWPWRSGSHCHHHHLPLSLKSRPARGLNCLQPAMNLSHCSFLTG

SEQ ID NO: 169661 - protein, 71 aa, Triticum aestivum
  Clone ID: PAT_TA_64079.pep
LTRTPTRAVCSSSPSQIARFLKAGKYAVWVGAGAPVYLADVLEYLAAAALELPKIAARDNKMTLIVPSHME

SEQ ID NO: 169662 - protein, 63 aa, Triticum aestivum
  Clone ID: PAT_TA_64080.pep
VFSDLFPHLANGKPRKPTDGIAHEQTKKCCCCYSTRSINLSANQAVSHVTLDPHAQCTRTWLS

SEQ ID NO: 169663 - protein, 88 aa, Triticum aestivum
  unsure (1)..(88): unsure at all Xaa locations
  Clone ID: PAT_TA_64081.pep
ARRLTSKRPDPNDELVDHDHHVAVAPWAPNANPVDMAWSVVPRLRSGDLRHSTIQLWPSSWALHSXDATLDQAAPSKLTSHSRRGIEI

SEQ ID NO: 169664 - protein, 66 aa, Triticum aestivum
  Clone ID: PAT_TA_64082.pep
CIRLTPAWYPRSCTLHGCESCKSSLHVVILPVRHVLRRTRGQVQPSLGALKALSVRDLRHRGRLMR

SEQ ID NO: 169665 - protein, 50 aa, Triticum aestivum
  Clone ID: PAT_TA_64083.pep
SELKEQKQSSGGFGLCRERVVLVSYCRWAKALGFKMFRTGTLVVKEIQIR

SEQ ID NO: 169666 - protein, 77 aa, Triticum aestivum
  Clone ID: PAT_TA_64084.pep
TFALLQFDRSRRTRSEIHPSLAQLKALAVRNLSHRANDGDDSPDQRPRQPVRVALGQGITWWHVQLLDWRLGRYLVE

SEQ ID NO: 169667 - protein, 39 aa, Triticum aestivum
  Clone ID: PAT_TA_64085.pep
MAFGAIDRVHDFIEPGHTIFWLSVLDGGTAARNGGQPIR

SEQ ID NO: 169668 - protein, 50 aa, Triticum aestivum
  Clone ID: PAT_TA_64086.pep
QLTTQGLAFEFPGLWGICYRSQRLLLLLTKLKIVKIVLELHQVTEARGLD

SEQ ID NO: 169669 - protein, 74 aa, Triticum aestivum
  unsure (1)..(74): unsure at all Xaa locations
  Clone ID: PAT_TA_64087.pep
SSKRPDPNDELVDDVHHVAVAPWAPNANPVDMAWSVVPVLRSGDLSHSTIQFWPSSXELKSFAVTLHQGAPWKL

SEQ ID NO: 169670 - protein, 52 aa, Triticum aestivum
  Clone ID: PAT_TA_64088.pep
TPAGEEEAPPHRFGGLSRKSPLVSFRGRGCYMAHVMKSLLAAAGAHATLFNL

SEQ ID NO: 169671 - protein, 47 aa, Triticum aestivum
  Clone ID: PAT_TA_64089.pep
YDLLPNLAKGKPRKPTDGIAYELTKKSRSSKTTRDANAQKRPDTQRR

SEQ ID NO: 169672 - protein, 72 aa, Triticum aestivum
  Clone ID: PAT_TA_64090.pep
RRERRKEDGLGLSDGPGTPPRVMPSGGPSISCTVEATWAFAIRAGRDSQGLVGRRVSSQRVTRQYDLGPIKV

SEQ ID NO: 169673 - protein, 46 aa, Triticum aestivum
  Clone ID: PAT_TA_64091.pep
PSYDYTLNHFNTLETNIYANLNYYYSCSIGTVHARLDQRSSPVDES

SEQ ID NO: 169674 - protein, 71 aa, Triticum aestivum
  Clone ID: PAT_TA_64092.pep
GSCYFKPALHLILQTLFFYRSKPLLTFVLLLPSFTFYIDTLFFLTHHQVTPLVYFRKCTNSNTFVSTSLYH

SEQ ID NO: 169675 - protein, 64 aa, Triticum aestivum
  Clone ID: PAT_TA_64093.pep
TFVFTTYKFYFLYDTLFFFNTSPSYATSLLSKSTNSETICVNYTLPLTIDSTYRLGEEVVGGNC

SEQ ID NO: 169676 - protein, 49 aa, Triticum aestivum
  Clone ID: PAT_TA_64094.pep
NRVTMVFISMTCMGLPIRIHQDNFGSVAWQSYGEPQNSIILTFVSSELM

SEQ ID NO: 169677 - protein, 75 aa, Triticum aestivum
  Clone ID: PAT_TA_64095.pep
ALKDMVLLLFNKSDRDLIARQTERQATLRGPPRYSRAMVPQCQPCEHGLFRCACTAIPRLGHATIQFYLSWRALN

SEQ ID NO: 169678 - protein, 43 aa, Triticum aestivum
  Clone ID: PAT_TA_64096.pep
ASTFLYDNPFFFLNTSTQDKRHLSISQNALNSEPSCVNYTLPL

SEQ ID NO: 169679 - protein, 107 aa, Triticum aestivum
  Clone ID: PAT_TA_64097.pep
TRKHENRCIRCNSRRLPSGMCSLHAVMLEGLRSTFALLQLDRSRRTREQIQPSLAALKALSVRNLRRRGRLMVNDIPISGHDSHVRLLRACALKWWHVRARHGLALR

SEQ ID NO: 169680 - protein, 61 aa, Triticum aestivum
  Clone ID: PAT_TA_64098.pep
HYRVLGFCPSSLDHKNSFSDLQIPTPLLEFLWFTSSLDLEPSTSSDHRNNPFLLFSYTHPS

SEQ ID NO: 169681 - protein, 65 aa, Triticum aestivum
  Clone ID: PAT_TA_64099.pep
QLSLLTFKSGFAIHATDFFCLQIQTFTDFLFLATYLSFPFIMIPFFSLHITQVSAPIYCRKCTDY

SEQ ID NO: 169682 - protein, 79 aa, Triticum aestivum
  Clone ID: PAT_TA_64100.pep
FSDLFPHLANGKPRKPDADMHQEAVCLTRHLPKANPMQLCMPPRACPGPSNPALAVVASAPTVITISCLCALSRDLTGP

SEQ ID NO: 169683 - protein, 68 aa, Triticum aestivum
  Clone ID: PAT_TA_64101.pep
FKSALPSHSTDSFFFNPKPSNFCFYYYLSFPFLYDNLFFLTHHPKIAPPIYCRKALTLTLLCQPNTLH

SEQ ID NO: 169684 - protein, 75 aa, Triticum aestivum
  Clone ID: PAT_TA_64102.pep
LTQESCVFNGHLPKAPIHAVSHVTTACQARCTPHMAVVAADRTVIHIICLCALSCGPAQGLKCTQRGMNLSTCPS

SEQ ID NO: 169685 - protein, 69 aa, Triticum aestivum
  Clone ID: PAT_TA_64103.pep
RIWISLTTNSFNIKAGLASHSYRLFFFQSKPTRLSVLLLTKSLPFYIDNPFFFLNTSPKIAHLSIIKSN

SEQ ID NO: 169686 - protein, 100 aa, Triticum aestivum
  Clone ID: PAT_TA_64104.pep
KAPLHVCILQFNRVRRTRGQINRRWVQLRPWQVRKLRHRGRLMVNDSRISGHDSHVRGAFGPGHAVVTCASCIDWRLGKCPLNTQLLESSKRRLSWLTIC

SEQ ID NO: 169687 - protein, 66 aa, Triticum aestivum
  Clone ID: PAT_TA_64105.pep
GSASSFLVPVRGPSLYGCSPKYRRWPISSSFLVHSSADSLWRPRPIITPVCHHTNSSRSASTTIRL

SEQ ID NO: 169688 - protein, 92 aa, Triticum aestivum
  Clone ID: PAT_TA_64106.pep
LFRRRRFEPPPNQQQSTGGAAMARTKQTGRKFTGGKAPRKQVATKGGRKSGPTTGGVKKPHRYRPGTGALREIRKYQKSTELLIRKLPFQRL

SEQ ID NO: 169689 - protein, 59 aa, Triticum aestivum
  Clone ID: PAT_TA_64107.pep
SEGSTKVTDRLAHGAHQVMLLVMFTGINYNLMGLIAQRQALGRMPPGCTWALGPRRLTA

SEQ ID NO: 169690 - protein, 63 aa, Triticum aestivum
  Clone ID: PAT_TA_64108.pep
RTLYFFCCCLTLTRLCPLNLAYLRYCVVPVFMMGRTRLMMNCKHISAHWVSTHLVLSSSQRAN

SEQ ID NO: 169691 - protein, 48 aa, Triticum aestivum
  Clone ID: PAT_TA_64109.pep
TFSASLAYYTYNPLPFFMIESSPLVHSLYTHPSPKYKRPPRSIYPEKC

SEQ ID NO: 169692 - protein, 163 aa, Triticum aestivum
  Clone ID: PAT_TA_64110.pep
FSDLFPHLANGKPRKPTDGIAHEQTKKCCCCYSTRSILTSKRPDPNDELVDDVHHVAVAPWAPNANPVDMAWSVVPVLRSGDLSHSTIQFSPSSSALQSFAVTLQQVAPSKLSSHSRSGIEILVLDVAPLPLDTVFVNLESELTKRLESGEGTFYKDHPTSPN

SEQ ID NO: 169693 - protein, 188 aa, Triticum aestivum
  unsure (1)..(188): unsure at all Xaa locations
  Clone ID: PAT_TA_64111.pep
MPRLPTVGIAHERTRIWCCCYSSRAILTLLRPDPNDELVYDVHHVAVAPWAHLAIPVDMAWSVVPVXRSGDLSHSTIQFXLSSKALNSSAGTMLQVVPNKLLSHRRSGIEILELLAGSLALDTEFMNLESESAKLLESGYGTFYEGHTSSPNAKDVADMTTSEVLATWLMAIICTLKIVHSAICFTAL

SEQ ID NO: 169694 - protein, 34 aa, Triticum aestivum
  Clone ID: PAT_TA_64112.pep
SGSSISKKETEFFLVTQWAIAVKYPVFRAAALSC

SEQ ID NO: 169695 - protein, 55 aa, Triticum aestivum
  Clone ID: PAT_TA_64113.pep
VRITNPFFFLLKHTPTQSIRAAPIYYLGRKMRTTTTCRHYCCSHKPNTVHQGESA

SEQ ID NO: 169696 - protein, 164 aa, Triticum aestivum
  Clone ID: PAT_TA_64114.pep
SCGNVLGIGACRYGPCKRCPPHSPAVLSIPSPGCRNTVSSERGASSRTRISIPLRLWLDSFQGTTVSQGRAKSLKRPQVGLDLHGRMGLVAGSQNRHNGPVHVDGVLHTGPMAQLQSGGHCSRARHWGLGAMRLESISLNSSSSISLNAHVQSRQLAFLALPSC

SEQ ID NO: 169697 - protein, 111 aa, Triticum aestivum
  unsure (1)..(111): unsure at all Xaa locations
  Clone ID: PAT_TA_64115.pep
PNDKLVCDVHQVANGPWAPNANSGRHAPANDEPELPSADLGYTTIQCWPSSGELKRSAATLQQVAPXSCAHHGLSWIEILVLDVAAVAIDTVSINLESELTKLLESGEVTF

SEQ ID NO: 169698 - protein, 54 aa, Triticum aestivum
  Clone ID: PAT_TA_64116.pep
VSYNIMDSLVKLVVCVKGNNRGSVLDHCRWATAVDFRMLMTETLGVKEIQIRYM

SEQ ID NO: 169699 - protein, 71 aa, Triticum aestivum
  Clone ID: PAT_TA_64117.pep
RLSSHLVLSSPQTATSSYTIHYVSKLPTLTLSTMLNEHKTSHTLSRYIGLERKCRFGNWFTAVRKRRGYLE

SEQ ID NO: 169700 - protein, 108 aa, Triticum aestivum
  unsure (1)..(108): unsure at all Xaa locations
  Clone ID: PAT_TA_64118.pep
MRPHPNDELVHHVHHVAFAPWAPNANPVNMAWNVVPVLRSXTRTIRTIQFSPSSKELQSFPVTLLQEAPXELITHSRSGLEILRLDVAPLALDTVFVNLESESTKRLE

SEQ ID NO: 169701 - protein, 65 aa, Triticum aestivum
  unsure (1)..(65): unsure at all Xaa locations
  Clone ID: PAT_TA_64119.pep
NLTARLLKPQALNSWGHYPLIPIXSWAFGTINRIHDFIEXGLKIFWLSLLDFGTVELMVAHLSNK

SEQ ID NO: 169702 - protein, 58 aa, Triticum aestivum
  Clone ID: PAT_TA_64120.pep
SYSILNLESFTIIEQRINPFFFKLKTHPSLKGQLPLSTMKNENCDQELHYTLCFEAKT

SEQ ID NO: 169703 - protein, 100 aa, Triticum aestivum
  Clone ID: PAT_TA_64121.pep
HYVSSSGAGGLPQLPTVGITHERPGLWCSCYSSRELFILLSPATTDTRLYQVHQLTLAPGAHLAISVDQARFVVPEPHPATLYHAPTQFYLSRKVLTRST

SEQ ID NO: 169704 - protein, 130 aa, Triticum aestivum
  Clone ID: PAT_TA_64122.pep
VFSDLFPHLANGKPRKPTDGIAHEQTKKCCCCYSTRSILTSKRPDPNDELVDDVHHVAVAPWAPNANPVDMAWSVVPVLRSRDLSHSTIQFSPSSSALKSLAGTLHQGAPSKLSSPSRRGIETLVLTVVP

SEQ ID NO: 169705 - protein, 62 aa, Triticum aestivum
  Clone ID: PAT_TA_64123.pep
TMIYSLHVAAAWTTLMSACSANWPRVAPWAIVDMRRSSCIMKNRPPDCVSWEINLSGMKDGH

SEQ ID NO: 169706 - protein, 79 aa, Triticum aestivum
  Clone ID: PAT_TA_64124.pep
PCVCECLFQMGHPEPRFFFVLNSPQIGVQLYAQIAQVANQQIFRNGLVHIDTVALKGHYYASCVVNIYQELVISISALE

SEQ ID NO: 169707 - protein, 95 aa, Triticum aestivum
  Clone ID: PAT_TA_64125.pep
DLFPHLANGKARKPTDGIGHEQTKKCCCCYSTRSILTLKRPDPNDELDYDVHHVVSYAMGPVCEPRIHGLVRCACSVIRLLVPFDHPDLALLFGA

SEQ ID NO: 169708 - protein, 78 aa, Triticum aestivum
  Clone ID: PAT_TA_64126.pep
SLHCPKISPTKIASPAQLERAGGSHPIQRHGLRIALPSHWIGDLHGQTTEKHAIRAHGHDHHNGSILHALQVSTNEAT

SEQ ID NO: 169709 - protein, 104 aa, Triticum aestivum
  unsure (1)..(104): unsure at all Xaa locations
  Clone ID: PAT_TA_64127.pep
HNLVPPSDTRNGSAPTNLFVSQLGNETLIPHSSSSNQLSKESPLMEETTVLSRCQRQXYIXLDNLTNLLHEHLVLTRQGNAMSRNRIQEGIYMAICALIILTLG

SEQ ID NO: 169710 - protein, 57 aa, Triticum aestivum
  Clone ID: PAT_TA_64128.pep
AMGHVRSPRSTQNSLLLLQNPDETLDAQWAYCWLQPRDLLPMSERAPHPFFLLHQPT

SEQ ID NO: 169711 - protein, 68 aa, Triticum aestivum
  Clone ID: PAT_TA_64129.pep
HQRSAGVGPSRVAYKNYCVHIQMTRPLLDFTWLYSVLQAQNATSVYKGRNAVSVLLYRHSNQKTIASI

SEQ ID NO: 169712 - protein, 91 aa, Triticum aestivum
  Clone ID: PAT_TA_64130.pep
TIGKGGTPARTGAGLPGHPLSGFGAAAIQRDRFLPYRAQIPTTSVFTMSTTLQSLHGPPMRTPWTWPGSLLPVLRSQRHSSIRPSSSLPSR

SEQ ID NO: 169713 - protein, 88 aa, Triticum aestivum
  Clone ID: PAT_TA_64131.pep
SQDIPSSGVEDPRKWTGLAVGSPSSSCSYIHTLAGTLSPFVHSGVTSGGQVVSRQRSLCRVNHILVNHGFLQGNQVWVKAPFSHSLSV

SEQ ID NO: 169714 - protein, 61 aa, Triticum aestivum
  Clone ID: PAT_TA_64132.pep
RDRTPNIRGNAGDAIQGDPMLHLSAQMPMTSSDKMFTTQQARQWPLMGTASTWTSPLCKNC

SEQ ID NO: 169715 - protein, 92 aa, Triticum aestivum
  Clone ID: PAT_TA_64133.pep
PLISLFTSTSDNYGSFWALGSSGEDSMAKDELIARLRSVGVPPDPSISPRRDRRRTGASWCFSRRSFYMTLGLSWQMTALSHPFNGETLGKP

SEQ ID NO: 169716 - protein, 105 aa, Triticum aestivum
  unsure (1)..(105): unsure at all Xaa locations
  Clone ID: PAT_TA_64134.pep
LLYDVHHATGAPWAPNANRVYMAGSVVPELLSGHLPHSSVQLXPSLWALESYDETLPQVAPSKLGSHRRKGIEILLLDVDHLPIDTEFVNLQSELTKRLESCEGT

SEQ ID NO: 169717 - protein, 113 aa, Triticum aestivum
  Clone ID: PAT_TA_64135.pep
VVVGGRSTVLELKVYAGSTGRRIFLPPCPAPATGQEAAGGRVVASSSTRRVEQLRLHARARGRHGFESYLAGWLQSSGIRFDFGLDWIGLDWSLPPSPIEEEKRARLGKFLGK

SEQ ID NO: 169718 - protein, 56 aa, Triticum aestivum
  Clone ID: PAT_TA_64136.pep
CPYPNDKLTNNVHARCSHSMYRECHPLIHGLTRCAFSVIHILAPCDHAHLALLSGA

SEQ ID NO: 169719 - protein, 174 aa, Triticum aestivum
  unsure (1)..(174): unsure at all Xaa locations
  Clone ID: PAT_TA_64137.pep
FSDLFPHLANGKPRKPTDGIAHELTKKCCCCYSTRSILTSKRPDPNDQLVDDVHHVAVAPWAPNANPVDMAWSVVPVLRSGDLAHSTIQFSPSXSELQSFAVTLQQEAPSKLSSHSRMGIEILVLDVGSLSLDTEFVNLESELTKRLESGEGTFFKDHSTSPNAKDVSNITSRG

SEQ ID NO: 169720 - protein, 40 aa, Triticum aestivum
  Clone ID: PAT_TA_64138.pep
IWNSLTTKGPENNILKSRAFAHLQKLTRTLSLLYKNQNLY

SEQ ID NO: 169721 - protein, 106 aa, Triticum aestivum
  Clone ID: PAT_TA_64139.pep
GVLGGLFQLSLEATCLVSSAQAAFTGFLKFLFSAQAAPACARTGAAATSSTAASSASTRVSDMAAGVRGRRISSPVPTSKGGGRRKETGGWCGEIERPQLSLAREG

SEQ ID NO: 169722 - protein, 103 aa, Triticum aestivum
  unsure (1)..(103): unsure at all Xaa locations
  Clone ID: PAT_TA_64140.pep
EEKAXFVXXAFSXGVLGVVFSGRGLAXVLXGXXFWGXXPGFCXPXLLLPRLXXCPXACGGFVXLPLLXPCGAGFLXXLAAXAAFSILHVLIFLLGXXXAKDSI

SEQ ID NO: 169723 - protein, 107 aa, Triticum aestivum
  Clone ID: PAT_TA_64141.pep
PDTEAGGDPAHAYHGGGPAATPRKRATREHAEPHPGGHATSPTAGPQRRGNPRPTNEEPTPSKATQTTPSNKGEQHDEASGRAERTREKHGKHKPRGHKPKKHQQGR

SEQ ID NO: 169724 - protein, 150 aa, Triticum aestivum
  Clone ID: PAT_TA_64142.pep
KSIHHSEKALGPGSYIPGATNGSNSAGRSGGMHSIGDHTVIELKGPDRTGLLSEIFVVLEELQCNVMAAEARTHTTRVACVLYFNYESSAHDIEDSCRLPTIDERLLHVLHRHCGGDYDYCYYRGAHTNWFDGCTHVDRRLHQLMHAHID

SEQ ID NO: 169725 - protein, 145 aa, Triticum aestivum
  unsure (1)..(145): unsure at all Xaa locations
  Clone ID: PAT_TA_64143.pep
TRALETSKRPAPNDERXDEGHHXAAAPGATKANPXNMARTXXPAPRTGDQAHSTIQYSPFSRALKSSAGTLQQVAPXKQTSHSRSGNESLGPHRASLALDTEYENLESETAKLLESGEGASYEDHTRSPKAKDVADMTPEERLAT

SEQ ID NO: 169726 - protein, 151 aa, Triticum aestivum
  unsure (1)..(151): unsure at all Xaa locations
  Clone ID: PAT_TA_64144.pep
RQRTRDDKVTPQRPRNESEGNQKAPRPQGQXTRRGPPAGSRAKGPRXANPRKTKAQGPKSTARAEPSDPDPDDQPXRRPPRGRERATTRPRNRGPRRRSQPQTERQREPPTPRRPPTARHGARQPGERTDKTAGERRGHPKQGAADKPQSQ

SEQ ID NO: 169727 - protein, 162 aa, Triticum aestivum
  unsure (1)..(162): unsure at all Xaa locations
  Clone ID: PAT_TA_64145.pep
QRKASQESRRTASSGMTQKXRRRETRRARRTAKRPDPXDERGDQGHQPGRTRQGPRKRTQRTRPGPXSRNREPATRTNRPATXRPPRRSNRAPPRPSDKGPQRSRPATDARATRAESTTRXPRRETREPPTRRAXGQNSRRAARAPTTRTKRQAPRPRTPPT

SEQ ID NO: 169728 - protein, 70 aa, Triticum aestivum
  unsure (1)..(70): unsure at all Xaa locations
  Clone ID: PAT_TA_64146.pep
ALCRFVWLFFLLGLLPFVSAVXPSWPRLRWVFCPGSLXLGVRLXVPLAPARFSLRGWFPLMFGTCGFRGR

SEQ ID NO: 169729 - protein, 175 aa, Triticum aestivum
  unsure (1)..(175): unsure at all Xaa locations
  Clone ID: PAT_TA_64147.pep
PLVARHVGNVLGIGTCRMVLLIGALAARQQFCRSALQVLRTPCRAQRQQRRDRGSHSRSACGCTASQWPLVPGSRAVLFSSPEEGQHWMVVWAKSPDGRSGSSFLAIPRGSPLGPMAPLLTWWAWSTRSSLGSGRFEVRIALVESHQRXFCISSKTRPSVGLSWLPSCWVPASIL

SEQ ID NO: 169730 - protein, 119 aa, Triticum aestivum
  unsure (1)..(119): unsure at all Xaa locations
  Clone ID: PAT_TA_64148.pep
KSSFFDFWEYYRTPKRSVVTVSSSLSWLARASELFFPWATGCGGSSYLLFPXVGSGRALVLCGALCXWFFCWVCSLLCXCPAVVRCGPAVLLPWLSXLLGAGHSAACPCSVSSGWXVPQ

SEQ ID NO: 169731 - protein, 140 aa, Triticum aestivum
  Clone ID: PAT_TA_64149.pep
TRGNRTRSREARHDSRRSAEALERTGQRSVRYNESEPNRKAPRPQRRARRPGPPGCRRARGPRKRTPGTRPGPVSRNRKPATSTKRPPRPSPTGKREQELPGPRTRRTRTRHTPPQRTGNDPTNTPKQHRAGKKDQERAR

SEQ ID NO: 169732 - protein, 112 aa, Triticum aestivum
  unsure (1)..(112): unsure at all Xaa locations
  Clone ID: PAT_TA_64150.pep
KTEAGXHHSEKRRREAHERHKKRGAPQAPNQENNXPXNRNPEEXGAKAARDEPGKTPTAQTPKAQGAPTGKXTPAKPPTGPRGRRXTTDSQPKHQPRTNKDREKGGSXDKTP

SEQ ID NO: 169733 - protein, 93 aa, Triticum aestivum
  unsure (1)..(93): unsure at all Xaa locations
  Clone ID: PAT_TA_64151.pep
SFFALPVGWACSVLVCLVLVARVRSFRLVFPRPCRRGSPSGPLARLRCGGPRXLARRWGVGSGVSLCSRPWPRGVSLIAIVRCRRSAFVAALL

SEQ ID NO: 169734 - protein, 134 aa, Triticum aestivum
  unsure (1)..(134): unsure at all Xaa locations
  Clone ID: PAT_TA_64152.pep
KRRRGTRSKLTAKRPXPXDERXDEDHHAADAPGAPKANPDDTARTREPERRPGDEAQTTNQRTPAAGAPQRHAATPQQAAPTKQTSHSRSGKENHDHDRAPRPPDTEDDNPESEXTKRQESGEGTXNKDQPTSP

SEQ ID NO: 169735 - protein, 63 aa, Triticum aestivum
  Clone ID: PAT_TA_64153.pep
PLCGRHVGNVLGFGACRRALVIGALAAPHQLCRFALQVAGLCVKRKRTCVWFEDLIPTSPVVE

SEQ ID NO: 169736 - protein, 90 aa, Triticum aestivum
  unsure (1)..(90): unsure at all Xaa locations
  Clone ID: PAT_TA_64154.pep
SFCIISRRPPARTRRTLSEARPNRPRPXTRAPXRRTRTTPPAXTRGRARRSXTRTPADRRTRGEAPRXGRTAGRGQARRRSSHGRTKRRR

SEQ ID NO: 169737 - protein, 97 aa, Triticum aestivum
  unsure (1)..(97): unsure at all Xaa locations
  Clone ID: PAT_TA_64155.pep
PCLRVPAVLSRAVGAGEXWLVAWGSSPAGRPGSAVPALSPGFAFGARGALXPWWPSSXRLSLGSGRFKVTLALGGWPLHHIFNAHVLARQSAFVAGP

SEQ ID NO: 169738 - protein, 107 aa, Triticum aestivum
  unsure (1)..(107): unsure at all Xaa locations
  Clone ID: PAT_TA_64156.pep
LRLWLGFLCRGPLLLGPGGALSRRRGGXALGGRLALVAGSRSRPSGPGRVAGVRFRGPWRGCGVVVLVXALVVGVWALSGSXRPRXXXXAAILYLLVCYAVSRLSWL

SEQ ID NO: 169739 - protein, 122 aa, Triticum aestivum
  unsure (1)..(122): unsure at all Xaa locations
  Clone ID: PAT_TA_64157.pep
FFRAXFXLWVFVXSFSXXAWXAVXGSXRPXXCLLWFWFAFFGXVXPGWALXLWVGLCFSSXRXGVASLFCRGCCLWVSCAXAAAPVSXXFWAVFXPESVLVGFWXWAKTLSFXMLNPSPLVV

SEQ ID NO: 169740 - protein, 54 aa, Triticum aestivum
  Clone ID: PAT_TA_64158.pep
VCAGFPRVRSAPGFAPVLFRSPSGGLPWLVVLPASPGRRSVSSFLVLASAVRLL

SEQ ID NO: 169741 - protein, 98 aa, Triticum aestivum
  unsure (1)..(98): unsure at all Xaa locations
  Clone ID: PAT_TA_64159.pep
LGCGGLLLGAACAGSGVALPRPRGAALLVVWARRRSLSGLRPVPSSGFAFGALGRLRRGGFXXGWSWARALSVPSLSLVXRRQSLLLVCDAVGWLSWL

SEQ ID NO: 169742 - protein, 143 aa, Triticum aestivum
  unsure (1)..(143): unsure at all Xaa locations
  Clone ID: PAT_TA_64160.pep
RQPTDGIAEQLKIWSTRALTAKSPDPTDERXDEGHHAAXAPGAPKANPDDKARAEXAGQRTGDKAQATTQXXPAPKARKSTAGTPQQGAXKKPASHRRSGEETPDPDAAPPPADTEXGNPESETTKRRESGEGTXNKDXPTSP

SEQ ID NO: 169743 - protein, 59 aa, Triticum aestivum
  unsure (1)..(59): unsure at all Xaa locations
  Clone ID: PAT_TA_64161.pep
CGCGWSASLGPLVAGSRRFFVAPRRXAISVWLFGPRSAXRAFRLSFLGXAAGFAFGALG

SEQ ID NO: 169744 - protein, 77 aa, Triticum aestivum
  unsure (1)..(77): unsure at all Xaa locations
  Clone ID: PAT_TA_64162.pep
WAFFLAXCXLCVFVGSXSXSAWSXVLGSCAPAXVSCRSXSRFSXWXXLGGRFSFGLGCVCLLPXPGLVPCSGLVAAS

SEQ ID NO: 169745 - protein, 78 aa, Triticum aestivum
  Clone ID: PAT_TA_64163.pep
VPLGWRRIWLVWVGPGSWGWVLFVSLLPPGRFRALSRFALLACRLLRAPRPPVAGWPFGLHLPWFLFGLVLRQESLIC

SEQ ID NO: 169746 - protein, 86 aa, Triticum aestivum
  unsure (1)..(86): unsure at all Xaa locations
  Clone ID: PAT_TA_64164.pep
CVCLWGLVPXALGGXRLVRAPLVRVSCGSCSLFSGWLXLGGRLSFGLGCVSRLSGPGLFLWFGLVGPSRCCPLVALAPSRAGCGWG

SEQ ID NO: 169747 - protein, 77 aa, Triticum aestivum
  unsure (1)..(77): unsure at all Xaa locations
  Clone ID: PAT_TA_64165.pep
VAGRLLRGPLLRGPGGSLSRPPGGLGLGGRLVFVAGSLSGPSCPGLVLGVRLRGPWRGCXVVALVAALVVGVWAPCG

SEQ ID NO: 169748 - protein, 75 aa, Triticum aestivum
  Clone ID: PAT_TA_64166.pep
ASGSCPHVPCPRQFSFALFGRARTGWALWPLALGCVYQHNGPGLVHWFRMVGPSRLSKLVDLVQSLVGGGGGPGG

SEQ ID NO: 169749 - protein, 138 aa, Triticum aestivum
  Clone ID: PAT_TA_64167.pep
MAPKAEKKPVAEKAEKTTEAKKTKAEKRPPASKEGGEKKGKKKSKKSVETYKIYILKVLKQVHPDIGIFYKAMSIMSSFINDIFEKLAGESAKLARYNKKPTMTSREIQTCVRLVLPGELAKHAVCEGTKACTKITCS

SEQ ID NO: 169750 - protein, 88 aa, Triticum aestivum
  Clone ID: PAT_TA_64168.pep
MKLKARTLSTRPPVEGKSWMRRDASRALALMSFDLNDLTGDLEGLSPDELEVLQDWEEKFKERYPVVGHLPGENGTAGAQPDHEAEKA

SEQ ID NO: 169751 - protein, 85 aa, Triticum aestivum
  Clone ID: PAT_TA_64169.pep
KLSDKLTNNIGIQSVKCVMSNNIGIQSVKCVMSNNIGIQSVKCVLSNNIGIQSVKCVLSNNIGIQSVKCVLKLVANLPEHKSSRD

SEQ ID NO: 169752 - protein, 41 aa, Triticum aestivum
  unsure (1)..(41): unsure at all Xaa locations
  Clone ID: PAT_TA_64170.pep
SRRNRAGGPLVGCTIQPSWXLSLKNYGTANCECLRPGLDFA

SEQ ID NO: 169753 - protein, 94 aa, Triticum aestivum
  Clone ID: PAT_TA_64171.pep
MANASSGAGIHDDCMLRCRELKSNRMHRFITYRLENQTEGIVDQTGEREATYDDFTKTLPENDCRFAVFDFDFTTPEDVPKSRIFYIFWSPCTA

SEQ ID NO: 169754 - protein, 92 aa, Triticum aestivum
  Clone ID: PAT_TA_64172.pep
MADVEYRCFVGGLAWATDDQSLQNALFKYGDVIDSKIITDRETGRSRGFGFVTFASDEAMRQAIEAMNGQDLYGRNITVNEAQSRRYGGGGG

SEQ ID NO: 169755 - protein, 66 aa, Triticum aestivum
  Clone ID: PAT_TA_64173.pep
DANAQAKHYACARYPKNCITTADPESKMTNEQPVPLMLVPDQDEFVHLQLAWSWPFIAIVCMRTRP

SEQ ID NO: 169756 - protein, 98 aa, Triticum aestivum
  Clone ID: PAT_TA_64174.pep
GRLVPRDKKGGPQGCHPHRRGKNRPRKNKQGAPKEKPKTGGRRAETREPKNGPPKKQRPRRTMGTPGVCTLTPQAYLSCFIFFYFFFFFSFFFLNFKI

SEQ ID NO: 169757 - protein, 101 aa, Triticum aestivum
  unsure (1)..(101): unsure at all Xaa locations
  Clone ID: PAT_TA_64175.pep
FGRRQSGFRCQLFNQRRETGTQFIIRHALHHRWPMAPMVHPDARCPTPHVLSSQPHSVHAVNHWMSLVALRHRSXWYTRIFRVIGQRRKGVHAVRPRPCRA

SEQ ID NO: 169758 - protein, 96 aa, Triticum aestivum
  Clone ID: PAT_TA_64176.pep
RVQEPHAVLVVHAVVRDGSAQARRLHAHRGGARLRRVPLARRRRRRRQEEEEEEGADDDAHREPHCCVRLLWPAGDRALTGGRWSDRSRRKEEGCT

SEQ ID NO: 169759 - protein, 115 aa, Triticum aestivum
  Clone ID: PAT_TA_64177.pep
RRGTPLGASCRPQSRQRRLHKRIKSPGLGRHRKSAKDHPPNRSADRNAPFRIRPGRNAGPHPRSSRQFQAPLDSIFKALLIFTTEAPSTLIGRSPAFQPWTEFTARMAAPHRRTA

SEQ ID NO: 169760 - protein, 128 aa, Triticum aestivum
  unsure (1)..(128): unsure at all Xaa locations
  Clone ID: PAT_TA_64178.pep
MFNYGTGHTMNKVXSKNDYKSCILGNYIKYDISGTTNIALTTTGPRYFXIVKSPSQCAXSIKLAVTVAXNSSNGVAGGTTTPTPFTEGGGGYNPTTTQTIPCAAWTVSCPXRALVATWADVLYALALS

SEQ ID NO: 169761 - protein, 60 aa, Triticum aestivum
  Clone ID: PAT_TA_64179.pep
FVHLNISCLDLVPKISLAANPQDHAFCTDLILSGSYVSIMGSIMLHGEPQRSRDQPCAST

SEQ ID NO: 169762 - protein, 87 aa, Triticum aestivum
  Clone ID: PAT_TA_64180.pep
MAENHYHHSLDHSLCQLVECYHLHPLGQSLSYMVESLIIIHWTSLLDYQLQSFLHSALNQTLEHKKEKKTPAYHSSVHSTTWVEYSS

SEQ ID NO: 169763 - protein, 142 aa, Triticum aestivum
  Clone ID: PAT_TA_64181.pep
SFETKDTDIWAAFRVSPQPGVPPEEAGAAVAAESSTGTWTTVWTDGLTSLDRYKGRCYHIEPVAGEDSQWICYVAYPLDLFEEGYVTNMFTSIVGNVFGFKALRALRLEDLRIPPTYSKTFQGPPHGIQVERDKLNKYGRPL

SEQ ID NO: 169764 - protein, 38 aa, Triticum aestivum
  Clone ID: PAT_TA_64182.pep
LPIFIDLCYLTLGLNWDRDFVLATSIMERNCFCKTLLN

SEQ ID NO: 169765 - protein, 110 aa, Triticum aestivum
  Clone ID: PAT_TA_64183.pep
RSHVGLMPVLMAIGNRSRDSSGDVSRSSSRDTTGESNVVQELGGYCLSYSYVMANMMEDRRCSYESAQVSSEMPTTPTTERAGETTAVTKGVGEGPSAKPEAAPGAPNGG

SEQ ID NO: 169766 - protein, 95 aa, Triticum aestivum
  Clone ID: PAT_TA_64184.pep
ARCYQSPLTGSPSSSLVPLRSPSGYSWCSIDRQRSERGPLSSSSRPCRSIHRRTKWPLIGAMLYATLTASGSPNSHTAAESIMVDSRSASAVDTQ

SEQ ID NO: 169767 - protein, 107 aa, Triticum aestivum
  unsure (1)..(107): unsure at all Xaa locations
  Clone ID: PAT_TA_64185.pep
GHHGYSRPAKGRLPCFMSYMFDIGGRAXNKSSVCEKDAEGPSRRDYHPAYDPNGVNNCTELAAFRLPQNMRAFLXNIGEKGLITRGLSSAVQRVVPPKQMGTHMALP

SEQ ID NO: 169768 - protein, 74 aa, Triticum aestivum
  Clone ID: PAT_TA_64186.pep
CHAKGEESSESTGSAVAPRESAPGSPGPAAMALSDLSRDSLLPSLLYSPSSFVAAVFARLHCSPWPYQAPDEAP

SEQ ID NO: 169769 - protein, 145 aa, Triticum aestivum
  Clone ID: PAT_TA_64187.pep
SKDLVGFLSDSNIEGSPDIAEVIYAGLDIVTPLISLDLLKYPKLSRDYFVLMSHLLEVHPEKVAHSNRDAFGRITGSLEFGLRNQDGDVVERCLTALNALASYHFKERLGGIGGLGSQAMESEGSNGKLQESISSHFLRLLLQLL

SEQ ID NO: 169770 - protein, 125 aa, Triticum aestivum
  unsure (1)..(125): unsure at all Xaa locations
  Clone ID: PAT_TA_64188.pep
VPLVQSLLGKDQEGDDTGKKKKKKKGKGKAGNERKKPAPAYILWCKDQWAEIKKSPDAHFKEVSNALGAKWKTLSSEEKHPYEERYRQEKEAYLQVVGQEXREDDAIKLLDEEQMLWTAKEIAEQ

SEQ ID NO: 169771 - protein, 114 aa, Triticum aestivum
  Clone ID: PAT_TA_64189.pep
AARRPSAFAGTTFAVAGRHSTSTASLPLPLLFAADFPPSNRNVAETAGDASSRMQSAKGPAAAREEAIGGNRFLYPPFLAVLEAGSAAACTDRSVGKPPPFGASSSLYGFEKSR

SEQ ID NO: 169772 - protein, 109 aa, Triticum aestivum
  unsure (1)..(109): unsure at all Xaa locations
  Clone ID: PAT_TA_64190.pep
SGHVPRPPGYSPTKGPITRTPVTXXGVVVGPPVTYPSITNPPSKGPTPRPTVTTPTVVVGPPVTYPAPPVIAPXVTTPPSAPATTPTPPSPSVTAPPSTPGNTPPSSTG

SEQ ID NO: 169773 - protein, 151 aa, Triticum aestivum
  Clone ID: PAT_TA_64191.pep
KKIDRCCELALMALRSTCKQQGVRQSESEPNSRYKASLFTLLKVTAGDVRPRGRRRGWRRRRRRRRRRWRCGSRRRGRAHRRRLPPCRRLCREGTCCWRQLRARWRRGTGPEMRGNPPRGPRRPPRRSSPVRPRGRGSGVARGGHPRIFPR

SEQ ID NO: 169774 - protein, 144 aa, Triticum aestivum
  unsure (1)..(144): unsure at all Xaa locations
  Clone ID: PAT_TA_64192.pep
SNILLDEDWNAKLSDFGMAREGPTEGLTHVSTAVVGTLGYAAPEYIQTGRLNAKSDIWSYGVLLYELITGRRPIDGERPRGEQKLLDWVKPYISDTNRLRLIVDPKLEGRYSIKSVAKLVTVANRCLARLPKARSRMXEVLDMV

SEQ ID NO: 169775 - protein, 141 aa, Triticum aestivum
  Clone ID: PAT_TA_64193.pep
WQLLGRPLQSYISRSSSSRKSPFVVRASSSPPAKQNDNRQLWFASKQSLTYLDGTLPGDFGFDPLGLSDPEGTGGFIEPRWLAYGEIFNGRTAMMVVVCMIAPEALSKVGLVPPETAIPWFQAGAIPTEGTYQYWADPYTL

SEQ ID NO: 169776 - protein, 166 aa, Triticum aestivum
  unsure (1)..(166): unsure at all Xaa locations
  Clone ID: PAT_TA_64194.pep
LNKSMSYQPCDQEGDPLPGTELKEVWKAAPAPPNDKYQYTYFAHKINSFDTAPKKLLPSDSRLRPDRYALEKGDMSKSGAHKSRLEEQQRAEKKIRDTKGEQFTPKWFKMTEDISPTPWGDLEVYEYNGRYAEHRAAIDSSSVVREETDVSSIEFNXWQYGDSPSQ

SEQ ID NO: 169777 - protein, 147 aa, Triticum aestivum
  unsure (1)..(147): unsure at all Xaa locations
  Clone ID: PAT_TA_64195.pep
FGKLEGTAKSMYAAGKVRLAMLQEPAGAGHANGNAGRRHEGSFVVWQLAPGMWLVEMAVAGHSVAAGSDGRVAWRRTPWLGAHAARGGSRPLRRALQGLDPVMIASIFXTAEHAGEKHVDGEDCFVLRLDVGPSTLSSWSDRTAEVI

SEQ ID NO: 169778 - protein, 77 aa, Triticum aestivum
  Clone ID: PAT_TA_64196.pep
YVPIPGGRSYLSPPPSPSLRGRVFSFVWPCLTSLAGPLLHRAGISPSLPHPNCFALHPPPFWWAFVDTRRPVPPSLP

SEQ ID NO: 169779 - protein, 108 aa, Triticum aestivum
  Clone ID: PAT_TA_64197.pep
VAPLFVLPRRAPVLLLSPSGRPRGSVVLSARGGGRSVHLLSWPPPQRSVALGRAVPSPCGWSGPRPGSGVAASAAAGLCSVVLRPLPGSACGRSVKLFWVAGVDAFCL

SEQ ID NO: 169780 - protein, 135 aa, Triticum aestivum
  Clone ID: PAT_TA_64198.pep
LDGRSLRPSSLFRRLGDWVFAACLFCCLLLPFSHSCRCLATASFGLRSGVFLLLFRLFHSQFLFCPRPPQSSVPLLLLPPRACAHFLFLLRLGLLHSVALAPRDHACSTCSYTSSSASVISGAGSVLIISRSRSA

SEQ ID NO: 169781 - protein, 39 aa, Triticum aestivum
  Clone ID: PAT_TA_64199.pep
FKERSHHKYKLLNVGVSQFTHPNSRECTTKEWKLPGRQW

SEQ ID NO: 169782 - protein, 89 aa, Triticum aestivum
  Clone ID: PAT_TA_64200.pep
YLLVYRLPESLSCLYASQKPVRKKKQQKQGTVPSNRFGVILEWEGVVVEDDDPDLDPLVWYVLLLDKATIFSSDEMLKEIEGMRTDQAI

SEQ ID NO: 169783 - protein, 73 aa, Triticum aestivum
  Clone ID: PAT_TA_64201.pep
SPKSSHFSPIFPAGQDNGGDREHLGLVPEPCEVNVKQTGAMHGLSEPMSHCGGWHDEQATALPAPLDGRTTGP

SEQ ID NO: 169784 - protein, 84 aa, Triticum aestivum
  Clone ID: PAT_TA_64202.pep
LAFFHASDHAFAPRVRIVDGPGAGKHLQAGSKKVIITAPAKGADFPTYVVSDNEGDYHHDVVYINRNVVCTTNWFEPYTKVLDE

SEQ ID NO: 169785 - protein, 71 aa, Triticum aestivum
  Clone ID: PAT_TA_64203.pep
TRTRPAWWWTVLLPITETERRGPDRIPAWYQEMEDLYKLKLIGDLSDCESCDDAQERRQLILWGFDQYYWS

SEQ ID NO: 169786 - protein, 80 aa, Triticum aestivum
  Clone ID: PAT_TA_64204.pep
PPRAPVLLSSPSGLTSRIRCPPNGTELDNQFIVGHDTPPPITEGPIGPCLLRLAGLELYRVSRQLHRCCLVHGVLTHRFA

SEQ ID NO: 169787 - protein, 64 aa, Triticum aestivum
  unsure (1)..(64): unsure at all Xaa locations
  Clone ID: PAT_TA_64205.pep
RRTIDHLWERHMCNKWGSVLGSAWRDERRXYLSLCTAAVGGASTCXLCGCGKHQRRLAALCCIC

SEQ ID NO: 169788 - protein, 107 aa, Triticum aestivum
  Clone ID: PAT_TA_64206.pep
VADQSLSIICFFVKLHACNLLAEYRGAHTIQFSLQPRWESKDTHDMLTRAATPNALFFCCNHHQHEKNVRRYIFLTNQQIQQGTFHIRSCCPSSYVGREEVFRQGNP

SEQ ID NO: 169789 - protein, 87 aa, Triticum aestivum
  Clone ID: PAT_TA_64207.pep
KDKYLGTEEVLQIEKLQTRGAANTREVHVMPLLHILLGGGWSVQISFSSWWVVSITLHHLCINPIQLQGLVLPAPFHRMRGHGYAIP

SEQ ID NO: 169790 - protein, 100 aa, Triticum aestivum
  Clone ID: PAT_TA_64208.pep
VNIKLAKLGVLGALEVIDAARKAGVALMIGGMVETRIAMGFAGHLAAGLGCFSFIDLHTPLLLSEDPVYGGYEASGPVYKFKNARGHGGFLHLDNNNGWK

SEQ ID NO: 169791 - protein, 124 aa, Triticum aestivum
  Clone ID: PAT_TA_64209.pep
RPRVRGRVGEHECDQERIINLGQERQIDPVMEAARGDPDDPLVVFRPERVGGWWARNQDFIRRRAETLRRPDGHAEADAAAERSREPAACKNYMEGLHLAGGGRGAECGVRGVTGGPGGRRQEA

SEQ ID NO: 169792 - protein, 92 aa, Triticum aestivum
  unsure (1)..(92): unsure at all Xaa locations
  Clone ID: PAT_TA_64210.pep
SADHCPPTRTLTVGHDGFLEDVWCPCVTVGRRVRSRGDGVDVMKIXLYSEECINTEYTVATSSVVTEQLDRKTMLTRTMGLLPLGDACLEWV

SEQ ID NO: 169793 - protein, 46 aa, Triticum aestivum
  Clone ID: PAT_TA_64211.pep
LGSGRVTAGPHCIGLTSRCARRPAHRWSANAWGARAGFGKGTSMRA

SEQ ID NO: 169794 - protein, 80 aa, Triticum aestivum
  Clone ID: PAT_TA_64212.pep
SGKGSRRNAPWSSPQPALLPSGDRGGWRLRGSLRTGGVVCALGCPWLSLEEYMMKDGLIARLPSGTNQLPRRRWMTGTRI

SEQ ID NO: 169795 - protein, 119 aa, Triticum aestivum
  unsure (1)..(119): unsure at all Xaa locations
  Clone ID: PAT_TA_64213.pep
MANPRVFFDMTVGGAPAGRIVMELYKDAVPWTVENFRALCTGEKGVGKSGKPLHYKGSAFHRVIPDFMCQGGYFTRGNGTGGESIYGEKFVDEKFVHKHTKXPGILCMDNAWPNTNGFQ

SEQ ID NO: 169796 - protein, 34 aa, Triticum aestivum
  Clone ID: PAT_TA_64214.pep
LNRTLSGDFGIHPLGLLDPEGTEGLIEPRGLAWG

SEQ ID NO: 169797 - protein, 85 aa, Triticum aestivum
  Clone ID: PAT_TA_64215.pep
IGERAGFPRQVVGEPRPGNCNEGTLKKRAKGGSQGMETWVPQKGRPIGLEWAMLTPVVRTRISSGSSLSFIVFCFFHGFLFFLFF

SEQ ID NO: 169798 - protein, 44 aa, Triticum aestivum
  unsure (1)..(44): unsure at all Xaa locations
  Clone ID: PAT_TA_64216.pep
MGFRGHCCYVEDFMXRDELNVRVRSLGEQLKRDACLTGTKEELA

SEQ ID NO: 169799 - protein, 66 aa, Triticum aestivum
  Clone ID: PAT_TA_64217.pep
MMLHTLSISWQIPLRKVDLKMYNTYKDLSIALQKMFSTFTATGKIRHRRHQNIKLELEQMYKSRRS

SEQ ID NO: 169800 - protein, 86 aa, Triticum aestivum
  Clone ID: PAT_TA_64218.pep
YTDDSLGLGPRYLGRSALLYLYRTQIHDQIIIRVGFKQASATPHESHNRCTRQQMDTARARPRLAGPLPLAGVLPHSRGAAPSRKG

SEQ ID NO: 169801 - protein, 65 aa, Triticum aestivum
  Clone ID: PAT_TA_64219.pep
RKAMIQLAGELFRKMGEDLDSIAKDYTASLDSFISQLPLQQHVDLKFLLFRLDFTEYYSRVSSNK

SEQ ID NO: 169802 - protein, 108 aa, Triticum aestivum
  Clone ID: PAT_TA_64220.pep
LFSRSGHAQLLFFFRPPQVPVPFLLLPPRAVARFLFLFGLVLLRSLSMAPRGLACSSCTDSSSSGSAFSVAGSFFFMVRSRAGSPKTQNRFSGYGRWRFSLCVGVASL

SEQ ID NO: 169803 - protein, 141 aa, Triticum aestivum
  unsure (1)..(141): unsure at all Xaa locations
  Clone ID: PAT_TA_64221.pep
MAGKCYPTVRDEYLAAVAKAKRKLRGFIAQKNCAPLMLRLAWHSAGTFDVGTKTGGPFGTMKCPGELAHGANARLHIAVRLLEPIKEQFLILSYADFYQLAGVVDVEVTRGPEVPFXPGRQDKTEASAEXRLPDATQGSDH

SEQ ID NO: 169804 - protein, 69 aa, Triticum aestivum
  Clone ID: PAT_TA_64222.pep
LAPAVSEGGHSVLVPSVVVGDSINVGHGQPLVQSLEVLLATVSHELVACYRCLLVRSRPGYPKVKQFFR

SEQ ID NO: 169805 - protein, 110 aa, Triticum aestivum
  Clone ID: PAT_TA_64223.pep
LRSFSILPVCNVVTSASYDLRPPCLLAHLSPMQRQLLVRLWQPSVSHHLFVVQPETGDRLSVHHSFCPPPPMTHDAHGPSFCQLSGSALSRVSHQHHRCCTDITGGTRRR

SEQ ID NO: 169806 - protein, 40 aa, Triticum aestivum
  Clone ID: PAT_TA_64224.pep
MLFQGHCVCVEEAMTKDDLIALLRSLIEQLNLHVRHAGTN

SEQ ID NO: 169807 - protein, 38 aa, Triticum aestivum
  Clone ID: PAT_TA_64225.pep
ISRCVDLPVVHPVFARYRSIGVKCHSRVCVCHPCRAQA

SEQ ID NO: 169808 - protein, 108 aa, Triticum aestivum
  Clone ID: PAT_TA_64226.pep
VVAVLDPLRRVVQLPPVRDVDVVTGVVTVSGRQRPTRALVLLCTVPTCPFLASPACVTHRSGAHISSSLLGQHRHQGRRQSLLPPDLHLCRSQLDHAKRQDEDSVNSQ

SEQ ID NO: 169809 - protein, 36 aa, Triticum aestivum
  Clone ID: PAT_TA_64227.pep
FPSRHVAAQQPVTSLGLWSTSTSFSFPSYSSSSSGD

SEQ ID NO: 169810 - protein, 47 aa, Triticum aestivum
  Clone ID: PAT_TA_64228.pep
RPEPCRDCGRTAAKALYASAPLPVLTVVTHRRCRCHECHHDVTCSTR

SEQ ID NO: 169811 - protein, 98 aa, Triticum aestivum
  Clone ID: PAT_TA_64229.pep
SRSGWHHGSVVLSANGAGQSVHLFSCPPLHSSDALEGPCHASCGARPHHGQATPSAVLVQSWSSRAQAPRWPKLKSVFRATGVDAFGLRAGSPSGLRP

SEQ ID NO: 169812 - protein, 58 aa, Triticum aestivum
  Clone ID: PAT_TA_64230.pep
CFGEETKRKDERTAPLRGLGEQPSRDVSLTETKEEPARRAADLEEGLDDTKAKLGTGL

SEQ ID NO: 169813 - protein, 99 aa, Triticum aestivum
  Clone ID: PAT_TA_64231.pep
LLVMFEIEIGVRLFAQRPAVDIQFFFSLVLLHTVTMSPNDHVYGRGPYTNSSGSGSSGIGSHLIMANSGSAVARTQTVVHARQAYTVSRCAAGISFPYS

SEQ ID NO: 169814 - protein, 126 aa, Triticum aestivum
  unsure (1)..(126): unsure at all Xaa locations
  Clone ID: PAT_TA_64232.pep
CPSTRPPTRPASCRSAASVDVVQSKKPQGAGGGGEGTSSAAAPGIRPAKGESLSLVARLLRGFKNLSHQIFAVYDEEDEEEEEXRRMVIGLPTDVKHVAHIXGWDGSTSTTSSVRSWNRAAPPPGT

SEQ ID NO: 169815 - protein, 69 aa, Triticum aestivum
  unsure (1)..(69): unsure at all Xaa locations
  Clone ID: PAT_TA_64233.pep
LLFFATSGTSLFGKSSXLEKKEGGEQHDPAAAYVPPQPGLLTXQDITMFAHIMRGGFGDMLRVTNTGAD

SEQ ID NO: 169816 - protein, 41 aa, Triticum aestivum
  Clone ID: PAT_TA_64234.pep
QLEKGECGLVPLRLVSAGFWQSQCCWCSSTDCKLGYAIQKL

SEQ ID NO: 169817 - protein, 55 aa, Triticum aestivum
  Clone ID: PAT_TA_64235.pep
AAKSTSLAVCSQGPDCQTHGDNQLNGSLERPTFKQVLDYTRAPLGCAFQSTTKCM

SEQ ID NO: 169818 - protein, 73 aa, Triticum aestivum
  unsure (1)..(73): unsure at all Xaa locations
  Clone ID: PAT_TA_64236.pep
DLNRSGTAPDKKECAAALSTVNMQEVLRSTGCLEELEMHTEAKEMPRQHKEHXPDCILSCVEQHXSCPICGCD

SEQ ID NO: 169819 - protein, 150 aa, Triticum aestivum
  unsure (1)..(150): unsure at all Xaa locations
  Clone ID: PAT_TA_64237.pep
TFFDLTCCPGHGINIESLCRYTVDMDWSDITNTNCVLKGFTNGLCIKAHDDTKTDLXASNIHYKNITMDXLCYPIIINQNYCPNKLCTCKVDPHRVTAMDVTLQNISWTYDTPEDINLLCSEKNPCKCITMYDVKIEYSCQYNQTMTVYS

SEQ ID NO: 169820 - protein, 109 aa, Triticum aestivum
  Clone ID: PAT_TA_64238.pep
KGGCKAIQLSWVRAWLFQSLCCKGQARAKLRCRVATLLFQQRAATVQLFSRSRQDHIRVVLLAKRAEQADQLIFCNPLHSRNAMARQGHDQLSCPDLITSGTHQQHQRF

SEQ ID NO: 169821 - protein, 108 aa, Triticum aestivum
  Clone ID: PAT_TA_64239.pep
PAGSPPLVGSPPLAASLSSSNWSSLHTLPHPPSFQHHPPTDASLPNVGRSNSRWLRPSQHNVDAVVDLHHMERQPTVTCSPQQKVSTAAEGAASPESARWISSPLRAA

SEQ ID NO: 169822 - protein, 81 aa, Triticum aestivum
  unsure (1)..(81): unsure at all Xaa locations
  Clone ID: PAT_TA_64240.pep
VHPDNRITGKAMSIMKHLHQTTICRDSLVRGRPCQCXARYNKKPTITSREIQTSVRHVLPGEVAKHDVSEGTKAVTKSTYY

SEQ ID NO: 169823 - protein, 75 aa, Triticum aestivum
  Clone ID: PAT_TA_64241.pep
MALPWHCCCGEEDMRKDERPAPLRSLAEQPNRDASLTETKDELALRVAELGEELDDTRAKLWTGRYITTTGLRIP

SEQ ID NO: 169824 - protein, 119 aa, Triticum aestivum
  unsure (1)..(119): unsure at all Xaa locations
  Clone ID: PAT_TA_64242.pep
YVHASGHAVDHASDRNAGDLSYSALSILASKMPMYYECNDSCTCLHNRRNRFAHKGIQIHFEASKTGDRGWGLQRXDPIPAGTFIXEYAGVIADKNAFDAEDDYMSETPPSEQNLIWIY

SEQ ID NO: 169825 - protein, 64 aa, Triticum aestivum
  Clone ID: PAT_TA_64243.pep
ADAHAQTDGVYACGPNPKFCFTTPDPEREFTMLETQPPLLVADPAEFVPVQLSVITAPSPPLFV

SEQ ID NO: 169826 - protein, 113 aa, Triticum aestivum
  Clone ID: PAT_TA_64244.pep
NWPKGDCLPSHLIWVPQGFSHSDGGKPRPIPNLSLGVTNSFFKFAPPKPSFFFGPGKLTSRVHWSTNQRKRAIRLSFVLDFPPKKPLPPKALISPSGRTRTSQGQPTTTTVLD

SEQ ID NO: 169827 - protein, 164 aa, Triticum aestivum
  unsure (1)..(164): unsure at all Xaa locations
  Clone ID: PAT_TA_64245.pep
KKEGNRGKAKKKGKTQNTRNRDQGKRKRPRAKTTPPPEGKRHPKGGRPPRPEGRPTXEKATQKGPPEQKPNRKKGKRPQAQEEGGPRGYPTPTAGNHRPASVHREPRKKKKAAPRAGRKPRNPKRPPPPLKKQGDRENRPPSYEVGLFVFFFFFFQFSFYIPFF

SEQ ID NO: 169828 - protein, 50 aa, Triticum aestivum
  Clone ID: PAT_TA_64246.pep
TQQQRNKELHRTMHCARLASTPRTDGNIIASALIIELFAELSLRFSTERR

SEQ ID NO: 169829 - protein, 68 aa, Triticum aestivum
  Clone ID: PAT_TA_64247.pep
AERVRSIAAYGARIVRIAGNYDESVVCAAQLAQANGWYVVSDTSYDGYEAIPRDVMQGYGVIAAEAAA

SEQ ID NO: 169830 - protein, 114 aa, Triticum aestivum
  Clone ID: PAT_TA_64248.pep
SQVGFPVEKKFVGQSNAIYLYRSRTHLFPFRSGRRRIRRRPPPPTPALGSRPDSATYDGARPPKPATKGFEAVGRSYFDFDVEEGVGLSFWPPRARRRWARPCQVLATRRGALA

SEQ ID NO: 169831 - protein, 114 aa, Triticum aestivum
  Clone ID: PAT_TA_64249.pep
FRWRQACFFSVRWLLTASHKQRQPVCKLVPLLCHPQGQLVFRSCQAGIQVGLFIHPAKAGGQSVFRQAFPPTQTMAGKGHPCSSRLYAHSLGTASSQPGRSELFMLTHGPEVRK

SEQ ID NO: 169832 - protein, 89 aa, Triticum aestivum
  Clone ID: PAT_TA_64250.pep
FVLWDPTSVLPAGLMTFYGNTKPLDKSWHVMGLGYNPSISPEVIRGAAVIHFNGNMKPWLDVAFNQYKALWTKHVDTEMEFLTLCNFGL

SEQ ID NO: 169833 - protein, 57 aa, Triticum aestivum
  Clone ID: PAT_TA_64251.pep
FPKGTVYKWVFPSRIPGNGSVNAWQHTISKHTQQPEINTRNSTVSMKVVNLYKQKGI

SEQ ID NO: 169834 - protein, 116 aa, Triticum aestivum
  unsure (1)..(116): unsure at all Xaa locations
  Clone ID: PAT_TA_64252.pep
MTCACCGCTVTTDGALAANRKPXGAPXVTIAFARRPQALTTRRRRLEDVQGQXFVTRAGREHNLTLVGNKETDLTREAALDQEFIHVKLSEHIGKKKASLSLNHLDCTLVCPTEIT

SEQ ID NO: 169835 - protein, 65 aa, Triticum aestivum
  Clone ID: PAT_TA_64253.pep
EALKHANKMVMDSWGTHLQITPTIQPQIMRLQVSKPAKTSLLFSDLGIMRKRTLEIHSNTNTHGE

SEQ ID NO: 169836 - protein, 58 aa, Triticum aestivum
  Clone ID: PAT_TA_64254.pep
GLVSSHTPSSGRTGTRGGPPTAPSRRTKSWSAPVLVRVTKPNVSGDRDRRYRLRPACQ

SEQ ID NO: 169837 - protein, 59 aa, Triticum aestivum
  Clone ID: PAT_TA_64255.pep
VVQDDATRGHICMLLVTAISRFMTSERGQIVFREGPQSYYMTSERYSRNAMAAYTGSDP

SEQ ID NO: 169838 - protein, 115 aa, Triticum aestivum
  Clone ID: PAT_TA_64256.pep
FLYGIKEAWSFYMIDRAFALTVAFLINICIISASGAVCSADNLNPEDRMNCIDLDLNKALFLIKNVLGNWCSKVTAIALLVSGQSSTITGTYAGQYDMPGFLDLQMTPWVRNLLT

SEQ ID NO: 169839 - protein, 104 aa, Triticum aestivum
  unsure (1)..(104): unsure at all Xaa locations
  Clone ID: PAT_TA_64257.pep
IPFSTHPYFILQLVPNLLGELLLTLKGLIYTPSLHSLHHTHFTTNYSLFAPFYYYLNSTMNKTSDHLYYRTLNXQHEAPDFVHLNHLTTPGSLLHLRLWFASLT

SEQ ID NO: 169840 - protein, 40 aa, Triticum aestivum
  Clone ID: PAT_TA_64258.pep
EEADIDKDGRISLSEFRKLLRTASMSNLPSPSGVPNPQAL

SEQ ID NO: 169841 - protein, 119 aa, Triticum aestivum
  unsure (1)..(119): unsure at all Xaa locations
  Clone ID: PAT_TA_64259.pep
MCFCSMSIWFGYALVFHGRCRCTPVPVPSFGLVSSRSSFCCSARRFFSSFVPVGLXSRLFCSPRERAVPFXFFFWSWSSSAAVPLARRGRACSGCAVSSWSGSAGSVXESVWVXVRSRS

SEQ ID NO: 169842 - protein, 54 aa, Triticum aestivum
  Clone ID: PAT_TA_64260.pep
PPRRFRGPIPQRPFFHRFRCYGCGWGCQGSQGGHGSRRLELKRPEQRGREGGDT

SEQ ID NO: 169843 - protein, 118 aa, Triticum aestivum
  Clone ID: PAT_TA_64261.pep
LVGALLALLVDLSASSHLEAHGHQQPQQEEGQPYAPIPTTKKAPAFELTGEMSPRKRAFLDESDRDDPAPHADKNGGEPDRDDVALFGPKKGARLPRSDEPVVPIVGCHGAGHEVVEV

SEQ ID NO: 169844 - protein, 143 aa, Triticum aestivum
  Clone ID: PAT_TA_64262.pep
VRCHGFVRVARYSEVSNRTEPFKLQKGSGRRRTVERDLDQLQQSRLGEADGFEVIHVTGKHPFLWPDHWPVKDYARIFDCLAVAPEIETEDVRVIFKIKDAGKKARHDAAVSHNTKRIDGLKNLPVQYIAVHMRIEKDWMIHC

SEQ ID NO: 169845 - protein, 138 aa, Triticum aestivum
  unsure (1)..(138): unsure at all Xaa locations
  Clone ID: PAT_TA_64263.pep
WPLPRVAVSLPVPLXSAALGFRCRAGSFGVPCCASAWCGXGPRSVLPXAASVLLLSLSAFXLGSVVVFPVGAVXSVGLSSWSPPPCCXGLAWPXRGRVAWXLSPRGPFVASFVFFFFLGXPSRWFAFNQTWVGPGVPG

SEQ ID NO: 169846 - protein, 175 aa, Triticum aestivum
  Clone ID: PAT_TA_64264.pep
FAVKNQKKNKKLGRSTVVPDASLPDGLPEFASAESMGEKGSSTIVAARPDFDLPEEVEKLVEDDQICPQIKNKNKGKAKETDVARPEVKIQEKKKLRRSTVVPDASLRDGLAESASAASVVGQGSSTVIINKIISRSIENMNLVTSIDAHPTKPWIVTGHERGNVSIWDYQKKEL

SEQ ID NO: 169847 - protein, 82 aa, Triticum aestivum
  Clone ID: PAT_TA_64265.pep
MAMARQGHCVYEDETMKKEELSVRLLWVQEHLNRDVTLTKTKEELPLREVKQEQEHANTRPETGTGRTTTTLGMAKPCPNQT

SEQ ID NO: 169848 - protein, 46 aa, Triticum aestivum
  Clone ID: PAT_TA_64266.pep
ASSVGKPQGFPRLTIVKRRPRAVNLGATIADLSRRRCAKVRKGPVQ

SEQ ID NO: 169849 - protein, 113 aa, Triticum aestivum
  Clone ID: PAT_TA_64267.pep
LVVAEAARRGGAHVAEAGCYVGPAVNVLVELGLSLLLSCWVGYPNPGAIPWEPRLYQTLGWVATGLFWAFVMLPRRGMNVDRTLGFGLLAIYTRCLSTTPCLFAQFKGSNGFS

SEQ ID NO: 169850 - protein, 103 aa, Triticum aestivum
  Clone ID: PAT_TA_64268.pep
LRPRVAISSFCSPPQVCSSSPGRVSPVVLLPRSGRGVLFSLARLIRTYAMAGRAMIIAVAGTQPRQGPASAVPVLSLSWCSLVSGCSVFLQRVGQRGKSVRAP

SEQ ID NO: 169851 - protein, 107 aa, Triticum aestivum
  Clone ID: PAT_TA_64269.pep
LDDADRSDFPVCHALYLFKLIGSHQGDACDFSISSCCTVTERCGSVAHHLSSGLRSHGHCSRRQKRMHRHERTRALLSCEKELRHHMCRDRRRDELRQWANRVRVTQ

SEQ ID NO: 169852 - protein, 138 aa, Triticum aestivum
  Clone ID: PAT_TA_64270.pep
LAFVLASFSLFPVCTLSTSAQFRPWALLSPRSSLPPAAPVSLLLSSPSVSVPVLVLPRGGRRFLFIFGLGLRHTVALAPHDPAFLPLLRTLLSSAVQHQAVLGASMVPSLLGSLVVGNLTGFRAAALGPSPCALASFL

SEQ ID NO: 169853 - protein, 74 aa, Triticum aestivum
  Clone ID: PAT_TA_64271.pep
MALQGHCVSEEETMEKEEVRARLRSEQEQRNRNVSLTKTKEELRLRVRKLEEELANTRPKPGPGRRLQHRDSKT

SEQ ID NO: 169854 - protein, 74 aa, Triticum aestivum
  Clone ID: PAT_TA_64272.pep
NVVQRRAEPWCDLGPLRSSATRSASCSFASVVPAWRSSCSRCSRSEPSRSSFFTYSSADYPWPRRPMMTTVVRA

SEQ ID NO: 169855 - protein, 51 aa, Triticum aestivum
  Clone ID: PAT_TA_64273.pep
VIPCNGRHALRPIATKVPNGDDCTSCTFSHSSGTSSSIDGFMVNHGEGTRV

SEQ ID NO: 169856 - protein, 108 aa, Triticum aestivum
  Clone ID: PAT_TA_64274.pep
KTLSTSEHSHPYHLGPLSPLSPITPVVTIFSFGPGRQSYRFTSSSSELKLCIFLHVRLQIHHIDPKVHQDHFCPNSTNPHSPRTVNRINCPLMNPRHVRTLINGRKGL

SEQ ID NO: 169857 - protein, 70 aa, Triticum aestivum
  Clone ID: PAT_TA_64275.pep
CPSLGRRVIKAPLYSICHTEGAKFFFSSPVRLDITSSGCFTQASGRRANQFVLSSMRLLHKRSNWHPKEP

SEQ ID NO: 169858 - protein, 117 aa, Triticum aestivum
  Clone ID: PAT_TA_64276.pep
MAQTMACMTGLSQGVRIPGPTGRRASRFTVRASPAEAEACGRRAVLGLMASGVVGSAFAQVVHAGTVGDIKDGPPTTLCGGLPVTDNFDEARDFDLPLKNRFYLQALPPAEAAVRAK

SEQ ID NO: 169859 - protein, 62 aa, Triticum aestivum
  Clone ID: PAT_TA_64277.pep
LNLGGPLENLWSCIPPASKLWSSKAPPPFSCLFFFSLFFFFFFYFFFFFFFFFFFFFFNFLN

SEQ ID NO: 169860 - protein, 67 aa, Triticum aestivum
  Clone ID: PAT_TA_64278.pep
FKRAFVHWYVGEGMEEGEFSEAREDLAALEKDYEEVGAEFDEGEDGDEGDENYCFCDCDLQICPSGF

SEQ ID NO: 169861 - protein, 52 aa, Triticum aestivum
  Clone ID: PAT_TA_64279.pep
DVHQPQGDKLSAHHWLCSPPHKKPSPRRSKIEPSIRKQSPRMHPTESSFFYI

SEQ ID NO: 169862 - protein, 154 aa, Triticum aestivum
  unsure (1)..(154): unsure at all Xaa locations
  Clone ID: PAT_TA_64280.pep
FGAAGKAVASRASFAVRAAAPERPIWFPGSTPXPSWLDGSXSGDFEFDPWGVGSDPESLRWNVQAELVHXRWAMLGAAGIFIPELLTKIGILNTPLRYTVGEHEYLTDTTTPLIGELIPIGCAEGRRWANINKPGCXNKDPIFPTQAYRTDVGP

SEQ ID NO: 169863 - protein, 72 aa, Triticum aestivum
  Clone ID: PAT_TA_64281.pep
KGRSWRYAHASKASARAHLGPYAVLHDVKNVKAQLVAMQVCSRCFRPRLASPQVVWSKKRALCRCQLLRHIT

SEQ ID NO: 169864 - protein, 50 aa, Triticum aestivum
  Clone ID: PAT_TA_64282.pep
GAGSRFKSHTHHHKGPGRLMSFDFGHRNRYTKGAPTVVMQTPEPGSPLDK

SEQ ID NO: 169865 - protein, 56 aa, Triticum aestivum
  Clone ID: PAT_TA_64283.pep
QGRSRSQSHAIETCIDIYLVKRTLLSYVNLPVLPIYQMASKVCKNIIPRAIILLAC

SEQ ID NO: 169866 - protein, 120 aa, Triticum aestivum
  unsure (1)..(120): unsure at all Xaa locations
  Clone ID: PAT_TA_64284.pep
FSDNKEDMINDGMHELLAHLHGPKDRMYQGGQWKVRGDLTEXTPYXKSSSIGFNKQIDHLNVVEKDRNGCLDVTNPTWNPMFRLVNIFEEFRDQIVLYWNRSDSXTGRLGKLMMRDTNAY

SEQ ID NO: 169867 - protein, 85 aa, Triticum aestivum
  Clone ID: PAT_TA_64285.pep
NIMSSNSSSCSPTRTTSCSFIAFGCPSRCKCFTLLSAKRHLSRPQLMWSPPDCARAAPCHVDTRLRVTGSFPADPEAPALLAASW

SEQ ID NO: 169868 - protein, 115 aa, Triticum aestivum
  Clone ID: PAT_TA_64286.pep
PAGMLPPRGAAASTLPAAPRTGFSPPTRRVGRPRCIKHHRCCWWPTLRSWCANKGCHEWPCAASCFCVEDITTDELLVALLPLVGQQLHRDGLPAATKEQLPLRAAQLKEVVDAT

SEQ ID NO: 169869 - protein, 54 aa, Triticum aestivum
  Clone ID: PAT_TA_64287.pep
FFEEESRKNDELTDRTRSVDEQLYRDGSLTETKEQLALPVAELNEVVDDTRPML

SEQ ID NO: 169870 - protein, 73 aa, Triticum aestivum
  Clone ID: PAT_TA_64288.pep
GGSLVVRVKLKKICRNPWGGTLQRTPANIFCIMKAIQHLNVFDKPLDQGRPDGPSECFCMTVLAIVSILPDTI

SEQ ID NO: 169871 - protein, 146 aa, Triticum aestivum
  Clone ID: PAT_TA_64289.pep
SAKSKTQPETRKTGLPPANRHERKRQNKQTEEADDRPRRERDKQQAKPRPNGAKAHREEPRQRELMPPRTRGKRTGDKRKTKKQHNAGQNRKRNKENTRTKQRNRTEEKQTPMNREKPQATTQKKNTKASNNTPTTHNRDAKNKKG

SEQ ID NO: 169872 - protein, 149 aa, Triticum aestivum
  unsure (1)..(149): unsure at all Xaa locations
  Clone ID: PAT_TA_64290.pep
TVFVHPAFYEGVDHTSIKAIACGRSTXXTADRATGEIMVHGGHGYYMEDXTQNDEELSVLVDLFGKQQKHDVHWNKTXEGVLLRMEEKYTGLLYSKRLITTCRVYRTWKHGYNLDRRKKCRYLEMLYALKYLKMDRTVPLAVESETPAK

SEQ ID NO: 169873 - protein, 140 aa, Triticum aestivum
  unsure (1)..(140): unsure at all Xaa locations
  Clone ID: PAT_TA_64291.pep
MVGVNTSVDGLKPGGVAPQSAWPAAGKRVQVAPAKDRWSGLLGLGGAFGVTAVCGGSARASVFDEYLEKSKLNXELNDKKRAVTSGGNFLRAYTVQLGSCXLPYNFTGCQDLCKHKKVPLITDDLEIECEGKEKLKCGSN

SEQ ID NO: 169874 - protein, 76 aa, Triticum aestivum
  unsure (1)..(76): unsure at all Xaa locations
  Clone ID: PAT_TA_64292.pep
RTGAPCHKCYKVSDNLIKTIYPHGTNYLGGESHVSWKSGTVLQDXDSEAXNVDSGSVALHLEWAHAPGVTLLGAPD

SEQ ID NO: 169875 - protein, 47 aa, Triticum aestivum
  Clone ID: PAT_TA_64293.pep
FPHYETAHASTGPRPRTSTPAKPNQQKQDRPPKPQHSREANQGNSRS

SEQ ID NO: 169876 - protein, 102 aa, Triticum aestivum
  unsure (1)..(102): unsure at all Xaa locations
  Clone ID: PAT_TA_64294.pep
MEADAQGESINAFARHPKNWCTTXQPAREFTRIQTVPTMLVADPEEFVAGQLAYTHGSLAPMGHSEEGVSDPRRNGEPDVRSLGEELNTLKRSQTGYERRTW

SEQ ID NO: 169877 - protein, 61 aa, Triticum aestivum
  Clone ID: PAT_TA_64295.pep
LWSTVNTLLAWSVSSIVSILQFFGDLALLSVHLFSHDQNFVIKFIAFHVRFHIDGSAPFSP

SEQ ID NO: 169878 - protein, 90 aa, Triticum aestivum
  unsure (1)..(90): unsure at all Xaa locations
  Clone ID: PAT_TA_64296.pep
TLGASWSLRSDFFDGIEHREIRSSADCLHEIDEHHNERAMDGMQDLVLILKRITGDIDDSGADHYPWLYTMGNDLEXSRGFLFGTVDSFK

SEQ ID NO: 169879 - protein, 109 aa, Triticum aestivum
  unsure (1)..(109): unsure at all Xaa locations
  Clone ID: PAT_TA_64297.pep
KARTVQVGQKGIPYLNTYDXRTIRYPDPLXKANRHYKAYELETNKIVDXLKNHDGNLTMTTDELNTGRVDVIKNLENPRATFETIHVEAAQGQQKPTRLGNEFTIGTGT

SEQ ID NO: 169880 - protein, 97 aa, Triticum aestivum
  Clone ID: PAT_TA_64298.pep
MDQRGHRLSDQVYITQDQLDRRHRSLREQLNRDIKLTGTKEELPLHVRNLKQDMNDATPTFDTGLSNTTLKLLTNKCLPNHNARNTFPLIQFNKDRR

SEQ ID NO: 169881 - protein, 108 aa, Triticum aestivum
  unsure (1)..(108): unsure at all Xaa locations
  Clone ID: PAT_TA_64299.pep
MKTVAISESVGGMVARSTRMMRGNRRGLSVSLGGNAGAMMQADRKITRXRHLEGHIWRTGLERQELQWAVVEDVHQALRNWQCEGMKVYIDSNGSREGQRLLCGHTSD

SEQ ID NO: 169882 - protein, 108 aa, Triticum aestivum
  unsure (1)..(108): unsure at all Xaa locations
  Clone ID: PAT_TA_64300.pep
MLRRNCCFISSNYNKLPAVLQQRDCXNHGVAQLNHLVAHHPFVSWCNSKEEGTDRRSXTIXSMIGEWYEPCSGAXEAAAVVVTSSMTAAIVSSVVAAAFVVFFSFFVT

SEQ ID NO: 169883 - protein, 66 aa, Triticum aestivum
  Clone ID: PAT_TA_64301.pep
FSVSFGCLTSVPVPCFGAGVVWAPLFALSSWWACSSFVPVGLSSRFCCSPSGRGRASLFFFGLGSS

SEQ ID NO: 169884 - protein, 84 aa, Triticum aestivum
  Clone ID: PAT_TA_64302.pep
FRTDDTGRRPTTVRLRTPGGITALSRRSTSAEDQMTKDQLSAHLPSLRTQVHREWRLTRTKEQLTLRVAYLKYAHDDTSTNLGT

SEQ ID NO: 169885 - protein, 105 aa, Triticum aestivum
  Clone ID: PAT_TA_64303.pep
GGPYATQQGRVPLTFKGADLLERPPAGALLVFSQPVKRGRPARCSNWGMARVFPATGVGPPPKKLNLAAPTKDPWVARTGTAGWDPQNRPPFFFFFFFFFFFFYI

SEQ ID NO: 169886 - protein, 123 aa, Triticum aestivum
  unsure (1)..(123): unsure at all Xaa locations
  Clone ID: PAT_TA_64304.pep
AERKTRGDPRARGRIPPPTQTARGRDQHRPRGPTPSGEEEGKADDQDRSYAGGHAGATDDQSRQNAPPKHGDGTDAKNNXDRETGTTRGRGXGTSAENKAKPQANEAKNGQDQDGRNRTDNEA

SEQ ID NO: 169887 - protein, 109 aa, Triticum aestivum
  Clone ID: PAT_TA_64305.pep
ARARLGPRVLRLLFRLCPAGRPFFFCPRRAVLSVRLFSPRAGGGALFFFCLGLLRGGSLAPRGPVFARCAGSCSSGCAPGAAGVLCSSVCSRAGSPVVSPFFGCGRRRF

SEQ ID NO: 169888 - protein, 164 aa, Triticum aestivum
  Clone ID: PAT_TA_64306.pep
IARRGQASHLHGRCAARPHGRGAGRPRRQRAWRTRGQRIHPSTAGAGKQAIRAGGEQGGRAGSEHGRREDGEHGARGRLTPPTTSSIGRAAASSLERAAASSLGRAAASSSSARLSLPSAAEGGLLPPASARQCCTGARRCPSLSPGTSEHGRAAVPKPRVGER

SEQ ID NO: 169889 - protein, 52 aa, Triticum aestivum
  Clone ID: PAT_TA_64307.pep
ILFAFFSSFNLAFFFFYFFFFFFFVSFFFFFFFFFLFFFFFFFFFWGVSEIS

SEQ ID NO: 169890 - protein, 95 aa, Triticum aestivum
  Clone ID: PAT_TA_64308.pep
RSTVVLLFHSLSFLFSVGSGCVFLWICLAGIRAFCVTLPLLGGLVLNPSSWGLVQGDLGHFVRIVALSVCQPLRLRAPRARCSKTPRSFAPAVWG

SEQ ID NO: 169891 - protein, 75 aa, Triticum aestivum
  unsure (1)..(75): unsure at all Xaa locations
  Clone ID: PAT_TA_64309.pep
AGGSVLLLVVGLPLRGGAGPPGAPVSAALLGLLSLFGGAPGAPVLFCFLLVLSRRVAGGIPVFLRVTGXGVSAFA

SEQ ID NO: 169892 - protein, 111 aa, Triticum aestivum
  Clone ID: PAT_TA_64310.pep
PTRPATRPVDFGYLYEGLGGERGKRKRREEEADASDSMELDAYAPRPSKLRAVVCQSDPSKPEAFGCATYDGVISEHVSLRTWKVPHTLRSSALMVSWKPVPMEQRVRDTC

SEQ ID NO: 169893 - protein, 150 aa, Triticum aestivum
  unsure (1)..(150): unsure at all Xaa locations
  Clone ID: PAT_TA_64311.pep
CLSVSKQEIHAVLSSNVPPKLVILHMNMALHVYDDIMRMTENLSEKYIIGYGASSTVYKCVLKNCKPVAIKKLYAHYPQSVKEFETELETIGSIKHRNLVSLQAYSLSPAGNLLFYEYMESGSLXDVLHAPSSMKTKLDWEARLQIALGT

SEQ ID NO: 169894 - protein, 86 aa, Triticum aestivum
  Clone ID: PAT_TA_64312.pep
VYVGVSVGETGGDDWLAPKIGPMSLSLKMIGEEIGEETAKDSEEVWKSLKVTVQNSEDKVYVKASVVALVIELLNEPLKDTQKGKN

SEQ ID NO: 169895 - protein, 65 aa, Triticum aestivum
  Clone ID: PAT_TA_64313.pep
MEIGSLAPRERPHAVMIPYPAQGHITPMMKLAKLLHARGFHVIFVNNEFNHRRLLRSQSGDRLRG

SEQ ID NO: 169896 - protein, 89 aa, Triticum aestivum
  Clone ID: PAT_TA_64314.pep
FCLFFSSGISRNTGTGTTCGRSSGCAPPIAPIGLPGRPFSPRSRLLLGHVVLRLRLHLIGMHRLECRSSTAPSCQSWRHLCAYAPHQHR

SEQ ID NO: 169897 - protein, 95 aa, Triticum aestivum
  Clone ID: PAT_TA_64315.pep
VGGVGPPSVLVGRAQGFCFPASLSLGPINFFLVPRCKAVALPFLSVDPGFSLPAPPAAFCGACVSFFSGRPVFASPAFLFFLLSFFFFFFFFFFN

SEQ ID NO: 169898 - protein, 75 aa, Triticum aestivum
  Clone ID: PAT_TA_64316.pep
VLIRSGPVEFESLFNTNRDKAHSDSNLVSTALTCIVLLSLKSIHLLIRAWRQDAAGSRLLTRRRGTLYVVGATQT

SEQ ID NO: 169899 - protein, 157 aa, Triticum aestivum
  Clone ID: PAT_TA_64317.pep
SYREFTVEVEAIGRVRHKNLVRLLGYCVEGAHRILVYEYVDNGNLEQWLHGDVGPVSPLSWDARMDIVLGTAKGITYLHEGLEPKVVHRDIKSSNILLDKRWNSKVSDFGLAKLLGSDSNYVTTRVMGTFGYVAPEYASTGMLNERSDVYSFGVLIM

SEQ ID NO: 169900 - protein, 55 aa, Triticum aestivum
  Clone ID: PAT_TA_64318.pep
SVQLWCAGFLLAIIGGPYRSSGISDSLHIFSHPPQLSMILPVFSTHQYQGPPNVH

SEQ ID NO: 169901 - protein, 73 aa, Triticum aestivum
  Clone ID: PAT_TA_64319.pep
LDHKVHKSVSHRQQDDSQPIWGSASLPRPSPPLEDLVYSSLDEGVLIRVTHQLQGFKLFLGFLKASKRGKKPV

SEQ ID NO: 169902 - protein, 110 aa, Triticum aestivum
  Clone ID: PAT_TA_64320.pep
LAGGRPGAGGGCGDGGAVAGAACGARRRQDDLVRRDAGGRGAGPQRADPRGRPGQSVQPRLRGLQGVQRLSSNPAMLNDQFVLLTFLSYLVATSAVERKIKPRAIAMEFV

SEQ ID NO: 169903 - protein, 99 aa, Triticum aestivum
  Clone ID: PAT_TA_64321.pep
LNSAKLVRRRDKHNMSVNRGGYCSTSTLSAGSPTSSPSEERVSSGISLSWQDVYNIAVKWRQISEPCDPVVWVNKLSEEFNSGFGSHTPLLFGQAKIGR

SEQ ID NO: 169904 - protein, 82 aa, Triticum aestivum
  Clone ID: PAT_TA_64322.pep
MRCKLHPYANALGVCAPCLRDRLLVLAAERDRAGAGASSGADCSSSSSRGSSPARGRAASTFAADVVVPAQQHRRSDACAYT

SEQ ID NO: 169905 - protein, 71 aa, Triticum aestivum
  Clone ID: PAT_TA_64323.pep
MSRTGPIARDCLPVVVCLMPPNSAGKKDWGDYMAFRRAGVDMDIAKKHYAGTNKAVYSTTSLTPMWLYDDT

SEQ ID NO: 169906 - protein, 50 aa, Triticum aestivum
  Clone ID: PAT_TA_64324.pep
TEAARLRYLYRLVPRERPPVFYFVFGRSPGNDLVIFFFFFSHEKRPKSPR

SEQ ID NO: 169907 - protein, 51 aa, Triticum aestivum
  Clone ID: PAT_TA_64325.pep
GSWTMDKAHGGQTCEAETNETMTANEAPEREPMDWDPEGSTDHGSTWKTKD

SEQ ID NO: 169908 - protein, 87 aa, Triticum aestivum
  Clone ID: PAT_TA_64326.pep
CAHSHQHTRREQSAARRARARKKDGGGEEGKQQPQLVPAHKPNLPSQPDVDDPAKGGLREDVLAAEKTHDMAALYEDMADDGVTEKD

SEQ ID NO: 169909 - protein, 52 aa, Triticum aestivum
  Clone ID: PAT_TA_64327.pep
CRGGRCPCELSEGVHLGVNGVHGCCRRARRDLRAGVDYEVPRVRGRWKPKKK

SEQ ID NO: 169910 - protein, 100 aa, Triticum aestivum
  Clone ID: PAT_TA_64328.pep
IKKLKSRANAEVASAGVGSATSTATLSSLQSLLAHVWRSVSRARRLSPVEETTYTVLVGCSDRVKRVPRTYAKNTEVRSKASSTTSEILEKGTFAWESPR

SEQ ID NO: 169911 - protein, 151 aa, Triticum aestivum
  Clone ID: PAT_TA_64329.pep
LTRNRQRQREQTTQNPHHQDRTRGKERDRRKRARRNRPEPQRGRSRNKRQGKKGHKQKRKQPNKRAAGNPQTGEGKEGKRGQRKTRAEAKTTQGAPPRKKAQAKKKNSKKTGKTPRQTKDRQNKGKKEPRKGGGTTRGRKAKKKKKKKGGR

SEQ ID NO: 169912 - protein, 66 aa, Triticum aestivum
  Clone ID: PAT_TA_64330.pep
PPPPIKAPKRGGPHTPIEMRDVGRDDRVGPLQDYHPQGKRGIIPKTLSRGAPGFSPPHGVSAPPQD

SEQ ID NO: 169913 - protein, 60 aa, Triticum aestivum
  Clone ID: PAT_TA_64331.pep
LAALGLSHAQEHVPLRCSSMQWRRACSYSFRFVHHTFQSPVVRWQMTIACQFIFHFRWLL

SEQ ID NO: 169914 - protein, 161 aa, Triticum aestivum
  unsure (1)..(161): unsure at all Xaa locations
  Clone ID: PAT_TA_64332.pep
LRVRPRVRAAAPSASAVSVRQRTAAAASPLLQDQQQEKHEAADPVPPPPPRSTLYQALTSTASLANLLPTGTVLAFQLLAPTFTNHGACDATTALLTRILLAVLALSCLLAFFTDSLNGPDGRVYYGVATLRGLWLLDYPPGAXTPSDTFRYRLAPIDAVH

SEQ ID NO: 169915 - protein, 68 aa, Triticum aestivum
  Clone ID: PAT_TA_64333.pep
CSVLLLVTVCVVRLSSWLPLSLLPARIGLFFGRLAFVLLVTLSSLGRRGCLVHPPLSFRFAGGNPKFG

SEQ ID NO: 169916 - protein, 89 aa, Triticum aestivum
  unsure (1)..(89): unsure at all Xaa locations
  Clone ID: PAT_TA_64334.pep
FSCVRPRVRGRVGYSKREFWLEKSTGMDCMALHLKAXVITGIDDRRYWVHMPNTEFRFQSVAYLNQIXWIEVFXEIDFHLPVGTYSLYF

SEQ ID NO: 169917 - protein, 38 aa, Triticum aestivum
  Clone ID: PAT_TA_64335.pep
GEFHDRGWCVGTAPWFNGPYSPGRVNPGLLLVRSLKIK

SEQ ID NO: 169918 - protein, 68 aa, Triticum aestivum
  Clone ID: PAT_TA_64336.pep
FSCSPIEIREALSIIFCYVVRPGKNYGCVMAMIAAGVQARTHQVQPTVRAVLTKSWSTHSSDRWKMQD

SEQ ID NO: 169919 - protein, 81 aa, Triticum aestivum
  Clone ID: PAT_TA_64337.pep
QDSRRPVPDRNGWLNPRCTFHASAHACGHAFAHASAHASDRYHETPGGPISEGWQISALKYKNVNYTFVSVFGIVLDARLD

SEQ ID NO: 169920 - protein, 47 aa, Triticum aestivum
  Clone ID: PAT_TA_64338.pep
RPVPVWIAWPDPRCPFERTPQYHNTYEERLELFSSLRESGVLVHHRF

SEQ ID NO: 169921 - protein, 65 aa, Triticum aestivum
  unsure (1)..(65): unsure at all Xaa locations
  Clone ID: PAT_TA_64339.pep
LLTYSVESPNFKSLALGLQRADWXNPGGTQLNMHGAHPSLASWKNSEEVCTDRXSKQERILHGEW

SEQ ID NO: 169922 - protein, 91 aa, Triticum aestivum
  Clone ID: PAT_TA_64340.pep
FPFRRPPTRPNQVCMVRAQVSCALVLGLLMDSKLLSHSTNIWIQGDVCSNTHLHLGTSLRSNRCMGLVLEVFNIHMTWEANLCKMLLCDLL

SEQ ID NO: 169923 - protein, 72 aa, Triticum aestivum
  Clone ID: PAT_TA_64341.pep
KSGRSLLSITPSCNNSIGSNAKNFAHTNVLPSRRDCISNEPRLEFRCHHCILPLLPSRACIPGSSRALAHYS

SEQ ID NO: 169924 - protein, 81 aa, Triticum aestivum
  unsure (1)..(81): unsure at all Xaa locations
  Clone ID: PAT_TA_64342.pep
KAQPSASSSFRHRQAYITDQCTPNERRPPTSSSLVMGWLSEPQCPFQPPLSPDDRGRSHQDRPIASAXLTAPRASRVPAXR

SEQ ID NO: 169925 - protein, 103 aa, Triticum aestivum
  Clone ID: PAT_TA_64343.pep
MSGRGKGGKGLGKGGAKRHRKVLRDNIQGITKPAIRRLARRGGVKRISGLIYKETRGLLKIFLENFIRDTVTYTEHARRKTVTAMDVDYALKRQGRTLYGYRG

SEQ ID NO: 169926 - protein, 102 aa, Triticum aestivum
  Clone ID: PAT_TA_64344.pep
ICRHYGRLLRRCPRKVLDGLLCRCKFTTRFMDPLMAPQEGQDTDLVVNRVVHRRERILERDLVTVHAHADRERAGAHSGDRPGHYHHHDRQHCGSHFARQLG

SEQ ID NO: 169927 - protein, 125 aa, Triticum aestivum
  Clone ID: PAT_TA_64345.pep
SVGGDAFVGELKRHYSHLSLGLRIPSGSVVDALALSVTGICFGTRLYLGLRLEPIALSRRVKHPLQASAQYTVGIYDAFGNTASPFWTAGGGALHRIERLKKKNKVVFFDKFKRRNVESCKKSPF

SEQ ID NO: 169928 - protein, 73 aa, Triticum aestivum
  Clone ID: PAT_TA_64346.pep
AIKARLTALQLIIGQVGSSKVGSSQRLHGPPVVAPPSGAVASAAHVLVVVPVTVAVTVVITRGKVELQVQPVK

SEQ ID NO: 169929 - protein, 59 aa, Triticum aestivum
  Clone ID: PAT_TA_64347.pep
RPIGSFQDALCEDPSCLIRMCDACTVSSPVSAISPLLKPLAARRSDGSLWWVGWLRKGK

SEQ ID NO: 169930 - protein, 61 aa, Triticum aestivum
  Clone ID: PAT_TA_64348.pep
GETAYHILLPRRRSSTLYSKTNLKFYAAPLFIHAKKVHTTKLALPLETDHTHITHTHTNKR

SEQ ID NO: 169931 - protein, 63 aa, Triticum aestivum
  Clone ID: PAT_TA_64349.pep
NNENGKQTNTSHMFHYFPRNNKLMPTLDIILPVSQLETSSQTMALELLSILNHRSAPSCLTGK

SEQ ID NO: 169932 - protein, 86 aa, Triticum aestivum
  unsure (1)..(86): unsure at all Xaa locations
  Clone ID: PAT_TA_64350.pep
MKGTKLGAKLILQAVLDMGLLLHVNAYVNPKCCNNCWYNWGADVCDDAHHKCYQDCSEGCVVCTSPXRGAXADMKSTVECTCGGPC

SEQ ID NO: 169933 - protein, 90 aa, Triticum aestivum
  Clone ID: PAT_TA_64351.pep
MEENPSWCFGKHYRSVKQLEIVGACEDEFGVPNDLHLPDLHLLPHNLRRLKISCPNLLNDENPMPLLGSWLTFLNVLEIGVKSYTGATMT

SEQ ID NO: 169934 - protein, 103 aa, Triticum aestivum
  Clone ID: PAT_TA_64352.pep
GTGAEARGRPTRVLSRAPARARAGALEEPGVAARACNKEPASRVAPKLQPTWGAMIQRGGLARPRRYPTGIGPEAHVTKSPRWRNERTGDRTGTPVPQTVAQP

SEQ ID NO: 169935 - protein, 73 aa, Triticum aestivum
  Clone ID: PAT_TA_64353.pep
PFFCPVQWAFPALLSPQQSKASTLPIFQSAGSPQKSPPPEAPCDRQCSVVTLKVARSSGCLMNPAAPYRRSAR

SEQ ID NO: 169936 - protein, 38 aa, Triticum aestivum
  Clone ID: PAT_TA_64354.pep
HKQFQSFVRLRHAHMAVQFLILDPQVPNHCLLGHEFLP

SEQ ID NO: 169937 - protein, 116 aa, Triticum aestivum
  Clone ID: PAT_TA_64355.pep
MISGRKGGLWKKAVTRFVKAGLHFPVGRFWRYLRKGRYTQRVRSCAPVYLGTALEYLAATVLELAGNSAKDNTKTRIIPSHLLFAGRNDQELSKLLAGVTIGHSGVIPNINFRLLP

SEQ ID NO: 169938 - protein, 59 aa, Triticum aestivum
  Clone ID: PAT_TA_64356.pep
MALHSHCFYVEDATTKEQLTAPLRSLEQQLSPDVTLTGTKEELVLRAAQLQEELVATRS

SEQ ID NO: 169939 - protein, 60 aa, Triticum aestivum
  unsure (1)..(60): unsure at all Xaa locations
  Clone ID: PAT_TA_64357.pep
MNKEEQGGFFWNMENNKCLGVLSGHTFSVXSLTCHWGGPVLGIQGSCAGFAALWVFFWDP

SEQ ID NO: 169940 - protein, 89 aa, Triticum aestivum
  Clone ID: PAT_TA_64358.pep
KSTVDVYGLPQLRPLSQPTGINPGPLLGGGPLGGPNFPNAALQAHLPSLGPPKSTSRPAFYHRWTGETPGGPPLIGLGSHPPLPWGLLM

SEQ ID NO: 169941 - protein, 74 aa, Triticum aestivum
  Clone ID: PAT_TA_64359.pep
RRGREEEDNVWSTLLLPAHAMSSVNNQEHACRAWVRVHRRLACEQGCNSEADEKRLVLKGREGYAFLATKEEPM

SEQ ID NO: 169942 - protein, 114 aa, Triticum aestivum
  Clone ID: PAT_TA_64360.pep
FSWADAWADAWDLCITAGALVLRFQRRLKTAERVMGTVKRFNFTKGFGFIFAEDGSQDLFVHQDSIKADGYRSLNENDVLEFEVITGDDGRTKVFDVTAPGGGALAGGSRPGHR

SEQ ID NO: 169943 - protein, 69 aa, Triticum aestivum
  Clone ID: PAT_TA_64361.pep
NGCYSPSPTGRGGRFLKCHQGISPITAITLEANKTRYHGPGSTLAEDARLDEYRSTLRGTSHIGGRTEP

SEQ ID NO: 169944 - protein, 52 aa, Triticum aestivum
  Clone ID: PAT_TA_64362.pep
LLIMAGFEATGQHTGANQGVRTVDSPLAYVSAVARGPRLPNKARSFKCRVCH

SEQ ID NO: 169945 - protein, 75 aa, Triticum aestivum
  Clone ID: PAT_TA_64363.pep
MSCNCGSGCSCGSHCKCGKVYPDLTEQGSAAAQVAAVVVLGVAPENKAGQFEVAAGQSGEGCSCGDNCKCNPCNC

SEQ ID NO: 169946 - protein, 73 aa, Triticum aestivum
  Clone ID: PAT_TA_64364.pep
SLPPRAEPRQGGVYTATGVLFASALVAIPSSMALMDRLRLGRLSAGPRTRTEEGNLRQIKPGRHRNFQEWAKR

SEQ ID NO: 169947 - protein, 58 aa, Triticum aestivum
  Clone ID: PAT_TA_64365.pep
VPPRLLPFLVCVSSSSSFVSAARIFSLSLVPASLPINVQLFPQLSVKLLFQFVSSVHF

SEQ ID NO: 169948 - protein, 138 aa, Triticum aestivum
  Clone ID: PAT_TA_64366.pep
MDFYERMGDTLAIQYGGSAAHNKIFCEQRGQWKAATQSQEFLRTLQRYYNNAYTDPEKQDAINVFLGHFQPQQGKPPLWKLDSDQHYNIGRQGTLSEETGRYGRVGISEWCMYHLSGALVTAWCLHVMCACGNISISM

SEQ ID NO: 169949 - protein, 133 aa, Triticum aestivum
  Clone ID: PAT_TA_64367.pep
PLDADAQREGNNASARYPKNRFTSGDPARAATMSQTAPPKPLADPEEPATEQQAKPWHLRGHCTLRGGAQRRKMNRMARHRPAGRTHRHRDESPDGERKKNRRLREADLKEEPDDTRPKLGTGRRPTTPGLGK

SEQ ID NO: 169950 - protein, 72 aa, Triticum aestivum
  unsure (1)..(72): unsure at all Xaa locations
  Clone ID: PAT_TA_64368.pep
RLPVGVELVFPGSAAPGLFVFCSAGFSRVSFVSEGLGSARGSGCFTLPSDVLSCRSSCIRPPRWPRSFXLEA

SEQ ID NO: 169951 - protein, 107 aa, Triticum aestivum
  unsure (1)..(107): unsure at all Xaa locations
  Clone ID: PAT_TA_64369.pep
RHINCHKRSPETGNFCLHCSTSDRILNGDCANFSFLRLRSFNPTPARIEGVFVPNPXGFYPRRGLDPRLAYMHIRLNPDGFIFHPKPPQTQGFTGFWATSSSAWKKT

SEQ ID NO: 169952 - protein, 66 aa, Triticum aestivum
  Clone ID: PAT_TA_64370.pep
HPGLVVSSSQRVRPCCSSLVVRFSVDRLCRGRSLIIFGGRGCPFDRRVTKRTVSVKFTVPFCSGSW

SEQ ID NO: 169953 - protein, 90 aa, Triticum aestivum
  Clone ID: PAT_TA_64371.pep
RERGRTTGENKALRGQRGPEEETTTKEEPKAPLRSLGEQQNRDVNQTGTKEKLALPEAEPKEEPEDTRPKLGTEPTHNNHPTGKTLAEPN

SEQ ID NO: 169954 - protein, 133 aa, Triticum aestivum
  Clone ID: PAT_TA_64372.pep
HEEDGDEQPAKTRPPGAKDTQRRRPRPKRNGKPGPARGENNRTEKAARRGRKKNRAPGRQSGKRRTTTRGQNTAPSRHKKQPGRGKTSRDPTKKPRNTNPTPSRGKSQKGRTRAAPQTGAQPERRKGPGGGNK

SEQ ID NO: 169955 - protein, 90 aa, Triticum aestivum
  Clone ID: PAT_TA_64373.pep
LRLSARFCSGVAPRVASVGSSLRFPVRSFVPGSSCSSFGRRVLILLFLLCLAGRPVFCCPRLAHVPALLFVRLSVSGLSVVPSSWCSSSV

SEQ ID NO: 169956 - protein, 90 aa, Triticum aestivum
  Clone ID: PAT_TA_64374.pep
RTGPAVPRPRGGRGRTTGENRALRGQRNPGEETTTKEELNARLRSPGEQLNREDSQTGTKEEPAPPAAELKEEPEDTRPKPGTGRRMTTT

SEQ ID NO: 169957 - protein, 132 aa, Triticum aestivum
  Clone ID: PAT_TA_64375.pep
PRRERAQTTGANKAQRGQRKTGKEPMTKEELKDPPRSQGEQLNREDRTDGDKRRTGAPRGRAEKRSTKTQGLSEAQAEGKKQSDREKPGVTKTKSPEKQTPKDSRRKSEKARTERPPNKSTNRKGERRQKRK

SEQ ID NO: 169958 - protein, 116 aa, Triticum aestivum
  Clone ID: PAT_TA_64376.pep
PEPAREHRVTFRGPSPAVPPTQRRKETEQPAKTRPHGAKEAPRRRPRRKKNRRPASRRWENNRTGKPARRGPKKNRGPKRKNRKRSTRTRGPSTETSRRNTKNQNGKTPAENPNGK

SEQ ID NO: 169959 - protein, 125 aa, Triticum aestivum
  Clone ID: PAT_TA_64377.pep
GGGNDAPGRPKPGATTPEPARERSVTYKGPGRLTPDPEEEGGEQPKETGTEGARGQSGGDHDEGRTESPPPSSGGTTEPGGEPDGDKRRTGATRGKGGRGPTRTQGPNEEPGERTTKPETGKKPG

SEQ ID NO: 169960 - protein, 117 aa, Triticum aestivum
  Clone ID: PAT_TA_64378.pep
LGFPGPPLCCGLSCASLGPGVFKLLFPLCLSGAPVSSFGPRLASLSRFCLFSPRGGGGLSVLLLFWLSSSFPPLAPLVLGSSGCSLLSSSGSGVSGLGPLKPTLFSRSGSWLLAPGF

SEQ ID NO: 169961 - protein, 48 aa, Triticum aestivum
  Clone ID: PAT_TA_64379.pep
LSSWACPPRRFGSVRPWFCQSPRCSPPAGGLQPDRPFKNTTRRMLPFV

SEQ ID NO: 169962 - protein, 129 aa, Triticum aestivum
  Clone ID: PAT_TA_64380.pep
HEPARENSVTFKAPNPHEPDPEEDESEQPNEPGPHKATRGKQRSPRRKKNRKTATPSRGNNRTETPTGQGQKKNRSPEGQSKKSTKKTRGPNRAQAHPKQPPGPGKPRRNPNKTHNKTTPKSPTDAKNK

SEQ ID NO: 169963 - protein, 132 aa, Triticum aestivum
  unsure (1)..(132): unsure at all Xaa locations
  Clone ID: PAT_TA_64381.pep
GDPNNPAKQGPTGPMEKQRRRPRTKEEQNARPRKKEEKPNREDNPTXTKEERAHQAAKPQKGSPKTPGPNTATGRQPTTTRKEKPRTNPQQTTREKKTPTTSGPKTNKDQNEHPTQPESETKRQKEARRKTN

SEQ ID NO: 169964 - protein, 75 aa, Triticum aestivum
  Clone ID: PAT_TA_64382.pep
RKPPTPSRGNNPTETPARRRPKKNRRPAGQTRKRTPTTQGPTQAPTHEPQRPQPRKPRRHPTKTPRNTTPHTPTG

SEQ ID NO: 169965 - protein, 77 aa, Triticum aestivum
  unsure (1)..(77): unsure at all Xaa locations
  Clone ID: PAT_TA_64383.pep
PPWPGKNKIPFLAPPPSXSREKIDLPSIVQVSHIRTLTVFGEWQSLLLCPNTTIFPALALPDAEGVQAPDLVPIGKL

SEQ ID NO: 169966 - protein, 71 aa, Triticum aestivum
  Clone ID: PAT_TA_64384.pep
WVRRVSSCVVNAPGQLRPVSQLLFQSAPEAVLLCPSGCSGQCPHEERHQLSCQAPPRTWPKPYTQCDRLSG

SEQ ID NO: 169967 - protein, 47 aa, Triticum aestivum
  Clone ID: PAT_TA_64385.pep
EDRVVRLVLIAVVVEPALLVRVAHELGLTRLCAMMGTSAQVTGLLAQ

SEQ ID NO: 169968 - protein, 33 aa, Triticum aestivum
  Clone ID: PAT_TA_64386.pep
PSSCPLSARTISPSVGAAVVNGGFTGLFSYCTS

SEQ ID NO: 169969 - protein, 72 aa, Triticum aestivum
  Clone ID: PAT_TA_64387.pep
RCQPVPVLVLVSTTSSVIYATRQGRSSLAFSMRTFRMGCSSSTVGGPPADHRSLSPQQINLGHDRLFPVQLL

SEQ ID NO: 169970 - protein, 81 aa, Triticum aestivum
  Clone ID: PAT_TA_64388.pep
TVDLLAPPCTGKAEGSTTCIMGAGQRSELLGAPLVAHLAACMQYCPSYDDIYVCKYYCQRETGGHCMFSIAGICGCLLKLQ

SEQ ID NO: 169971 - protein, 93 aa, Triticum aestivum
  unsure (1)..(93): unsure at all Xaa locations
  Clone ID: PAT_TA_64389.pep
PLVRIRPSIPGGSRRDIAAAGTGSGMPFTSPSRTIGGPLRSYPNLRPSTAAARPGLSFHRXPRPGDTNPVVQRWVPQIGMPPPDAELFWEYYC

SEQ ID NO: 169972 - protein, 112 aa, Triticum aestivum
  unsure (1)..(112): unsure at all Xaa locations
  Clone ID: PAT_TA_64390.pep
SLISAGKLLMNGQTLADYNIQKESTLHLVLSLKGGMQILVKTLTGKTITLEVEQYDTIYNETAKIQAKEGILPDQQRLIXAVKQVEDGRTLADYNIQKESTLHLVLRLRGGQ

SEQ ID NO: 169973 - protein, 112 aa, Triticum aestivum
  Clone ID: PAT_TA_64391.pep
QKTRQTAQLFGKTIGKGHPANTPTGHKKKGQQGDQPGEHKGFPKKTTPKQRPEELNLGNPIKEQIGSHERGPKHGSSKTTPQFFFSFFFLLSLFFFYKKFPFSANRLPRHKT

SEQ ID NO: 169974 - protein, 46 aa, Triticum aestivum
  Clone ID: PAT_TA_64392.pep
MGVGGEKFQLGTVGALGLSVVSSVSIVICNKALMSSLGFTFATTLT

SEQ ID NO: 169975 - protein, 94 aa, Triticum aestivum
  Clone ID: PAT_TA_64393.pep
GKRELDAELRDAFDIYDINGDGRISVAELSKVLARIGEGCSTEDCEKMIASVDVDGDGCVGFDEFKKMMTGDVAGAPPQSEATAAPDSNKPKKE

SEQ ID NO: 169976 - protein, 72 aa, Triticum aestivum
  Clone ID: PAT_TA_64394.pep
SVSLSAPPRKAHPRLVRTQNHSILLYSCVKHNQPKTLTHVDTPPLTCAGGARSCLHTCAFFPNPKFGANKVG

SEQ ID NO: 169977 - protein, 62 aa, Triticum aestivum
  Clone ID: PAT_TA_64395.pep
RPWRPPRPSGARPRRGCASRGGAAGDPAPRRRARPRPATATGRRPAPSSPAPTTPPPRRRRR

SEQ ID NO: 169978 - protein, 80 aa, Triticum aestivum
  Clone ID: PAT_TA_64396.pep
KFWERQKGRAPSVITQPGKRGSAPKPINWGTPRVSPTPRWKTTAKEIKLRAPKKKKKTPKHAEGNLEPQKRPPPYFFFYL

SEQ ID NO: 169979 - protein, 68 aa, Triticum aestivum
  Clone ID: PAT_TA_64397.pep
IFTNKRKVNMGKKQNLDFRTMTTQVLNWATCLVEQETIPPIGHQRLFLSGNLNSINCPLVILEETGKT

SEQ ID NO: 169980 - protein, 64 aa, Triticum aestivum
  Clone ID: PAT_TA_64398.pep
GRVGFVAPLLQHALPYHGAFSLSFPSHGAHPSIPMTPLPLPSSYGASLPSILVSVSLSLSLLEP

SEQ ID NO: 169981 - protein, 75 aa, Triticum aestivum
  Clone ID: PAT_TA_64399.pep
KNKFVQCFHRQVGAGVFLAQLASLRSHCNIPLATLKLVAGTCLHHDGRRSFSLPGNIDDLRPVPHDGAQRLRSVG

SEQ ID NO: 169982 - protein, 67 aa, Triticum aestivum
  Clone ID: PAT_TA_64400.pep
SWHPPSIAVEAARPVLRHLFAALLPLVIQLHQRHSVHHGARPLRLTHRRPVCPVASQALVPSRCGFV

SEQ ID NO: 169983 - protein, 187 aa, Triticum aestivum
  unsure (1)..(187): unsure at all Xaa locations
  Clone ID: PAT_TA_64401.pep
GIVPQYSVTPYSPVGQTWLASATQEXRSHFICLEALLQVHVNLLKXATWGNSIMMPPXVLLSEACNIPSRELNMFNSRXETIRIXHLRASACDLIFFLIADLKEEGQKIALWDGISSDNPTIRSLTRXDFVLYLATISPRSILGYIKYSTAIQHDKIPPHVDKNTALGNEXEGNVSPFGSLDPIKST

SEQ ID NO: 169984 - protein, 91 aa, Triticum aestivum
  Clone ID: PAT_TA_64402.pep
SNRQFCYRHFWEQGVYGISRYWLKEQERHLSDSLHVRNYTRDITLQGSPLPEFLREEYELWADQECLGHYVLHLGIYHSPQLPVDPRVPSS

SEQ ID NO: 169985 - protein, 68 aa, Triticum aestivum
  Clone ID: PAT_TA_64403.pep
TSHRLEDEHDHQPTLVGEQQNHHDTLTQTKEELELLDGHIKEEYDDPRSNNATGRLYTLLRLVKQCGY

SEQ ID NO: 169986 - protein, 45 aa, Triticum aestivum
  Clone ID: PAT_TA_64404.pep
PCRSSLEDHPGRTRFIYIGPDTASVISVEANTGWHGGKTKPYHSG

SEQ ID NO: 169987 - protein, 67 aa, Triticum aestivum
  Clone ID: PAT_TA_64405.pep
TPPHRTQWLRTCHDHIQLLLHDTHHGSTSSILDSDCILFHSRTRCPINPQFSGFRADALIPRSCASL

SEQ ID NO: 169988 - protein, 88 aa, Triticum aestivum
  Clone ID: PAT_TA_64406.pep
RFYRRGAGGHLPRGGDQGHPLQEPRLVNPAPANGILSVLIAGRSIMWWRWGPLARAVVDHLLPARAVRMPASDGLGLSSVCVPARRAN

SEQ ID NO: 169989 - protein, 125 aa, Triticum aestivum
  unsure (1)..(125): unsure at all Xaa locations
  Clone ID: PAT_TA_64407.pep
LLRRINEEQRHNLQNLGLPVPXDFWAMESLPAQLPGLPXVLKATXHGYDGQGTHIINSPADLPDXVKLTPXSWMXASFVPYERELGVIGFRNVRGEMEVYPVVDXKQIDQLCRWVEAPVPIDFNI

SEQ ID NO: 169990 - protein, 80 aa, Triticum aestivum
  Clone ID: PAT_TA_64408.pep
RPLIRSTCRRGSRAYKQRAFLCTTFRVSGPCRAPPSLGAGTDSDESPTAYPLVPGSRRRPPPDTGCALQLSSWLPTGGIA

SEQ ID NO: 169991 - protein, 50 aa, Triticum aestivum
  Clone ID: PAT_TA_64409.pep
IDIARPLCIGNDKVSRMTACRRLVETAGSRGSTDDISVLIIQLQKFSGSS

SEQ ID NO: 169992 - protein, 59 aa, Triticum aestivum
  unsure (1)..(59): unsure at all Xaa locations
  Clone ID: PAT_TA_64410.pep
IARNGGEAVSPPDATADGMEVEAXEEACEEGNEGEDVMQRRLIYDSHLHYIYSQNKVTP

SEQ ID NO: 169993 - protein, 50 aa, Triticum aestivum
  Clone ID: PAT_TA_64411.pep
HYVASAVRCTVLIPLDVMAPVSSPKFIVVVLLAFVPVFTHEKTLIHSVRV

SEQ ID NO: 169994 - protein, 43 aa, Triticum aestivum
  Clone ID: PAT_TA_64412.pep
PSCTPTRPPTRPPTRTPTRSAPGSDLGEQPQLSEMLANYTADQ

SEQ ID NO: 169995 - protein, 39 aa, Triticum aestivum
  Clone ID: PAT_TA_64413.pep
LHTFCIGCPKPKSLAGRLHPRDWLDPGLAQLKSLAAQKP

SEQ ID NO: 169996 - protein, 76 aa, Triticum aestivum
  Clone ID: PAT_TA_64414.pep
GEPPGEGPALMAGATHPSLFAGGGAEDGIPAYDITSSGRHGARVRRSVTVTARCLCCTDMLNGLGGWGTNILCRSI

SEQ ID NO: 169997 - protein, 52 aa, Triticum aestivum
  Clone ID: PAT_TA_64415.pep
SFIPRLRCAEKEKCTSYSHLPKMVVGTILDLGHGPAPKVQFTNSRIIHTFHG

SEQ ID NO: 169998 - protein, 82 aa, Triticum aestivum
  Clone ID: PAT_TA_64416.pep
ALIRDYHQTKYNVSSLYIQKNGVWVEPDANQQAWHQGDPWGDQTVTAGQLWQFAPDAALMEVWNTILDGPKREYRTVHGLYS

SEQ ID NO: 169999 - protein, 144 aa, Triticum aestivum
  unsure (1)..(144): unsure at all Xaa locations
  Clone ID: PAT_TA_64417.pep
MICNKTPPARSDDSLAQQQLLSPINSLSYSTXSRHGISRDLVGTQKMXWGSRILDFADVLVFYPMRVHGQEWRFCSPCIKXWSPRNLLARVXWMLFLRRASCAFAHKVTVAAEKPTSPGPEDSCSQASKRLRHANILVVKDSSA

SEQ ID NO: 170000 - protein, 68 aa, Triticum aestivum
  Clone ID: PAT_TA_64418.pep
NGPPPLFFYLSFIYSFCTKLTNVLQLYLYFLLLIYFFFLVSTTQARDLHMNKIHQYHIQVSNLVHGQP

SEQ ID NO: 170001 - protein, 115 aa, Triticum aestivum
  Clone ID: PAT_TA_64419.pep
MASRASMLATIMACALLLAGSTCDAARNLADTTPTAAAPAANVVPGLPAEPTDTVTLMPPMPSVTLPTVPQVTLPTMPAIVVPKEVLPPMPKVTLPTVPYVTMAPMPAIVEPKVT

SEQ ID NO: 170002 - protein, 93 aa, Triticum aestivum
  Clone ID: PAT_TA_64420.pep
ISRSGEYTYTYVGLPTPSSRRSSGNPCPTTVGHPLGRWALNFLPTARVASEHPYGDTVTLRAQALCFPDTFSAGCLLSIAFILTVKLLILRIC

SEQ ID NO: 170003 - protein, 41 aa, Triticum aestivum
  Clone ID: PAT_TA_64421.pep
SHDHSSCASRYSQGSCSSVNGAALFIVYSRVGLPVDYPFFV

SEQ ID NO: 170004 - protein, 113 aa, Triticum aestivum
  Clone ID: PAT_TA_64422.pep
RAVNTIGLVSTSSSFHLWPTELRVLFSTRRHGLIVRLLCHQIVGNQGVYPQSRTPPQRNGGSTGVLLMPVVMPLRSARAFIVWSPVYNWPLVFSRAVRRVLTRFFRTMVDSLM

SEQ ID NO: 170005 - protein, 68 aa, Triticum aestivum
  Clone ID: PAT_TA_64423.pep
RIFEIVHTDENLFFRIRQAHISDSYEVPRVGGSLLLLSSAVGAHYIKQLNGSLSLGGLLATDHHYVDA

SEQ ID NO: 170006 - protein, 41 aa, Triticum aestivum
  Clone ID: PAT_TA_64424.pep
MTLVYLAPIALLSLLDEVTSEQYSRTTVFNVHCVLSEEFPN

SEQ ID NO: 170007 - protein, 66 aa, Triticum aestivum
  Clone ID: PAT_TA_64425.pep
RSRARERRPRPKITKRKRSIRRGAKGEQSNAKPCFFFLLTLWWAFSRIFSYRSLLSTKIRSTVHVA

SEQ ID NO: 170008 - protein, 57 aa, Triticum aestivum
  Clone ID: PAT_TA_64426.pep
GRSVPPLSWCAPPRIIVPSWRSILRLWDVPLLSVGRQLRLRSIIPRRLLPRLAPRSH

SEQ ID NO: 170009 - protein, 54 aa, Triticum aestivum
  unsure (1)..(54): unsure at all Xaa locations
  Clone ID: PAT_TA_64427.pep
MDVKGHCTAQGETMRKDELMRQIHCLTXHLNREVRLTGTKEEQALPWANLKYEL

SEQ ID NO: 170010 - protein, 70 aa, Triticum aestivum
  Clone ID: PAT_TA_64428.pep
RSGLSSGIMCSSSDQGGYTRFIFCCVCSYSVVQRAGGADPYEVFGLVPVRGNLGVDPAMIKRRRVPSRVR

SEQ ID NO: 170011 - protein, 87 aa, Triticum aestivum
  Clone ID: PAT_TA_64429.pep
PPVNWCDCASSSQVTHLADHRPGVYMILWCLLDADLVSTVELARSVGGLSSTSVIDPPASRNGWRESTLAPCPEQSSSQRGSAGAAP

SEQ ID NO: 170012 - protein, 78 aa, Triticum aestivum
  Clone ID: PAT_TA_64430.pep
VYFFVSASMWSGHACSPSQHSRTLSASLDVCFSTVRHRVLSASESNALLALAPIAVSKPLLRAIIRLSPVPMRAPNKK

SEQ ID NO: 170013 - protein, 84 aa, Triticum aestivum
  Clone ID: PAT_TA_64431.pep
PQCHTGDNGKTVSSPKLTALQDLHLMPVGALGIRSNTPALYNISQHLNGLCGECCAGSLSAISAAVALSTTSASRYHRKGHIVK

SEQ ID NO: 170014 - protein, 75 aa, Triticum aestivum
  Clone ID: PAT_TA_64432.pep
PLDRTPPSSNIRPRVIKLLFQLFLYEITHTQPFQYNCKCLTDVTLTGSLRLSNNPSASCLSSRNHVHNTPIHFPK

SEQ ID NO: 170015 - protein, 104 aa, Triticum aestivum
  Clone ID: PAT_TA_64433.pep
FLPTGARHPTRVSLHCEPSTRPTPVTVHHESAFERAPWVIVLKYWHPGLKKAMHSCPYLQHNGVKRGAGPGDTPEHPPFGALDVKEYTVNTRFILDPTRGATRS

SEQ ID NO: 170016 - protein, 93 aa, Triticum aestivum
  Clone ID: PAT_TA_64434.pep
GESHSQFRSSFCCEEAIGWGLFLKPPVEANGSILLCDYVRQFQCFSSLQRVTICANEYNLVVFKENLLSRNHEVATLAPYIPPPHFCFFFSFT

SEQ ID NO: 170017 - protein, 72 aa, Triticum aestivum
  Clone ID: PAT_TA_64435.pep
GLLLGAPHVFSSPSVVKHGCSCFTIDPRRSTLLIIRHGGLLMGPNMRAPPYDYRLSVDEAPQGGRPAAPVLI

SEQ ID NO: 170018 - protein, 51 aa, Triticum aestivum
  Clone ID: PAT_TA_64436.pep
TAGHAAFSSGTNSQESQADRHCQQKCSLICQSYTTMFITLSAESGMWLRSY

SEQ ID NO: 170019 - protein, 78 aa, Triticum aestivum
  unsure (1)..(78): unsure at all Xaa locations
  Clone ID: PAT_TA_64437.pep
MLLAATDEDPVIQKVKVRAVRGHNLVMGNSLTQTNXPTVSSGWVXQKEKTIIQKKNDKELWNDVLELTETNPTQAVKL

SEQ ID NO: 170020 - protein, 98 aa, Triticum aestivum
  Clone ID: PAT_TA_64438.pep
VFWRAVALGHAGVVTSGAAVTLPIWGGIDATLLAGDPKTHTDSCLELMTKDALSAILVLMFEQMEQRIILTAPKEDVQLRLRKMKEEFRDKKPKLRAD

SEQ ID NO: 170021 - protein, 82 aa, Triticum aestivum
  Clone ID: PAT_TA_64439.pep
SMLGLVSCSSSYRSCTRGGSSSLVAFSLSSRFCCSPSELRRAIVFVFRHFLTHRRSNGPAGPFFLHLSIQELFSGMHEHVRL

SEQ ID NO: 170022 - protein, 100 aa, Triticum aestivum
  Clone ID: PAT_TA_64440.pep
RTFPVVGLVSSSSFFSTATRRVSYSFVTVRPICWSICSPNDCRRPLEFILRNGIHRRALVLLLGDPCASCAPGSSTGSINSQIGAGFIMVNSGRVSAKIA

SEQ ID NO: 170023 - protein, 55 aa, Triticum aestivum
  unsure (1)..(55): unsure at all Xaa locations
  Clone ID: PAT_TA_64441.pep
RAEDTQRSSFQGYPIWVSMGNTQLACADLAKHQFSQLXGLWNDFYNRGLSSNLAV

SEQ ID NO: 170024 - protein, 59 aa, Triticum aestivum
  Clone ID: PAT_TA_64442.pep
QQLIVCAVGRFCWVPSWINQIHRCRVACCSCFLHESIVELLGGILAGLSLVPLHRGPPR

SEQ ID NO: 170025 - protein, 91 aa, Triticum aestivum
  Clone ID: PAT_TA_64443.pep
TSYPRAPMFALSRAAPVFFLSSSILLSVSNSLPVVRSLFNPFIFPLEILYEYPRVPLVIINAIRQVNTIAGASNSVIPCYCILIDALPGAL

SEQ ID NO: 170026 - protein, 104 aa, Triticum aestivum
  Clone ID: PAT_TA_64444.pep
HSSFPPCSLIGSYFSISHLEYLPSMSRNVCARKQSFSLGRGVSLQHVAGNQLLFRSACQDNAVKGLFDGSLPHSIKVARLMKTEPRHRSPKMLCHVKLFKLGSI

SEQ ID NO: 170027 - protein, 104 aa, Triticum aestivum
  Clone ID: PAT_TA_64445.pep
MTRGLYTAATLTFAAMARDSSAPLSMKYTSVTLVLQRLGSQTADLTELNCPYVHAQLTSLPHFEDARANRPYRQEPIIYAELDAPPNFAASALCALNTLIVTGT

SEQ ID NO: 170028 - protein, 111 aa, Triticum aestivum
  Clone ID: PAT_TA_64446.pep
GRNPMMLSHVNVYRPMACFDHYNFFKVSMPETRPVQLRLAALSPAEGSSTSVLAVSRTVLPGPRSNHKLCMCNNLHMRDCSWNFLACWHHTCPPMDPCLGIYTVLIPPKDR

SEQ ID NO: 170029 - protein, 69 aa, Triticum aestivum
  Clone ID: PAT_TA_64447.pep
LNVSFFHTSDHEGVLIFVFVHGLLRILAMGAIHHPLLFLKLECIICLFYLRQQKQLLHVVLYTHSRKNK

SEQ ID NO: 170030 - protein, 104 aa, Triticum aestivum
  Clone ID: PAT_TA_64448.pep
LQSFPNNDVVLFFHVSRLGLMLSTSSRCSSNGRAIYSLVKVRMTPRYDCSPSTVRGATLVVFVHELHRFITMGAIHHHHLGCKLECIIKERHLHSHRCLNLGPL

SEQ ID NO: 170031 - protein, 48 aa, Triticum aestivum
  Clone ID: PAT_TA_64449.pep
CNLISTEVRMVNSAQCVKCGGVHEQRRLWLHPYCRCGNNTNRGVSSEL

SEQ ID NO: 170032 - protein, 44 aa, Triticum aestivum
  Clone ID: PAT_TA_64450.pep
LDQFIHAGVIKDKVNGFTVSLHELQRYHRSLLPFLVIDRHSLFP

SEQ ID NO: 170033 - protein, 43 aa, Triticum aestivum
  Clone ID: PAT_TA_64451.pep
SRFTYDSKGRKLTMMVTTTVNWPDHCAPDYVSYYIGVNDVRKP

SEQ ID NO: 170034 - protein, 59 aa, Triticum aestivum
  Clone ID: PAT_TA_64452.pep
WSGQCQVSASCHQTSSISSANRRCQFFFSRNQGLQLRSIVLQTIGGGHQVHLWSKDSIT

SEQ ID NO: 170035 - protein, 25 aa, Triticum aestivum
  Clone ID: PAT_TA_64453.pep
SLTPQYSHTYRYSSSSIKLKLGDII

SEQ ID NO: 170036 - protein, 39 aa, Triticum aestivum
  Clone ID: PAT_TA_64454.pep
LMSRAGGIDDPDSGTLDCEGVPPIWCHLITTGWTVLTRL

SEQ ID NO: 170037 - protein, 46 aa, Triticum aestivum
  Clone ID: PAT_TA_64455.pep
LQMPLMAMNTPSAHLLYILELLRDSHQHNRYKVPLGGLSRCFRTSR

SEQ ID NO: 170038 - protein, 33 aa, Triticum aestivum
  Clone ID: PAT_TA_64456.pep
LTKIYSPPLTLLAVPDEVMSEQLAVPWFHIVLC

SEQ ID NO: 170039 - protein, 42 aa, Triticum aestivum
  Clone ID: PAT_TA_64457.pep
NWAHNIAWSQPVVLTWPHQGETPASSMLTVSGSSPEPAPHER

SEQ ID NO: 170040 - protein, 78 aa, Triticum aestivum
  Clone ID: PAT_TA_64458.pep
SSSLSAVKLVITVLVVQPASGGEQTNSSLVVSSSDIKRMCVTSFITPVDRTRSHQGEPSATSLVTDSWCTLAPVRHKT

SEQ ID NO: 170041 - protein, 65 aa, Triticum aestivum
  Clone ID: PAT_TA_64459.pep
LKQTSAKFRPRVIKLLYKLFHTKTRFFFSHCQTDITILLVHPENGGGQTESYFSQGLLHKNTMSR

SEQ ID NO: 170042 - protein, 69 aa, Triticum aestivum
  Clone ID: PAT_TA_64460.pep
FFTGDTAREYTRIQSASTVPMADLDESVSSQLAKSMVLRCHCSYCGGVQDHKMNSIALLQIVGVNNMNR

SEQ ID NO: 170043 - protein, 33 aa, Triticum aestivum
  Clone ID: PAT_TA_64461.pep
VIFWAPAREQTMIHSHATMQLADREEFAYVQLR

SEQ ID NO: 170044 - protein, 92 aa, Triticum aestivum
  Clone ID: PAT_TA_64462.pep
ALPTHAQCLVHRSCDRPLLESVSANSCRVFFGPRLMCYNGSCCITQLSYEGLSVGSLLMFSTSKICRAPSDHIVLRLHDRRLITWNPRRRQL

SEQ ID NO: 170045 - protein, 92 aa, Triticum aestivum
  Clone ID: PAT_TA_64463.pep
RLFKYVQTKLEASCDHSSSIRSSTRRPSYSLVTAKVTSRFMLFTKRPKRDNQFILSTGSPPHINKFHVGPLISPVVSYTYSYGSASCINAGE

SEQ ID NO: 170046 - protein, 79 aa, Triticum aestivum
  Clone ID: PAT_TA_64464.pep
MGFAQLVIGPAGSGKSTYCSGLYQHCETVGRRIHMVNLDPAAEHFSYPVSTDIRELISLDDVMEELGMGPNGGLIYCME

SEQ ID NO: 170047 - protein, 51 aa, Triticum aestivum
  Clone ID: PAT_TA_64465.pep
FCFILYFFFFIFILFFFFFFFFFFFFFFFFFFFFFFFFFFFFFFFFFFFFF

SEQ ID NO: 170048 - protein, 127 aa, Triticum aestivum
  Clone ID: PAT_TA_64466.pep
FLKSDFFRAFFIFPHLGIRGFFFLGILIWVTPGFFHSHLFKPRAIDFILVSPIKKFLLGNPGELILVFLERPPLFFFFFYFFFCFFFFFFFFFVIFLLFFFFFFFFYTIGKFELNPTRPPTSPRTRG

SEQ ID NO: 170049 - protein, 73 aa, Triticum aestivum
  Clone ID: PAT_TA_64467.pep
NPYAYQAPHHTSSLVGHQPSHLLKLFLAIGTTRLPRVLAICTLIWPLLRGGLFSLLLELLQGWQCCTAPPLCA

SEQ ID NO: 170050 - protein, 140 aa, Triticum aestivum
  unsure (1)..(140): unsure at all Xaa locations
  Clone ID: PAT_TA_64468.pep
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFRAXMAKSIHHARVLIRQRHIRVGR

SEQ ID NO: 170051 - protein, 66 aa, Triticum aestivum
  Clone ID: PAT_TA_64469.pep
AERSVHLIFCHPLHSRNAMARPCHHHLSCPDLNWARSPNSISGVDLIMLNSRSAVLKLIQFFRSQA

SEQ ID NO: 170052 - protein, 74 aa, Triticum aestivum
  Clone ID: PAT_TA_64470.pep
ICVPVQGGERGGTPIQGHTVSPLLFAPSNPYVLCCHFSFFHIFVTNIIILCIALLLSLSLARLSWTNACNSTNL

SEQ ID NO: 170053 - protein, 106 aa, Triticum aestivum
  Clone ID: PAT_TA_64471.pep
EDGFIHVRNAVNPATLEQIFGFSSLAGAPNLLVLEQFDNVLSRKVNEVVNEIRRQRCSYLRLRLCQKGDPSGDFFRSLLVEDKAPGGLSYVEFLVHVHRQIQSKMT

SEQ ID NO: 170054 - protein, 44 aa, Triticum aestivum
  Clone ID: PAT_TA_64472.pep
KKWGFFIFGTPFFFFFFFFFFFFFFFFFFFFFLWFFFFFFFFFF

SEQ ID NO: 170055 - protein, 92 aa, Triticum aestivum
  Clone ID: PAT_TA_64473.pep
RNMHARRPRHQLMMLRVWATGAFPLRAGNVDVAVCLDHLLPQHLPRKTPSRHRHHGHRGLSPVIPFPASCLSRHERGREKQECAHHQPHTAE

SEQ ID NO: 170056 - protein, 85 aa, Triticum aestivum
  unsure (1)..(85): unsure at all Xaa locations
  Clone ID: PAT_TA_64474.pep
LRKKKKNNREEDKVKKKKRKEKRPKRQKKKKXKRIKKKVGARGKMKKRXKMVEKEREMEKENHELIKQKKKNVNILKEKKVATSK

SEQ ID NO: 170057 - protein, 156 aa, Triticum aestivum
  Clone ID: PAT_TA_64475.pep
IIQLPNQHFRKDWQIRVKTWFDQAGRKSRRRANRVTKALRIAPRPIDGLIRPAVRCPTIKYNTKLRAGRGFTLEELKAAGVRRKEAISIGVSVDFRRRNRSEESLQLNVNRLKAYKAKLIVFPRKAGKVKKGDTEISFDFAKQAHIKVANVFPVEQ

SEQ ID NO: 170058 - protein, 61 aa, Triticum aestivum
  Clone ID: PAT_TA_64476.pep
NYCSFDALPMPYPKRLRIHQPFTPIDTSEFIHHRLLILRLIRQRNLVLLSALNLIPEPHAS

SEQ ID NO: 170059 - protein, 75 aa, Triticum aestivum
  unsure (1)..(75): unsure at all Xaa locations
  Clone ID: PAT_TA_64477.pep
DXSAGGRYIGCGLSFGCMLRYACLIGSPIIYMHCPKLYNGPTGNTLGIPNNNDLPNFPLLLDGALSTGAVLVDMS

SEQ ID NO: 170060 - protein, 106 aa, Triticum aestivum
  Clone ID: PAT_TA_64478.pep
APLQSWHRGEAVRLPFILAIHLGLVVLLVIRVGLTVSLVTCVLIHSILVIQVPLVLHMLGSILLIVSHHNRGCSIHHSLLTLGTGRGNRVRGATRKVGNGTGRGVS

SEQ ID NO: 170061 - protein, 44 aa, Triticum aestivum
  Clone ID: PAT_TA_64479.pep
LPIQEKNEFEQLEKKWTLEDNRMVGRTTGPKITWLACYDRWVNK

SEQ ID NO: 170062 - protein, 87 aa, Triticum aestivum
  Clone ID: PAT_TA_64480.pep
MASVKLAAAALAVVLACAALAATPAATYAEYRPEPEPCKTQAMYFKNCLRLGHCEKCCFGVVANPACYLQVEREALIECAPGHHCSR

SEQ ID NO: 170063 - protein, 119 aa, Triticum aestivum
  unsure (1)..(119): unsure at all Xaa locations
  Clone ID: PAT_TA_64481.pep
MANASCGAGIHDDCKLRCVELKYKRMHRCITYRLENQTEVIVDQTGEREATYDDFTKTLPENDXRYAEFDYDFTTQEDVPKSTIFYIFWNPDTAQVRSKMTYASTNEKFKRTLDGIHIE

SEQ ID NO: 170064 - protein, 47 aa, Triticum aestivum
  Clone ID: PAT_TA_64482.pep
VHTSIVAGQPAHLWSCTPPHRIIGSLGPCLRLLFVHFLFWDRQLDIS

SEQ ID NO: 170065 - protein, 49 aa, Triticum aestivum
  Clone ID: PAT_TA_64483.pep
LGTKKKQCYLCVNKILSGTNVDSLLGASTQRTTLLIPADGDPNFYIWLK

SEQ ID NO: 170066 - protein, 84 aa, Triticum aestivum
  Clone ID: PAT_TA_64484.pep
VFFFFFFFFFFFFYFFYFDNYFFFFFFNHTNFTITITKQIPQLSESFQDTQHLIVTDTTLESRLTTIEQSKNTDVRMGNNKQYD

SEQ ID NO: 170067 - protein, 107 aa, Triticum aestivum
  Clone ID: PAT_TA_64485.pep
QARRDRPRISPGLGIPATLTPTARDLSARRGADRIRPGRSSPHRGGRGGQIWRCRSPAAPCHPSSSSSAVHTARFASKEGNGALEHRRCQGRRRRPTVLWFSPGRLE

SEQ ID NO: 170068 - protein, 75 aa, Triticum aestivum
  Clone ID: PAT_TA_64486.pep
AIAGIQSVILGVSPGGTSSCGLSTGGNKNRCTVPCAVPNLDQYLCVCAGAVLVPDIVPEYGHQDGPLAHTNSQPN

SEQ ID NO: 170069 - protein, 88 aa, Triticum aestivum
  Clone ID: PAT_TA_64487.pep
ALMEKDPNKAVLLFWAAINSGERIEAALKDMATVLKQANRAEEAVEAIRSFRDRCPNEAQESLDNILLDLYKETHGHEAAVAMKTILT

SEQ ID NO: 170070 - protein, 55 aa, Triticum aestivum
  Clone ID: PAT_TA_64488.pep
TTATTRVMRTRATECPILHPQRGWKDMDPIERRCRIATPEEEARPHTERVQPVRA

SEQ ID NO: 170071 - protein, 85 aa, Triticum aestivum
  Clone ID: PAT_TA_64489.pep
MEGSSSSQSRQQGSSSASFSCKVNTVYEDKNMGILLYTDDNGDLEGEGLDEGPRLTLRDMEILAKDRDSKNTTDDWRERALWIVG

SEQ ID NO: 170072 - protein, 38 aa, Triticum aestivum
  Clone ID: PAT_TA_64490.pep
TSGQIRKYYRWSVQKERYSATTGSQVGQTNSADSLIMT

SEQ ID NO: 170073 - protein, 47 aa, Triticum aestivum
  Clone ID: PAT_TA_64491.pep
AHVKKTPSPCKSCYSLVGFVCFVPFREDFNLTYRLLFFTPGGRRLGW

SEQ ID NO: 170074 - protein, 109 aa, Triticum aestivum
  Clone ID: PAT_TA_64492.pep
EHALFFPPPPKQIQHEVLLAEQSASPAKQAEPEPRLEEEQSVFSPISRVPHWFSRRTDASELMGFAARGLLGNGRSMQEGYRQFQEPSVFNAWWEAHTSSAMMPRWSTA

SEQ ID NO: 170075 - protein, 88 aa, Triticum aestivum
  Clone ID: PAT_TA_64493.pep
GFRRVVLGFFLVSVGVVSVWWLLVAPLLFWGLCVSVFSSSVLWAPLWLFLGAWLAVVGFLFVPVAVLFAPLFLLSPPLVCGRASGGIG

SEQ ID NO: 170076 - protein, 119 aa, Triticum aestivum
  Clone ID: PAT_TA_64494.pep
RTRSKRHTLAGVNTPGEGIPRTDYAPGGQNAAHTHPRAAEIMFATDGALEGDSNSTDHKLLTKTVTDGDVSGVPRGLVHFQQNRGRGPASDIAGYNSQLQGTQDITTTLFAGEPAVPSD

SEQ ID NO: 170077 - protein, 88 aa, Triticum aestivum
  Clone ID: PAT_TA_64495.pep
PLWVLPPWAAVLLSSASGCPHGSVVRAACGGGLSVPLLSWLPPLTPSASEGLSFGFVPVPALACGRFAASAVFKYPWWPPAVGAGAST

SEQ ID NO: 170078 - protein, 164 aa, Triticum aestivum
  Clone ID: PAT_TA_64496.pep
LRKAHALLSDARFRAAVAVSTARKLDGGLVPLLDGIAAGASVVDLQDVFMRLTFDLTAMFIFGTDPGCLAADFPRVPFAAAMDEAEAVLFYRHVTPTAWRRLQTYLNIGHHKKMTKAQQVLDASIAEFVSLRRERAASADANADGSDDAADLLTLYMACQDELG

SEQ ID NO: 170079 - protein, 64 aa, Triticum aestivum
  Clone ID: PAT_TA_64497.pep
ILPWLVVFRPFVCMMVSVSRDLVLSPFAFCSCFLFVLRLAPCVTPGFVFLTPPVLFGLEQLYPG

SEQ ID NO: 170080 - protein, 106 aa, Triticum aestivum
  unsure (1)..(106): unsure at all Xaa locations
  Clone ID: PAT_TA_64498.pep
YLPTPXQHDARGVVSTTPGHQPKHATTNRAPSGGRTRRGGRGERGDDHKRTGEKESKQAGQGQWQGGDRQGTNLGRRMAGGETMSWIRRWKMIDRSFHELRRCTSS

SEQ ID NO: 170081 - protein, 112 aa, Triticum aestivum
  unsure (1)..(112): unsure at all Xaa locations
  Clone ID: PAT_TA_64499.pep
VTPGEEQXKRDRKKHRATKEDRAKSKNRKYLRKPKKVKKSNGQMHATNEIKEKNPTTNKNEGKRLRHQSRTGYHNMYKEYRDTTLNGAVEQRYTEMATRHRERTPCKQSNKT

SEQ ID NO: 170082 - protein, 170 aa, Triticum aestivum
  Clone ID: PAT_TA_64500.pep
PSIATRPSFSTCGRCHGQAGVVVRLPPHHPSPSTTTPSPCTTSATSTPTIIPRHPSTISSHRRIWRDPPDPPDCPSGVRREHAIHHFHPSLSVVAAPPSCFVLLLLFFPSPSSTAAAPFLPQTLLLHLPFFSLSLLLLLNRSSSCCVSATRCSPTADPFLNSLCWLSHAT

SEQ ID NO: 170083 - protein, 101 aa, Triticum aestivum
  Clone ID: PAT_TA_64501.pep
VKYKEAAAPPPGRLTRSEGRARGAPRKPQEREQDSHGGGHSRSTRDLGSQREGHTLKDKYRSDPERGTKRNESQPLRHANPTTHGENAKAPAKDTRLDEST

SEQ ID NO: 170084 - protein, 203 aa, Triticum aestivum
  Clone ID: PAT_TA_64502.pep
CRSLFGIPVSTSRARSLFRSHIRCYALALSWSMSLILADKYADVIYSIVLQDDFLPRTPTPLEYIFGSIFCLPCLLFLFCLRDTFKQDKKKFKDPRRLYAPGRMYHIVERKFCSCARYPPEVRTAIPVEGRFEHIVLSCSTTADHGIIWIERESALALELMKEKEKATTPPAEQKMERLQSFKEDTRMRSQGENLDVPMRRHL

SEQ ID NO: 170085 - protein, 130 aa, Triticum aestivum
  Clone ID: PAT_TA_64503.pep
AAGAQGAGFNEKKRAFLTAEDTGLGCTDGGARALLLRSHVPAGGGRTIQIDSQSSEAKRRAGDRATSTDEDTWRDVASLACDGSPACVRELADTRSVAIEVRRRQKKIMGRAGTTELLGRAQGAWRDVGD

SEQ ID NO: 170086 - protein, 107 aa, Triticum aestivum
  unsure (1)..(107): unsure at all Xaa locations
  Clone ID: PAT_TA_64504.pep
PAAQRRGGVYLKPLFFPPRGQARAIVPTKGEGPAIGIDLVTTYSCVCVWHHDRVEIIANYQGISSTPXYVTLTLLGANIMRCXKNQVFIIPINTVFHANRFIGLWVC

SEQ ID NO: 170087 - protein, 116 aa, Triticum aestivum
  unsure (1)..(116): unsure at all Xaa locations
  Clone ID: PAT_TA_64505.pep
ENRRSATARXPPAQQPPPGPRPPAGGGQGGGTDGXRPRPRGTRPRPPGRRPPGLAPPRPRTKRPGATEETPPAGRSPGTRRAPQRPPSRXHEHRATMTPSRKRGRVRKPAPKAKRR

SEQ ID NO: 170088 - protein, 55 aa, Triticum aestivum
  Clone ID: PAT_TA_64506.pep
MMACVRYSLLFPLPYEILPPFLKYKPFQRFQYGLHMEQNELHSKICLYTSVCSPC

SEQ ID NO: 170089 - protein, 53 aa, Triticum aestivum
  Clone ID: PAT_TA_64507.pep
PREPGRVGWWWRRCCFYLYLCCLSLMCDVETVMLIIMALIEPVVKFVSGFCIS

SEQ ID NO: 170090 - protein, 62 aa, Triticum aestivum
  unsure (1)..(62): unsure at all Xaa locations
  Clone ID: PAT_TA_64508.pep
RMFSQFLSPHLCTPSFKFASSLLVHVLGLLFFFGCSFLLSVFFGDGVFXFFLFXGKLKERXX

SEQ ID NO: 170091 - protein, 70 aa, Triticum aestivum
  unsure (1)..(70): unsure at all Xaa locations
  Clone ID: PAT_TA_64509.pep
GPGRRRAGACRPPPPLGRYGHAVARGVPRAPGAPALVGAVRPXPRWGGTARANVSCPSKFVEKGRCLHRG

SEQ ID NO: 170092 - protein, 108 aa, Triticum aestivum
  Clone ID: PAT_TA_64510.pep
AFNISATHTDLRAGLHLILATVTSSIDYGSPTSAASLEAAALLNLSVALADPSGNLSAHWTPATPLCSWPRLSCDAAGSRVISLDLSALNLTGPIHAAALSSVPHLRT

SEQ ID NO: 170093 - protein, 134 aa, Triticum aestivum
  unsure (1)..(134): unsure at all Xaa locations
  Clone ID: PAT_TA_64511.pep
VAQDEKESGLRXTLTWGHTFGHAIETGLGYGEWLHGEAVAAGTVMAADMSYRLGWIDESIKKRTFDILDQAKLPVTPPKGMTVEKFRNIMAVDKKVADGLLRLILLKGPLGGCVFTGEYDRKALDETLRAFCDN

SEQ ID NO: 170094 - protein, 130 aa, Triticum aestivum
  Clone ID: PAT_TA_64512.pep
VHTHDGEPRTIKFLGSFISWTLIIDVVEEDTPVEEKVIEIICKKLPKLRVLAVAFSKKHHGIRKPNKFSVPTSIAQLKHLRYLAFKTYHSCFVTLPRTLTKLHHIQLLDFYEGLMLEFPFADRVNLRHMF

SEQ ID NO: 170095 - protein, 81 aa, Triticum aestivum
  Clone ID: PAT_TA_64513.pep
GFGPLKLLRVAWLLSSGINPVCVRSYSLIEKLIFSCRLGRMSSTSWWQSFLQQFSIVPKLFRSEGVAIYVARLACIGFSST

SEQ ID NO: 170096 - protein, 110 aa, Triticum aestivum
  Clone ID: PAT_TA_64514.pep
QERYNGCCRIGRLVARAALQSPDVELVDANDPFITTDYMTYMFKYDTGHGQWKHHEVKVKDFKTLLFGQKEVAAPGCRNPDEIPWAAAGAEYDAESTGAFTGKDQAAAHI

SEQ ID NO: 170097 - protein, 53 aa, Triticum aestivum
  Clone ID: PAT_TA_64515.pep
MANRSRIRQKMVEFDDNYKLGDLYDMRISKEVAVDLLGEVFKVTIYKIMGGCD

SEQ ID NO: 170098 - protein, 84 aa, Triticum aestivum
  unsure (1)..(84): unsure at all Xaa locations
  Clone ID: PAT_TA_64516.pep
FKLYHAHSLVMCSVLSPXFLESSVEHIAWHIKNYRVLISTYSSLFIFSLFSLMFSFSLISLFSLLSYPLCKKNIRSNLDLKTSE

SEQ ID NO: 170099 - protein, 52 aa, Triticum aestivum
  Clone ID: PAT_TA_64517.pep
KKKRKKKYNPQKKKNWPVNQDHKKKKGGGVSRIPNFTPRGEQYYSFFKGPLK

SEQ ID NO: 170100 - protein, 109 aa, Triticum aestivum
  Clone ID: PAT_TA_64518.pep
IKRVSNAQDEDCSLHNNKFNWVDLEHPFPSIYACFAIVSIYSSPTRVRLELGQTSQTYNIHHNQGQRWVIRRRQLPQFTRKFGIIIGYADVPGGFKKRKPESSPPGLAR

SEQ ID NO: 170101 - protein, 151 aa, Triticum aestivum
  unsure (1)..(151): unsure at all Xaa locations
  Clone ID: PAT_TA_64519.pep
KTKLFQSITSRDKLKNEGIILGYILHYMPKSPSLTIMYVQVFCTAKQSIPSTTACLKISLDRWIYYPKGNPALAQPVPGLVRAAAGAGRRHGAPRQHGEQKRRVLVDDHLVLEHLARHVDGWPERPRGRGFSXAGGQEKQHLIKPLRLLRA

SEQ ID NO: 170102 - protein, 59 aa, Triticum aestivum
  unsure (1)..(59): unsure at all Xaa locations
  Clone ID: PAT_TA_64520.pep
FVRNXXQTEXRAGLLRXQYHIPHEQVVYLLSKPCLLYGPKIFSKEETTTDRKSIRQKPH

SEQ ID NO: 170103 - protein, 128 aa, Triticum aestivum
  unsure (1)..(128): unsure at all Xaa locations
  Clone ID: PAT_TA_64521.pep
THRRHTILFLATSIIHDNRDVTTVFIQAATYAYSPAHQGKTIWVFHSTAQPARSPCNSRNVQLNLAAAAQGLHAALAGLVAAEATAQCKQACIXAAFLLMALLNMIIVGHVLRTRRVVHLDVYLYTSI

SEQ ID NO: 170104 - protein, 85 aa, Triticum aestivum
  unsure (1)..(85): unsure at all Xaa locations
  Clone ID: PAT_TA_64522.pep
GGRFCSRFVVVHVGVFPVSRVWPGGPWGPFWFALSAALVSVLPGWLGVVLSAGAPSWGGSGCCFLLFVGVSTAFFFLIPSXFFFF

SEQ ID NO: 170105 - protein, 60 aa, Triticum aestivum
  Clone ID: PAT_TA_64523.pep
APCCSARRWVWPPCSHRAVGLQFCYPVPVHAQTVVDGADAAAMPAAPQRGGHAGVLIAPS

SEQ ID NO: 170106 - protein, 65 aa, Triticum aestivum
  unsure (1)..(65): unsure at all Xaa locations
  Clone ID: PAT_TA_64524.pep
GSHNQPXAEKEGLDQTNVPLPAPGGKIDVWSSKLIGLRTDQETGLPAIAPNERLVLPGLDDQCGT

SEQ ID NO: 170107 - protein, 146 aa, Triticum aestivum
  Clone ID: PAT_TA_64525.pep
ARLGEGELEDSFAYTAALAQVHGIPTSEISVVSYNQCPGAEPMPTLVLSLNGDDCALVTQALGSLNAVNQTAGGVVVGATNNSVTRAKPSKKSGMPTWLIVGIVLAVLLGIAAIVVLVAVIVKATSGGSKPSGLAHRTHWATEELY

SEQ ID NO: 170108 - protein, 41 aa, Triticum aestivum
  Clone ID: PAT_TA_64526.pep
KICPWVVFIHSQLYLIVSRQRISQHHHSLTYTVQYNCTGRV

SEQ ID NO: 170109 - protein, 131 aa, Triticum aestivum
  Clone ID: PAT_TA_64527.pep
CPLTTSSLGQGGPLETAIIGQTPPHKARTSREPAPPTSGNQPTEKGRARRERPRARPNGLTQQRKQEKKEAVDLEDTDNSGTIDAKEPTVAMRAQGSEMTEEHIRQKKADGDQHGSGANDYQEVEPTTTGQ

SEQ ID NO: 170110 - protein, 63 aa, Triticum aestivum
  unsure (1)..(63): unsure at all Xaa locations
  Clone ID: PAT_TA_64528.pep
MAETEYRCFVGGLVWATDDHNLQQAFSQYGEILDAKIXNDRETGRSRGFGFRTFGSEESDAPG

SEQ ID NO: 170111 - protein, 82 aa, Triticum aestivum
  Clone ID: PAT_TA_64529.pep
MCANKRAPDPVMAHEFTLEFTMHLHRCIFGCTLPNAVPDIMKVVQKVVQTDIVTIDVQLDVHIYKHILSSVLRRVPSRIRLK

SEQ ID NO: 170112 - protein, 68 aa, Triticum aestivum
  Clone ID: PAT_TA_64530.pep
GAQKKKIFFPNRRRKTWTLKRGPPLFFFFFFIFFFFFFFFFFFFFFFFFFFFFFFFFFFFFFFFFFRV

SEQ ID NO: 170113 - protein, 54 aa, Triticum aestivum
  Clone ID: PAT_TA_64531.pep
SMLALVPLIAVSLFFLFCFSFFFFFFFFFFFFFFMVFELLNDKHVTESRLVAAG

SEQ ID NO: 170114 - protein, 71 aa, Triticum aestivum
  Clone ID: PAT_TA_64532.pep
ESSFLFGPFCLFPNFLKFLNNTHDRISFTLWSNTLHRLPCIITQLRRSCTRALPSHTIPPKPQKGPIKSPR

SEQ ID NO: 170115 - protein, 77 aa, Triticum aestivum
  Clone ID: PAT_TA_64533.pep
SHGCRSLRPKAWKSDQRVQNLEIHVQDGWTGHTQHKHTTCVRTYGVDYSGLLLSDQLGGPLALVVHDGAVVVGRTRG

SEQ ID NO: 170116 - protein, 137 aa, Triticum aestivum
  unsure (1)..(137): unsure at all Xaa locations
  Clone ID: PAT_TA_64534.pep
MSGNPVAGAPGAVEPYVPQATYNFSARLALTVSLVLLMITVVVVVIPLMVYLMITRSRRSGGHGLAGGILRSVGMIGSRRHGLDASALSALPVTXAYRKESGAAARAECAVCLAELADGDQARELPNCGHLFHLECV

SEQ ID NO: 170117 - protein, 148 aa, Triticum aestivum
  Clone ID: PAT_TA_64535.pep
SPESLPDAAPQPHRFTVPVIDLSAAVTTRAAAVAQVKEAAETAGFFQVVGHGVPEAATAAMLAAVRGFFEQPVEAKAPFYTRDLGRRVRYQSNLNLFKSRAANWRDTLFMELPAPEEIPAACRSAAPEYARLVQQGLGRTLLGLLSEA

SEQ ID NO: 170118 - protein, 64 aa, Triticum aestivum
  Clone ID: PAT_TA_64536.pep
HASGPPFFFFFFFFFLFEAHSRRAFDEGGSSYDNIRLLIQEMEIKTNACRSVVDTDGNKLSFLV

SEQ ID NO: 170119 - protein, 69 aa, Triticum aestivum
  Clone ID: PAT_TA_64537.pep
FYFRCPKKKLFRCNHAVVNFGPLKRPPPFFFFFFFFFFFFFFFFFFFFFFFFFFFFFFFFFFFFFFFFL

SEQ ID NO: 170120 - protein, 130 aa, Triticum aestivum
  Clone ID: PAT_TA_64538.pep
KFMLIELSGLNSSHEKNSIHTHNVSMGRGVLPRGHASIDYKPGIQELEKGELGIRKNREPPTPGSLIHWIPFSCVCGRLSSRWGGSPATPTLACGPCCWACLILVGRAAREPASSADCRACMSVALAWSY

SEQ ID NO: 170121 - protein, 93 aa, Triticum aestivum
  Clone ID: PAT_TA_64539.pep
ASSLHALFFFFFFFFFFFFFFFFFFFSFFFFFFFFKQQHSCVQGPDATVFLYRVCGQNSNRHRHLINNLPVSCYLWLLKVYLSQVAKSSLRGK

SEQ ID NO: 170122 - protein, 47 aa, Triticum aestivum
  Clone ID: PAT_TA_64540.pep
LKKKKKKKKKKKKKKKKKKKKKKKKKKKKKKKKKKKKGGPFKKNKVN

SEQ ID NO: 170123 - protein, 172 aa, Triticum aestivum
  unsure (1)..(172): unsure at all Xaa locations
  Clone ID: PAT_TA_64541.pep
MSDTEEENPEENDEGLTGLEGELKGWRVGETFEGFTGTSSLSTTNDDDASSTNTEAVFVISPNGKFKRNIKSWMRGALLGSGSFGMVYEGISDEGAFFAVKEVSLLDQGSNAQQSILSLEQEIALLSQFEHENIVQYYGTDKEESKLYIFIEXCTQGSLSSLYQKYXLRDSQ

SEQ ID NO: 170124 - protein, 66 aa, Triticum aestivum
  Clone ID: PAT_TA_64542.pep
SHSWSPSLNLNRNRSRLRSANHQPLTVDGILIYASCWRRPCMKPQCVISRISGVVFPVFIYSSMHV

SEQ ID NO: 170125 - protein, 147 aa, Triticum aestivum
  Clone ID: PAT_TA_64543.pep
RPRVRVKKILHRIEGVYQSSIDPEQGKVTVSGMVDPDTIIKKLTKAGKPAELWGSKAGMANQFQKLQLDGGGKGQAKDAGGKGQSKDAGGAKGQKGGGGGGGAGGASKDAKMMMPPPTAQQLQQLQQQMQMKGMKLPQFMDGKMPFA

SEQ ID NO: 170126 - protein, 83 aa, Triticum aestivum
  Clone ID: PAT_TA_64544.pep
SLTRPPTRPDKEDFDDFCSRASELAEQANGAPLFTVVQSVQPSKQMYNQDDGSGCSGYGVSDNIDTEDLDGSGETGEDEWQIL

SEQ ID NO: 170127 - protein, 106 aa, Triticum aestivum
  Clone ID: PAT_TA_64545.pep
SPCRTPWTAARTSGCARRSSGSPTASPTPPCRRFSSIVLLAGRACKCKGLPALRFVPAGLGSAGRRCGTSGQVTGTRALYCDSCTFFAWDSTGHVISPTSPNVLRS

SEQ ID NO: 170128 - protein, 90 aa, Triticum aestivum
  Clone ID: PAT_TA_64546.pep
MADASAPAPEGHREEGGRGFGRGRGRGGRGGRRGRGGRGGAPGDKKEWVPCTMLGRLVRDGKLTSLEEILLFSMPINEHDIVDRLLGESL

SEQ ID NO: 170129 - protein, 137 aa, Triticum aestivum
  unsure (1)..(137): unsure at all Xaa locations
  Clone ID: PAT_TA_64547.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIXLTGPNSIVGRACVVHGDPDDLGRGGHELSKSTG

SEQ ID NO: 170130 - protein, 91 aa, Triticum aestivum
  Clone ID: PAT_TA_64548.pep
MLNLQLCCVISLVPLCAVLAAAVRNSHRIIAFSSRQVTISRRMQKSSVVLFRPTHVYLDSYRLVEPLDFQFQLTGSYIHVSERFSKGELQC

SEQ ID NO: 170131 - protein, 36 aa, Triticum aestivum
  Clone ID: PAT_TA_64549.pep
PQGAMIRPVVVALASQGGPTPTMPLNTPCIVVRGGV

SEQ ID NO: 170132 - protein, 175 aa, Triticum aestivum
  unsure (1)..(175): unsure at all Xaa locations
  Clone ID: PAT_TA_64550.pep
ASAADTATATARASAAVLTAPLSLEGGLAAELQPANLVQRVLSLFGNVRPGADLSHFQLPATFNLPKSQLQLYGEIVYCDGDDYLSRCGKGKDSLERFTAIVAWSISTTRPPIFGFAPYNPVLGETHHVSRGSLHVLLEQVSHKPPVSALHATDDGGXVELVWSQHPVPKFNGAS

SEQ ID NO: 170133 - protein, 59 aa, Triticum aestivum
  unsure (1)..(59): unsure at all Xaa locations
  Clone ID: PAT_TA_64551.pep
VMVSSRACFICHSGSASFSMVIVRGTSRYQLFMQQSXMWPIQLYYVGVWTTASTQSIGL

SEQ ID NO: 170134 - protein, 94 aa, Triticum aestivum
  Clone ID: PAT_TA_64552.pep
MSKYVELLDMGVRIAARFHSHCPQTARMYYKPPQSTSTSGAAEDAPTDRRTAGFDGGEDVAAGFRPFAASGALGAGVQPRFGFDTAQVLIYEVV

SEQ ID NO: 170135 - protein, 44 aa, Triticum aestivum
  Clone ID: PAT_TA_64553.pep
RAPPIFFFFFFFFFFFPFFFFFFFFFFFFFFFFFFFFFFFFFFF

SEQ ID NO: 170136 - protein, 97 aa, Triticum aestivum
  Clone ID: PAT_TA_64554.pep
LVLSFEADPDTMQLHVGCNCTLLSLIKPNTFYNTIHSCCETHIAFKSHHSFCFKFCRMAMSQKQHPRGDFPVDRIFLAFSLIFFSSSYFLSPAIDLT

SEQ ID NO: 170137 - protein, 94 aa, Triticum aestivum
  Clone ID: PAT_TA_64555.pep
MRPRRHSPCTHTESSELVDPGEIRMSDPKYAYPYPAQGYYQGGPYQGPPVMAPPQYAAPPPRPQPSFLEGCLAALCCCCLIDECCCDPSIIFVG

SEQ ID NO: 170138 - protein, 44 aa, Triticum aestivum
  Clone ID: PAT_TA_64556.pep
ALANFCCAVRIVVVNLRKGVSTCNTYTVSVQTFDFTYDVYSKQQ

SEQ ID NO: 170139 - protein, 162 aa, Triticum aestivum
  Clone ID: PAT_TA_64557.pep
KKICPLKKTPRQQEVPRHHENHRPFSSHSQQPFRNHARFDHGPGQTIHVAQRRTTWCLQSTDLPPAPSGFPPLLDLSYSAFRVDLDPHAAEKVRDRNDGHRPDWPNGTLLPWRLLPSLPPRPIRRARRMLPWRPPVNVTRLFVLRSLTPATTSRVRVGARVS

SEQ ID NO: 170140 - protein, 54 aa, Triticum aestivum
  Clone ID: PAT_TA_64558.pep
MGNPSVVAVTSLLTSDYLSGPRSHYTIASTLYMTSHTLVSTIATAGELAPAVLQ

SEQ ID NO: 170141 - protein, 122 aa, Triticum aestivum
  Clone ID: PAT_TA_64559.pep
EGRHHFIHGATRRSEVYCSSTRSSMRFEGAGFSTNAASHRLIAWHAWLGLLPWLTSSSRLSNLDESTSQRARGGSTKHIVSSASLARRSSLVSPLIHTSVSAVYSHSKQPIAIDFSAAAFEK

SEQ ID NO: 170142 - protein, 113 aa, Triticum aestivum
  Clone ID: PAT_TA_64560.pep
MTKIYPGESLNISYLSPYLKALGSNYSNGVNFAISGSTTLPRDALFVLHGQVQEFFFFKARSSLYKKKNETKENISNLKIDSAMMIVTTLMSANDAAIHPHFQFQFLFQSPQP

SEQ ID NO: 170143 - protein, 103 aa, Triticum aestivum
  unsure (1)..(103): unsure at all Xaa locations
  Clone ID: PAT_TA_64561.pep
MSGRGKGGKGLGKGGAKRHRKVLRDNIQGITKPAIRRLARRGGVKRISGLIYEETRGVLKIFLENVIRDAVTYTEHARRKTVTXMDVVYSLKRXWRTLYGWPG

SEQ ID NO: 170144 - protein, 90 aa, Triticum aestivum
  Clone ID: PAT_TA_64562.pep
WVKLQGSAVEGECAAAAGRRGEDEAGAGRLGQGRGIHGHQGIDAVLRSTRAARGDGGVMGRCISCLLRARSYTPAAPSVAGGRWPAFRFL

SEQ ID NO: 170145 - protein, 57 aa, Triticum aestivum
  Clone ID: PAT_TA_64563.pep
RRCQLVPLRGPPTKSTSLSFFRVYFCFLVKLVPFFFFFFFFFFFFFFFFFFFFFFFF

SEQ ID NO: 170146 - protein, 58 aa, Triticum aestivum
  Clone ID: PAT_TA_64564.pep
VSCFFFFCDRYIDRLITCLRKLCKSLSLVPIFPTAKEVLCCYPFAHILLLHIHFLYVK

SEQ ID NO: 170147 - protein, 98 aa, Triticum aestivum
  Clone ID: PAT_TA_64565.pep
SGCLFLFFVFFFFFFFFFFFHEMPFRRPCIFSSCMPSVKAAHISSLGSLGLAVHTTSVGPVLLSGTTTSHGRIHPCCSYRTRGRKFRARGCMRGRTRS

SEQ ID NO: 170148 - protein, 81 aa, Triticum aestivum
  Clone ID: PAT_TA_64566.pep
MAAAAPADAKAEAAKMDLLEDDDEFEEFEIDQEWDDKEDGNEAVQQWEDDWDDDDVNNDFLLQPWKEAGGRFPPTELPLFP

SEQ ID NO: 170149 - protein, 148 aa, Triticum aestivum
  Clone ID: PAT_TA_64567.pep
MKLRIALFILASFTAHGHPSAEPGTAAFGSYFTTVIRVPHGCTGSSTTKVDVKISEDISHVKAHRVPGWKLDVVYRDNDNATALKLGENRTVDTLTWTALTEADYLPDNMFEDFGVNMKLPQPSAMKIVYLPTTQTCGNGTSAWVGIP

SEQ ID NO: 170150 - protein, 56 aa, Triticum aestivum
  Clone ID: PAT_TA_64568.pep
PMGFPGHVVVNCRPVNSLWLVWYTSYAFKSPLPSGVGSLDETKSSGLVEKGIPDRP

SEQ ID NO: 170151 - protein, 60 aa, Triticum aestivum
  Clone ID: PAT_TA_64569.pep
YASTQIYKAWPFVHILYLLRTPSTIINRFPPLPSVLVHLYPISQANFSPNNTCHSLRHIL

SEQ ID NO: 170152 - protein, 38 aa, Triticum aestivum
  Clone ID: PAT_TA_64570.pep
AITNSQLKILNHGTLKALLPSLHVQYTYILSFNDRLMR

SEQ ID NO: 170153 - protein, 119 aa, Triticum aestivum
  Clone ID: PAT_TA_64571.pep
CWDKNKMSNIIPQQQHTHVPSTYPPEFDGGGPGAEVHEALAASNMATPSPEQAAMAEAEGPVLSAMGAMEVMAHELHVRPVAMGDGGGGIRADWRRRRRRDLDRGERFCLMLRARRLLA

SEQ ID NO: 170154 - protein, 86 aa, Triticum aestivum
  Clone ID: PAT_TA_64572.pep
KRGGEFNFGAPFKRFWSGVEREFSLGSLGGGPPFFFFFFFFFFFFFFFFFFFFFFFFLFFFFFFFFFFFFFFFSRTEITISPDHEI

SEQ ID NO: 170155 - protein, 69 aa, Triticum aestivum
  Clone ID: PAT_TA_64573.pep
SPHVPHTPAPAWGLEEFPAAMVAPAAAAKAKQGHVREWYHSDSDSDVFAVPEITSPPAKRARPSSFWCL

SEQ ID NO: 170156 - protein, 108 aa, Triticum aestivum
  Clone ID: PAT_TA_64574.pep
KIFFFYFFFFFFFIFFFFFFFFFFFFFFFCTSLITALHFVYCENKSNGVCYVVRGHMTSSISAGVGQVGLDVRGGEAVEVGAGGGGVGAHVVEHEPVLFPKLRIRGRV

SEQ ID NO: 170157 - protein, 46 aa, Triticum aestivum
  Clone ID: PAT_TA_64575.pep
FTRPGILGQEVIKSISCKGDPIKNFFYFDDADGKGAMEDIPPTPED

SEQ ID NO: 170158 - protein, 75 aa, Triticum aestivum
  Clone ID: PAT_TA_64576.pep
LNGGNLHCFTALTPCAVLDVMGPPYSSAAGRDCAYYSETPFSNTAGVADVRYSWLKEIPNTFRMKGVTMPRDFVV

SEQ ID NO: 170159 - protein, 124 aa, Triticum aestivum
  Clone ID: PAT_TA_64577.pep
MAAIAAKLQVFVACALLLLAAGCQASPFWPLEIGYYHDKCPQAEAVVKGVMEKAISQNPGNGAAMIRMLFHDCFVEGCDASVLLDPTPFSPTPEKLSPPNDPSLRGFELIDAIKDALEAGCPAV

SEQ ID NO: 170160 - protein, 80 aa, Triticum aestivum
  Clone ID: PAT_TA_64578.pep
CGDPSGFAHPGSHGGRGRAPAPLPPPPLPPPPSPLVGAPPRPLTPPRRVPPRHPIAPPPPSSPPPGAGRGGTRLPPAGQG

SEQ ID NO: 170161 - protein, 50 aa, Triticum aestivum
  Clone ID: PAT_TA_64579.pep
SAQQGNSGLRINYLDKVVAHISNYFSVNIGDLVFTGTTKREQENTVKKEK

SEQ ID NO: 170162 - protein, 57 aa, Triticum aestivum
  Clone ID: PAT_TA_64580.pep
YFFIFLVYYLFFFFFKKLCYAQFTEEIMVCDVLTLYVSLFRLFLFIQLRDNNLPHDS

SEQ ID NO: 170163 - protein, 100 aa, Triticum aestivum
  unsure (1)..(100): unsure at all Xaa locations
  Clone ID: PAT_TA_64581.pep
MPRPCKGGTGLGKGGTKLHRKVLRDNIQGITKPAIRRLALRGGPNRIWGLIYEETRRALTIFLKNDIRDCVTYTXHARRKTVHNMDVWYALKRQGLTLYG

SEQ ID NO: 170164 - protein, 78 aa, Triticum aestivum
  Clone ID: PAT_TA_64582.pep
GPCPWLGSASVPCSRCPFHLRLSPHGCQVLCRGAGVPEGERADICGELVWADRFKNPPSGGVGVDDPFGWVGQGMLVP

SEQ ID NO: 170165 - protein, 103 aa, Triticum aestivum
  Clone ID: PAT_TA_64583.pep
GNRWERATVGPACPRATCRKATSREPAFLGPGKGFPRHTGVHTERGRANKGPQTTGTPSAGTRAHRRAIIAGCPLFFFFFVFCLYPSVSFNNPPFLFFCFFWY

SEQ ID NO: 170166 - protein, 79 aa, Triticum aestivum
  Clone ID: PAT_TA_64584.pep
MPTSKATTLPYDFGRWCRYNFRAHHQAQQVRSGESLSPQHTTTTSYGWLGCFASLAVQKGTDDLQDENEQLSRATEAEY

SEQ ID NO: 170167 - protein, 166 aa, Triticum aestivum
  Clone ID: PAT_TA_64585.pep
WTRGFLSCFCLSPSSSLTPPPSHSQVTASPVCYLLGELGAEERRRPTQRRRRAKAARQQGALRLKSSDSDSDIVPLVDYLNTQYYGVIGLGTPPQNFTVIFDTGSSNLWVPSSKCYFSIACYLHPKYKSSKSSTYKADGEICKITYGSGAISGFFSNDNVLAGDLV

SEQ ID NO: 170168 - protein, 61 aa, Triticum aestivum
  Clone ID: PAT_TA_64586.pep
QSCEIGVILVSCSCGNGVPSTLEIHESLSSSTTRDTCYIHLTFVVLYSISCNLTHRPCARG

SEQ ID NO: 170169 - protein, 82 aa, Triticum aestivum
  Clone ID: PAT_TA_64587.pep
FFMEPNKVYKGDYYKHSGLYYKMTDTKHAAAQTDTTKEMTTAMSTTKNKTDSMTHKTTMSTEMRKMAKAITNDVKNNYCRTY

SEQ ID NO: 170170 - protein, 136 aa, Triticum aestivum
  Clone ID: PAT_TA_64588.pep
VDGNCQLRAGADLIFRRADYHRHVRKAVAKQLKEFRKHYEGYVPLDYKVYLKKMKRSGEWGDHVTLQAAADRFGAKICLLTSFRDTCLIEIVPRDAAPTRAKYLLWLSFWCEVHYNSLYANEDLPTRKTKKKHWLF

SEQ ID NO: 170171 - protein, 60 aa, Triticum aestivum
  Clone ID: PAT_TA_64589.pep
FWGPQKKAFSLPAPGSKLGSPKTAPPFLFFFFFFFFFFFFFFFFFFFFFFFFFFFFFYNL

SEQ ID NO: 170172 - protein, 67 aa, Triticum aestivum
  Clone ID: PAT_TA_64590.pep
YFLVYWATYCQLPLLCFVLRMHTLSLVNMMPLSRTGTSELGKLWVLLHTIREMIGRMELYPIQKRFE

SEQ ID NO: 170173 - protein, 107 aa, Triticum aestivum
  Clone ID: PAT_TA_64591.pep
KNVSTLSSGPPGPWGFQCFSVVELSSLSIHVIVPGVRLLQDLIHASVTVTMCFRHSRCPRVVLALVLAVHCVCFTSSYQVSEVRVTQLGLDRGRSPCGLLYTAALVV

SEQ ID NO: 170174 - protein, 93 aa, Triticum aestivum
  Clone ID: PAT_TA_64592.pep
SSSFLKTAGMNMGASGFSTDIAMVLMITSLHAGANQSASDHHIDRYCNHAMATTDLCISANSRRSCLPFLYRSSVVGADKISHVVIWVETGGK

SEQ ID NO: 170175 - protein, 33 aa, Triticum aestivum
  Clone ID: PAT_TA_64593.pep
RGIKRGGCGGYANRDRDTSQWLNTRSFRYNTFL

SEQ ID NO: 170176 - protein, 73 aa, Triticum aestivum
  Clone ID: PAT_TA_64594.pep
GRTSCRPTQTVFLTGSARSSASSLTPNPCSSCVRVRTYMHTNGHDHGLRGQSFMRRQTLTKEEQVSPHFPSTM

SEQ ID NO: 170177 - protein, 51 aa, Triticum aestivum
  Clone ID: PAT_TA_64595.pep
SDYSVRGKPFPNLLFWSVSPFPGLCKSMDIKSQYFLVTAGRNLFTVFQTHR

SEQ ID NO: 170178 - protein, 136 aa, Triticum aestivum
  unsure (1)..(136): unsure at all Xaa locations
  Clone ID: PAT_TA_64596.pep
GPERPGPTHATRSLXSASIRDLSSLVIPRSVSVSRYRCLDGRAALRKETTMEEDEWSGRACAKQARAPGGTVVGSRAGWAGRTGRLYPGPNCALTENRQREWERKDRRTVDMEVETREGVCHNIAARSTSPENGRR

SEQ ID NO: 170179 - protein, 64 aa, Triticum aestivum
  unsure (1)..(64): unsure at all Xaa locations
  Clone ID: PAT_TA_64597.pep
RLRVRSRVSARGSLYNQPFKGLDHEKLKEMEHDYXVMCDHDRRETYNQCMEEALKEGMVGGGGG

SEQ ID NO: 170180 - protein, 52 aa, Triticum aestivum
  Clone ID: PAT_TA_64598.pep
MSRLGQPPDFEEYMVTKLQIMLHANRVDIDTLRGFDPAMNLAVDNTVEVNGD

SEQ ID NO: 170181 - protein, 96 aa, Triticum aestivum
  Clone ID: PAT_TA_64599.pep
FEIARAAAMAIAVDADTGLPADGAHVQEDLRRRLLRHVHRFDLGPLKASPSSSSPPRTSQPCRRLLLLALTEPFLSSPMPPPTDATTWIPLTTRSS

SEQ ID NO: 170182 - protein, 72 aa, Triticum aestivum
  Clone ID: PAT_TA_64600.pep
MNGGSGKKKFCGGRLPTGTPYLAWTQGAVVASLLAGASIDHNIYKPDMTLPPVEAAHGNGAGATDGGTRTES

SEQ ID NO: 170183 - protein, 92 aa, Triticum aestivum
  Clone ID: PAT_TA_64601.pep
SMFSLLKQRKAFPCITSKQEENLIDDNLMNQVLFFLPSPGAEDHRAAGYDDDLAACPLVDQPPIKRWEPIGSPPLRAHRVVVARALFSVTSA

SEQ ID NO: 170184 - protein, 106 aa, Triticum aestivum
  Clone ID: PAT_TA_64602.pep
GWRASNASVGGRGVLERVAAQLRRRVGGVQVDRARHELRRARRKRAGGIRGRRRPLRRRRRGGHAAGDGHGDGDGHRLWQKARAHTAPHLARARLAAARVEVCERV

SEQ ID NO: 170185 - protein, 51 aa, Triticum aestivum
  Clone ID: PAT_TA_64603.pep
DAWADAWGKGEHNYLPPSGNTVGPCHLRRLLRRLAGGDPGGSAPTVDRATT

SEQ ID NO: 170186 - protein, 91 aa, Triticum aestivum
  Clone ID: PAT_TA_64604.pep
FAPVKKKKREIQVKKRKNEKKNKNSKSTKTHQLAQLKATQKPKKGGGGLKGPQVYCPGPAAPWFFFGAPEVQPTGPPFPPAGREKPGGPPL

SEQ ID NO: 170187 - protein, 67 aa, Triticum aestivum
  Clone ID: PAT_TA_64605.pep
VIFYVFLFFFFFFFFFEPTCNKPWDAIYTGFTLQGHPSLLILLNKDKTMKRRLRPYDNSRAWRRDRQ

SEQ ID NO: 170188 - protein, 39 aa, Triticum aestivum
  Clone ID: PAT_TA_64606.pep
FYLFLLLCQPIVAFGPCFILLALCEPVSFVAVLCKTLLN

SEQ ID NO: 170189 - protein, 57 aa, Triticum aestivum
  Clone ID: PAT_TA_64607.pep
VVPLRRLRRSAGSAPLPGAARGGAGSAADGSIKWMRDPSPVGRLAAVAGRRRWRNGQ

SEQ ID NO: 170190 - protein, 85 aa, Triticum aestivum
  Clone ID: PAT_TA_64608.pep
LRPVSILGLGLLRLHILQYPGNTETSQQSERFHLLNTTKLERVSLRTSATRCHNTRNYMHTESHLMDLSDQSPCIIQSFRPRVAA

SEQ ID NO: 170191 - protein, 53 aa, Triticum aestivum
  Clone ID: PAT_TA_64609.pep
ILNTVATADTRAAYPATRERAQVWTGRGYGHVNTTSRDHLTEQPRKLSGRRPP

SEQ ID NO: 170192 - protein, 101 aa, Triticum aestivum
  unsure (1)..(101): unsure at all Xaa locations
  Clone ID: PAT_TA_64610.pep
MTASASRPLLGCIGDDFTGATDLANMLVKSGMRTVQTIGVPAGDAAVDTLIDADAIVAALKSCTIPEDDAVEQSFAAYEWXLHAQGLPEVFFKDCSTLDST

SEQ ID NO: 170193 - protein, 119 aa, Triticum aestivum
  Clone ID: PAT_TA_64611.pep
LPVNWIHTYNSATNLFQEPTASAIIATPVVLDDCRDILCWKLTPGKCNSKSTCKLCSEQIHAVQANQPRQVNQSTKGIMQQVWKHKFMAPRVKTFARRLLRHALPTGLRAGRTRGQKRK

SEQ ID NO: 170194 - protein, 75 aa, Triticum aestivum
  Clone ID: PAT_TA_64612.pep
MAAHKRLHDGFEQDPDQPEKKRMERSVSFSTVIREAMVMKQVQSVFLVLEPLLRRVVQEEIQAELVRIPRYIERS

SEQ ID NO: 170195 - protein, 132 aa, Triticum aestivum
  Clone ID: PAT_TA_64613.pep
ILRCGPVSMFQSLCHRWCGRLSPSEVADKVKHFFKYYAINRHKMTVLTPSYHAESYSPEDNRFDLRQFLYNSTWPYQFRKIDQLVQDIDKDGKWVEDRRADSQLRQRGAARPAQGGGMGVAAAGSANPGAGL

SEQ ID NO: 170196 - protein, 34 aa, Triticum aestivum
  Clone ID: PAT_TA_64614.pep
NSSWSGSAISGTGNSHHSGSAPGGSQNSGYRAKA

SEQ ID NO: 170197 - protein, 88 aa, Triticum aestivum
  unsure (1)..(88): unsure at all Xaa locations
  Clone ID: PAT_TA_64615.pep
MKTTKRKMHPEYLRADLDQTIQNYTXGFDMNQMRKRETPEEKTTNAFLGYRPEDTNSALDLTYNYGVDKYDIGAGFGHFAIANDDVDK

SEQ ID NO: 170198 - protein, 62 aa, Triticum aestivum
  Clone ID: PAT_TA_64616.pep
RVGVRSTGATMALSGPSASAQERISHEAPKVLSRVRGPHSYYSLRCERGAGAPCGYTGRGRW

SEQ ID NO: 170199 - protein, 124 aa, Triticum aestivum
  Clone ID: PAT_TA_64617.pep
RAPTRGGPIPHQGGQLVGKANRAGPFANNPTGQKGKGPQAKKVGNPQGFPGPTVEKRGPGNEIRGPQKKTKTSPAPGRKPGTPKTAPPLVFFFLLTNYMNGPGECHMIVLFLFFFFVYLSFFFF

SEQ ID NO: 170200 - protein, 64 aa, Triticum aestivum
  Clone ID: PAT_TA_64618.pep
LSPPCQRPPASLGALVVPGLLSQLQPPIGDRVPHSAIDRRQAVVVGQALSIKEASALTIHDSTR

SEQ ID NO: 170201 - protein, 43 aa, Triticum aestivum
  Clone ID: PAT_TA_64619.pep
SDNRLIDQTRGSALSNYTMRLDYARIPRVRHLLGPDREAVGLG

SEQ ID NO: 170202 - protein, 49 aa, Triticum aestivum
  Clone ID: PAT_TA_64620.pep
AAAAIKVAQRPENAGKLIVVVFPSFGERYLSSVLFQSIREECEKMEAEA

SEQ ID NO: 170203 - protein, 100 aa, Triticum aestivum
  unsure (1)..(100): unsure at all Xaa locations
  Clone ID: PAT_TA_64621.pep
ARTCSAVTRRRRRCRRRRERSWPWAAAAAGPARAPPGRPAPPATGSARAPVSTPGRRRRXAVTAAPAPASAASGPCRRGPRRPPPPRPGRRPGCCSGGAP

SEQ ID NO: 170204 - protein, 123 aa, Triticum aestivum
  Clone ID: PAT_TA_64622.pep
MAVDLMGCYTPRRADDQLAIQEAATAGLRSLELLVSSLSGAAPSKAPQQHPQQPFGEIADQAVSKFRKVISILDRTGHARFRRGPVQSAPSPPTSPAPVAPPPPPLTVVGRWWWPTRSRSRRA

SEQ ID NO: 170205 - protein, 50 aa, Triticum aestivum
  Clone ID: PAT_TA_64623.pep
FPVDRLTRFWDFSLLSLLRRRPVNLTSHRAQRIRRPLRSSTSTPPTGSWA

SEQ ID NO: 170206 - protein, 101 aa, Triticum aestivum
  Clone ID: PAT_TA_64624.pep
PYNRVFKTLIYKYNNFRSTIYTYLNIKSSKQDKSYIASTCMISHYDLSSAISMIITGVSFLHLLLLCSPWNCGTSLGRGSSLVDTHDEFPHQQGYSFHQQN

SEQ ID NO: 170207 - protein, 46 aa, Triticum aestivum
  Clone ID: PAT_TA_64625.pep
YSVTIFSRCTHLITDTVHRVYIFELNGSSSCMHNKGLPTRLYYHRA

SEQ ID NO: 170208 - protein, 93 aa, Triticum aestivum
  Clone ID: PAT_TA_64626.pep
PHESRLQRFLEEENHVEDNRNDSRYLPFGVSRRSCPGIILVLLIIGITIHRFVQNLVLWPATGQDKLDTTEKGGQISLHIIMHSTIMAKPSVF

SEQ ID NO: 170209 - protein, 139 aa, Triticum aestivum
  Clone ID: PAT_TA_64627.pep
FIDFCAPNFGLADYYGGWCNFPKEHLEMTEAAFLRVAKAKADIVQVQFRRVSCDRAGGIRFTITGGPNFLQVLITNVAADGEVDAVKVKGSKTGWIPMGRNWGQNWQCDADLRGQAFVFEVTGGKGRTITMYNVAPWTG

SEQ ID NO: 170210 - protein, 123 aa, Triticum aestivum
  unsure (1)..(123): unsure at all Xaa locations
  Clone ID: PAT_TA_64628.pep
QIISYFFGRKNISYLCKLETEQDSVWSFTLCRHWINGLAILHHCNARLRSRSACCRDLDDPSLVPAAARVRAGAARQRPVRGAAAVRHVVEXVNRWREGXLILQYSNHAAYFCAFPRLVLYAP

SEQ ID NO: 170211 - protein, 93 aa, Triticum aestivum
  Clone ID: PAT_TA_64629.pep
ACNSASNGGHGDGARLFQGTVVIFRVSSCCMLNTMKALFAHLGVSSTMVHELDKAPQGEEVERALAGMVSQSPVVPAVFIVSELVGRTDTIMS

SEQ ID NO: 170212 - protein, 86 aa, Triticum aestivum
  Clone ID: PAT_TA_64630.pep
DCQSYKAGAHRPVLVTDTPPCALPVYQDYARTRLINHKPAGRYIIAWILNSVYLKPLPIIFQKTEKLAVVGMEMFTGGCIMGMRFA

SEQ ID NO: 170213 - protein, 129 aa, Triticum aestivum
  Clone ID: PAT_TA_64631.pep
LWKRTARALGAAAADGTQLRERAGRALRRRRRRVGCLHASAFGRGLLLAFLVQAPAERARVVRRRAHACPTGLRGDGPARGGGPGTRGAVGLAWRTPGSGRRELYPKERVGLRSWQRESTGWTRCGRVE

SEQ ID NO: 170214 - protein, 59 aa, Triticum aestivum
  Clone ID: PAT_TA_64632.pep
CSPVRPRRRLTNLTVNRELALRDHDQDEEDKKKCGARCCYLVTLSAVRIPRSMLGAPSF

SEQ ID NO: 170215 - protein, 112 aa, Triticum aestivum
  Clone ID: PAT_TA_64633.pep
SIMEQQQVKPSLPPSDTPMDNQDSSPLPAVTTADPVPRALSNDSATQAASPNPVAPSSPSAPTSATTQDAAGREAPSSMFSTSGLSSWAKNLKIPQPSSGQESPTGKNTVSR

SEQ ID NO: 170216 - protein, 105 aa, Triticum aestivum
  Clone ID: PAT_TA_64634.pep
SAPRLGHPFVGGCLRHWGRNSVLAAVCAGGPLIGWHEVWDQLVNARMGDTEWKTGINLRQDRGKDGIVSRDAVCDAARKLMDSDNDTGQEIRKMAAHLREASLGG

SEQ ID NO: 170217 - protein, 64 aa, Triticum aestivum
  Clone ID: PAT_TA_64635.pep
ICIARCQGAPAASFHPCRLRDRIDSATAALPRWLLCAGLPPPVGELCTPAGSREDEIADVVYRG

SEQ ID NO: 170218 - protein, 102 aa, Triticum aestivum
  unsure (1)..(102): unsure at all Xaa locations
  Clone ID: PAT_TA_64636.pep
GNALLRLQSLPMRFAVCCSAKQDTVEKVCEIVKKQLAVPEGTEVCGTTKFSDLGADSLDTVEIVMGLEEEFQISVEETSAQAIATVEDAATLIDKXVSAKSS

SEQ ID NO: 170219 - protein, 80 aa, Triticum aestivum
  Clone ID: PAT_TA_64637.pep
WSRDYSLLQAVDPYLIMTPTHAWCPHCSHILVSLSGPHGAAHMVAKPSRLSASGAREKRAWWDHRDTGAGPAGGQSFHRA

SEQ ID NO: 170220 - protein, 99 aa, Triticum aestivum
  Clone ID: PAT_TA_64638.pep
FFTRPKRSFTRYLFLLQKSAMRHYNRQESIHVAIEKREGRERSEERDMSIKERRNRGPKLKMEGIYLGRKKERRRAKSEKRQTRGGVKIPSSSPDPLWA

SEQ ID NO: 170221 - protein, 145 aa, Triticum aestivum
  Clone ID: PAT_TA_64639.pep
NIYLHKHAASAALSSPIYKRGNEGRKQPIAHLTNILLSSQHYMLYFIYLCMVVSGKCRIPCIRTPVSVCTYQCFLDGHVWRIETGEWVTGIHQTASIKFCGFHRLKIKHVGTVINIQNDHIAGFVIPQDFFLPHVLTSPRRTRGK

SEQ ID NO: 170222 - protein, 76 aa, Triticum aestivum
  Clone ID: PAT_TA_64640.pep
MPTIIIKVDLDCARCHRKIERVLDRIREKGEFVIDDIEYDEKNNKVIVKGPFDADKLSDKLCCKACKIIKEIEIVE

SEQ ID NO: 170223 - protein, 90 aa, Triticum aestivum
  Clone ID: PAT_TA_64641.pep
HSLYVHSKSRMKRVYITDTTHSIRTIDYGSTKVEFVKSQFTCREGQSRASPHRPFHLHGRDQVHNVRMPDGVRARLYNPTYLTSLQQPLK

SEQ ID NO: 170224 - protein, 73 aa, Triticum aestivum
  Clone ID: PAT_TA_64642.pep
FKFSLSCHQAPLSVFSLGWSCSLVRHYDFGNLKDDITMLLKSYTGFPQKKRKKSYTGVQKEARSTLCYRKHTN

SEQ ID NO: 170225 - protein, 128 aa, Triticum aestivum
  unsure (1)..(128): unsure at all Xaa locations
  Clone ID: PAT_TA_64643.pep
KGAPGGGNPPPPPPQKNAKQRGGPQDPQKRGPKGGKGQGWGPLAKNPNRQKGKIPPNQKKGGPPGVSPPPRGXTRPGKRNKGPPKKNKNGASPRTENGTPKKAPPQKKSLEGPRKRPETVQDLFLYHL

SEQ ID NO: 170226 - protein, 68 aa, Triticum aestivum
  unsure (1)..(68): unsure at all Xaa locations
  Clone ID: PAT_TA_64644.pep
MAVNMALGGQCIYVEEHMTKDELSARLRSLGAKQNRDVKXRGTKEELALRVEDLKEDLGNARPKRGTG

SEQ ID NO: 170227 - protein, 46 aa, Triticum aestivum
  Clone ID: PAT_TA_64645.pep
ERRPRRQHLVQFEKPISTYPSIWHKTTAYSLMKLSKSPFSFLLLDH

SEQ ID NO: 170228 - protein, 103 aa, Triticum aestivum
  Clone ID: PAT_TA_64646.pep
SAREGMSERCEEQASPLDSLGLWYAAALVLQSNRGGVCFCTSRCLEPGNDIHGATLLCYMTRPSCPLRAACSLRSISTHATFPGNGALPRFGSYPLSQVVLCV

SEQ ID NO: 170229 - protein, 84 aa, Triticum aestivum
  Clone ID: PAT_TA_64647.pep
PPGTQRLCRSPLGARHGPGGPPPHAVRPRPVSFVMVTPSEGPSPRRARLGPWGSYTRPPWVFLLHFWFFLFFFFLSFFFFCFLL

SEQ ID NO: 170230 - protein, 155 aa, Triticum aestivum
  Clone ID: PAT_TA_64648.pep
LYWRARLRIARGAGRGVLHIHEVCTPQIVHRDIKSSNILLDESGEARVADFGLARLILPDRTHVTTELVGTLGYIPPEYGQGWVATLRGDVYSFVVLLELLTGRRPVEMMAAAGQPRDLVGWVTQMRSAGRHAEALDPRLRQGSSPGDEAQMLYV

SEQ ID NO: 170231 - protein, 62 aa, Triticum aestivum
  Clone ID: PAT_TA_64649.pep
RKFSGCSSGFFIFIAIYLWQEIRKTNSCVDNPELAELCLPCFHINDICEPIEKKKKINNIQE

SEQ ID NO: 170232 - protein, 71 aa, Triticum aestivum
  Clone ID: PAT_TA_64650.pep
ITCDLNDNIAAPWSPSLQASASTCNKSAAPGPTIPERPAATSAQNGVNHNRLELSLAVCFGALVATILLQV

SEQ ID NO: 170233 - protein, 78 aa, Triticum aestivum
  Clone ID: PAT_TA_64651.pep
MLAGHDHMEIGPMLRQCRELLEGLETITDCRGSDGTTARTIVEVYPHITRTVVDLPRLMDRVLRAPEERAREVSILVT

SEQ ID NO: 170234 - protein, 77 aa, Triticum aestivum
  unsure (1)..(77): unsure at all Xaa locations
  Clone ID: PAT_TA_64652.pep
ILAVLYQCYIPCNPSGYFTVMYLQLIVDVISFLKNXXXXXXXXXXXXXXXKKKKKKIKKKKTKKNPXKNQKKKRGGP

SEQ ID NO: 170235 - protein, 88 aa, Triticum aestivum
  Clone ID: PAT_TA_64653.pep
FVLPPRAAVAPLLPSATCHGSSGALRNSGEWHAVLVRSGMFWTQPLALVDLVVPLCVRPRSRGSLGDLPGPRCKLPPSPPVSPGASTS

SEQ ID NO: 170236 - protein, 109 aa, Triticum aestivum
  unsure (1)..(109): unsure at all Xaa locations
  Clone ID: PAT_TA_64654.pep
PRVRPRVRWNISHAEWLGVPLKVYADRLSXSSRAIIILCKVNRFDFQELTVDLVKGQHRAPEFTKINPMAQVPTIDDGRFKLFESHAILRNLAPVLPGVSHYWYSADLF

SEQ ID NO: 170237 - protein, 75 aa, Triticum aestivum
  Clone ID: PAT_TA_64655.pep
VSWMKPGHWSGWCCEQSSRVGPESARGAHTTALLYAWPRAFGQATRHTMLPQASAVLWSTQIGKSPSCLLAQHAV

SEQ ID NO: 170238 - protein, 99 aa, Triticum aestivum
  Clone ID: PAT_TA_64656.pep
SKPFSSTNLSRIITLMKISVIMVVGLIFINLCTCMPRNVANHESHDTVVPQKEMRSLMSGTAGRNRPPSNDHQCPLGTYPNCQGMSQNTQEAAQDVGGN

SEQ ID NO: 170239 - protein, 136 aa, Triticum aestivum
  unsure (1)..(136): unsure at all Xaa locations
  Clone ID: PAT_TA_64657.pep
SCSFPFLAAAAASYPLEADPTMADVDVDTEVAAGAQPKKRTFRKFSYRGVDLDALLDMSTDDLVQMFPARARRRFKRGLKRKPMALVKKLRKAKKDAPAGEKPEPVRTHLRNMIIVPEMIGSLXGVYNGKTFTRLR

SEQ ID NO: 170240 - protein, 103 aa, Triticum aestivum
  Clone ID: PAT_TA_64658.pep
SLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 170241 - protein, 82 aa, Triticum aestivum
  Clone ID: PAT_TA_64659.pep
SRVRAVFLLVQGLVYLILTNSSDVFSKSKRLRSLSFRPMRSMSVRRVLAPLSDVPVGTDDDSPLPSSASSWSSRRWGSRKED

SEQ ID NO: 170242 - protein, 106 aa, Triticum aestivum
  unsure (1)..(106): unsure at all Xaa locations
  Clone ID: PAT_TA_64660.pep
FSPVKDYSDWAHTVDINAGVCSTDDLTMYSFRVNPCWRAYTHDWTESPFAHPGENERQFDPRRVTYSCVPCPDFRQNQXACRKGDFCKYAHSVLESWLHPVQYRTK

SEQ ID NO: 170243 - protein, 49 aa, Triticum aestivum
  Clone ID: PAT_TA_64661.pep
EAFGRAPLTAPVTFYTRAASLTSSRERSLSKFVSLFWPLFSFRKFGIIF

SEQ ID NO: 170244 - protein, 128 aa, Triticum aestivum
  unsure (1)..(128): unsure at all Xaa locations
  Clone ID: PAT_TA_64662.pep
FRLEAKIADFGLTKAFDYHNNTHLFTNTLAFTPGYVDPQYQATMQPTTKSDVYSFGVVLLELVTGKPAILSDPEPTSIVQWARQRLARGNMEXVVDARMQGGYDIKXVWKVADIALKCTARGQHIGPP

SEQ ID NO: 170245 - protein, 59 aa, Triticum aestivum
  Clone ID: PAT_TA_64663.pep
LVFLWCLPGWACPLVDVLLLPVSQSRVRVLWRPLVRCGSLLLWLPLLRLSFFLLALRKP

SEQ ID NO: 170246 - protein, 40 aa, Triticum aestivum
  Clone ID: PAT_TA_64664.pep
MSREGQWMCQVQGRGRRQCIPLHHSGSVIPRRVRGPWAGA

SEQ ID NO: 170247 - protein, 44 aa, Triticum aestivum
  Clone ID: PAT_TA_64665.pep
PSRPEEKKSRSWSLLRRVANMTWETCDRFGAIPSYLEMLPGLLH

SEQ ID NO: 170248 - protein, 65 aa, Triticum aestivum
  Clone ID: PAT_TA_64666.pep
MGGDMITDIAVASMCGTELAVTYCVNTQSRTPLCSLSTRCRWPTKNSVIYERPFKLLSTVPELLP

SEQ ID NO: 170249 - protein, 39 aa, Triticum aestivum
  Clone ID: PAT_TA_64667.pep
FSADAWAHASGGAYDKDNTDTATGRPRGGGSRSARRGTP

SEQ ID NO: 170250 - protein, 51 aa, Triticum aestivum
  Clone ID: PAT_TA_64668.pep
DMLGEILLLLAPQPSSGLLAPLVSRRWRGLSTDPNFIRQFQARRRSWKPPL

SEQ ID NO: 170251 - protein, 50 aa, Triticum aestivum
  Clone ID: PAT_TA_64669.pep
LLVILSFLEPSTKNTGFGSSHPPTKAADLLQYVMMILGQRHEIKQAGPQV

SEQ ID NO: 170252 - protein, 159 aa, Triticum aestivum
  unsure (1)..(159): unsure at all Xaa locations
  Clone ID: PAT_TA_64670.pep
LEDMYLKPLNLGLIAAYYYISYTTIERFSSMLTQKTKMKGLLEILASASEXELPSRPGEEEYIERLVRHQRFSIDKPKYGDPHVKANALLQSHFARHTVVGNLAADQREILLSAHRLLLAMVDVISSSGWLTLALNAMELSQMVTQGMWDRDSVLLQLP

SEQ ID NO: 170253 - protein, 74 aa, Triticum aestivum
  Clone ID: PAT_TA_64671.pep
INLGPPKKKLIPSKHPEVNFEPIKPPPPIIFSFFFFTFFNFSFFFFFFFFFFFFFFFFFFFFFFFFFLFFFSNA

SEQ ID NO: 170254 - protein, 73 aa, Triticum aestivum
  Clone ID: PAT_TA_64672.pep
HRLPKIGEAFLGESAATSASQVIGTLAALIPHDNSIPITSEKKGPLSKLSESMARPTAPGSSPSFWKRRATTT

SEQ ID NO: 170255 - protein, 68 aa, Triticum aestivum
  unsure (1)..(68): unsure at all Xaa locations
  Clone ID: PAT_TA_64673.pep
SFWHSLIEEYKLXGLIRWISGQMNRVRKGEPPRSMCKTKGASGQAACYDAIGRTAMEAMTWGVATIAT

SEQ ID NO: 170256 - protein, 68 aa, Triticum aestivum
  Clone ID: PAT_TA_64674.pep
LSYAPGKPPPPCLVDDTGIRLACRQPIGDPGAIDGRRRPDRSKRKGTTSKVPLQDEQFPTGHETPSKT

SEQ ID NO: 170257 - protein, 37 aa, Triticum aestivum
  Clone ID: PAT_TA_64675.pep
ACGVRRSQRLGPPLVFSCRVGSKVGQPKNFQVRCLPA

SEQ ID NO: 170258 - protein, 76 aa, Triticum aestivum
  Clone ID: PAT_TA_64676.pep
DVGFFQILEYGPNTSKWLCLPHHLMLSIIIQFRFIVVAISSSSGKERESTIRFKVVLGILCVSAICFRVINRTFSD

SEQ ID NO: 170259 - protein, 98 aa, Triticum aestivum
  Clone ID: PAT_TA_64677.pep
FSPCGQGGFFPLAVWVGAPRVFPVRGVFKLRPFAWLSGAPFRFFFGAGPRPRAWVLCGGRPLFLLFGRVLFFFFFFAFLVFFFFFFSPFFFFFFVSGK

SEQ ID NO: 170260 - protein, 96 aa, Triticum aestivum
  Clone ID: PAT_TA_64678.pep
MAFMRYRALPQGEVKAEEFWAWLGQFDADHDGRISREELQRALRSLNLWFASWKARGGVQAADANRDGAVGREEAGLLFAYAQRQLGGKITQLGSY

SEQ ID NO: 170261 - protein, 96 aa, Triticum aestivum
  Clone ID: PAT_TA_64679.pep
VSEAHGHARKAYRDKSGHHGHKTAHHTGHGSGHHHGQQHHGGQISGGAHGPQRDKGNGARRNSAEQVHAHDMPEANTNDALRLLPEEERSMHGERY

SEQ ID NO: 170262 - protein, 70 aa, Triticum aestivum
  Clone ID: PAT_TA_64680.pep
GNPQGAPPHFCRISTRTGASFSQQQPLSLDKLSFLVTAIYILSILASFIGTSFLSLTTLVRSSVFVPRVR

SEQ ID NO: 170263 - protein, 84 aa, Triticum aestivum
  Clone ID: PAT_TA_64681.pep
TTNCQKYTILLLLVKTTGQKFSSHFFCWQSVYQSPNHSCIILIPGLYIYKNDSQIHSFTSHYCQSLSLSTRTYASYSHTATSLA

SEQ ID NO: 170264 - protein, 104 aa, Triticum aestivum
  unsure (1)..(104): unsure at all Xaa locations
  Clone ID: PAT_TA_64682.pep
MMGRVIRAQRKGADSALKFHTHHRKGPARFMSLDFGQRNWYLKGVTSDVIHDPLRTTPVANVTFRHPFTYXHQTELFVAAXGIYTXQFVYCGRRSTLSVSHMLP

SEQ ID NO: 170265 - protein, 64 aa, Triticum aestivum
  Clone ID: PAT_TA_64683.pep
YAAELLTEKVGQRSRISARRNIECDLDTPPTNKRKGPPASCYEVECFSLAHTAAQTVFDCTGRG

SEQ ID NO: 170266 - protein, 56 aa, Triticum aestivum
  Clone ID: PAT_TA_64684.pep
LSLDLPVLISLSVFAALLIATHIGLYLESTTCWPIVMLLSSWRWVSYILIHAILIH

SEQ ID NO: 170267 - protein, 116 aa, Triticum aestivum
  Clone ID: PAT_TA_64685.pep
ASFLLGEVCVRVSFHGVCSCLLKRRREKPQESCARQLEEEEGWRCKRSGANNWYSEPCRSGAVAARQTPCEMEAGGARRRSVAAATVRGRYEEEMVRGDRRREVVVRVKRRPLHTA

SEQ ID NO: 170268 - protein, 84 aa, Triticum aestivum
  Clone ID: PAT_TA_64686.pep
LLTQVQPDVGIFYKAMSIMNYCINGIFEKLAGEYDKLGRYNKKPTITCREIQTSERLVLPGELVKHAVFVGTKVVTKLTSSCTG

SEQ ID NO: 170269 - protein, 126 aa, Triticum aestivum
  Clone ID: PAT_TA_64687.pep
CPNDKGEESKVNKALTDRRTPKKSCRRRDTTQTTAMSHHHAVAAHIHAGTSRDSPEPPWSGYDTLPSSHPAPCASYRTTPTMTSHHRIATTILTLLTANLASTGQDHHHQRPSLPEAEHQPPAQAA

SEQ ID NO: 170270 - protein, 97 aa, Triticum aestivum
  Clone ID: PAT_TA_64688.pep
RRGSKLQQGPRGASSREAQLQQRPCGASPARPPAARGASRRRPLPLLAAGEAKHDPPSPPPVKQKKCRFQQNQKTVVAIFRLVQQKSKKTWGGSENF

SEQ ID NO: 170271 - protein, 64 aa, Triticum aestivum
  Clone ID: PAT_TA_64689.pep
ARSASAGRLDSPAGRGRNFSHHLRPSRPRNRRHRSRGRRRREWEAGQGQESSQARSSRRRPRKR

SEQ ID NO: 170272 - protein, 73 aa, Triticum aestivum
  Clone ID: PAT_TA_64690.pep
TRADQVGLSSERRQSFPSQFVVFRHAVTPFSVPSHKVSSVARRSVFVWGQHPNPPPVVGGKLRNFIHFTMFKK

SEQ ID NO: 170273 - protein, 59 aa, Triticum aestivum
  Clone ID: PAT_TA_64691.pep
KGRPIFFFFFFFFLFFFFIFFYYFFIFFFFFFFFFFFFFLFVAEDTISSVIFLQKTLIK

SEQ ID NO: 170274 - protein, 66 aa, Triticum aestivum
  Clone ID: PAT_TA_64692.pep
VYLFSQHNMSLTSGIHEVTAVVKPIVPAQQQYMHTSMLDKATACLCLNTFNITLFPPPAKTNPRVQ

SEQ ID NO: 170275 - protein, 127 aa, Triticum aestivum
  unsure (1)..(127): unsure at all Xaa locations
  Clone ID: PAT_TA_64693.pep
MDRRRRRPFWSWPAEEHTLERXDLLREILVRLPSXPTYLLRASPWVKSWRHMAICPKLLRRWRVHHRKPTLLGDYTSENGGLSRRSTLDLPYRIRPGHIFLQLQVHGRDPWRLVDXRHGRVLLLTRR

SEQ ID NO: 170276 - protein, 48 aa, Triticum aestivum
  Clone ID: PAT_TA_64694.pep
IKKKIKQDYRSNLNKRKTSSYWGGPFRGPKFTSAGMQALGFFLGSPNL

SEQ ID NO: 170277 - protein, 44 aa, Triticum aestivum
  Clone ID: PAT_TA_64695.pep
LGETPGGTQLNGVGAHAPLGRWGNSEEGSTDRPGQQVRRLNGHW

SEQ ID NO: 170278 - protein, 108 aa, Triticum aestivum
  Clone ID: PAT_TA_64696.pep
PAGKGRMCSKRALVALPSDFASLRVVTPRPVPSVALMCSSPSPICSTSSCSSSLVAASSAITPSCCSPRCACNGLQFGLSTVFPLQTFYSPDSSFESRLHDHRLIRFH

SEQ ID NO: 170279 - protein, 99 aa, Triticum aestivum
  Clone ID: PAT_TA_64697.pep
IITSISPSTSKRSNEDTRRYRSHTLYHLSIQPVACLSLEPALSSLIYPPYGVTFTIVCDQALQTQQLHPCLGLASGACCYSPGALHLLSPSVLSPLLRN

SEQ ID NO: 170280 - protein, 111 aa, Triticum aestivum
  Clone ID: PAT_TA_64698.pep
FGALPMLEDLGLVYSVSMANANGFCLGFQHLPRLRNARVRLYKEGATSSAITSAEVAIKNEADAHPNHPTVTLIEHVKRVDYCSEECPKRTVQSYSEDPELVDNTTKQKET

SEQ ID NO: 170281 - protein, 47 aa, Triticum aestivum
  Clone ID: PAT_TA_64699.pep
MFNRLLTSDRPRVRPRHRAHASANAWADAWADAWADAWADAWADAWT

SEQ ID NO: 170282 - protein, 80 aa, Triticum aestivum
  Clone ID: PAT_TA_64700.pep
TAPPLFFFFFFFFFFLFFFFFFFFFFFFFFFFFFFIYFFFFFIFSLGCTSNLYIHRTRGRTRGRMRDRTRCAQAWPYAST

SEQ ID NO: 170283 - protein, 109 aa, Triticum aestivum
  Clone ID: PAT_TA_64701.pep
FYFGKPSILFMTNEKMAPTQMRIILSPHKTNHKPFQRTNYKWHGNNTNRLAVVVLQTRKGNAAMYKEMHGGSIIREKSILLGAHGWLNLIFVSFICYQFSCTILAFSNR

SEQ ID NO: 170284 - protein, 55 aa, Triticum aestivum
  Clone ID: PAT_TA_64702.pep
GKLIKYPVNCAVITVNLGPIIIPICNDDNGFYNCATRKFYQQHSCSTLEQGVHVA

SEQ ID NO: 170285 - protein, 127 aa, Triticum aestivum
  Clone ID: PAT_TA_64703.pep
QCVAVRQSELPVHEHPEVVRDPFHPEERHSRDLQPRPKYTAINLVAYMFASLTVLRPSAGLFTRACAMKAFASQCHVVPDVSALYLEVHQRQHGQRGHGHAPRPPPVSIVTPTQLVHTHEMVSPIIP

SEQ ID NO: 170286 - protein, 122 aa, Triticum aestivum
  Clone ID: PAT_TA_64704.pep
KSSPGFRQQIRMRKTTSTFVLSAHTISMLTILHSTLPQMLLFSMHVNSWTKNWRMRFTKQYTVIQLRLLDAALNILALKSCPPLNQQGVYSNLSAMLHGAMWSGQEQFAKHASPWHSSQVNS

SEQ ID NO: 170287 - protein, 112 aa, Triticum aestivum
  unsure (1)..(112): unsure at all Xaa locations
  Clone ID: PAT_TA_64705.pep
VRNFLLHPRPYPYGWLLSSLNTPTTSSSDRLPGPSIKFSMTPAMAGSPYMHFFSAAERTGGRLRHVRSLLRQPRHVRHRHGVRRRRAPAQLSQAERLHLPVHGRLRRGXELQ

SEQ ID NO: 170288 - protein, 128 aa, Triticum aestivum
  Clone ID: PAT_TA_64706.pep
FCGRVGKQLVGGDVFVFPQGLIHFQVNNGKVPAVAIAALSSQDAGVITIANAVFGSTPPISDLILAKAFMTEKDTVDWIQAKFAPAMSGNSSMGGGGYDMPPGGGEGEGGNSTGGGGGYYPGMRKRKP

SEQ ID NO: 170289 - protein, 51 aa, Triticum aestivum
  Clone ID: PAT_TA_64707.pep
KGGDPTDAEKGSGDPKERPDLIRQCSLFFWGWFTQNVYKTTPATYQLNKLS

SEQ ID NO: 170290 - protein, 133 aa, Triticum aestivum
  Clone ID: PAT_TA_64708.pep
LLLSLAVGITIAVGVVGYIQENLGWGIGFGMLCAIMLGALVVFFLGTPTYRLYAPTPGAENPFALLARSLAALAQHDNATSSSLLGYKKEYQVEQKEDAVKKEEARGVVRLLSIWAACLAYGVVFAQFMTLFY

SEQ ID NO: 170291 - protein, 81 aa, Triticum aestivum
  Clone ID: PAT_TA_64709.pep
MDRILAFSILSSSPADIPGAGYSTPTRLSWRGGSGEQPEKAADKHRQEEKVNQGSRPEKKPEVRFAPEFDGINCFESIISF

SEQ ID NO: 170292 - protein, 80 aa, Triticum aestivum
  unsure (1)..(80): unsure at all Xaa locations
  Clone ID: PAT_TA_64710.pep
MSLTKRKEKRKLYMISSKPGRPFSLNLLLRCRSSVFREMKKYQMGFSSWCGECQREKRERQIQCVKATKXFLRGAGGAMI

SEQ ID NO: 170293 - protein, 71 aa, Triticum aestivum
  Clone ID: PAT_TA_64711.pep
LFLNRQKDIKTGKYSQLLSNGLDNMLREDLERLKKIRAHRGLRHYWGLRVRGQHTKTTGRKGRTVGVSKKK

SEQ ID NO: 170294 - protein, 58 aa, Triticum aestivum
  Clone ID: PAT_TA_64712.pep
ATHRAVAFLLHVRLLSRFRCSLIARTRASQLIFCDGVLRKVTMAPHHHAASCRALMHS

SEQ ID NO: 170295 - protein, 117 aa, Triticum aestivum
  Clone ID: PAT_TA_64713.pep
FPFGCCGVFPVSPLCSAGRSLASASCHRPPLLLAHAVRRFFFGGSSSSSSSSLFSSCASSSSPVSFCLGFSSLSPVAPWRLAASGCWAEILSVSVRRRRGSCLPRCEHRRWFSGGNQ

SEQ ID NO: 170296 - protein, 53 aa, Triticum aestivum
  Clone ID: PAT_TA_64714.pep
TLLFLESESMGPSVSSSVATACMYTSVARATITTCELEQTEPMAMVMYLAPSQ

SEQ ID NO: 170297 - protein, 71 aa, Triticum aestivum
  Clone ID: PAT_TA_64715.pep
CIIDINFFFYKVDQTLLSLTLTRFYMQTKTTEEVAVENGHAQCRSAYHVHIMVTAKSQRIVADYVLVHTRI

SEQ ID NO: 170298 - protein, 134 aa, Triticum aestivum
  Clone ID: PAT_TA_64716.pep
MSEEKHHHLLHHMEGEDFQPAADCGVYTYGYSTVTVVTVTGNHSEYERITKEEKHHTHTEHLSEMGAAWGGAFYLYEKHEANKDPEHAHKHKIEEEVVADIAVGAGGFVFHEHHEMKHDHMEAKEASGEKKHHH

SEQ ID NO: 170299 - protein, 78 aa, Triticum aestivum
  Clone ID: PAT_TA_64717.pep
FIKKKKKKKKKKKKKKKKKKKKKKKKKKKKKKKKKKKKKKKKKKKKKKKKKKGGGPFRGPSFPPRGRPQNSFFLGPPN

SEQ ID NO: 170300 - protein, 57 aa, Triticum aestivum
  Clone ID: PAT_TA_64718.pep
TPLRCHCLSLTDPFSYDELSGRLRSTGAHVGSCLRPPAANEKLVLRVADLQEALAHT

SEQ ID NO: 170301 - protein, 164 aa, Triticum aestivum
  Clone ID: PAT_TA_64719.pep
MDMGRNTVTTGIRGTMGHIAPEYFKTGRPSVKTDIFGYGVMLLEIVTGERAIFPDFLEGAGEVMLIDQVKLLMQEGRLEEIVDRNIGCGYDFQELVKIIQVALLCTNIDPCQRPAMSEVVHMLEEKIVPEDQWEEWQQAELTRRQQYEYKQHHILFTFSEESLN

SEQ ID NO: 170302 - protein, 71 aa, Triticum aestivum
  Clone ID: PAT_TA_64720.pep
LFIILYYVYFFFYIIFFFFFILIFYFFFVYFFVNSEDVLLPNFMYKKTSVLYNVYIVLPPSGNTCRGNGCI

SEQ ID NO: 170303 - protein, 138 aa, Triticum aestivum
  Clone ID: PAT_TA_64721.pep
MDPSSEIVYDMPGFIRIHKSGRVERLQGTETVPPSPSGDPANGVASKDVVLDPAANVSARLYLPAAAAAEPGKKFPVVVYFHGGAFVVHTSASPIYHKYAVFLAVVAPAVVVSVDYRLAPEHPLPAAYDDAFAVLQAI

SEQ ID NO: 170304 - protein, 78 aa, Triticum aestivum; identical to SEQ ID NO: 106976
  Clone ID: PAT_TA_64722.pep

SEQ ID NO: 170305 - protein, 31 aa, Triticum aestivum
  Clone ID: PAT_TA_64723.pep
GSFLPRSSGIGAVRLCQEWPLLGLDEIINKK

SEQ ID NO: 170306 - protein, 45 aa, Triticum aestivum
  Clone ID: PAT_TA_64724.pep
LASHTLFQHYRLQIVNPASLSYLVGSLAPGSFKARKRGRYRSSIH

SEQ ID NO: 170307 - protein, 58 aa, Triticum aestivum
  Clone ID: PAT_TA_64725.pep
IRSSRFSFYSVSYFYIFWIFKTISFNLPRFNFQLVCSVSILRSTLIPLPSAEASARER

SEQ ID NO: 170308 - protein, 50 aa, Triticum aestivum
  Clone ID: PAT_TA_64726.pep
SMLIVNEFSICSFFYLRFFYYGFSCEAHMCYSCEKATVRPKKSEAHLSIV

SEQ ID NO: 170309 - protein, 142 aa, Triticum aestivum
  Clone ID: PAT_TA_64727.pep
SVRGRVGGRVGGRVGGRVGGRVGGRVGRGPKGTGEYECIDLYAVGGGRKASDMYNSTAEDVLYVLKESSDDDRHDWYSLGRFDAAVNKWTPIDEELELGVWLRYDWGKYYAFKSFYDPVKKRRVVWAYVGETDSGRADITQG

SEQ ID NO: 170310 - protein, 39 aa, Triticum aestivum
  Clone ID: PAT_TA_64728.pep
KGAPPISFFVFFKFIYMFFLFIMFFFFFFFFYFFFFFSS

SEQ ID NO: 170311 - protein, 78 aa, Triticum aestivum; identical to SEQ ID NO: 106980
  Clone ID: PAT_TA_64729.pep

SEQ ID NO: 170312 - protein, 86 aa, Triticum aestivum
  Clone ID: PAT_TA_64730.pep
MVLSQYQAYESPGPYASRSLSCLHVSMVSRSSSSSSAALGESFVLLTSQSLFHAPHRNANKSPQQVERCELTKGSHPTRPPRRQKK

SEQ ID NO: 170313 - protein, 56 aa, Triticum aestivum
  Clone ID: PAT_TA_64731.pep
RSRACACQTAQERIPDRKCLVACEIVRSALLLIVDHERCGFTTAPASVSHFFFANK

SEQ ID NO: 170314 - protein, 44 aa, Triticum aestivum
  Clone ID: PAT_TA_64732.pep
VQGHVVRTAPTQAQNARHQGASQSPSRVGTCCHRDGQGLSVISH

SEQ ID NO: 170315 - protein, 80 aa, Triticum aestivum
  Clone ID: PAT_TA_64733.pep
YSMQKFLIVCMFSIHQYSYVNMAKCLIEPPIRVCQKAHVNPSQPQIRQQGLVDAYRAFMCFSVSSKSWKLPRTVIVHRRP

SEQ ID NO: 170316 - protein, 57 aa, Triticum aestivum
  unsure (1)..(57): unsure at all Xaa locations
  Clone ID: PAT_TA_64734.pep
MEAAVPADAKAAAATRDLLSDDNQFVEFELGEXCDHTEDRDEAGQQGEDDWDYDNVN

SEQ ID NO: 170317 - protein, 95 aa, Triticum aestivum
  unsure (1)..(95): unsure at all Xaa locations
  Clone ID: PAT_TA_64735.pep
MSKLWTMLSHLHTLEGPGVMLLFPLYAWVLAMASPSKLDDXQRLAYWILYSCVRLVLMVLEYFIYWIPTWYALKILIVAWLATVNLRERSYIRQV

SEQ ID NO: 170318 - protein, 71 aa, Triticum aestivum
  unsure (1)..(71): unsure at all Xaa locations
  Clone ID: PAT_TA_64736.pep
AHTRIIDHARRMXKYYSVRDRQMIHVRAQQQPPPPPHNRSTDDEQRSDSIRSSWKDQSRLLKAMTLITTTW

SEQ ID NO: 170319 - protein, 74 aa, Triticum aestivum
  Clone ID: PAT_TA_64737.pep
IPLPSDMVNPGTLKGAPPFFDGLLIFSQCTLQLRPNVPSHVQDVCCFVLLSPLFLVFFLLYIFSLFFFFFGRVN

SEQ ID NO: 170320 - protein, 89 aa, Triticum aestivum
  Clone ID: PAT_TA_64738.pep
CGPGRWCALPDHPHRAQVGVGRDHGRDEGGERLRQAPCCPCRCPHRRQAEEAPCRQGRRRRISDRCAEPKRVSLGTSNTPSSMWNNCWV

SEQ ID NO: 170321 - protein, 51 aa, Triticum aestivum
  Clone ID: PAT_TA_64739.pep
STMAKAVEDFMTKEQLMALHRLLAQQLNLEGRHAGTNDDGGSHGGQPQRGA

SEQ ID NO: 170322 - protein, 85 aa, Triticum aestivum
  Clone ID: PAT_TA_64740.pep
RVMLRTPHGQTFTQFIQGSQLLHHEIVAWQSRHVQPALVYPIVGLLTGCLVLAPPWGPHEQDNQWCPKDAWDPPILQRQYQQEQH

SEQ ID NO: 170323 - protein, 89 aa, Triticum aestivum
  Clone ID: PAT_TA_64741.pep
PCSRIACGPHCSVLRVAVHLVHGHHQQGLDDLPADLALEVVDPQPVAAQVRHLLVRVRVPPVLHGDQQQPRPYLVKVQEHRLPRRRSRA

SEQ ID NO: 170324 - protein, 60 aa, Triticum aestivum
  Clone ID: PAT_TA_64742.pep
PLIRGIIGRPAWLTDWLAHCSDHYAGYHNDSATERNHEPNYSQRRRPRRNPSLKQKDGPS

SEQ ID NO: 170325 - protein, 70 aa, Triticum aestivum
  Clone ID: PAT_TA_64743.pep
GPPFFFFFCEPKLGARSKHLISNSTTGSTRSYIYMPNTPRLDLIIQQLTRLRKLWIGRTARRPADEASSP

SEQ ID NO: 170326 - protein, 85 aa, Triticum aestivum
  Clone ID: PAT_TA_64744.pep
ARTHGTVILHHIYCPHHQVHITDPIGYLWPRTLFFLPSRAPCVARPPLLPVISSSTWLSFSCLSSGLTRWPWALEFCQWSRVLNS

SEQ ID NO: 170327 - protein, 144 aa, Triticum aestivum
  unsure (1)..(144): unsure at all Xaa locations
  Clone ID: PAT_TA_64745.pep
AHVCSFVVEAYNNVLFTHYLVEHTELDGLLETEAMYDKXRRCLDIGGPTYTRPNGFAPQVIXCTTGSLWSDGALNVKXSELYTNLVRYPWIHYMLYXYLPVISSDKAYDEQICVDVITNNDFSPCSMMVKSDTCHRMHMACCLM

SEQ ID NO: 170328 - protein, 80 aa, Triticum aestivum
  Clone ID: PAT_TA_64746.pep
ISLSIKMLLTVRPSMHRLFVSGPRAAIMAEMLPKRTMKNIKFIVLHDILGKIGIFPKYDDNDSCGEQTSSLLSISMIAGY

SEQ ID NO: 170329 - protein, 64 aa, Triticum aestivum
  Clone ID: PAT_TA_64747.pep
SITKKKKKRRAHNKSNKDTECRETRTDEVTSEQEASSCGLRGDYFFAEEPTPYADLIALRRFLG

SEQ ID NO: 170330 - protein, 80 aa, Triticum aestivum
  unsure (1)..(80): unsure at all Xaa locations
  Clone ID: PAT_TA_64748.pep
VRALGLAQMVGGLAGGLHYYAAVLHRAGAGEDPCANWRVYAVYAACXVIICACARAEKRKKVYLAGCRGVEEELRDESFF

SEQ ID NO: 170331 - protein, 122 aa, Triticum aestivum
  unsure (1)..(122): unsure at all Xaa locations
  Clone ID: PAT_TA_64749.pep
CLYVRVTGGGVGAVTSXLAHKIGPIGLSSKKIREDIVKETDKDWKGLRVTXKLTVQNREAKVSVVPSVAVLVIRXLKEPARDRKKVKNIKHNGNISLDDXIEISKIMKSRSMGNEMAGTVKE

SEQ ID NO: 170332 - protein, 81 aa, Triticum aestivum
  unsure (1)..(81): unsure at all Xaa locations
  Clone ID: PAT_TA_64750.pep
SGRGLDALSKFTYNGDGRLGXMIATTTMVVVTFGTHRPVGQYPVRDKRQTVAVRAIKGLXKNDHTGAKDTKADLMNKLAGY

SEQ ID NO: 170333 - protein, 123 aa, Triticum aestivum
  unsure (1)..(123): unsure at all Xaa locations
  Clone ID: PAT_TA_64751.pep
CFAYIVTLGMGGAYMVGLNRWRTAMTTDIALVDGYCGHAEPCFVRAFYWVLDXTYGMCMTESGFNKTGLPGAIWYXRSPYYKVGSVLSIMVLSAIIALVANLSFNVPAVLLMGNEVGTAVALI

SEQ ID NO: 170334 - protein, 53 aa, Triticum aestivum
  Clone ID: PAT_TA_64752.pep
TICLHKPNIQPSRKADNVLHVTRVGIPKASVQPRHIRSPNTSSSLQTGAVKQG

SEQ ID NO: 170335 - protein, 55 aa, Triticum aestivum
  Clone ID: PAT_TA_64753.pep
QLFFRHRIHPTTVMTLSFHDLSYLTQIYLYRVGSNYIRRRVQPLPPTHPTLGVHQ

SEQ ID NO: 170336 - protein, 126 aa, Triticum aestivum
  Clone ID: PAT_TA_64754.pep
NPPDGRGICPSTRGVPIPGFAVPMLVKTIVYGLYEFSRNGDPRIDGKPFKFGHPMAFPAVLLGTAVRAFVRGGPIVQLLAMHSSARNLGTLRAADPVSCAFCRSSWTWPCDFWLCLFYGPLARVGF

SEQ ID NO: 170337 - protein, 50 aa, Triticum aestivum
  Clone ID: PAT_TA_64755.pep
LRVPYSRWMTSQACVRHFGCSKKTSPVAVNTILAFAFAFANAHTCSLSLT

SEQ ID NO: 170338 - protein, 96 aa, Triticum aestivum
  unsure (1)..(96): unsure at all Xaa locations
  Clone ID: PAT_TA_64756.pep
MRPHVLLAALADVVILTAAVALAHGQGATPSASPCCNNCGTCTRNIPARCTCMDPXTSGCYPACKTCDKFTVAGQDSFQCKDRVANFWQHSCTNAA

SEQ ID NO: 170339 - protein, 129 aa, Triticum aestivum
  unsure (1)..(129): unsure at all Xaa locations
  Clone ID: PAT_TA_64757.pep
DEPDRYVILGNHHDAWTFVAADPNRGTAALLELAXRLSELQNMGWRPCRTMILCNWDAEXYGLIGSTXWVEENRAMLTLRTDAYLNVDVGAGASGVDASGTHQLDELLKQASKKDQNPDNGTVSLYDSW

SEQ ID NO: 170340 - protein, 78 aa, Triticum aestivum
  Clone ID: PAT_TA_64758.pep
LLSDPVSSNFRLSCHNMKTSRQSCHSFGRGRRVFINAPSDPSCATCMCICSSGSPTSQHVAVCLMAPTRSDMEWWHKR

SEQ ID NO: 170341 - protein, 76 aa, Triticum aestivum
  Clone ID: PAT_TA_64759.pep
AQSLTNEYLSALSWAPSQQCHRDGGLNRTNEASSLARPLPVGLDRLHSVFNLPFHSLGHYSVWCSAAASQHIHHMQ

SEQ ID NO: 170342 - protein, 58 aa, Triticum aestivum
  Clone ID: PAT_TA_64760.pep
VGHPKKRCSPSKRRGANMVSLKQAPPLKVSMAPKDHTYASCNEHKLIRFIHSELSVLF

SEQ ID NO: 170343 - protein, 91 aa, Triticum aestivum
  Clone ID: PAT_TA_64761.pep
LTPPYKMFNQTLLDLGLQVTPVNDYLYETVHSLHEKGHLPVHRKDVLPEALDSQQREGAGATTRVTLSCIAAGHRTWSVWGYILSNIVLFK

SEQ ID NO: 170344 - protein, 107 aa, Triticum aestivum
  Clone ID: PAT_TA_64762.pep
GVSSKSPHQWCWAIWAMLYIVQCLCCVSYSQVDLKFVAIPSWNLLFVTTDVSHQLRSYANKMMRPSCQLIDIFSVAILQYQEQVMPKHLEDCSYRTGDSVATEVDYA

SEQ ID NO: 170345 - protein, 108 aa, Triticum aestivum
  Clone ID: PAT_TA_64763.pep
RPRVRSTSAGRSNRSQVSKSPPRRSRRPDAMARTKQTARRSTGGMAPRTQLATKADRKLAPTTGGVKKPHRCRPGTVVLREIRKYQKSTELLIRTLPFQRLVREIAQD

SEQ ID NO: 170346 - protein, 41 aa, Triticum aestivum
  Clone ID: PAT_TA_64764.pep
NASSYKYRHNMCMNVLVRAPHDAAHGFLSQHPPSERLECVA

SEQ ID NO: 170347 - protein, 86 aa, Triticum aestivum
  Clone ID: PAT_TA_64765.pep
LFCHRKMLVLQSVSASLTSGFSCSISLIRGSISSSLIMYSGANKPWPPRAVVPPVVRTATYLGQSAAASLPPETWYAHVEATRWSP

SEQ ID NO: 170348 - protein, 130 aa, Triticum aestivum
  Clone ID: PAT_TA_64766.pep
VSKMADPVADPAALPIVPCPDCGRNVVTYVARRGQNAGQRFYKCRNHNPSAGGCDFYRWQQGYVAHLANLEGGEAAVGQIGPGQTQGGQAVQAQVVQALHGQPVQQNGPPEASQAASFASAVAGYMLAAA

SEQ ID NO: 170349 - protein, 88 aa, Triticum aestivum
  unsure (1)..(88): unsure at all Xaa locations
  Clone ID: PAT_TA_64767.pep
MASKWVRPEVYPLLVATGXVAIGICAFSLSXNITGDPEVMINKMGRAAGVLENHEEGRRYAXHGLRAYVQDKTCEIMPGINMFSTRPE

SEQ ID NO: 170350 - protein, 146 aa, Triticum aestivum
  Clone ID: PAT_TA_64768.pep
CPRVRVNLIFVGMLVTGMYSLKYINVAMVTILKNMTNILTAVGEIYVFRKCQNKQVWAALCMMIILAGSGGMTDLSFHLIGYAWQILNCFLTADYYVTLRRLMDTVKQSTELGFVNEVSMVLLNNGVYIPFEDILIIVLNQWEYVY

SEQ ID NO: 170351 - protein, 117 aa, Triticum aestivum
  Clone ID: PAT_TA_64769.pep
GFSLSCRCLLPARALLCPRVFVLLFRVCLSALPFFFRRRQSCLLGSVVPPSSGGGRSVLLLSRSPPLFSIGLGGALFSPVVRPLYSSVSSGRFCGAACFLVLSLSVLPVVAQKFVFP

SEQ ID NO: 170352 - protein, 82 aa, Triticum aestivum
  Clone ID: PAT_TA_64770.pep
IQISSMSVIAQLNRSVRIGCSTSRRYQLPTTCAPSHSHVVLCSVLRPQCAYPATDRPLAAQGRLPADRVREYSFTCALEQRL

SEQ ID NO: 170353 - protein, 97 aa, Triticum aestivum
  Clone ID: PAT_TA_64771.pep
VLAHELVASASSSLAAPLRIICSFVVVVGNTRLGVSPNKLREPLVVLVRLLVLAPIDRHRSSHHMAGGSNATSQACLAAETPQLDEQSPQQSEAHCS

SEQ ID NO: 170354 - protein, 142 aa, Triticum aestivum
  unsure (1)..(142): unsure at all Xaa locations
  Clone ID: PAT_TA_64772.pep
WSPPNVTLRPCAFKAINAIRALLQRACGGPVVYCADIGALAVRDSCHLAGGPRYAVPLGRRDGLTPASLDTILGALTPTTSKVHVLLSFLAKIGLDAYDLVALSGAHTLGIAHCGSFEERLSPKEDPTMNKWVXGHLKLTCP

SEQ ID NO: 170355 - protein, 83 aa, Triticum aestivum
  Clone ID: PAT_TA_64773.pep
PWRSSALARPQMVSRDAGVSPSRRPIGPADLGPWPTWQEWQTTRAPMWAQQTAGPPHALCRSGQRALMALNAHGRSVTFGGKQ

SEQ ID NO: 170356 - protein, 62 aa, Triticum aestivum
  Clone ID: PAT_TA_64774.pep
CSKPRTESSLDVNDVEAEADDEEERGTLLLPGHALSSVNYQMPCLPGLFPGAPHAAMRAGLL

SEQ ID NO: 170357 - protein, 87 aa, Triticum aestivum
  Clone ID: PAT_TA_64775.pep
ASCRMAFLITVRAKKKKKQLERMSITHLSAMRRGRSKFRGNVGVGASRTEREQRSHRRAGSHESRAGRCGGRRGGRHHHHAREVLEA

SEQ ID NO: 170358 - protein, 70 aa, Triticum aestivum
  Clone ID: PAT_TA_64776.pep
VHASAYTVYYCHTVNPTSAYTVTLESVDGAMAPEVMEALAVCHLDTLRRSPKNPIFELHTLKPGDVDVSH

SEQ ID NO: 170359 - protein, 53 aa, Triticum aestivum
  Clone ID: PAT_TA_64777.pep
SSRIHKLQLYSCAINGCTEEVVQYQHTGVHALQADCSQTTPWICLCTYIEKEG

SEQ ID NO: 170360 - protein, 45 aa, Triticum aestivum
  unsure (1)..(45): unsure at all Xaa locations
  Clone ID: PAT_TA_64778.pep
YYVHPKCPRGCXSACRVVSTSPGMWRCADMKFTVDGTCGGPCMKY

SEQ ID NO: 170361 - protein, 62 aa, Triticum aestivum
  unsure (1)..(62): unsure at all Xaa locations
  Clone ID: PAT_TA_64779.pep
LTTAGTNSQDWFSGNFGFGSPGMPANGSTPGRANKSACTLTSFTMASXSSKEYEFASLTQGM

SEQ ID NO: 170362 - protein, 73 aa, Triticum aestivum
  Clone ID: PAT_TA_64780.pep
FHYNITGKLFDNQVSTPGHAIDLQRVRLRKSMSINAPSVVMMAVWYLSRFLLSAAASTVETQRSNAIEGRWKQ

SEQ ID NO: 170363 - protein, 85 aa, Triticum aestivum
  Clone ID: PAT_TA_64781.pep
KLVRLLVPLRHNCRVPRLLLRTRIRVTLQPNPECESCLIPTRACPDRTDLQVIPRGSACDPKSTNLWDPFFCYHLGSCGGTGLFP

SEQ ID NO: 170364 - protein, 83 aa, Triticum aestivum
  Clone ID: PAT_TA_64782.pep
GDHRSSGAAGDYVLLITGGAGGWPCGANIWPTGGIMVLHANLKGADVVMANDKVLALLLSVGEQLNTHDWHTQDEGTTVLSHG

SEQ ID NO: 170365 - protein, 76 aa, Triticum aestivum
  unsure (1)..(76): unsure at all Xaa locations
  Clone ID: PAT_TA_64783.pep
SSVSALRFDLGSGHTKCISDEIKGGSMDHGKYSXGERDPPYPVAQLPEAHRVFLKGAFSYGNRMHYCENVHSAYFC

SEQ ID NO: 170366 - protein, 42 aa, Triticum aestivum
  Clone ID: PAT_TA_64784.pep
QHCRHRTHLLSRASVHVTFMQLIIHPFLSPTQSPDAWAYAWK

SEQ ID NO: 170367 - protein, 95 aa, Triticum aestivum
  Clone ID: PAT_TA_64785.pep
LFLHQKSAAREGDDLPHPVDAADWPGGAVVAQLPDGMAPAGHLCIICRVHEEQTELPARPRSPSGQRTPPVGRTWTMKKLGAAAAQAGEEPVDAR

SEQ ID NO: 170368 - protein, 127 aa, Triticum aestivum
  unsure (1)..(127): unsure at all Xaa locations
  Clone ID: PAT_TA_64786.pep
MGISRDSMHKRRATDGKHTALRKKRKYELGRQPTNTKLSSNMTARRVRVRCGXVKRRALRLDTGDLYXGSEDSTQKTRXLDVXYSSSNNELVRTQTLDKNAIEQVDAXPLKQWDLTHYGVEIGRQKK

SEQ ID NO: 170369 - protein, 104 aa, Triticum aestivum
  unsure (1)..(104): unsure at all Xaa locations
  Clone ID: PAT_TA_64787.pep
PPCRYRRGGPGWTPPAVAWQSADIPIGLLCRKVGGIYTRCPVWQVTLHRKKNLQSYEISAKSXYNFEKPFLYLARKLAGGPNIHLVEAXPLSPREVTFYLGMQK

SEQ ID NO: 170370 - protein, 60 aa, Triticum aestivum
  Clone ID: PAT_TA_64788.pep
NFSIHCLWSPIFCIYQGSIYIAVSESSPRCQTELRASQMASYLSPFRPSKFSFEPTRPRA

SEQ ID NO: 170371 - protein, 108 aa, Triticum aestivum
  Clone ID: PAT_TA_64789.pep
AEMMTLCGHGAVDVELYELHQSDDEVILRNKHLGLPSSGSSSASSCAPASRAQLRPAQHPRVPRGLAHPPGRARRDGRLLRRGHRGAIRQNRRGARGRRHARRGRVGS

SEQ ID NO: 170372 - protein, 100 aa, Triticum aestivum
  Clone ID: PAT_TA_64790.pep
SRGCPCRQVVLLCGPVPVFVLVSSSSSISSTVIMRHFLLGLPSSASSFVLSSPPASRAQLFLARHPRLPRALAPPPGRASRCGRLLSSGRPAGGSNGNCF

SEQ ID NO: 170373 - protein, 129 aa, Triticum aestivum
  Clone ID: PAT_TA_64791.pep
PLLGRANRAGPLCNTPTGEKGIFSQAIKVGQPQGFPGPEVEKPGPCNGIWGPQKKTTVGPAPGRKPGTPKGPPPLLLFVCSVISFQGYFLVFFQGFPSRKAAGFLLFFCFYFCLFSRERTHIDQDTTRA

SEQ ID NO: 170374 - protein, 65 aa, Triticum aestivum
  unsure (1)..(65): unsure at all Xaa locations
  Clone ID: PAT_TA_64792.pep
FSRTRGRTRGIRSSLPCCSPEMTLSYCRSNFDAMPTGFVNLPSLIVKGCMCYFQKKKYKSYXXNT

SEQ ID NO: 170375 - protein, 95 aa, Triticum aestivum
  Clone ID: PAT_TA_64793.pep
ALCPQAILWVLPRGSPSSSWVTDSLQSGLRCSNNKCRWASRTSLIVDPPRDTPSSLCGHIYLRCKDPHLARPAFWSIRVDCLKLPSPFRSAGGQR

SEQ ID NO: 170376 - protein, 73 aa, Triticum aestivum
  Clone ID: PAT_TA_64794.pep
CQGFSRLGKLGNSGQGTQFWFLYYKVILLHARGWKLVFLLTAAPFFFFWFFFFCYFFYFLERENTLTKTGGQR

SEQ ID NO: 170377 - protein, 47 aa, Triticum aestivum
  Clone ID: PAT_TA_64795.pep
HICYGHGIWMEVYTTSTELIDALQRFDWENGVFTEDKKILQDMPLVN

SEQ ID NO: 170378 - protein, 99 aa, Triticum aestivum
  unsure (1)..(99): unsure at all Xaa locations
  Clone ID: PAT_TA_64796.pep
ALQRCRGYYRCTHRXNSKGCAATKQVQRADEDPALFDVIYHGEHTCVHKTVATAAAAMAQPAEENPDARRHLQNLSTSLTVNTEGLTATAGHQGCGTTT

SEQ ID NO: 170379 - protein, 97 aa, Triticum aestivum
  unsure (1)..(97): unsure at all Xaa locations
  Clone ID: PAT_TA_64797.pep
EHIQSILTGCWETCAVSIQEENFYVSRGLDGGLHTSFCQDEXLRTTRAGGATKRVIGSTGPVLDGKAFLMRVIVDHCIVHGYAMGGKTTMTPSVYPM

SEQ ID NO: 170380 - protein, 61 aa, Triticum aestivum
  Clone ID: PAT_TA_64798.pep
SPLVPPLRSLEHSFPSHMLLCLTPSVSRLVGRGGSEIVWETRRGSAGLCRPERVSPPGFSA

SEQ ID NO: 170381 - protein, 51 aa, Triticum aestivum
  Clone ID: PAT_TA_64799.pep
IDLAITGSHAHTESHIGHLGQSIGGYGACKSLAQAPVRDSIRSYARDASIL

SEQ ID NO: 170382 - protein, 85 aa, Triticum aestivum
  unsure (1)..(85): unsure at all Xaa locations
  Clone ID: PAT_TA_64800.pep
AACIRKENLYVSRGLDGGLHTSFCQDEXRTSRAGGVTKRMKGSTRPVLDGKAFLMRVNLNHCIVHGXAMGGKTTMTPKLFPLEAY

SEQ ID NO: 170383 - protein, 55 aa, Triticum aestivum
  Clone ID: PAT_TA_64801.pep
SKLLLVDQSVHVNVANICAIVTYTLSEKEKLPFFFNKKTKNKKKITQHKHLETQN

SEQ ID NO: 170384 - protein, 68 aa, Triticum aestivum
  Clone ID: PAT_TA_64802.pep
VGAFVCHTCPGTKTISTVSTDDSDRHHGGTLSAIDPHECRPMSEWAGYPQRICTLHKQAPEVGFSGGP

SEQ ID NO: 170385 - protein, 94 aa, Triticum aestivum
  Clone ID: PAT_TA_64803.pep
SYCVNQPLVHEFEEYRRCAVFQLTQREGDTHESLSRRGMLQGAYLRPWWMQLIFFWCQDNCVKRNLYPSLSSLQDRYLIYLIAPSDRTSSTETG

SEQ ID NO: 170386 - protein, 99 aa, Triticum aestivum
  Clone ID: PAT_TA_64804.pep
QHQYNSTCVPPTHSSLSQSLIASHCTNSVFIVTAKMLLTPTSSQQGFLGSQPRVPSIRSLRAFCIIMVTHRCSIHIHPYKVVIGYPVGHDICLSHSVVI

SEQ ID NO: 170387 - protein, 53 aa, Triticum aestivum
  Clone ID: PAT_TA_64805.pep
RCEHIQLACFLVSEEPTVNSRFQDQHQDAGQPPGDANHTRDTSGFASGSLRSS

SEQ ID NO: 170388 - protein, 59 aa, Triticum aestivum
  Clone ID: PAT_TA_64806.pep
LLRVLPSRTPTCASANAGHASTYFASGLQEVARIMLTLNALDVPAKNLNLRILEEPTVW

SEQ ID NO: 170389 - protein, 61 aa, Triticum aestivum
  Clone ID: PAT_TA_64807.pep
RPLRVDRRTGLAMAFRSMSLALFALHLVICWLTLMSSHNTKWDFYGLHRPSCFWDGVHHER

SEQ ID NO: 170390 - protein, 134 aa, Triticum aestivum
  Clone ID: PAT_TA_64808.pep
YASAHASAHASAHASGQVVELSGENINITYKHDGTHIAVGNKEDELTIVDVRKLKPVHKQKFPYEINEIAWNKTGDLFFITTGLGFVEVVNYPSLDVVCKLNAHTAGCYCIAMDPLDRYFAVGSADSLGSLWKC

SEQ ID NO: 170391 - protein, 65 aa, Triticum aestivum
  Clone ID: PAT_TA_64809.pep
KGVQLIRFRGHYSKAFVLQAGVGELGSFKTAPPSFLCSFFFSFSLFSFICFLIYHGFFLFFFFLN

SEQ ID NO: 170392 - protein, 42 aa, Triticum aestivum
  Clone ID: PAT_TA_64810.pep
PLRVPRLCSRPDPRVLFQACGSRVDDGLGQDRDPWCITLMSS

SEQ ID NO: 170393 - protein, 48 aa, Triticum aestivum
  Clone ID: PAT_TA_64811.pep
IKKAFIHVRELLKAEFPPPASDSCIFVTAARINHIMLTRWVVHDKKPS

SEQ ID NO: 170394 - protein, 46 aa, Triticum aestivum
  Clone ID: PAT_TA_64812.pep
SLSWVIPSVLSNGVLVLSSMAAAQSAGCPVVSKCMGGPTQAFRPGP

SEQ ID NO: 170395 - protein, 44 aa, Triticum aestivum
  Clone ID: PAT_TA_64813.pep
SLCDSLLATVVVKCKPISSIQYCCCGHHSEDVIKYLLLKEPCDV

SEQ ID NO: 170396 - protein, 53 aa, Triticum aestivum
  Clone ID: PAT_TA_64814.pep
LASLVRVGHALFVGVIAWFGATESRGSANGYPEWIPGSRSVAWRRKRVGGSRK

SEQ ID NO: 170397 - protein, 53 aa, Triticum aestivum
  unsure (1)..(53): unsure at all Xaa locations
  Clone ID: PAT_TA_64815.pep
MADDDYNEVDMGYXDEPTEADIEEGAEEDPENNEDAPDDVGGGEGQEKEQRKT

SEQ ID NO: 170398 - protein, 55 aa, Triticum aestivum
  Clone ID: PAT_TA_64816.pep
INTANLINLGYPKKELFLSLDEHQNFDSLKQPPPKCVLWVFLSVFFLKALHRHLG

SEQ ID NO: 170399 - protein, 67 aa, Triticum aestivum
  Clone ID: PAT_TA_64817.pep
IVMAAMSINDHVLLHILITMAVPDDLIDAGPYTPGPDVGDALTHAYTPTEKDVEPVSVKHQAYTAAY

SEQ ID NO: 170400 - protein, 78 aa, Triticum aestivum
  Clone ID: PAT_TA_64818.pep
RLIAAKNINEHVLLQILIPMAVLDALTKAGRNSWGEDLGHAITTAYTPIYETIEYMSVKTEHSALDTMNRIKSALEGW

SEQ ID NO: 170401 - protein, 61 aa, Triticum aestivum
  Clone ID: PAT_TA_64819.pep
IFHSYIFITPSIVGIDKAITGAHAHAHTHKDTMGRAWESERANRTHTHKQTCLTPSDHTQA

SEQ ID NO: 170402 - protein, 51 aa, Triticum aestivum
  Clone ID: PAT_TA_64820.pep
SSMILLSNLTAGRPSVETVASFSMIFWRILTDYYFSGIDVVHSTQSNIPFP

SEQ ID NO: 170403 - protein, 59 aa, Triticum aestivum
  Clone ID: PAT_TA_64821.pep
PAGFLVDPRVRLFCARMANAPCLLFPSIYCLIVKKPKKARSCEAPSQNKAPISSFKYTA

SEQ ID NO: 170404 - protein, 112 aa, Triticum aestivum
  unsure (1)..(112): unsure at all Xaa locations
  Clone ID: PAT_TA_64822.pep
MNPEYDHLYKRLLIGDSGVGKSCLLLRFADDTYTESYISTIGVDFKIRTIQLDGKTIKLQIWDTAGQERFRTITSSYYRGANGIIVVYDVTDQVSFNNVKQWLQEXIDRYAC

SEQ ID NO: 170405 - protein, 131 aa, Triticum aestivum
  unsure (1)..(131): unsure at all Xaa locations
  Clone ID: PAT_TA_64823.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHILLTGPNSIVGRAVVXHRDPDDLGKGGHE

SEQ ID NO: 170406 - protein, 79 aa, Triticum aestivum
  Clone ID: PAT_TA_64824.pep
SSGNVTHGHSHCQEGTCVAAHTFTHRQIRSTYDKMSTCIYGSVHVYYTSGLLPFAPHASSTHPGAGTRGGQMLGGWVDL

SEQ ID NO: 170407 - protein, 60 aa, Triticum aestivum
  Clone ID: PAT_TA_64825.pep
SGTNSRSRPYLVVNLVGRITTALHILLVGEALCSFNTFLYCFTELLLSPVRMRKILKHQR

SEQ ID NO: 170408 - protein, 79 aa, Triticum aestivum
  Clone ID: PAT_TA_64826.pep
MMLDKLWDDVVVGPRPETGLDKLRRAVVTQPLAINTVAGEAIKAVSVDAYDPDHVGDAVFRYAVVWWKLCGGAFFTPGA

SEQ ID NO: 170409 - protein, 57 aa, Triticum aestivum
  Clone ID: PAT_TA_64827.pep
LRRRGQGVGILVSKHPKDTSASFSLQEPAEVMEFLLRLVEWKQLSRARLRLRRQADA

SEQ ID NO: 170410 - protein, 43 aa, Triticum aestivum
  Clone ID: PAT_TA_64828.pep
KGPPFNLRGFVSEINSGIQVFFSNFCLFLQFFLFKFICTNYFY

SEQ ID NO: 170411 - protein, 57 aa, Triticum aestivum
  Clone ID: PAT_TA_64829.pep
SFLFYHRNIRKACGDALAALSFSYVVLLSGTRAMLWRRRSRTKLNFVCSLQQKLICK

SEQ ID NO: 170412 - protein, 71 aa, Triticum aestivum
  Clone ID: PAT_TA_64830.pep
GTTHTGQLSPRNNYFGAQIQKSRSPLGAYHRCNHREIHKPEGINTQVSHPHLGGAPTAPLGRSGARPRDPK

SEQ ID NO: 170413 - protein, 47 aa, Triticum aestivum
  Clone ID: PAT_TA_64831.pep
IKVYTLYSQATKLKYSNALDRRTGYLATKTTEELSKMIINTQVFKTS

SEQ ID NO: 170414 - protein, 62 aa, Triticum aestivum
  Clone ID: PAT_TA_64832.pep
HGWHGLRGRWTSSRACLWRVSCRPSCCHGVPDRARLRLLLLRPCPCARSYLGFFFGSSRVHT

SEQ ID NO: 170415 - protein, 38 aa, Triticum aestivum
  Clone ID: PAT_TA_64833.pep
PHTLPNVLILSRWYFLYFHGVLLSSSQKHPFVCCNPYT

SEQ ID NO: 170416 - protein, 80 aa, Triticum aestivum
  Clone ID: PAT_TA_64834.pep
YPTKHLITDRGGFYYTRGVYTAQAQCEAKDQPYQESQGLDGPHAKLRRRFRPSFIKQITGISSFKSRTLKSFTTQHGLPL

SEQ ID NO: 170417 - protein, 58 aa, Triticum aestivum
  Clone ID: PAT_TA_64835.pep
VNNIHQHFENNKAGYAENNKNNAALIHTDTAEYIAIIKAKKWQELLKGEDIYTNYPAT

SEQ ID NO: 170418 - protein, 45 aa, Triticum aestivum
  Clone ID: PAT_TA_64836.pep
WNNAFSSLSRFVASYYYNCLDWGTAPLYMPIRWPVHQISRSEHHT

SEQ ID NO: 170419 - protein, 84 aa, Triticum aestivum
  Clone ID: PAT_TA_64837.pep
PFLSPTRPPTRPAVWFCCAAVMETEGFNYLEETCPSLLSDLLATVAVVDDDPSSVNRKRGVCINEDVNPVESVEASDRRTRRRV

SEQ ID NO: 170420 - protein, 65 aa, Triticum aestivum
  Clone ID: PAT_TA_64838.pep
SCSGSGSASKDGGGRWARRAQKREAADKAAAEKHLKLLQRLGRGKTPEAPPEALESLEVGPPVIE

SEQ ID NO: 170421 - protein, 138 aa, Triticum aestivum
  Clone ID: PAT_TA_64839.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQADAAPFKQWYLTHYGVEIGRKKKAAAAAKKEPAE

SEQ ID NO: 170422 - protein, 159 aa, Triticum aestivum
  unsure (1)..(159): unsure at all Xaa locations
  Clone ID: PAT_TA_64840.pep
MSWTSSKPKRGGGLRGPRPQPLSLSARPSKKPRVGGHAGPAAGPVIVYERTPTVVHADPHEFMAVVQRLTGNCKQRPSTAAMTLPPEATSGSGARDGRASTWTAADALVLRLGQQQRAPCGAHHPAPSASPAAASSPLLSSSSFFXSPTTMQAIRELIS

SEQ ID NO: 170423 - protein, 120 aa, Triticum aestivum
  Clone ID: PAT_TA_64841.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYRGQRGGGGGYRGGGGGYRGQGGGG

SEQ ID NO: 170424 - protein, 55 aa, Triticum aestivum
  Clone ID: PAT_TA_64842.pep
LMSRLRWRQDRETANRNQKVGSMIQHHHLSPWEEILLLCLFNHPSPTIGRVGGRE

SEQ ID NO: 170425 - protein, 175 aa, Triticum aestivum
  unsure (1)..(175): unsure at all Xaa locations
  Clone ID: PAT_TA_64843.pep
MRPPTRPVYFGAWCALNVIFNIYNKKVLNAFPYPWLTSTLSLAAGSAIMLVSWATRIAEAPQTDLDFWKALSPVAIAHTIGHVAATVSMAKVAVSFTHIIKSAEPAFSVFVSRFFLGEHFPLPVYFSLLPIIGGCALAAVTELNFNMIGFMGAMISNLAFVFRNIFSKXGMKGKS

SEQ ID NO: 170426 - protein, 60 aa, Triticum aestivum
  Clone ID: PAT_TA_64844.pep
STPYASKHLTLHKLLGTHRQYHCTWITLPIFPTESKLSVSNIPSYVSMYSNLSPSNYFAK

SEQ ID NO: 170427 - protein, 87 aa, Triticum aestivum
  unsure (1)..(87): unsure at all Xaa locations
  Clone ID: PAT_TA_64845.pep
LTRGAKIQEGEGIFPDQERLIFAIQHFEDGRTLAEYNIQKEITLHSVLRLRGGMQISVKTLTENSITLXVEASHTIHNANAKIQYKE

SEQ ID NO: 170428 - protein, 109 aa, Triticum aestivum
  unsure (1)..(109): unsure at all Xaa locations
  Clone ID: PAT_TA_64846.pep
VPEAILHGMXVEDRGVYHRLLKLARFVPQTILHGTDLEEHVVHRLLGRPSRQGEPNRTPSEYKTSIKPRITRKTSIYRLLSPLASLTLLSSCSTSPFSGTLFLLRGSRT

SEQ ID NO: 170429 - protein, 149 aa, Triticum aestivum
  unsure (1)..(149): unsure at all Xaa locations
  Clone ID: PAT_TA_64847.pep
FVYASGFIQTSNXITIGGCISPISTYGGTHYDIDILVWKDRAGGNWWLQVGGDYVGYWPSSILSYLEDSASTIMWGGEVFSPDAGQTSTHMGSGHFPNEGFGKASHIKNIQVVDSTNCLNPPSNAGLITEQNNYYNVQSDTYGDWSTYI

SEQ ID NO: 170430 - protein, 81 aa, Triticum aestivum
  Clone ID: PAT_TA_64848.pep
ATQVPVLRPRGLGFHPRCDVHRPIHSVTSVRLSSLIRPSRNAHRSRMCPIFLSIPTRGLVKTQPPECVIPLSSLHSCSCNR

SEQ ID NO: 170431 - protein, 107 aa, Triticum aestivum
  unsure (1)..(107): unsure at all Xaa locations
  Clone ID: PAT_TA_64849.pep
MGCWWERLVLPVRRAWLGVASRFGVRQSGKAARRXLTVQPHAAEASLVGPPSPGLTPASLVAFLVAGLWRLRQEVSTCEYEDVRVMWEMLSRPRRRRRRRRPGATAG

SEQ ID NO: 170432 - protein, 73 aa, Triticum aestivum
  Clone ID: PAT_TA_64850.pep
LFIFFFFFFFFFFFFFFFLCTILHYVMPIPALKIREQGQRKENSPPKKKTNYRNHMYTSSVIAPSSCAIAILE

SEQ ID NO: 170433 - protein, 153 aa, Triticum aestivum
  unsure (1)..(153): unsure at all Xaa locations
  Clone ID: PAT_TA_64851.pep
RFAFCLLWIAAVFQSLLYEVAGRTINPVSGAVGLLWAGSWHLCEAAVQTVLRGGAIRPLPELAGGVPEGGVGGSDLFASSSRRAVVGCSTYSAAKRVTPRKTWAPEAASHHQEPSCDLXLFLTPGSAAAAEGERLARRARTPSMSSDGSVTTS

SEQ ID NO: 170434 - protein, 160 aa, Triticum aestivum
  unsure (1)..(160): unsure at all Xaa locations
  Clone ID: PAT_TA_64852.pep
ALPKLLLLLFVGGALSLTFFSGSEAGEVGVCYGMMGDNLPQPPAVVQLLKQHGITMVRLYDADAGGLRALANTGIKVXVSLPNDNIPDAASSMSYAVRWVQSNVQAYPGTWIDSVAVGNEVFHQAPWLTHQLLPAMKNIQAALAGARLGDAVKVVTPIAL

SEQ ID NO: 170435 - protein, 97 aa, Triticum aestivum
  unsure (1)..(97): unsure at all Xaa locations
  Clone ID: PAT_TA_64853.pep
LTLSRTRGPTRGGLDWDCLVDNKTAASNKENSCKGERQAQWATVQITLHELQAPEPVSHTLENDKSSYRELSEIDEQAQRXAVMARLLEVNTLNGHV

SEQ ID NO: 170436 - protein, 55 aa, Triticum aestivum
  Clone ID: PAT_TA_64854.pep
TCCSRGRTMHFDIERALTARWDHLRQSTTLKLLQVLRQLSIHTQHLMVTSDLLQV

SEQ ID NO: 170437 - protein, 68 aa, Triticum aestivum
  Clone ID: PAT_TA_64855.pep
LLFFTLNPSFVSVNSFQYIFLVLFIVLVFSCFFFGDYFFDNFVRSAQPTRAILCNCLTLARLQCKTNR

SEQ ID NO: 170438 - protein, 145 aa, Triticum aestivum
  unsure (1)..(145): unsure at all Xaa locations
  Clone ID: PAT_TA_64856.pep
GLLSATSLLQERQSLPQRPSLLLAPSQQNQSFQSKESLSEQQRSSQSTMLPLQHHQDLRQHQQQLRLQLREELSHQEQNSQSAVHXPQQRRCLRRQHPDSQPANLHQHQSSQPALSPWQQHKSSQPAMSLSQRHQSLQSSQYVLP

SEQ ID NO: 170439 - protein, 72 aa, Triticum aestivum
  Clone ID: PAT_TA_64857.pep
TFRSSDLRGAPGGGCTHACLGYSRAGDLTVVQHQGHGRNREPRRAGQLARDPSLRYVAQSRNLALRQGLTQL

SEQ ID NO: 170440 - protein, 98 aa, Triticum aestivum
  Clone ID: PAT_TA_64858.pep
SWCAGRYRTPIPTHTHAFDQTPSARPQGEIETNPGLGTHKPTTGHPRQQSSDCRKDNTMTGMASVSQMLACPPHIKAGTSAARSPREAAQQRPDQQWH

SEQ ID NO: 170441 - protein, 62 aa, Triticum aestivum
  Clone ID: PAT_TA_64859.pep
LIVTVFPSVCPPVLSNVYFLFGFGSSATTVSASPPPSSRARARSVSVGLHELDPDRTRTSFP

SEQ ID NO: 170442 - protein, 130 aa, Triticum aestivum
  Clone ID: PAT_TA_64860.pep
LFTMAIQSITPMCLNPSYWQHMPLILSDMMIESYPGHDPANSRNPNINSRNLGHMWKPQSSHMPGVGHNQVRGTGVWSPPSSAGPSSDQIEESAMYGRAAIEASMTPISNLVLNESMIVPDRVCYSSYQP

SEQ ID NO: 170443 - protein, 60 aa, Triticum aestivum
  Clone ID: PAT_TA_64861.pep
TLIAYAHASAHAGACVHKDLHRERHPSTLISQSVCPGTSNEPHIHEQLERNKSLWSLCAC

SEQ ID NO: 170444 - protein, 59 aa, Triticum aestivum
  Clone ID: PAT_TA_64862.pep
QKTAPPVNLCLWRPPCPLALLSASPSASHSLPRVWSWSSFRRSRLCPGPLVQMASPDTK

SEQ ID NO: 170445 - protein, 73 aa, Triticum aestivum
  Clone ID: PAT_TA_64863.pep
MQASQLAEARRNATRLRREVERHIRANVALAVPTTRAKVHAAMDRALALDCIYPMPMLRDMPEKIPKAVEPTH

SEQ ID NO: 170446 - protein, 69 aa, Triticum aestivum
  Clone ID: PAT_TA_64864.pep
NRSIYHKDEHEQFEINVLSCLEKLFMYSSCYENLCMYSNCLEVVMYNLSFARSKKHSVLKKRKRKKKDK

SEQ ID NO: 170447 - protein, 107 aa, Triticum aestivum
  Clone ID: PAT_TA_64865.pep
RNITSSTYRQPDAYSCAFFRSWRRQTPLRCRDEHRLQYSIAGSVSDALPAVGAESSVDPDKCQEQPGGAGSHHTLSSSANVLTRHIVGLSCTLRMVDLNVVETRSVG

SEQ ID NO: 170448 - protein, 130 aa, Triticum aestivum
  Clone ID: PAT_TA_64866.pep
IFRRVQTSSNYIKTCGSPHRFDGPLGPPACFSSGACIFLFQAYPWLRGLPSSKWFMHPEHNRRYVPSTHCPADSNFASSSCSSPGSRDPSRWWSRIPLPTYFALAANFTDVTLLVPCPSGSAFRRPNSDG

SEQ ID NO: 170449 - protein, 47 aa, Triticum aestivum
  Clone ID: PAT_TA_64867.pep
MGHFKNRYMVMEVFIDASRGEADPVILTQFNITKVIRDSIQLNSGEC

SEQ ID NO: 170450 - protein, 78 aa, Triticum aestivum
  Clone ID: PAT_TA_64868.pep
MHFSQHPCVTRLKSSPVFPMSLSAIHNIISVPTSIGTSLGPPLVSWPHPQRNTGPDGPSFDQLGDHDRGRDTPNQHRC

SEQ ID NO: 170451 - protein, 91 aa, Triticum aestivum
  Clone ID: PAT_TA_64869.pep
MADVEYRCFVGGLDWATDDQSLQNAFYKYGDMIDSKIITDRETGRSRGFGFVTFASDEVMRQAIEAMNGQDLDGRNITVNEDHSRRSGGGG

SEQ ID NO: 170452 - protein, 74 aa, Triticum aestivum
  Clone ID: PAT_TA_64870.pep
FNFSFPIKKLLLCLPRVVNFDPLKGPPPFFFFFFLFFIFFFFFFFFFFFFFFKSTDALADALADALTDAWSNAR

SEQ ID NO: 170453 - protein, 59 aa, Triticum aestivum
  Clone ID: PAT_TA_64871.pep
MLCNPGQGKFEPSKRPPPFFIFSILIFIFFFCFYYFYIFFLFFFFILLFFFILFFFFFF

SEQ ID NO: 170454 - protein, 168 aa, Triticum aestivum
  Clone ID: PAT_TA_64872.pep
RCRVGAGGLDLLALVSLYDDAHRHTQQNASYNPWEQPAPASSAPMMQQQYQQQPMHNPLYASAQQQQAFMLQQQQAFVLQQQQQYQQMMMMGAPSLHRQASSNPSLHRQASSNPSLHRQASSNPSFHRQASSNPFDRSYVPAAAAAVVATLMLRRCSSTPATPIPEPA

SEQ ID NO: 170455 - protein, 133 aa, Triticum aestivum
  Clone ID: PAT_TA_64873.pep
KLPKSPRAASPPKPHGLGTPTPNPPPPLNNLKTGKTPRCPKKKPLPTKPPLTTGAKYPKGPKKTPLHKIPKTNWAKETPPKPRPNFQNFGPFPPPPNPHNCPAPNPPPSLHPPLNPPSPLSPKPPKGAPLGPP

SEQ ID NO: 170456 - protein, 75 aa, Triticum aestivum
  unsure (1)..(75): unsure at all Xaa locations
  Clone ID: PAT_TA_64874.pep
MSCNCGSGCSCGSNCKCGKMYPDLTEQGSAAVQVAAMVVLGVAPENKAGQFXVADGQSGXGCNCCDNCKCNPCNC

SEQ ID NO: 170457 - protein, 83 aa, Triticum aestivum
  Clone ID: PAT_TA_64875.pep
MAVLKKNYGEAKKDYTETGLAVYGDQAAGLYALQLNSLSSLPMTLKNALLLALLETVVALGGTLLTPAQVAPLLPFTVYPTGA

SEQ ID NO: 170458 - protein, 68 aa, Triticum aestivum
  Clone ID: PAT_TA_64876.pep
GTPLTHPVLPRHYPFCGAPEVQCIAGVSHGRDGKNPGLHQVNALHWTPLFTGRDYRNGARPNPLSQQG

SEQ ID NO: 170459 - protein, 56 aa, Triticum aestivum
  Clone ID: PAT_TA_64877.pep
HLSSFVHPANGGGQFISSLVIISFAVYTMAPGSHVKVCVGRTLSHRDQRTASSELT

SEQ ID NO: 170460 - protein, 47 aa, Triticum aestivum
  Clone ID: PAT_TA_64878.pep
MDQESWKEAMDTDEHTPQVPIMCINNCGYFRNPMTENMRSMCYRDTV

SEQ ID NO: 170461 - protein, 30 aa, Triticum aestivum
  Clone ID: PAT_TA_64879.pep
MDSSRHQQWHRTAIIMPVVRTLTDPCQPTA

SEQ ID NO: 170462 - protein, 68 aa, Triticum aestivum
  Clone ID: PAT_TA_64880.pep
MSDLDVQVPTAFDPFSEANAEDSGPGAGSKNYVHVRVQQRNGRKSLTTVQGLKKDYRYNKILKDLKKE

SEQ ID NO: 170463 - protein, 77 aa, Triticum aestivum
  Clone ID: PAT_TA_64881.pep
LSFLFWVSPGFFLNAYRRTAPFVVHRKVYQEHPLRRNAPHINECSKKRPTLGLFGLLTTPGQNTNHPQLDSVLSRHK

SEQ ID NO: 170464 - protein, 56 aa, Triticum aestivum
  Clone ID: PAT_TA_64882.pep
MGQLRPAAGGGGDCLIKLFGKTIPVPDAGAGANAGDVDKDLQHRGGSTTAELKVQE

SEQ ID NO: 170465 - protein, 90 aa, Triticum aestivum
  Clone ID: PAT_TA_64883.pep
GQQDFSYFISPTEYRVGLLYLHTHAWPHVAHWAHTRSPLSIYFTFQVHRYSCIRCDICLPLSASVFIPTACLRVALTEHRIILPGRGFRS

SEQ ID NO: 170466 - protein, 36 aa, Triticum aestivum
  Clone ID: PAT_TA_64884.pep
FSFLFDFFFLIFFFFFLFFFFFFFFFFLKFTKNLLL

SEQ ID NO: 170467 - protein, 57 aa, Triticum aestivum
  Clone ID: PAT_TA_64885.pep
RIPLIRLEQGARSYVNRGIMSRGAFAVIYGLHLKYYIKDPEVILGRETEDVKVDIDL

SEQ ID NO: 170468 - protein, 47 aa, Triticum aestivum
  Clone ID: PAT_TA_64886.pep
CSSPHINFAFTIKQHSGIMHRGEILGPHGRPSPTVACLLISTLISFQ

SEQ ID NO: 170469 - protein, 76 aa, Triticum aestivum
  Clone ID: PAT_TA_64887.pep
LAPPRTAGALPSCGASPLPLPLLFKPSEGCTPPLLLSTYYSTHTTTCEAIGLPPYWSAFSHDRLDSPPSQLARALL

SEQ ID NO: 170470 - protein, 63 aa, Triticum aestivum
  Clone ID: PAT_TA_64888.pep
LYPTKGVGRLRQQDGGHGKSKSDGEGRYNGSDVSTSPQKGWSCSVGPTQGNLGECHDKMSKRK

SEQ ID NO: 170471 - protein, 49 aa, Triticum aestivum
  Clone ID: PAT_TA_64889.pep
NKVKPIRINQQKECTNPPIHPSILIKKSPSPTLSISHIFLSYSINTPSL

SEQ ID NO: 170472 - protein, 80 aa, Triticum aestivum
  Clone ID: PAT_TA_64890.pep
GSCGRAPGRRGGVLLLRFGFWFAPRSVRERGRVARIEKGFGREEGRSMADTENRWFVGGLGWHHLLHHPPAGFFLSSARP

SEQ ID NO: 170473 - protein, 98 aa, Triticum aestivum
  unsure (1)..(98): unsure at all Xaa locations
  Clone ID: PAT_TA_64891.pep
RRVILSGAHSIRGGHXSSLMVGLTAPSEQIHPAYRNLFNHKCHSGDEPRRNDNVRDGDYXTVYKFMPGVTTRGPKISDFLCNAXYHNNLSRQRGLKLR

SEQ ID NO: 170474 - protein, 83 aa, Triticum aestivum
  unsure (1)..(83): unsure at all Xaa locations
  Clone ID: PAT_TA_64892.pep
RYYSIALARSPNRDAYLRLLGFITRSSTRSRSGLYWPVWTSDRTPXTTSKSCLHIARFQGLGLEERLVDSQEEEEAARARKGG

SEQ ID NO: 170475 - protein, 124 aa, Triticum aestivum
  Clone ID: PAT_TA_64893.pep
GEVSVRLPHVHGSSADGAAAREEAPGAGARHGRPTRPNAHLRNNHVLARRHVTRRAAHGQTNQAGRKTQLRARVTFPEARKLRVSFQRQAPASRRTGTGSWPSGGARVRSCPVRVCVCGSPRVR

SEQ ID NO: 170476 - protein, 52 aa, Triticum aestivum
  Clone ID: PAT_TA_64894.pep
FKTSLQILKECENGHVGPNGDGLCVGQTGRAEPLKRGKGVKEICGNHLDANK

SEQ ID NO: 170477 - protein, 44 aa, Triticum aestivum
  Clone ID: PAT_TA_64895.pep
AVSWGAIRCSCGARAYSGVLRAALRPSFCSMFVTGLLRGRGQAQ

SEQ ID NO: 170478 - protein, 64 aa, Triticum aestivum
  Clone ID: PAT_TA_64896.pep
CSTIDCSRAFSFFQRNQFGALFLLLIYTSPPYPCMSNRHKRSDVRWNMPQMTPRNITLVILRSI

SEQ ID NO: 170479 - protein, 106 aa, Triticum aestivum
  Clone ID: PAT_TA_64897.pep
SFRFLLRVSCSLCFQALACSTHCLGFSRITLLSRTVPLFCWLSSAALSAPVAPFPVGVPPFGLPAGIPALGVLASAFSCRSTNHTFSLSSPSCHTFSRRCQRMRVG

SEQ ID NO: 170480 - protein, 62 aa, Triticum aestivum
  Clone ID: PAT_TA_64898.pep
GCPFIIVLQMTELRQSYIVQGKTNEFLILANHTTVSAGCTTTLLEVAALDRNLPKGMANSHR

SEQ ID NO: 170481 - protein, 88 aa, Triticum aestivum
  Clone ID: PAT_TA_64899.pep
MSCNCGSGCSCGSDCKCGKMYPDLTEQGSAAAQVAAVVVLGVAPENKAGQFEVAAGQSGEGCSCGDNCKCNPCNSGGGCTTSCLREKV

SEQ ID NO: 170482 - protein, 64 aa, Triticum aestivum
  Clone ID: PAT_TA_64900.pep
ILRAYPYTCVEGKIKNRFFLRFQQDQTDTSKKKSMARETHERKGGRPFKRPQANPRDQAELIAL

SEQ ID NO: 170483 - protein, 139 aa, Triticum aestivum
  Clone ID: PAT_TA_64901.pep
AFQASTPRVTSGLSWELHAISKQWRPALCPFREKCAFATSQQISWPALDVLFMCRQQHMLPASTWMAFMCPALRAGTCNSVHGIAVSQLGRIAFPTVFKYGVHMIEPSSAPFCMSYEFTKQVTHSLIPNPQYSGTFNCS

SEQ ID NO: 170484 - protein, 132 aa, Triticum aestivum
  unsure (1)..(132): unsure at all Xaa locations
  Clone ID: PAT_TA_64902.pep
FFSTTELVGTPGYIPPDFGHGWVATLRGDMYSLGMVLLELLTGRRPVLVLFLSKELSEXVQEMKSEGRQIEVLDTTLRSTGYEEQMLNVLEATRKCVHYNPLLRPTIQEIVFFSESLDAKLETRNSVQIERG

SEQ ID NO: 170485 - protein, 114 aa, Triticum aestivum
  Clone ID: PAT_TA_64903.pep
MSGRKKTREPKEENVTLGPADREGEHVFGVAHIFASINDTFIHVTDLPGRETLDRNTGGMKDKADRDESSPNAAMLATQDAAVRRKELGITALHIKLRATGGNKTKTPGPGAQA

SEQ ID NO: 170486 - protein, 101 aa, Triticum aestivum
  Clone ID: PAT_TA_64904.pep
LPCFQPGRFLQMVFYPPLMPCVSATCAAYIGIHAFLTIEFSVLEGINYRKYSALIQRKKGEEREQADLYTPSTPSKRICTHPRLQASGSVHLTHDLTFCGK

SEQ ID NO: 170487 - protein, 62 aa, Triticum aestivum
  Clone ID: PAT_TA_64905.pep
FCSAHGTAAAPLNQEPTDAGVDAGRAFRGVRKRSWGKYAAEIRDSTRNGVRVWLGTFESPEA

SEQ ID NO: 170488 - protein, 138 aa, Triticum aestivum
  Clone ID: PAT_TA_64906.pep
WECFPLRGPFAFRHGVFWVGSSLGGLFLLLPGGLCRLFWLLLCFVRASLAACATLGDCREQSRRGSSRVSASKVSPPVADAGLLCRGMCRFCVFAGSCKPWSTFGVRAAQVPPLALTVLGSEGYGIMGGCMHSGWWEG

SEQ ID NO: 170489 - protein, 68 aa, Triticum aestivum
  Clone ID: PAT_TA_64907.pep
IIFYFYLIFFFFYFFFRGNRRHKASYRIVCEVGSSNQDAGSSIWRRIWYRALRYPLCCSSSGSLSMPK

SEQ ID NO: 170490 - protein, 104 aa, Triticum aestivum
  Clone ID: PAT_TA_64908.pep
TIRGFLQHLTGGKPMPSAEIRVACRAEKADGHGRRQPGDDGQRAEGEPVRAGAQGAWPGRHEELHGPNDISLKPQLRRRGGQGRRPLVRLRANHAPGLLPLQAP

SEQ ID NO: 170491 - protein, 139 aa, Triticum aestivum
  unsure (1)..(139): unsure at all Xaa locations
  Clone ID: PAT_TA_64909.pep
LFPQRLEGIDGSFLYAFHNIALHDVNMRALDGLMGPVYAGTGXASPCLHSYGFDPPRSTEHGGCCSSCFLKKRTIKSTVSSGTFEEXRSLCMANFDDEEMNMSTFSKRFGYSNYLINSISNAVSKGARLMSPWVKKGVH

SEQ ID NO: 170492 - protein, 34 aa, Triticum aestivum
  Clone ID: PAT_TA_64910.pep
LSHRLSEVIRYIKNQKYIKKRKHNKRKKKRPTPM

SEQ ID NO: 170493 - protein, 123 aa, Triticum aestivum
  unsure (1)..(123): unsure at all Xaa locations
  Clone ID: PAT_TA_64911.pep
LNPGKGAAMIRGLFQDCLGWGRDALALRAPTGAKPAPEKLSQAHDRRVRGCQHGDAHEDALQADCPGAXSEETEMALRSETGLCMLRRGKEHCQRPNGRRDGTMSNTYEPVKVLGPPTANLSD

SEQ ID NO: 170494 - protein, 111 aa, Triticum aestivum
  unsure (1)..(111): unsure at all Xaa locations
  Clone ID: PAT_TA_64912.pep
RDTRRERRILRQFCGAARDPHGAHGHPAGRRVRDSRPRRLMDDARAKAXDRASTLPAAGXKKAPARAYKGNDRDTGSHRGIDSRCSGRHEVTSSKLRADHHHGTGGTLAPP

SEQ ID NO: 170495 - protein, 122 aa, Triticum aestivum
  Clone ID: PAT_TA_64913.pep
PLKEKKLKCKEDSTIDRFEMRGDIWARRRTCLRDNSAFHLIQWRRTAGLRRVQVQQPREASSQNDSNTLLKELYVTMKSLLEELKVNTKAATESCQLIAKSCQEVIEACKISATSTGTRIVN

SEQ ID NO: 170496 - protein, 91 aa, Triticum aestivum
  Clone ID: PAT_TA_64914.pep
PFGQCICFRGRYVRAFSLHARVGKVGSSTRPFILVFSEFLQLRSCSSLPTSFHFVYILKQQQASQLVTSCMALQADRPVLRAPRCILFFFR

SEQ ID NO: 170497 - protein, 100 aa, Triticum aestivum
  Clone ID: PAT_TA_64915.pep
AGTPVGIWSGISGLTLRVCFRVCPRVRLRVRPRVRPRVRPRVRFFFFFFFFFFFFFFFLDWNYFDPEALNRGPTLHVSVLVRMFTLSFSFMQNFFELIDW

SEQ ID NO: 170498 - protein, 102 aa, Triticum aestivum
  Clone ID: PAT_TA_64916.pep
LKGTAAICQAAPKEGTGLQAKNTSAHLAQILRGGGHPNAQQAAQAGGGNQRKNRDDRPGGTTEELERCDAHVQREVACDRPYAGNGSAKTGRRSLDATHHQD

SEQ ID NO: 170499 - protein, 58 aa, Triticum aestivum
  Clone ID: PAT_TA_64917.pep
IDFLSLSKRSNLRPIVRDVILHRVNLSPLLRTVQYDYAPLVSTNHSTKAPSFLVFLGV

SEQ ID NO: 170500 - protein, 77 aa, Triticum aestivum
  unsure (1)..(77): unsure at all Xaa locations
  Clone ID: PAT_TA_64918.pep
FGGSSALSGPGKGGKGPGKGGIELHRQVAXDNIHSITKXLIRPLARRGGTDRASAGXIYEETRRALKICLKNVIRDG

SEQ ID NO: 170501 - protein, 118 aa, Triticum aestivum
  Clone ID: PAT_TA_64919.pep
MDLDDDMVPYSPSGDSSPSSSDLDTESTGSFFPDRSTTLGTLMGVSTFGGAGVQRRLTRAAPGQESERPTRAATEERDGRRAGGWRRRRRLRCGSWWRLCRDDASGPSTRLGEFLDME

SEQ ID NO: 170502 - protein, 96 aa, Triticum aestivum
  Clone ID: PAT_TA_64920.pep
FRDPPTPVRLVLLQLHHTTVLRYAALALPAPYCSQGAWAPVADSDRTEPFVRAQDAGRRCRLISGSQTRLAPAGGGGGVIDLGGGKARAWACLTYC

SEQ ID NO: 170503 - protein, 131 aa, Triticum aestivum
  Clone ID: PAT_TA_64921.pep
FCGHWCHAACGLERNLIRPGPTLKGPIGTTEMQFQCLGCSHSSEMFGFVKEVFNCCAENWNAETLMKELDVVSKSKGILAANQASQSTIPLLSPAISPPKSFNFNASTSILDSQIDALKTSPKSLSIEPCF

SEQ ID NO: 170504 - protein, 58 aa, Triticum aestivum
  Clone ID: PAT_TA_64922.pep
LDCSAMRTSMTLDICFCRFQNVSKIAGKLITPSVEDGLWKMDIAPQVISLCPRLITDY

SEQ ID NO: 170505 - protein, 96 aa, Triticum aestivum
  Clone ID: PAT_TA_64923.pep
PTSYYTCAHFRSSFLYIQQYSANPLRCYILFLFLVPLFHSFIDIIASIHCDFCDHLLHHFSSLIEHKHISFFFFFFLFFFGRVDGRVVVRVDARVG

SEQ ID NO: 170506 - protein, 116 aa, Triticum aestivum
  Clone ID: PAT_TA_64924.pep
CAERALFLWNNDHIEGLIKQNSKVLLPIILPSLERNTKGHWNQAVQSLSLNVRKIFLDHDPVLFEGCLKKFQDDEAQEDAMRSKRDATWKRLEEIASSNPQAGRPQAIAHQQSSST

SEQ ID NO: 170507 - protein, 106 aa, Triticum aestivum
  Clone ID: PAT_TA_64925.pep
FTLQFLSNLIIVLPRTNIGEPTETRARNTARGCLAIRRNSEGPGGKCAPSGPSRRSDPSPSRQKEQEKNNRPPPPAHHHHHGFRFINRKIAARFYRHAPAAEPGSS

SEQ ID NO: 170508 - protein, 96 aa, Triticum aestivum
  Clone ID: PAT_TA_64926.pep
MALASLPKVVLGSFAFAIFWMMAVFPSVPFLPIGRTAGSLLSAVLMIVFHVISPDDAYASIDLPILGLLFSTMVVGGYLKNAGMFKHLGTLLAWKS

SEQ ID NO: 170509 - protein, 52 aa, Triticum aestivum
  Clone ID: PAT_TA_64927.pep
GSSSHTLTSEDVMFWDRNLTSQYAAYRTLEAIPLAGSIDFSVDSPLGVHAKF

SEQ ID NO: 170510 - protein, 83 aa, Triticum aestivum
  Clone ID: PAT_TA_64928.pep
PGHFSPPPVQRTPPDISHSSPGSFPPGTYPGNMGTCIGVKKVDLGPHRFSAIVRLLGNVYQVLNPCLRDTEWVSKVKIVLKVP

SEQ ID NO: 170511 - protein, 36 aa, Triticum aestivum
  Clone ID: PAT_TA_64929.pep
YKIHLHPILLSDRITKDQINDMFHPWHNNLEFFYIK

SEQ ID NO: 170512 - protein, 71 aa, Triticum aestivum
  Clone ID: PAT_TA_64930.pep
LREEETPSLRGDDEAGSTRLVQPAVCDVNHHDESELGAVRCELRRDLQTESVSPLKTLSVKRLTEETKWYC

SEQ ID NO: 170513 - protein, 69 aa, Triticum aestivum
  Clone ID: PAT_TA_64931.pep
ISSISEDLFKECTTRVQARHLATDVASEEPRRARLARGIVFQRQVQPEDQRRRRGHQRGQQRRARQDVP

SEQ ID NO: 170514 - protein, 80 aa, Triticum aestivum
  Clone ID: PAT_TA_64932.pep
DRSHVRPLVGGGVFVNDPAVQRVKRKRSWSPPPRRAKKHADSTGIDEEECRTKEEVRGAIQGDQGRAGRQVCEGERLKKN

SEQ ID NO: 170515 - protein, 70 aa, Triticum aestivum
  Clone ID: PAT_TA_64933.pep
IYFGATKKKIFRCNAGVIRVGPIKRPPLFFFFFFFFFFLVVFFFFFFFFFFFFFFFFFFFFFFFFFFFFR

SEQ ID NO: 170516 - protein, 39 aa, Triticum aestivum
  Clone ID: PAT_TA_64934.pep
VPRTKRTLGCSCKELAHHVCMYVPAELSESPRVREPMLD

SEQ ID NO: 170517 - protein, 162 aa, Triticum aestivum
  Clone ID: PAT_TA_64935.pep
FVYDGILRSILLSPTPQNLLRADVNLLDYRGKQNRDAAAVRQRFCELLQGFIHVKQIKLNIRLRKGFNVTSHGVLLPVLLNIECIELGLVYSPSCKEAAAMLIAELLTCCPKLRDLRFNLITSFEEDGRRSEGSGNWPTVCLEKDFKESVRRSSAVNAADVQ

SEQ ID NO: 170518 - protein, 72 aa, Triticum aestivum
  Clone ID: PAT_TA_64936.pep
AASLALSSEILQYPHPRWNSILTIHLHRNPPGGPPSDPRRSPWPTIIPTFVGWLEGEQGKENAHSNDSARVA

SEQ ID NO: 170519 - protein, 84 aa, Triticum aestivum
  Clone ID: PAT_TA_64937.pep
QLCADPRAKAAVLADMDSIGKEAQLRGFEFAKAVTLVAEPFTVENGLLTPTFKVKRPQAKAYFAKELADMYAQLRDAESARQKL

SEQ ID NO: 170520 - protein, 58 aa, Triticum aestivum
  Clone ID: PAT_TA_64938.pep
FWWTLTRCLSVRNSPMSSATLTKTTISYSNLFGGYQGFCSLLWSEKLAPHFICGSVIN

SEQ ID NO: 170521 - protein, 127 aa, Triticum aestivum
  unsure (1)..(127): unsure at all Xaa locations
  Clone ID: PAT_TA_64939.pep
MAARNFFVRSPKEEESSAAIREAVLLGGKNAAIAGTVVAVPTFVACRVLPWAKHNLNYTAQALIISXSCVAGFFITADKTILRNARQNTIGLDRRVDLIQDCTESQALCSIYDPWMVLHEETSNFSF

SEQ ID NO: 170522 - protein, 40 aa, Triticum aestivum
  Clone ID: PAT_TA_64940.pep
DCFHVLCLCRPIHTYVIRESIYDLLAYIGISVHFVAIILI

SEQ ID NO: 170523 - protein, 73 aa, Triticum aestivum
  Clone ID: PAT_TA_64941.pep
WGPPGVAAWDRAAGAGLAPVRQVIQQALRSPSSGAGWEHPSSAVSPRAHPGFPRHCCKASSSSLRRVVEAWVE

SEQ ID NO: 170524 - protein, 120 aa, Triticum aestivum
  Clone ID: PAT_TA_64942.pep
SRKYGPLKLQVLDHDMVSKDDLMGEAEIDLQPMINAAASFGDPELLGDIQIGRWLKSGDNALTADSAVMVTGGKVKQEVSLKLQHTESGEVTVEMTGDGSKHLENPDIRWQICTLLQRIH

SEQ ID NO: 170525 - protein, 158 aa, Triticum aestivum
  Clone ID: PAT_TA_64943.pep
DAPPAGAAGALLGGPTRLVTRPATRPPTRPPTRPPTRPVEVFDEEGLHILMGMAFLTYLELKVSETAGVMTVSSNGFKLLEVFHYRINEDRLNEGEAPGIEFAAGAMPALRRLHLFWNGNFASDGADMGIQHLSSLAHLQVETRYYNATMEEVKAVEG

SEQ ID NO: 170526 - protein, 78 aa, Triticum aestivum
  unsure (1)..(78): unsure at all Xaa locations
  Clone ID: PAT_TA_64944.pep
WSSPPPPPPPRARPRSSPGRPSAPAPPSSRXPPRTAAATTPPSGPSRSTPAPRPAGSREADRPEQGCIRACIIYVIRI

SEQ ID NO: 170527 - protein, 44 aa, Triticum aestivum
  Clone ID: PAT_TA_64945.pep
STKVHWPPGAIVQPVAMTVTHHGHPTAAEVLALSWSPHAAGRRW

SEQ ID NO: 170528 - protein, 65 aa, Triticum aestivum
  Clone ID: PAT_TA_64946.pep
FGCSPSDSMRPISSSSLMCSSTENQWLHRAMIMPVVRTRTHQVFASGSSAADSVIVSSCGAVPLD

SEQ ID NO: 170529 - protein, 48 aa, Triticum aestivum
  Clone ID: PAT_TA_64947.pep
RCHRHQREVTRDPDFDWDACIRSCDDKDALPIKKERENKKDGVVPPAK

SEQ ID NO: 170530 - protein, 45 aa, Triticum aestivum
  Clone ID: PAT_TA_64948.pep
RCGEMYCGAHRNSDRDDCRYYYKAGARDAIIRENPQGRAAKNARI

SEQ ID NO: 170531 - protein, 93 aa, Triticum aestivum
  unsure (1)..(93): unsure at all Xaa locations
  Clone ID: PAT_TA_64949.pep
WVISGSTAGDATIDHYAGVVLLAVRAXADAVHAIPLGSAENSGSPPMDTFTEMNCQHVMENNSSCGTDXNDVXGAKDMKQQIVVETLIEELDD

SEQ ID NO: 170532 - protein, 48 aa, Triticum aestivum
  Clone ID: PAT_TA_64950.pep
PDRAPPRSQELLSPLARPSTTIDRVPISPGLTLLRWSLTCGACGSVRE

SEQ ID NO: 170533 - protein, 87 aa, Triticum aestivum
  Clone ID: PAT_TA_64951.pep
RRRRPRWRRPSPPRRSRRRRRPPRRPRPRSRRLLPPSRSRRPRRWHLPPLRRRRPRSPSQQLRPSRRPRPPKRQRRQPWSRQRPRRP

SEQ ID NO: 170534 - protein, 82 aa, Triticum aestivum
  Clone ID: PAT_TA_64952.pep
RGFPSSFVSDSLPLSFICSPNKKRLGFQFIVRHVGLPREAPPFYVHCFLLVVRSLSLLGLSISIIGSFFFFLFSFFCFFRCN

SEQ ID NO: 170535 - protein, 80 aa, Triticum aestivum
  Clone ID: PAT_TA_64953.pep
SQSLLSYPQRSMVGSGVLPLKVARPAAFLVSCAPPDTSNGVEGPSSCKLSGPSLTTVSTQSPRFRVSHGPLPPPVRGGNP

SEQ ID NO: 170536 - protein, 97 aa, Triticum aestivum
  Clone ID: PAT_TA_64954.pep
IWDSRVFPPLSFLNPGQFISFLVPHRKTIRFHLFAHKLESSKQAPPCHVLLPHIINVSLCPFFSSFVCSLSLHGHLSSFFCARVVVRVAGRVGENVN

SEQ ID NO: 170537 - protein, 63 aa, Triticum aestivum
  Clone ID: PAT_TA_64955.pep
LCSSREQPGNQFIFGPVFPSSGSHAPCPHYISIYKLEYFTLGQDRLNTSSPVFWDGPRVRGRV

SEQ ID NO: 170538 - protein, 46 aa, Triticum aestivum
  Clone ID: PAT_TA_64956.pep
QHHRHHTGAKEVRAFWGNLENQRQEPNNGHYRESLGQGRHRGWTSP

SEQ ID NO: 170539 - protein, 99 aa, Triticum aestivum
  unsure (1)..(99): unsure at all Xaa locations
  Clone ID: PAT_TA_64957.pep
GSRCSCGSNCKCGKMYHDLTEQGSSAVHXAAALDLRARPENKAGQIVVAVGQAGEGCXSCGDNCKCNPSTGKLDALTPTCVGERVYEHNQTSNLDRNPS

SEQ ID NO: 170540 - protein, 80 aa, Triticum aestivum
  Clone ID: PAT_TA_64958.pep
SWSPPAPGRPRGTVYRYPRQCPRERGDRVRPRKAYQYDQPAGEDARTRPQEERKHREPPGARGAHKRPPRTSSTRPTARP

SEQ ID NO: 170541 - protein, 94 aa, Triticum aestivum
  Clone ID: PAT_TA_64959.pep
KFCVKVVAPLNAEFAKSWCSLKSPLVDAPNRPEPRSLSVSCKPFRCLNGPALGSGVCSVLSTSKARCTILLCVGIMVIGLSCIALFGVSHRNIS

SEQ ID NO: 170542 - protein, 81 aa, Triticum aestivum
  Clone ID: PAT_TA_64960.pep
MQNEVGDMVDTHAPRKSSVTNRIITAKDHAFAQINIGNADENGLYDGRLTTLALNGLVRTQGDAVGTLDRPRQKRKAEIKQ

SEQ ID NO: 170543 - protein, 69 aa, Triticum aestivum
  Clone ID: PAT_TA_64961.pep
SLGDQGRRDGGEQGLPCLLLILEELITTDEQHGSHCSIARTILMPCPQGTRTCTSLIEMGCMCYLLCMR

SEQ ID NO: 170544 - protein, 51 aa, Triticum aestivum
  Clone ID: PAT_TA_64962.pep
LVEPGRASGVPDASLIPVRCQAIPGPASAFGEDRNGSISPPLGLRLHPGTT

SEQ ID NO: 170545 - protein, 68 aa, Triticum aestivum
  Clone ID: PAT_TA_64963.pep
SNNNRAATYLNVRTQKNLPLTPPPPDQATSPLPHPVRPTASPPHMPCADHEPSPSGHSISDLAREPPR

SEQ ID NO: 170546 - protein, 53 aa, Triticum aestivum
  Clone ID: PAT_TA_64964.pep
TCCQKVHELSLCANIRIITCKCTHQHHPVFCSFDSFDLINVVVNWWEVISQCL

SEQ ID NO: 170547 - protein, 61 aa, Triticum aestivum
  Clone ID: PAT_TA_64965.pep
LYTACCRNGAGAHDPELGLVLQPHGDQRRKPSPPAPSTGWTSKEREPEDSRLLGNTQMLVC

SEQ ID NO: 170548 - protein, 60 aa, Triticum aestivum
  Clone ID: PAT_TA_64966.pep
IILPEAVWWIQSCLVGDAHREASKCVDGESSVFQVWVREIVGTSSILVPLPSGKNFHTCS

SEQ ID NO: 170549 - protein, 141 aa, Triticum aestivum
  unsure (1)..(141): unsure at all Xaa locations
  Clone ID: PAT_TA_64967.pep
MPTLLTSPAFLYYSPLHLAYRLGGAAVRTTSNHHRRILAPDPQTAPRGTTTGGGYAEMSWLGKLGLGGGGSPHASEATEELAQGPDEDKPTPGCEIVQFGAGCSWSEELVXQRVPGVTPTKDGYSQCAFKTPPTGRLTGAT

SEQ ID NO: 170550 - protein, 139 aa, Triticum aestivum
  Clone ID: PAT_TA_64968.pep
WYQHVPVPSTLAASLAHHLLLEWRPTTAPAGPCTTPTPRSPSTAARPCTPPPPRSATTLASSAMVPATARVRAMAMVGPTCTPTTLASTPACTGMAVAAVAGPCTPPPPTSASTPSGPGMGRATATGTTTVGPCRTPPP

SEQ ID NO: 170551 - protein, 51 aa, Triticum aestivum
  Clone ID: PAT_TA_64969.pep
MGLPCQRMNWEEAMTKEEQNGPLLSVGEQLNQDVSLTGTKEKLGLLTPELK

SEQ ID NO: 170552 - protein, 62 aa, Triticum aestivum
  unsure (1)..(62): unsure at all Xaa locations
  Clone ID: PAT_TA_64970.pep
RDPPVLKVKSLFIPARESKFGTHKRPALFFLFFCFLFFFFFFFLTXFFFKFFFFFFFFGRVS

SEQ ID NO: 170553 - protein, 55 aa, Triticum aestivum
  Clone ID: PAT_TA_64971.pep
YLPPQRLATRGGFLPYDGSDPIRPAGKSHHPIPSSDFAFEGSDMVDLANHPFVMQ

SEQ ID NO: 170554 - protein, 40 aa, Triticum aestivum
  Clone ID: PAT_TA_64972.pep
VVTDTTVMVGDERKGNSGARNCGLEYVSRIKWKVLRSRLG

SEQ ID NO: 170555 - protein, 43 aa, Triticum aestivum
  Clone ID: PAT_TA_64973.pep
SRMEHRHVLSHFINLTHVHASTKKKKKKKKKKKKKKKKKKKNE

SEQ ID NO: 170556 - protein, 146 aa, Triticum aestivum
  unsure (1)..(146): unsure at all Xaa locations
  Clone ID: PAT_TA_64974.pep
XCLGAMQEGEAVRVLPACAHVFHVPCVDTWLASSSSCPVCRALVEPPPSPAAPAWVQEKQGLEKECAASGSSAPPCGLGASLMRMLNRERPLARRLTQGDHAHPMEMHVEDLESQHPQQYHCVDTKKCFFLRCVFFWGFPFVGRME

SEQ ID NO: 170557 - protein, 118 aa, Triticum aestivum
  Clone ID: PAT_TA_64975.pep
ATSRNLNHRQGSQQRMKIGPSFKEERVTDEHQIQGRDGLYRRVPSCAVLVIHLRDVVKLTGPQLKGFWHKASLLSYPQRANAYTEREFSNNFNAQWFKVTIYSSKINTHDQGCSPLPV

SEQ ID NO: 170558 - protein, 76 aa, Triticum aestivum
  Clone ID: PAT_TA_64976.pep
RGAGPAPNPWARRASWWGAWPCYSAGGSARGAATNRSVTERLLAQGLGAIVPTRSVCVYRKRIAHNFSARSFKVYI

SEQ ID NO: 170559 - protein, 71 aa, Triticum aestivum
  Clone ID: PAT_TA_64977.pep
CSSMLAQPSSLAFHYCNCTQITNPTAVLFTYRVRIYSSQLHRPDARAIDTLSTLISQQCKPHWVQFSTRSN

SEQ ID NO: 170560 - protein, 146 aa, Triticum aestivum
  unsure (1)..(146): unsure at all Xaa locations
  Clone ID: PAT_TA_64978.pep
MPASSVSGSTGPGGVSPDAIIEWLQDEMGYPSAPPAPEQLRKICRGNMLPVWSFLLRRVRSERTVATARRNILVHGVAARRAREGGVGAGGGDAAAREAEARERDLAAEEAERLRGVVRRQRKELRARIAEVAREEAXRKRVLGER

SEQ ID NO: 170561 - protein, 47 aa, Triticum aestivum
  Clone ID: PAT_TA_64979.pep
CIDHRANKVPDLTLTRCTHGFVYCNNNKKSQVDGVLYDANGNAAPIA

SEQ ID NO: 170562 - protein, 61 aa, Triticum aestivum
  Clone ID: PAT_TA_64980.pep
TRREINGRDGQPLFLGESMMKHQLQQPLRWLHAQLKDPRRQDHQQRARRGGSVRSDRGRSI

SEQ ID NO: 170563 - protein, 147 aa, Triticum aestivum
  Clone ID: PAT_TA_64981.pep
FSRVRGGAKPGLPNAAQTPTAGAPMNQGTPMAQGTPMNHSTPMAQGTPVAQGAPMAQAPPAPAQSTDEVKPSEATTAPDNVEATAATSNAEATAAPGTAEATEAPVPDPTSSSPDAADAPASAPAPAADSSGTDALAVTPSDFTNDA

SEQ ID NO: 170564 - protein, 82 aa, Triticum aestivum
  Clone ID: PAT_TA_64982.pep
STTRPPTRPLPCDTSHHLNLKRGEEEEERSNGVRAPLQQLQQQQGEEASVQERPAQAADRQDSRQPRGAGRQEQLQLQKMIT

SEQ ID NO: 170565 - protein, 145 aa, Triticum aestivum
  Clone ID: PAT_TA_64983.pep
PRVRPRVRQPGRCRCGRRRLLRHGIEWAGGQARDSTPSSVEGWMEPSAAWEQPSADATPTTVLVVLALIPPVLPQVYQLLSVYSLIFFLFSSSFMVNSLQQFDKMLKSKVWPLFDEPDTRRSMGLHVHIRRRWLEVNCVCFQLRR

SEQ ID NO: 170566 - protein, 63 aa, Triticum aestivum
  Clone ID: PAT_TA_64984.pep
LLFISQRRQRGGVFSNHGSTQRFAQWPLLSSPFSFVLVLLDVAITVQAPGAVPAVTLQDLTSP

SEQ ID NO: 170567 - protein, 44 aa, Triticum aestivum
  Clone ID: PAT_TA_64985.pep
IIFIFIFFFFLISFFIFFFSIFFFFFFFFTPHVFPTNNAQNNQS

SEQ ID NO: 170568 - protein, 61 aa, Triticum aestivum
  Clone ID: PAT_TA_64986.pep
TALRFVTDNPGVWAFHCHIEPHLHMGMGVIFAKAIDRVGKVPKKAVSCGAKATALMNGDHL

SEQ ID NO: 170569 - protein, 72 aa, Triticum aestivum
  Clone ID: PAT_TA_64987.pep
RPRRARALRPPGAFRRGHHGLGGEVGVGVGVVLLVARAGQHRRRLRPLICTDGRSKTACPLQEIVCRALEAG

SEQ ID NO: 170570 - protein, 56 aa, Triticum aestivum
  Clone ID: PAT_TA_64988.pep
CSGITMSAVYDSVFFLNDTTMQLAGSHAMASCRYYISGLFMCTQTGCFSFLNGLLL

SEQ ID NO: 170571 - protein, 57 aa, Triticum aestivum
  Clone ID: PAT_TA_64989.pep
TWGQNHSRGTRIRAYAYQQSRIKESVKSHLRTNEHNRDIISETSNGMRDRLLHESVI

SEQ ID NO: 170572 - protein, 57 aa, Triticum aestivum
  Clone ID: PAT_TA_64990.pep
MAVEGTDNCIDIILAIILPPLGVFFKFACGIEFWICLLLTFFGYLPGIIYAVWVITK

SEQ ID NO: 170573 - protein, 115 aa, Triticum aestivum
  Clone ID: PAT_TA_64991.pep
LLRTRFGVLPSGFDPFADGWSSGMQALAFGCLPACSSGKIYTRPWPSASAWGFLARLLCSPGSSWSGGGQRLTRRSFLRSANPSRSSVTAALAPARRQAVAVEGSSGLRPWPLWS

SEQ ID NO: 170574 - protein, 80 aa, Triticum aestivum
  Clone ID: PAT_TA_64992.pep
TVVAARKERRYGLGRSAVAGLGRAPSGPSSLLHRSRTLDSGRLQHIRPSANRMGALSKACGMQKTERPLICLYLVLLLSY

SEQ ID NO: 170575 - protein, 121 aa, Triticum aestivum
  Clone ID: PAT_TA_64993.pep
VVGNPSGSKRGTVCIQGIAWSFGGMIFVLVYCTAGISGGHINPAGTLGLSLARKLSLTRAAVYMVMQWLGPICGAGVVKGVQTTLYQGNGGCANFVRPGYTKGDRLGASIGGDPRAEVHRF

SEQ ID NO: 170576 - protein, 46 aa, Triticum aestivum
  Clone ID: PAT_TA_64994.pep
LPSSCVSVFQLVATACLCITPQSTSEVNKSGGLCAQEQNFPTEEQN

SEQ ID NO: 170577 - protein, 61 aa, Triticum aestivum
  Clone ID: PAT_TA_64995.pep
LSHASGLARVRARVICLLALRLCSAHGVLACMCVRMSPCNCFIYLHYGWSDEYARMKDLPN

SEQ ID NO: 170578 - protein, 49 aa, Triticum aestivum
  Clone ID: PAT_TA_64996.pep
LGSSTERLCLRRAIALPIARPRPPRRQLLSAPVLYHTFFLHLVDQQWTA

SEQ ID NO: 170579 - protein, 113 aa, Triticum aestivum
  Clone ID: PAT_TA_64997.pep
MGRTLDVLLGRTTKQTARLKSLLHLATKRIAVVRAHREVRCAQARGDVEQLLRQGHPDRALLRAEQVIRERDTLDALLLLDAYCALLADRSALLDDAHRGCPDELREAAAELC

SEQ ID NO: 170580 - protein, 46 aa, Triticum aestivum
  Clone ID: PAT_TA_64998.pep
FYFVYHSIRGLCCFISTAHGNQQVQHQQAIRKSAERAATCFWQRPH

SEQ ID NO: 170581 - protein, 60 aa, Triticum aestivum
  Clone ID: PAT_TA_64999.pep
GPVVAQCRFSSERAIDAAPLAGLPCACVCSAVSLLRCVSQCQFRLWSIGFLVSVVSMRVQ

SEQ ID NO: 170582 - protein, 80 aa, Triticum aestivum
  Clone ID: PAT_TA_65000.pep
MSKKNSLSKRKKQHEFDLQREKKAKEEQAKKLQAKKSKMKIDGSDKKKKGSSFKVGKKKVKTKLSALGKAKAAQAMELDN

SEQ ID NO: 170583 - protein, 59 aa, Triticum aestivum
  Clone ID: PAT_TA_65001.pep
PTRTQDIARGRNYHHECKPEPINHGEQAPKNIARDDEGKTRAAGLGTPDPTKGSQEKPQ

SEQ ID NO: 170584 - protein, 117 aa, Triticum aestivum
  Clone ID: PAT_TA_65002.pep
SRVFAGALGADGLVYAGGALHTAGGGGGGAAGIAVQSGTLTLNGNVTGGAGGPSPYQPGGGGDGVVLGHGDIIVNARISGGQGGSRRYYGTPRSASGDGGSGISIGSGTVINNNVVL

SEQ ID NO: 170585 - protein, 76 aa, Triticum aestivum
  Clone ID: PAT_TA_65003.pep
LNGPPLFFLFGSHLVEQRGACVPPCSLQCCPSTHGLLDVDGIPQMTWCGEHVRLPVSRSVEPGVGLKQSPDRSDDA

SEQ ID NO: 170586 - protein, 91 aa, Triticum aestivum
  Clone ID: PAT_TA_65004.pep
CDARVAILRQKNNKKRKRGSNKKTMKRKRPNNWPQPWTNKAIDPYAAETKGGGVQEGPAPLPGGGTAHVLQWGPQKKNNGPSFQPGWTGKP

SEQ ID NO: 170587 - protein, 120 aa, Triticum aestivum
  Clone ID: PAT_TA_65005.pep
LVCSTPPSGCTCDPFVLKKQKYTTTKKNKKKKTIHSFLHLSYLSTIPPPFFPPGGGLFGGPRFPPPGLRRLCFFLGAPYSLPRAVVSPLRAGETPGVPPSIPLAALPLFPGGVISAGAPP

SEQ ID NO: 170588 - protein, 82 aa, Triticum aestivum
  unsure (1)..(82): unsure at all Xaa locations
  Clone ID: PAT_TA_65006.pep
QIQQSHESLRFTMNNFTALSSSSFMENPSPEVDRGNVLASIPESNNSVPVDSCPYGYKMVLKLKSKIYPEGFTXKKKIKTKK

SEQ ID NO: 170589 - protein, 75 aa, Triticum aestivum
  Clone ID: PAT_TA_65007.pep
SVPSTLPDAQDPRRPARPWWYTTGLASHPSLRCRRPMTRLALSDCRGLTPLRARSRGSAIALPSPPHLAAGPRRP

SEQ ID NO: 170590 - protein, 52 aa, Triticum aestivum
  Clone ID: PAT_TA_65008.pep
LLHGHVLCKHVFDHSLRLKHGYAQSATLAIHTISPHRCCIVDLPPQMNKALP

SEQ ID NO: 170591 - protein, 125 aa, Triticum aestivum
  Clone ID: PAT_TA_65009.pep
MRPNDHGRQRNEREEPTPRRKKKKKEKEKKKKETKGGRPKGPKRTDASKQRHSAAKGAPKGKKRAAGQQRRDGENPGGTQQKSPGKKPPSPRGRKSEKARTERPSKQKNSPKGEKGRAQKRSKKR

SEQ ID NO: 170592 - protein, 44 aa, Triticum aestivum
  Clone ID: PAT_TA_65010.pep
FDDQQTGSPVIAHHVFSGVLESSILHNNGTWRRLTKPKKRKKNL

SEQ ID NO: 170593 - protein, 161 aa, Triticum aestivum
  unsure (1)..(161): unsure at all Xaa locations
  Clone ID: PAT_TA_65011.pep
GRRHPTAQPESRTPGXPPETRRGRRGGNKQHRRGRPQTKTSTRPDNRRKQRTRGATATKRRSPRRKKNREPDTGRRDEQRDPRRQPGGDERRTGAPGGRPERRSQTTRGQKGAQDDAKQRRDRENPGGTQSKSQAEQTPTASRRNRKEARTERPTNRSTTR

SEQ ID NO: 170594 - protein, 68 aa, Triticum aestivum
  Clone ID: PAT_TA_65012.pep
LSWPSKSAGLHVNSFCTANHCLYTIKKQSQTQPADRRCLHWAQKKRKKKKKKKRLLTIKKLEIKKKHI

SEQ ID NO: 170595 - protein, 101 aa, Triticum aestivum
  Clone ID: PAT_TA_65013.pep
RPSLLFGSRAAPVCPSRSCLPLSSGVLCVVALLASGAFSFARARRRVHRVPSGLARRCPSLSRGALRRRRWGPVLCWAGQWTRRPSRPPPRPRTRGRTRDE

SEQ ID NO: 170596 - protein, 62 aa, Triticum aestivum
  Clone ID: PAT_TA_65014.pep
QAGPVLESRGDPSRRFISQRAAGDTPRVDELTIQKLAHPRLREVRKLGENTVIKEKVTHARS

SEQ ID NO: 170597 - protein, 109 aa, Triticum aestivum
  unsure (1)..(109): unsure at all Xaa locations
  Clone ID: PAT_TA_65015.pep
SFFLSLPGGAGLFFLSFPVWLSFSVSVCSPVRRCSVVPCRRFGVASPPLLFFCPRLGLVSLXCAVAFSSGSCLPRLRFCLSRGVLSRRFACYHPVFRVRCGGVFASPGG

SEQ ID NO: 170598 - protein, 71 aa, Triticum aestivum
  Clone ID: PAT_TA_65016.pep
FLFPRGRKFGSFKRGPPLGFFFFFFCALRAPWFFVFFFFHVRAFFTFSVSFFFPCVWLVAPFGIHKVLGYQ

SEQ ID NO: 170599 - protein, 69 aa, Triticum aestivum
  unsure (1)..(69): unsure at all Xaa locations
  Clone ID: PAT_TA_65017.pep
KKKKKKKKKKKKKKKKKKRKGNRGVRRTQEKKRXMKRKKSEKEKPKENGGGALKRNRMSGQGAGDTKLC

SEQ ID NO: 170600 - protein, 60 aa, Triticum aestivum
  Clone ID: PAT_TA_65018.pep
NHTKKTKQKTAPPSNEQPPGPPFLPAYDPLITCPNYNPPSTVPPRPHLKNPALPQQNTFS

SEQ ID NO: 170601 - protein, 61 aa, Triticum aestivum
  Clone ID: PAT_TA_65019.pep
KGRDRPPPGVPLVQGQVPIKGPRQNGQQGGGLLGAPRVFPGYFKVLNMYGSSLAPVGFKSL

SEQ ID NO: 170602 - protein, 84 aa, Triticum aestivum
  Clone ID: PAT_TA_65020.pep
LDTTTMHLFVFSVLSYDLLLNFFAHGDKTIRNTRSPLLASQRLLFYKRILRRFTSPNFLQVFKNRRSAVIEIICKQGIARAIPV

SEQ ID NO: 170603 - protein, 50 aa, Triticum aestivum
  Clone ID: PAT_TA_65021.pep
AHIHIVLHGDFDSTYKTITWPALLGYQYVPAAHANYIIPQAVVVSSQSSW

SEQ ID NO: 170604 - protein, 61 aa, Triticum aestivum
  Clone ID: PAT_TA_65022.pep
GAWKGSPLSALKKLAAGKLGSEDVGFQASGALEWILCFLVRKLSSCLPTQRSPWHARTIYI

SEQ ID NO: 170605 - protein, 78 aa, Triticum aestivum
  Clone ID: PAT_TA_65023.pep
FFLTSRHVGAYIHTYIHTYEWLRAYSSDATGPLTVRLLEYSLHYPLTSEALYLFISCNPALFIRNTHQMSICSSRMRR

SEQ ID NO: 170606 - protein, 132 aa, Triticum aestivum
  Clone ID: PAT_TA_65024.pep
YTGTGAATDTTCSGQDGTRCAGPPLAGRAPGEPRPRKPPLEQARVPAASTQVASQSHERRLPCCGGAGLRRRRQSGQRHQSLRAPHHGQLARCPALHGTIHKDGRTSGHYLKLSHIPLRRPRSILQPLFSDV

SEQ ID NO: 170607 - protein, 55 aa, Triticum aestivum
  Clone ID: PAT_TA_65025.pep
FDYYYLGVFRGRDVAIPAALSRLVVWTKSWHGLSILTVHTENERSIVHVVRPPFS

SEQ ID NO: 170608 - protein, 58 aa, Triticum aestivum
  Clone ID: PAT_TA_65026.pep
KKKKKKKKKKKKKKKKKKKKKKKMKKKKKKKKKKIKKKKKKKKKKKKKKGGAELGVPS

SEQ ID NO: 170609 - protein, 51 aa, Triticum aestivum
  Clone ID: PAT_TA_65027.pep
PAHVVPLTNLDYIATCILVKPWAHKPGARLITQCVTPDRIAAFHEGMLDMN

SEQ ID NO: 170610 - protein, 95 aa, Triticum aestivum
  unsure (1)..(95): unsure at all Xaa locations
  Clone ID: PAT_TA_65028.pep
VTTGLVEVAVNITLSAGKPLAAYSDDKVLLPQALFGAKAPAPVPGAPKGAKNKKGEAXASGRASXDDDAAPTGAAGARAARRGMAGMDALLGYLL

SEQ ID NO: 170611 - protein, 99 aa, Triticum aestivum
  Clone ID: PAT_TA_65029.pep
LAELRYTAASTKGVRICICHRRQVLRYDDPTCSPVSGPRGRLGRRGARAPISSPGRATPASSRRSSRRGPWPEPAPEERTRSRRTRPNQHQRRAGRVEE

SEQ ID NO: 170612 - protein, 106 aa, Triticum aestivum
  Clone ID: PAT_TA_65030.pep
FVFFFFSHFMFCCYSLLGLLLKRTGRLKQHRQPGGTRVFKGPCSGDKLQNGTEPKFLQNEAPYWSEVGHNLGGATRKKGSSAGYFTAMGGKGHVRGPYVSVVDSKF

SEQ ID NO: 170613 - protein, 166 aa, Triticum aestivum
  unsure (1)..(166): unsure at all Xaa locations
  Clone ID: PAT_TA_65031.pep
SPRVREQWLQTEAQSFDVPSADMIYSLAYLPRTMPLDGRKDGGAGAGREAMQQKQQQQRDMMMSPSHMQKVEEMKQLFEKSSRDLSKVLDIYDQRLEEAEYLAGDKFTLADLSHMPNADRLAFDEALRXLIQSRRNVSRWWADVSSRESCVYVKSLHAPAFAEAPF

SEQ ID NO: 170614 - protein, 154 aa, Triticum aestivum
  unsure (1)..(154): unsure at all Xaa locations
  Clone ID: PAT_TA_65032.pep
KGNGPPPRGPPPPXAKKAPKGGAPMPLQEGQMFGKGPWTGPSSDLPPLEKGEGSPHQQFGVPPGFPPSRGGKTRPGNFSLGPHKKNTGGPXPPENGGPPNAPPPFYFFFFIEYLAPFHPFSFFLLFFLLFSLLSLFCCFFFIIFSSFFFFFFVY

SEQ ID NO: 170615 - protein, 69 aa, Triticum aestivum
  Clone ID: PAT_TA_65033.pep
MVKGRTGQRVRLYVRGTILGYKRFKWNQYETVYLVQIEGVYTREDAAWYGCQRMAYVYKAKTKSNGTHY

SEQ ID NO: 170616 - protein, 154 aa, Triticum aestivum
  unsure (1)..(154): unsure at all Xaa locations
  Clone ID: PAT_TA_65034.pep
FFVERLKTGFEKFKTEVYDQKPDLFEPLKAHQSPKXTLGLEPGEAFTVRNIAAMVPCYCKNKHTGVGSAIEYAVCALKVEFIVVIGHSRCGGIKALLNLKDGADDTFHFVEDWVRIGYPARKKVKDECSEMPFEEQCXVLDKEAVNVSLQNLST

SEQ ID NO: 170617 - protein, 72 aa, Triticum aestivum
  Clone ID: PAT_TA_65035.pep
FRAPQYRCSPSHRRGPTVCFFRPAPPLIVSMALKGHSFLPVVRSLSFQGHSASFFGFFFIVRVAGRVAARVG

SEQ ID NO: 170618 - protein, 179 aa, Triticum aestivum
  Clone ID: PAT_TA_65036.pep
LLVTAFMTIIDDIFDTYSSTEDSMQLAEAINRWDEDAVNVLPEYMKDIYLYLLETFHSFEDHLGPENSYRVVYLKEAFKKLVQAYSDELKWRDENYVPKTLNEHLQVSSVSIGTSVVACAIFVGMDDTTVETLTWVSSDQKLLEVFAIYTRFTNDMASAKREQAGGSVLYYPSYMRSMD

SEQ ID NO: 170619 - protein, 43 aa, Triticum aestivum
  Clone ID: PAT_TA_65037.pep
AFFTRPPTRPARRYPSTHLSMTKLAYSACNKQALVFLFYPLAS

SEQ ID NO: 170620 - protein, 110 aa, Triticum aestivum
  Clone ID: PAT_TA_65038.pep
FCTSRRFHSHNLLNPPKSTSFIANSKHVCTGVLLYMLTSKASSFDGLTECAKLQESSYTCIYRGIITLSNSTLLRMLTSKAIAFDAPRTISSRIAVDRHSKSRQIGEKLQ

SEQ ID NO: 170621 - protein, 69 aa, Triticum aestivum
  unsure (1)..(69): unsure at all Xaa locations
  Clone ID: PAT_TA_65039.pep
MALPNQNTEDYPSSKLVIRGDGGTGKTTLEKRHLTGEFEKKYXPTIGVDVDPLDSTTNXGKIRLYCMGH

SEQ ID NO: 170622 - protein, 98 aa, Triticum aestivum
  Clone ID: PAT_TA_65040.pep
SSEIRGGRGEEGEADRKRGSQGGGLVRRGERGRPGPQIELKELDINTATQTDERRNRTAGVTHESYGLSKPFKKIHVKLIKELLKNPSGQDIGFVATK

SEQ ID NO: 170623 - protein, 86 aa, Triticum aestivum
  Clone ID: PAT_TA_65041.pep
CCPFRPRQFCLSVVESSSPPQCLGPPLIIPSVRIHTHVVLPTAPAFLTCSSWPPPGGARELPRFFLNQAQPSLRSACGHTNTFGHP

SEQ ID NO: 170624 - protein, 65 aa, Triticum aestivum
  unsure (1)..(65): unsure at all Xaa locations
  Clone ID: PAT_TA_65042.pep
VRLSSCTPPHIYYVFFMSFFSQHEFLLPSWSPSTCRCSGNSTHASAHASARESTNAWVRTGIRXG

SEQ ID NO: 170625 - protein, 101 aa, Triticum aestivum
  Clone ID: PAT_TA_65043.pep
GRVVGAGLFLVWPLGEGGFFSRCFRWGRFGVSPSPGCLTGSVVFYFGGPMEVVFSCVPGVGSCGSFEGRAHVYLFGFFFFFFWVCGLVCFFFFYLPFFFFF

SEQ ID NO: 170626 - protein, 138 aa, Triticum aestivum
  Clone ID: PAT_TA_65044.pep
MGDATVESPWWRLAKVGLWRITQDNGPYNGRIATIVEIIDHKRILIDGPSSDEMLVVPRQAMALYEILLAPIVVESMPRAVRTGTVKKFWEKSGVDSKWKESSWAKRQEQKERRRALTDFERFKALRLKKQRRFEEQK

SEQ ID NO: 170627 - protein, 57 aa, Triticum aestivum
  unsure (1)..(57): unsure at all Xaa locations
  Clone ID: PAT_TA_65045.pep
PVRNPLVVLRDRLLLTXXXXGRKLLIQCVDISFFSIPDVFWLIHWAFNSLPLVQAIF

SEQ ID NO: 170628 - protein, 88 aa, Triticum aestivum
  Clone ID: PAT_TA_65046.pep
VPVRLAARFCCSPRPRGRAGRSVLRRGCLRPLAVPPPGPFFAPVGRSALSLWSAGGLGGSFLFHPPSLPVFSGFDLSGRVGRPGVSAP

SEQ ID NO: 170629 - protein, 87 aa, Triticum aestivum
  Clone ID: PAT_TA_65047.pep
KQSIGGMAGTTTDTSRRSPTVLSLGPLILRKDGPARGDGICVDEPCADATVSRGDGFTLTTDPGGHDDWFYRRTQLSPCDSRLNLGN

SEQ ID NO: 170630 - protein, 144 aa, Triticum aestivum
  unsure (1)..(144): unsure at all Xaa locations
  Clone ID: PAT_TA_65048.pep
MGVTSTATPRLSPAELVLILLLLPAAGAARGDGNGVYEPCADATVSRGDGFTFXVAFAGRDAFFSGGVQLSPCDSRLNLANAGPLLELFRPTVDEIAVLTDNAYDPKAXHSDGGHMEAFARRKIAARMPPVYVGNNFDTDTGLT

SEQ ID NO: 170631 - protein, 120 aa, Triticum aestivum
  Clone ID: PAT_TA_65049.pep
LYGGAFAATPAEAASGAEFVFCCVGNDDDLRSVVLGDEGASAGMAAGAVFVDHTTASAAVARELHAVAAERGLHFIDAPVSGGQAGAVNGALTVMCGGDAAPFDAARPIALAFAKAVTLL

SEQ ID NO: 170632 - protein, 56 aa, Triticum aestivum
  Clone ID: PAT_TA_65050.pep
CDVLILAGYPKKERKIIFKEPTVLFTKTRRDRVRTTGAMMALQSHCLFEEECLTKE

SEQ ID NO: 170633 - protein, 136 aa, Triticum aestivum
  unsure (1)..(136): unsure at all Xaa locations
  Clone ID: PAT_TA_65051.pep
MKFAPPQTDNESRDAKEMDLARRRNLLSILAILAATVTYQAGLNPSGGIWPAENSKGGKPGNPVLQDSHPXRYDVFYYSNAVSFASSAAVIILVANRESCEDGIKSYAIRACLVADLLGLLIAYSAGTCSIARPVI

SEQ ID NO: 170634 - protein, 84 aa, Triticum aestivum
  Clone ID: PAT_TA_65052.pep
PASGLADGPVSCRLPVDPFLRLMAGAAAGGRVPVQVLELLEDPCERHGSGAGSRLSAVCRFAPSCSLLARNRSHGTALPFRSRP

SEQ ID NO: 170635 - protein, 67 aa, Triticum aestivum
  unsure (1)..(67): unsure at all Xaa locations
  Clone ID: PAT_TA_65053.pep
QTQYNVQWSPLHLQRDQYFVYSQANHKSESVQLNDNACASCAGXSSEGAGDRISGTARIIVGARAGG

SEQ ID NO: 170636 - protein, 99 aa, Triticum aestivum
  unsure (1)..(99): unsure at all Xaa locations
  Clone ID: PAT_TA_65054.pep
CPRDRXVLATPSGAPTGFPFRSTAYSFAARSSGAASGAAARSMLYLEGRRLVVVLCIHFISVTRFMEGRPMWIIRHIHVILLQRLVDMSRVYDYSRLGT

SEQ ID NO: 170637 - protein, 84 aa, Triticum aestivum
  Clone ID: PAT_TA_65055.pep
APVLSAALTTGVGVTSSLCACRWIRIYSSPVDPCSGSMADGAAHERVPDHVQDDLEEHQEARSSGAGPHPIELVWPGLLARVSL

SEQ ID NO: 170638 - protein, 90 aa, Triticum aestivum
  Clone ID: PAT_TA_65056.pep
MLVYQDTLSGDELLSDSIPYRELDNGMLWQVDGHWVVQGALDVDIGANPSAEGGGDAVGDLKQELDDTRSKLGTCLAVYNRCAGKTLMLP

SEQ ID NO: 170639 - protein, 80 aa, Triticum aestivum
  Clone ID: PAT_TA_65057.pep
MARALGYDFFTENSCVFHAQGIQQSTDACIQHTTANAAHNLGPSRDEPTTDVFRREPWCHPTQRRTPTGVEQEKASAVTE

SEQ ID NO: 170640 - protein, 37 aa, Triticum aestivum
  Clone ID: PAT_TA_65058.pep
FSAYSRVFLFMQIPCYWDAGIMREHTGEWMTDCCYSP

SEQ ID NO: 170641 - protein, 47 aa, Triticum aestivum
  Clone ID: PAT_TA_65059.pep
TFCKVDRCRPFSYCVSWRMGDVPQGDSVVLFVVFTVKVGVKRGPVEC

SEQ ID NO: 170642 - protein, 78 aa, Triticum aestivum
  Clone ID: PAT_TA_65060.pep
PTASFSLSSGSPSWSFVQSGSGPIGGVQARQNAGLTRSALLACAHAATHWRRRGIFLPFEGRPAFLGRLEEMEQPAKK

SEQ ID NO: 170643 - protein, 152 aa, Triticum aestivum
  Clone ID: PAT_TA_65061.pep
CSAAAAPCFSHVSLTFSVGQLEGGVLPGLNRHYRDFLIQRLVQFFQGAITVKDLVLRFTGPEMWIMPKNPFSAMSNLRRLLVADVPSSWDASWPRLLIEAAPLLESLYVHVSHSEDEPRQEVPGETSGSRHCHLKELVAIGFQRTDRQMHLV

SEQ ID NO: 170644 - protein, 98 aa, Triticum aestivum
  Clone ID: PAT_TA_65062.pep
RFIDNLVVCSGGLARSVKEGIPADEADLRDMITSLESLLRDGIQPRVGRYAEQELRGFDTTFKSLLPDAAAATTIKEEPDNGDATSSCRQDQEGAASH

SEQ ID NO: 170645 - protein, 63 aa, Triticum aestivum
  Clone ID: PAT_TA_65063.pep
SPTEEKGNSKRVPRYLLSAEGAAGWGRDGEGAPSSTISSRTSLGVYLVATGATPEIGFMTMEA

SEQ ID NO: 170646 - protein, 81 aa, Triticum aestivum
  Clone ID: PAT_TA_65064.pep
TRPPTRAVFPAATQGCVRATAGSWTWWSWTRWSWRRPRPTARRSPSRCRPPAGKPACSATTRTDRWSKRWVDLDAVVVCVA

SEQ ID NO: 170647 - protein, 61 aa, Triticum aestivum
  Clone ID: PAT_TA_65065.pep
YQSPHAFVPLAALALLVAPISYISTVVLFHQDHVEPDGFILGHALRLRDEVAQDGHQHARC

SEQ ID NO: 170648 - protein, 39 aa, Triticum aestivum
  Clone ID: PAT_TA_65066.pep
LNHRPSSRLQPLPALSPPCLRAWQESLNLLKKSSPPALS

SEQ ID NO: 170649 - protein, 71 aa, Triticum aestivum
  Clone ID: PAT_TA_65067.pep
RHTRLGGGPLSERSPCFPCRASFIYGRLSARRNVNGIVAFALWLALCNALLSPPGVRLTDCLTVATGHGIE

SEQ ID NO: 170650 - protein, 55 aa, Triticum aestivum
  Clone ID: PAT_TA_65068.pep
GRTRGKRRIIYRRPPYFFRQRREEEAPTCVIMVVLGRLLNLWRRPSLLKNILPPS

SEQ ID NO: 170651 - protein, 70 aa, Triticum aestivum
  Clone ID: PAT_TA_65069.pep
MMALGGHCFSVEEFMTDDQLVALLRLVGEQLHRDGMLAATKEELVLRAAQLEEEVDDRRTKVGTGRCTTT

SEQ ID NO: 170652 - protein, 68 aa, Triticum aestivum
  Clone ID: PAT_TA_65070.pep
TRHAHHHSIKIHPSLAPPLSSSRRFACRLSLPQSGTQMVAALRVASAFSSAVYHTSKMHLQSLWSDRH

SEQ ID NO: 170653 - protein, 105 aa, Triticum aestivum
  Clone ID: PAT_TA_65071.pep
TNLFLYQQLIMTDAIAYMLCPALSAAPGVPICHMFYTSETTPRTIRFQLSKTSYKSEQREYVKSQNLYNNVQTHNCYVQPYLCSVCRLEIYLAQFLSTKAASRKC

SEQ ID NO: 170654 - protein, 72 aa, Triticum aestivum
  unsure (1)..(72): unsure at all Xaa locations
  Clone ID: PAT_TA_65072.pep
CGLDCHSGACWSFXATGAMEGINMITTGSLLILPEXKLIGCDRSHNAGCXGRLMNYAFXFVINNGGVTRRMT

SEQ ID NO: 170655 - protein, 61 aa, Triticum aestivum
  Clone ID: PAT_TA_65073.pep
YGDQALEHNEVPAERVAEPIRIAATTGTVPGDGDQPMGRKALADRTMEKRRGRVAPRAVPY

SEQ ID NO: 170656 - protein, 60 aa, Triticum aestivum
  Clone ID: PAT_TA_65074.pep
SSVLPDTAAEQPVHLRSWIPPHGRTGPQRRQLPPLWVLTLSWCSGRKERSSNINPPAHAP

SEQ ID NO: 170657 - protein, 76 aa, Triticum aestivum
  Clone ID: PAT_TA_65075.pep
APGRSKRWSFARAPLAGPTAVLVMQCGHFRSGHKGESLCPRLGRLGAPTISAAQMHRPVGSERSLSPPFQLIARSL

SEQ ID NO: 170658 - protein, 104 aa, Triticum aestivum
  Clone ID: PAT_TA_65076.pep
SQSRRCKPSASTEFSPRVIHLLLQLSHRELQFFIRHRQPAIMSISCSRSSARQDNQFFRGQVLLSRGTMAQEGHHNASWAVPYSSWSKNSDSGPKKIMVHSRAG

SEQ ID NO: 170659 - protein, 147 aa, Triticum aestivum
  Clone ID: PAT_TA_65077.pep
GCGARVEHVLTGEPVVARQEGLALFDTNGDGCISLEELAAVTGSLSLDPTNQELNDMMREVDMDGNGTIDIQELWSLIARKIQDGYGDEELKEAFQVLDKDQNGNIFAVELMTVMIKLREKMTDQEVRHLIREADTDGDRHVNYDES

SEQ ID NO: 170660 - protein, 41 aa, Triticum aestivum
  Clone ID: PAT_TA_65078.pep
RHLVIQCPVGAIAWTVDSYHRYQVPFRLSGGGVQAVVAMMS

SEQ ID NO: 170661 - protein, 92 aa, Triticum aestivum
  Clone ID: PAT_TA_65079.pep
LALVIRRGDEDTDLAFQCNEGYSYGVLFSHGRLRSKFHGPSWERLVSDYGVRPRDIMTIRLEHYGTWIGIDFNRVGRGDALSPLPSVGKVYF

SEQ ID NO: 170662 - protein, 119 aa, Triticum aestivum
  Clone ID: PAT_TA_65080.pep
VLAHRAIGCFVTHCGWNSTLEALANGVPLVGIPHWADQPTIAKYMESAWSMGVRVRKDNNGYLKMEEVERCIREMMDVERNDKSKRNAVKWMQKAKEAMREEGSSDKNIAEFATKYSSI

SEQ ID NO: 170663 - protein, 145 aa, Triticum aestivum
  Clone ID: PAT_TA_65081.pep
GNPTTPRPNSPRKGGVPLPEMGGQVLKGGYGRALYFLKPGEEGEVPTKGLRLGNTTFCPATRMGQTRPRDIDLGDPKKKWFAHRAERGKRVLLRHGPLRKETMAHNVHVFRLLYVHVLIMFRPASSSFFFLSFCSLFFFFFVFIK

SEQ ID NO: 170664 - protein, 49 aa, Triticum aestivum
  Clone ID: PAT_TA_65082.pep
RFDIECKRNFFEICTMIFDILFFYFFFFFFRYQKFLELYKLHHKDYPAQ

SEQ ID NO: 170665 - protein, 148 aa, Triticum aestivum
  Clone ID: PAT_TA_65083.pep
LLRARDYPNRPPSVRMTYAMWYPDGYAGGRVCISIVDAPGDDPNGCELARERRTPVRTVESIVLSIIRMLSRPNDETAADIDGGEDWREKRAEVRRLVRSLDGMLQEMLCIWRSIRGSPQALEYYRWHQDGAPGASTWTIPHVMFHSW

SEQ ID NO: 170666 - protein, 183 aa, Triticum aestivum
  Clone ID: PAT_TA_65084.pep
VAKKKCPIALEERNDRKSSQAAHSSSIRSQRDMKSSIREEMFFSGPQPSPEPRNRNVPLLSGFERRVWVELLAWRFHTGKFWALYKLKKHLFSALHYQDYNMVMSIYNDMDIDNYVFQFGCWADCPSWRSCIHRGSISGNSTQPLYHYQGTPREFLDEGSETGSDIEEQMAFGSGVPSCPIEA

SEQ ID NO: 170667 - protein, 90 aa, Triticum aestivum
  Clone ID: PAT_TA_65085.pep
GRGRTTGGSKATPGQRFAAGGHQTKDEMSGRPGSQGEQLNRDGSLTGTKEERGTRAAEPKEERDDTKPKAGTGRKEQHRDWENPRAAQQN

SEQ ID NO: 170668 - protein, 67 aa, Triticum aestivum
  Clone ID: PAT_TA_65086.pep
GPQKKNFSFPARGGKIGYFKKAPPFFFFFFLFYFFFFFFFFFFFFFFFFFFFFFFFFFFFFFFFFFF

SEQ ID NO: 170669 - protein, 95 aa, Triticum aestivum
  unsure (1)..(95): unsure at all Xaa locations
  Clone ID: PAT_TA_65087.pep
MTLWTDDHHVWFFRLDIGEGKEINLEDRCPRSKLLSQCIKYLGPKEREEYEVVIEDGKFMYKNSKQILDSXGGPRDAKWIFVLSTSRNLYVGQVM

SEQ ID NO: 170670 - protein, 83 aa, Triticum aestivum
  Clone ID: PAT_TA_65088.pep
GIGGSNDACDHASAHACRGAYVPLNKRTCTWKTRRKRMHHRRQTNGRTRRKRKKRRHETSTERYTTPKEGSIKKACNDSQTRT

SEQ ID NO: 170671 - protein, 66 aa, Triticum aestivum
  Clone ID: PAT_TA_65089.pep
CWQVVDLADEVLLDHLVAYALKSIVHRGSVIQWAAGAADELHRICCHIRGREARVEKPRYSGPVSA

SEQ ID NO: 170672 - protein, 69 aa, Triticum aestivum
  Clone ID: PAT_TA_65090.pep
WAQLRGEGWSNRYDIGIVKNFQQIFGVDKSPTTWLLPGKPDIGDGHRFPTLASLTSLAEEQELARAVQP

SEQ ID NO: 170673 - protein, 33 aa, Triticum aestivum
  Clone ID: PAT_TA_65091.pep
MINETTHWLQHYHWRGVVSRSCSGWEGVVPTLE

SEQ ID NO: 170674 - protein, 83 aa, Triticum aestivum
  Clone ID: PAT_TA_65092.pep
SRFGCSPRQRRRAIRSSFVLGSSPGGPWPRRALVSPVCAAPSLLGLPPASPVLSVSWCALAPRLRWSRDFFCVAAGGVVASFP

SEQ ID NO: 170675 - protein, 58 aa, Triticum aestivum
  Clone ID: PAT_TA_65093.pep
MVPRGHQSSAEELTTKEELLAPLRPPGEQQNRGVSPPGTKEEQGLPGAELKEEVDDTR

SEQ ID NO: 170676 - protein, 61 aa, Triticum aestivum
  Clone ID: PAT_TA_65094.pep
LLFCLTLKTFCFFCNISFFIFRFLSFYYAFFIPFVLLLNSVIPSFRSFLIYVISTLIITLI

SEQ ID NO: 170677 - protein, 93 aa, Triticum aestivum
  Clone ID: PAT_TA_65095.pep
CPRQAFISVQLFPQPTEAGHPFLLWPGLLPRGTMAPQGPCFARCSGTCLFSGLATRRSHACLCCVTGVLSRRVSGGLHAFFCVAAGGVVASFP

SEQ ID NO: 170678 - protein, 47 aa, Triticum aestivum
  Clone ID: PAT_TA_65096.pep
SFKAAPPFFFFALFVLFFFFLFFFFFFFFFFFFFFFFFFFFFFFFFI

SEQ ID NO: 170679 - protein, 98 aa, Triticum aestivum
  Clone ID: PAT_TA_65097.pep
PDRHSPGRPTQTSIPPMNRELRTPFHKAHQFCWRLPVESTCTYKWPESWHCRSHWIIWGRIHDEKGPAGPAPDAGITTATGHDPDRNQRKTCIAECRT

SEQ ID NO: 170680 - protein, 77 aa, Triticum aestivum
  Clone ID: PAT_TA_65098.pep
KFGNIIVFLILFFFLIFFFFFFFFFFFFYKLVTISINKVLNKIYMHVSVARGSVRLSVIPQFQNESISHSVSKLSSS

SEQ ID NO: 170681 - protein, 87 aa, Triticum aestivum
  Clone ID: PAT_TA_65099.pep
TTVIRGGVELPARREEIELHTADGLTLVGELATPLDRTPVATLVTLHPLPTGGGFMDSHILRKAAGRLPALADIAVLRFNTRGTASP

SEQ ID NO: 170682 - protein, 40 aa, Triticum aestivum
  Clone ID: PAT_TA_65100.pep
TTGNSLAFGFPIRDLISSLQRYLNLAPIKGPPGVQPTGKR

SEQ ID NO: 170683 - protein, 46 aa, Triticum aestivum
  Clone ID: PAT_TA_65101.pep
CTTGLQSLYLLRNDNMTSSKCIWHYNTSYILKRFAAKPSMGSQSRL

SEQ ID NO: 170684 - protein, 102 aa, Triticum aestivum
  unsure (1)..(102): unsure at all Xaa locations
  Clone ID: PAT_TA_65102.pep
MMTQKSKGADMCRTNETARTSTVCRGAHKQLATKVARXSCFATAGAKKPHXYRPRTEWLWESRKYQKSTELLILKLPLRALVREIVQDFKTDLKFQSFCRAG

SEQ ID NO: 170685 - protein, 59 aa, Triticum aestivum
  Clone ID: PAT_TA_65103.pep
RYSVSAMALKRPCSLRLTGTLLMGSYWRTRTYPEPDPEPEEKPTGNTRVIGRVGQTGNS

SEQ ID NO: 170686 - protein, 108 aa, Triticum aestivum
  Clone ID: PAT_TA_65104.pep
LDTGSKTPISQWLRAATDDADAGLTGTAALPLDGRVAIVTGASRGIGRAIAAHLSSLGASVLLGYASSAAEADALAAELPRAVAVRADVSDEASVRSLFDAAESAFGC

SEQ ID NO: 170687 - protein, 129 aa, Triticum aestivum
  Clone ID: PAT_TA_65105.pep
MANHVALLLLLSLQLTASFSQQPGDDPDLRTLLKIKEQFGDQAALVSLLPGTDQCNWPYAYCNQHRRVVAIFLQNVNITSTIPPAIGDLDQLHTISIHSIPGLHGPIPDTFGKLSHLSIFNIMRTVLGS

SEQ ID NO: 170688 - protein, 86 aa, Triticum aestivum
  Clone ID: PAT_TA_65106.pep
MREKKKKIIKGGALFGGQIFLPRDWKIKVFFWGPQKKINGGGFKKGGGGKTRGFPNLIFLEKIPFLPGGEKKKGPHQMAFLKIWQP

SEQ ID NO: 170689 - protein, 98 aa, Triticum aestivum
  Clone ID: PAT_TA_65107.pep
YKTLWNRNKKKKKNIKKKILHPTMGSRSVSAEGEFMRSASAQVFYRAIGVTIQFSPSNLSELEKPWGAPFYLVSRKIPLLVPPLYFLKGSSPFPFPIS

SEQ ID NO: 170690 - protein, 44 aa, Triticum aestivum
  Clone ID: PAT_TA_65108.pep
MGSLKRAPPKDRFFFLFLYFCLFFLFAFFFFCFFFFFFFFFFFF

SEQ ID NO: 170691 - protein, 39 aa, Triticum aestivum
  Clone ID: PAT_TA_65109.pep
KRPPRYLLFFFFYLFYFFFFFIFFFFFFFFFFFFFIFFF

SEQ ID NO: 170692 - protein, 82 aa, Triticum aestivum
  Clone ID: PAT_TA_65110.pep
CNKVSTTSTSPQPPRQRRRRRRRRRRRRRRRRREGDPVMGKGKEPAKDAPNKTKAPSISTQLTKPPSFKKNQVQSRNNPMLT

SEQ ID NO: 170693 - protein, 158 aa, Triticum aestivum
  unsure (1)..(158): unsure at all Xaa locations
  Clone ID: PAT_TA_65111.pep
FSRCRSSRGRQPSSSPPRXFLPWPSDAVGAALPHAPPEPPPSPREPRAAGAALRRPAAQLAGAARRPTPRPAGAAPFAVGAAGRWSRPSPSRRSACRSRPPHPLGHGSRVPPSRSSTTTTTKVGSAAPTFSPMTPSLTTPATRRAPLHGTRNVVYNIG

SEQ ID NO: 170694 - protein, 108 aa, Triticum aestivum
  Clone ID: PAT_TA_65112.pep
QAERRKGRAVPRGGLVSSSAAERGLHRQDQNCRKAQAVPRHGSVERPAIAGSQAIQQKGRDSASEEPEPRRAMTAPADGTRTSLRVCHLHYCFFFNFFFFFFFFFLFK

SEQ ID NO: 170695 - protein, 105 aa, Triticum aestivum
  Clone ID: PAT_TA_65113.pep
PSRPPTRPARAGLMNPRVLLLDEATSALDAESEHLVQDAMDSLMRGRTVLVIAHRLSTVKTADTVAVIFEGQIVESGTHDELLGRDGIYTALVKRQLQLPMLDYV

SEQ ID NO: 170696 - protein, 185 aa, Triticum aestivum
  unsure (1)..(185): unsure at all Xaa locations
  Clone ID: PAT_TA_65114.pep
NWGGAKTKTPQKPPKNPGKPPPQKKEKNKNGGTAPKKERPPGGTPPPPRAIKPHKGGPRPPQRGXPPGGKGKGGAPLRKSPHAEKGKGAPNDKSGGPPRGSPRPRGETPAPEREKRGPPKESMGSPRPGKKPGPPKKGPPKGQEREQSGGPRRGPPKRRRMKEGRGSLFQGWYGTPRVLNILTGD

SEQ ID NO: 170697 - protein, 130 aa, Triticum aestivum
  Clone ID: PAT_TA_65115.pep
LVGVIPAAWPPCVIKKKKNIKKAQKKKQRRHPAYSQDGWRHQRHERGGGRPRGPKGPAGGPGRQTSPKGAPKSKSRAAVYHPRGRGNPGGSPPKGPGRKTPFRRGGKKQRGPTRTAFPTVAHPEGKRGPP

SEQ ID NO: 170698 - protein, 101 aa, Triticum aestivum
  Clone ID: PAT_TA_65116.pep
LYSPPGVVLALLLPAEIALSFVRSLSALAPFSILADACTELAVAADVKEDVQLLAERGRPFDGRSAFAGLWGAPSDCGAPVVCFEGFCLTLEVEACKWNRG

SEQ ID NO: 170699 - protein, 72 aa, Triticum aestivum
  Clone ID: PAT_TA_65117.pep
FSLITAAAAVEEEEEEEERKLPDQARRAKMKTILASETMEIPEEVTVKVPAKMLLVTVPRWTLTLNFNHFNS

SEQ ID NO: 170700 - protein, 39 aa, Triticum aestivum
  Clone ID: PAT_TA_65118.pep
TGHQIMNILIGLAYRSPKQKIVDHMTQRNPTPPPEALPK

SEQ ID NO: 170701 - protein, 48 aa, Triticum aestivum
  Clone ID: PAT_TA_65119.pep
MLVNSTSLPQLSTLEIEVEELQADDIQIIGMLPALLCLVLFARHVMGT

SEQ ID NO: 170702 - protein, 67 aa, Triticum aestivum
  Clone ID: PAT_TA_65120.pep
VTPQGGESYTMDYSDPPPSSIVYVEEHTKWSIDRAAIAECVTTVLLLYISVATMINYMHEYDLFVKT

SEQ ID NO: 170703 - protein, 86 aa, Triticum aestivum
  Clone ID: PAT_TA_65121.pep
AGAFCLVGGRSGVGASCAGCAALACRGHVLLGVLCWVAPPLFPVWPVVGRRSGELYFGGPVGVLWRRLRACVSLGPLARRLAVGNQ

SEQ ID NO: 170704 - protein, 40 aa, Triticum aestivum
  Clone ID: PAT_TA_65122.pep
LADPAAITTVTVAAEEEEESFYFGWFDQHPTWHLTALYVP

SEQ ID NO: 170705 - protein, 113 aa, Triticum aestivum
  unsure (1)..(113): unsure at all Xaa locations
  Clone ID: PAT_TA_65123.pep
DRAQVNRDLASEKNLKIXQLDKEVRTMLVIMVKSCLGTYDTMGYSSDLLGLMLQACAEQGGXNAILIVDERIXEGKTCFPARGDSRXHVLTWTMSLLNTHPEWQQKLRPEVLR

SEQ ID NO: 170706 - protein, 40 aa, Triticum aestivum
  Clone ID: PAT_TA_65124.pep
PSLLGFRGGGLARSRVRERRSRMKIKVDIQVLRLMLCGMT

SEQ ID NO: 170707 - protein, 86 aa, Triticum aestivum
  Clone ID: PAT_TA_65125.pep
ILPPTPPRSQRRVIWHRPRTSPTAPSAMPKQGGKAKPLKQAKAAGMDSRQKDPGNPQKKKGEHKGLKEHEGPGRTEGRAGRIGSQE

SEQ ID NO: 170708 - protein, 44 aa, Triticum aestivum
  Clone ID: PAT_TA_65126.pep
FFWSRSRLTSTVQFVRPASGTRGNLVHLSVMGSATGCSVGVEGP

SEQ ID NO: 170709 - protein, 78 aa, Triticum aestivum
  unsure (1)..(78): unsure at all Xaa locations
  Clone ID: PAT_TA_65127.pep
LLAGDTPWSTLPTICNRSEGLGDALLGNIIFTGMLLLGVRYMLKFSXTLHGSREILLAVIIXSYFKTFMLTMMVREIP

SEQ ID NO: 170710 - protein, 43 aa, Triticum aestivum
  Clone ID: PAT_TA_65128.pep
SVLQAEGAIQALNCSGMILGTLPVRVSPSKTPVKPRLNWVVSN

SEQ ID NO: 170711 - protein, 61 aa, Triticum aestivum
  Clone ID: PAT_TA_65129.pep
FNVLEAVAAELHSLSWMTVSPVYMERRSALPFHCDMVLRLRRLLHYADRHLSQPTDKGDVS

SEQ ID NO: 170712 - protein, 50 aa, Triticum aestivum
  Clone ID: PAT_TA_65130.pep
DMEEYTIYLRRSFLNSLQCKNVSLLLSIHVCHTPDNFVIFIRLSIKLELS

SEQ ID NO: 170713 - protein, 64 aa, Triticum aestivum
  Clone ID: PAT_TA_65131.pep
SCSLSDEGPALRLLCPSSRPLRHPLPRRRLGFVHPRPRASAREGEGIGGVDWRVLGLPPGRLAI

SEQ ID NO: 170714 - protein, 64 aa, Triticum aestivum
  Clone ID: PAT_TA_65132.pep
EPGLVLESRAADFSVWVGPGLLVSAGFPEFSNMRKLVSLYRGDQGSGALGFRLPAVFASGSGAA

SEQ ID NO: 170715 - protein, 133 aa, Triticum aestivum
  unsure (1)..(133): unsure at all Xaa locations
  Clone ID: PAT_TA_65133.pep
LVVFLLFLLFIVVCFFXXCFFFFXNANLSIHCYFLFPKNKDYSIYQMCTFLSFLAAQRQQTVTNCSIAVCHVSVHRRWRRLPVRGTLGRRPVEELDALLAGPLVGATCDAVLPVVDVGHLQAPVRLAHASAHA

SEQ ID NO: 170716 - protein, 48 aa, Triticum aestivum
  Clone ID: PAT_TA_65134.pep
LFEELNFLEGSVLDRQGLVAAIVDCNSSSNQPFSRWKIWRVITLWRRP

SEQ ID NO: 170717 - protein, 52 aa, Triticum aestivum
  Clone ID: PAT_TA_65135.pep
VYPWDRPLCEVMTGAATDDVRFLLNIHEKMTEELSMAFSWRLALRCELFCMG

SEQ ID NO: 170718 - protein, 54 aa, Triticum aestivum
  Clone ID: PAT_TA_65136.pep
DPQGEGRNDSAGYPKHRLTTGNPARERTMIQPAPPTLPADPEESVTEQLGETGP

SEQ ID NO: 170719 - protein, 62 aa, Triticum aestivum
  Clone ID: PAT_TA_65137.pep
ANQSGVDRTWSGLILIMGCMSNYPLRLIIPPDTESILLHRKFLLLSLAMEKDDLIGPTPFAG

SEQ ID NO: 170720 - protein, 48 aa, Triticum aestivum
  Clone ID: PAT_TA_65138.pep
VTRPIAVIGGTGKYETAKGFAAIRTLHPGDQHATDGVDSLLQFDIHLS

SEQ ID NO: 170721 - protein, 91 aa, Triticum aestivum
  Clone ID: PAT_TA_65139.pep
MKGAKSKGAVKADTKLAAKSKGAEKPAAKGKKGKAGKDPNKPKRAPSAFLVFMGEFREEFKQKNPQNKSVGDVGKADRERWKNLSEFDKGP

SEQ ID NO: 170722 - protein, 79 aa, Triticum aestivum
  Clone ID: PAT_TA_65140.pep
ISWLLACGILPICSTILHDGPIDLMIYMVRINQLDKAATGRRPPARRTCAAAAPAGTGSRSPFRSRRGTEIESSETELH

SEQ ID NO: 170723 - protein, 74 aa, Triticum aestivum
  Clone ID: PAT_TA_65141.pep
GKILKRRLITQGLNIGGGPFLKTKFLAPALGYPNFFFLDHKINFPAGVFQPGGGENPRSTTHNIFLKKSPFCGG

SEQ ID NO: 170724 - protein, 70 aa, Triticum aestivum
  Clone ID: PAT_TA_65142.pep
MAREVQTAVIGKSLGGTQNKGGGGYKVSNLVTTSIRGLNSSMVQTKIKPLGANLQHRNWETPGVTQLIAL

SEQ ID NO: 170725 - protein, 58 aa, Triticum aestivum
  Clone ID: PAT_TA_65143.pep
ARVLLWSLSGLLYGLVPLFFFFSFVFLFFFFFFFFFFFFFFFTQGTPLETRDSIGEDK

SEQ ID NO: 170726 - protein, 48 aa, Triticum aestivum
  unsure (1)..(48): unsure at all Xaa locations
  Clone ID: PAT_TA_65144.pep
TVRAPWCEKMALKTGPGPVXEDMNMHHHIERQGDKDWRTLTKQAGLMC

SEQ ID NO: 170727 - protein, 85 aa, Triticum aestivum
  Clone ID: PAT_TA_65145.pep
KITDTLPVSHTNANKMEVCMYMSNKPRYLAGEDDEQDEQLAEPLAAPDVQPGAPSHASSHVACALVSAPCMWVCLWLPSRLSSLH

SEQ ID NO: 170728 - protein, 79 aa, Triticum aestivum
  Clone ID: PAT_TA_65146.pep
LMRPPTRPPTSRGIPPLPCSPHHFRPTLLQPDETGSGDLPQAIRRAQLRSPRRLGPSGRLHARLLRRAGRLLRRVRQDA

SEQ ID NO: 170729 - protein, 45 aa, Triticum aestivum
  Clone ID: PAT_TA_65147.pep
GWALSKSRPGTIFSMVPLLRSGGIVASSTHTKLVDLIASSLVFQQ

SEQ ID NO: 170730 - protein, 116 aa, Triticum aestivum
  Clone ID: PAT_TA_65148.pep
MATELAYAPPMKSGKLGFEGTQEVQHRIRITLSSKSVKNLEKVCSDLVKGAKEKQLKVKGPVRMPTKVLNITTRKSPCGEGTNTWDRFEMRVHKKVIDLVSSPDVVKQITSITIEP

SEQ ID NO: 170731 - protein, 52 aa, Triticum aestivum
  Clone ID: PAT_TA_65149.pep
LKTNKQQATSSETQMEQCQQHAAFPAHHKHLTMFQYSDIRAPLPYCTLPLAH

SEQ ID NO: 170732 - protein, 86 aa, Triticum aestivum
  Clone ID: PAT_TA_65150.pep
CTRGPLIGRGSSATEKIAVNRRTGGELAGKRVAADRDAELRGERGILRGLRSPDVERCLDTQDRSGGLLNMIMENAFGGSLSDEIR

SEQ ID NO: 170733 - protein, 153 aa, Triticum aestivum
  unsure (1)..(153): unsure at all Xaa locations
  Clone ID: PAT_TA_65151.pep
YPEQIDTCASSPLQDLGAPRHTPTKPRNPEXPSEFRKQLPTSPAYMYTKELICRACTSKTKIETTIPNLDTWWPDRVAGRDDVAGARVAGKHRSVERASVMVAEQHDDAAPDDVEPGPVLPQHPRQPSSSASTSASSSLLLLLLLPHIIVHPS

SEQ ID NO: 170734 - protein, 70 aa, Triticum aestivum
  Clone ID: PAT_TA_65152.pep
KGGKGIYFWFPQKKKKNWNTRGGKFVSLKRPPPLLFFFFFFFFFFFFFFFFFFFFFFFFFFFFFFFFFFF

SEQ ID NO: 170735 - protein, 46 aa, Triticum aestivum
  Clone ID: PAT_TA_65153.pep
NCSMTSSSGAASSNNGANCIMVRLARRVGGEHPVFQVTDIGVNAFA

SEQ ID NO: 170736 - protein, 72 aa, Triticum aestivum
  Clone ID: PAT_TA_65154.pep
CHCACIRRGGSIAAADPVDCAVKSASCGKMIRLRCRDLRIFADQESVVNVLWMPTAYRADYLTCGLMQHQQV

SEQ ID NO: 170737 - protein, 85 aa, Triticum aestivum
  Clone ID: PAT_TA_65155.pep
RSSRRRPREPSAMDDSAQLQRFIEQEKERMMVSEMIGKVTSECWDKCITGAPGSKLSSGETSCLSNCAKRFIDMSEIIAKRFGVH

SEQ ID NO: 170738 - protein, 122 aa, Triticum aestivum
  unsure (1)..(122): unsure at all Xaa locations
  Clone ID: PAT_TA_65156.pep
MRGCMSRIGSSIVKSLVDALHRGERQNDWETHVNTQVKHLAVHSCFNSWQDRAEGRTEQTCKQKGKRDAHWDAPXSAALGAATVMVTRTLASTLASALLPVSSAFLATFVGTFGEALSQGLN

SEQ ID NO: 170739 - protein, 88 aa, Triticum aestivum
  Clone ID: PAT_TA_65157.pep
NLVEDMSGTTPQARIAKLEALLLNKQWRMRGKFICHERSSVTAWRSHQRMSCREGTEPEADRGELRRLPVCEYSQSHTEQSKRRSPDR

SEQ ID NO: 170740 - protein, 104 aa, Triticum aestivum
  Clone ID: PAT_TA_65158.pep
MSSAPMSGRGEVGKGLAKGRPKVLRNVIQDIIQGMTKTPTRRLAMKRILKLIYEVTYEETQSFLKNFIQNVIRYTENYTEQTRPKIDTVLDLKYPLQRLYRSLY

SEQ ID NO: 170741 - protein, 86 aa, Triticum aestivum
  Clone ID: PAT_TA_65159.pep
PTCPPTRPPTRPPTRSRTRGRTRGAEQLPCRLPLLRPFSCPGSAPLSVIGWPRLRRRRSSPAPRRKPRPASRSSGSPSPSRRRERP

SEQ ID NO: 170742 - protein, 120 aa, Triticum aestivum
  Clone ID: PAT_TA_65160.pep
MALATPTAVVLELMTMGQQSAAHLRELLRAASPPVQAEHQALAAEILRCCDRVIAAVSAGATDKKRKATDPGATSCHLPLAMMPSKKRVRGAEAHREVHADTTADGFVWRKYGQKDINGS

SEQ ID NO: 170743 - protein, 48 aa, Triticum aestivum
  Clone ID: PAT_TA_65161.pep
TWVPQNGPPLFFFFFFFFFFFFFFFFFFFFFFFFFFFFFFFFFFFFFF

SEQ ID NO: 170744 - protein, 98 aa, Triticum aestivum
  unsure (1)..(98): unsure at all Xaa locations
  Clone ID: PAT_TA_65162.pep
MRPPTRPPTRAPTRPPTRPRTRGLGSCQAIDLQHLEENVKDAVKSMLKMTDLKTLSTHQXGHLHNARFCEKELLVTIDPEAVFANADEPCRANYPLMQ

SEQ ID NO: 170745 - protein, 132 aa, Triticum aestivum
  Clone ID: PAT_TA_65163.pep
SLFRVCVHLLRLRRRQTNRVSSDSSNHERRAGWKSTYPAGDKMTFTLTNLIRLMFTKMEMRILIENDNPILKTTILYKLKIREIYTTMLTMRFNAVTAVYKNISSTVCNVMGYDKINALWRHYFQNTQGLIF

SEQ ID NO: 170746 - protein, 143 aa, Triticum aestivum
  Clone ID: PAT_TA_65164.pep
PFCPPTRPPTRPPTRPPTRPGISDNDAGSAESVEKLDLLKDTKVSLSANHLQKLRLSFQLSTPLGRTFKPHQVFLKLKHESKVEHLFVVPGSARQFKIVLDFLGLVEKFYYLSGTYDLELSVGDASMENSFLRVLGQLELDLP

SEQ ID NO: 170747 - protein, 71 aa, Triticum aestivum
  Clone ID: PAT_TA_65165.pep
PTFPLLAELFLVSSQCFQDVGGFLYIVDSIKQDSSDVANDIIGAIIAGIMAKKAISDCGPIPAIINEMIHG

SEQ ID NO: 170748 - protein, 45 aa, Triticum aestivum
  Clone ID: PAT_TA_65166.pep
TDRPWPRRAIFSPCCSYTISSGSSISIIGCFFNEHNRCINRTNKR

SEQ ID NO: 170749 - protein, 106 aa, Triticum aestivum
  Clone ID: PAT_TA_65167.pep
MAPKRGGKAPVPAKKKAADKVVNPVFEKRPKQIGIGGALPPKMDLHRVVKWPKVLRIQRQRQILKQRLKVPLALHQFIRTLDKNLDTNLFKMLLKILPEDKVAYKE

SEQ ID NO: 170750 - protein, 118 aa, Triticum aestivum
  Clone ID: PAT_TA_65168.pep
ALPGDNVGFNAKNVAVKDLKRGFVASNSKDDPAKEAANFTSQVIIVNHPGQIGIGYAPVLDCHTSHIAVKFAELVTNIDRRSGKELEALPKILKNGDAGIVNMITTKPMVAETLATYP

SEQ ID NO: 170751 - protein, 100 aa, Triticum aestivum
  Clone ID: PAT_TA_65169.pep
EGARQNGQGWTVVPWTFCYRVLHERLTDKALNACWINNSTVNPSRLMIKKNRECMYKKENNIFMPLGLNLAPAYDLQLHDWENTEVDEHNRLEYKSFSPT

SEQ ID NO: 170752 - protein, 119 aa, Triticum aestivum
  Clone ID: PAT_TA_65170.pep
DAWADAWGSTQPLCASLRRPSVRQRWPSGDRDASAALRRHPLRRHPRRPTPRPRAGGAAAKARRPRRPVPKARETGKTLWIENAFSGSGIICHHLIDLGTCGHDFFSLDYSKNLEPRSL

SEQ ID NO: 170753 - protein, 77 aa, Triticum aestivum
  Clone ID: PAT_TA_65171.pep
PRFTSQCVLCHPSLIGARTGNAMGGVLPRREWKLRGESDQNSVGFHPPVVCWPSRQEDRAYRHYEQTRSLDGERGAL

SEQ ID NO: 170754 - protein, 33 aa, Triticum aestivum
  Clone ID: PAT_TA_65172.pep
LSQRIYAMAVELFFEVELTRSHLFHAPAPSLLT

SEQ ID NO: 170755 - protein, 89 aa, Triticum aestivum; identical to SEQ ID NO: 117642
  Clone ID: PAT_TA_65173.pep

SEQ ID NO: 170756 - protein, 54 aa, Triticum aestivum
  Clone ID: PAT_TA_65174.pep
VFIFLIFLNFFYVFFFFREHQFIHSPITRNGIKKYTNNLTTSQSYEQHLTNKFN

SEQ ID NO: 170757 - protein, 44 aa, Triticum aestivum
  Clone ID: PAT_TA_65175.pep
RHLVKERCCAWQLSWVSPWFPQPRRCDSVDQLIFFSFHLSNVKV

SEQ ID NO: 170758 - protein, 59 aa, Triticum aestivum
  Clone ID: PAT_TA_65176.pep
VCSRVSYDDRCGPLQSYEVCGKAYVLQVALVGLCHGIASRDSCYATASVFILGVAIDDL

SEQ ID NO: 170759 - protein, 48 aa, Triticum aestivum
  Clone ID: PAT_TA_65177.pep
IKLCLWFFFFFYRIWRNLQQRKSLQGLYHKAPPNHDPLDQQQTNILYS

SEQ ID NO: 170760 - protein, 70 aa, Triticum aestivum
  Clone ID: PAT_TA_65178.pep
MASDRLRDIKAFEDTKAGVKGLVDAGLTTIPAIFRHLPDTIPVDASRLAIPVIDLARITSHRAELVAELK

SEQ ID NO: 170761 - protein, 102 aa, Triticum aestivum
  Clone ID: PAT_TA_65179.pep
MPLEKLTSLTLEGPNSLIRSSGLSSSQLMVWKCFPFVRTLTISKCSNLVRWPTKELGCLDGLRYLCIQNCENLGGNTSSPEEETLPLYLEVLKISECRSVVA

SEQ ID NO: 170762 - protein, 81 aa, Triticum aestivum
  Clone ID: PAT_TA_65180.pep
PSRPPTRPPTRPPTRPKKKKKKKKKKKKKKKKKKKKKKKKKKKKKKKKKKKKKKKKKKIKKGGALLKGQIYSPGAGKKNGF

SEQ ID NO: 170763 - protein, 125 aa, Triticum aestivum
  unsure (1)..(125): unsure at all Xaa locations
  Clone ID: PAT_TA_65181.pep
MTLKCRNVGRIKHGLGQIKYMRCYNCATGXTKDKAIKRFLEKIIVEQAAVIDEKDARVHDGYVLTKLNGQGHPLCSCAIHAHIVRVRSSENSTHRKPLERYRCIDDRLYALDRVALSVLVAIEAL

SEQ ID NO: 170764 - protein, 65 aa, Triticum aestivum
  Clone ID: PAT_TA_65182.pep
PRVRPRVRPRVRDRLLRTGASWLLVCVCVCVVPLDCPVCSSQVCVPTPLSLSRHMPLQLIHSILQ

SEQ ID NO: 170765 - protein, 55 aa, Triticum aestivum
  Clone ID: PAT_TA_65183.pep
TKSRVRKPTRTDRKNLAAHQLNGSGRHTDEASSHQYLTGPDQSEWPTVRHPERRM

SEQ ID NO: 170766 - protein, 75 aa, Triticum aestivum
  Clone ID: PAT_TA_65184.pep
YPTGTRHCSAVPPWRSCCRSVLHLSWAPPPSAGALDEPVLLLLSAHRLLQVSQGDPLRQMILASLAGRLTGLLRV

SEQ ID NO: 170767 - protein, 75 aa, Triticum aestivum; identical to SEQ ID NO: 117166
  Clone ID: PAT_TA_65185.pep

SEQ ID NO: 170768 - protein, 78 aa, Triticum aestivum
  unsure (1)..(78): unsure at all Xaa locations
  Clone ID: PAT_TA_65186.pep
MGISRDFMHKRRATGGKQKAWRKKRKSELGRQSANTYLSSNITVRRARVRXGYVKCXPLRLDSGNFLWGREAVTSKTR

SEQ ID NO: 170769 - protein, 105 aa, Triticum aestivum
  Clone ID: PAT_TA_65187.pep
IHEKKKKQKKKITKNAAGKHKKEKKQTNGRPSLRFPAFVPLFATRGRLFRGSPFYSPGRGHLTLFLGLPWSNPGPGLCQAYPFKPLDFPHFMPCPSPPLLTAWII

SEQ ID NO: 170770 - protein, 90 aa, Triticum aestivum
  Clone ID: PAT_TA_65188.pep
CLVCSRIPSLICLTESQCSYCVWDHETAGYLCSHREQKCHHCIFFMILPLTEATGAEGRPVTPPCSDQNTSGEAASSIGPEVFMMVSSGA

SEQ ID NO: 170771 - protein, 92 aa, Triticum aestivum
  Clone ID: PAT_TA_65189.pep
SMRPATQHTTLWTASNPSIHRRLSRMSPWLAGGLSVPARVWSSVYHGVENHEDCVLRLAAIKHKRMHRFISYRLQRIGWGYGGQTGEREGTS

SEQ ID NO: 170772 - protein, 37 aa, Triticum aestivum
  Clone ID: PAT_TA_65190.pep
INHLIQTKSIVFYTPPPQPSPSLLVISSIFYNIQRSI

SEQ ID NO: 170773 - protein, 104 aa, Triticum aestivum
  Clone ID: PAT_TA_65191.pep
KVLSGFQSLIVSTFPPHHLSLQFHVLAGENSLAMASQCASETEPATRVNSADELQKLPAKSLFVRPGPGSARPLAWSAANAIEKYEHSPIFSLKFKSVTNSVCH

SEQ ID NO: 170774 - protein, 79 aa, Triticum aestivum
  Clone ID: PAT_TA_65192.pep
HSSAHASASMFSCFFLSKCVCCSNCLHFDGLAPLWLQPPHQMYRFQMNITPLLVSLFKNRAYTDAKKKKNWKNKKKKKN

SEQ ID NO: 170775 - protein, 50 aa, Triticum aestivum
  Clone ID: PAT_TA_65193.pep
VFLQEYNITKKIEHAVKSMQYDSVSISAVDPEFYSERFLKFIQTVFPENS

SEQ ID NO: 170776 - protein, 114 aa, Triticum aestivum
  unsure (1)..(114): unsure at all Xaa locations
  Clone ID: PAT_TA_65194.pep
HVLAGVAHLGLSDGHEDGAGPRRPLPLPFLFPPGMLSWHCQDPKSSSCCLLLLLLLFRLXRLLGIPQDADDSSGWVALTHARFKNIWVVDISNALLIAASHERGLLGPLSRHCL

SEQ ID NO: 170777 - protein, 143 aa, Triticum aestivum
  Clone ID: PAT_TA_65195.pep
MAMQPGGEGETLMQRCKPYVAMISLQFGYAGMNVITKVSLNHGMSHYVLVVYRHAFATLSIAPFALFLERGKARPPRMTPLVFLNIFLLALMGPVIDQNFYYAGLKYTSPTFSCAMSNMLPAMTFVMAVIFRMEKVDLKRPGA

SEQ ID NO: 170778 - protein, 84 aa, Triticum aestivum
  Clone ID: PAT_TA_65196.pep
PPQGFPSHDKGRRRPAPKLGPAGATPASGLQHGAPVLQMVAPKKKNKRSAAPPAKEGGPSKDPPLMKSSTEHQWLFKGHAFRQL

SEQ ID NO: 170779 - protein, 92 aa, Triticum aestivum
  Clone ID: PAT_TA_65197.pep
YVGLHVDSADRQLCLLVKPPQVALRVSEALPHTVPHEAHVCHQVWLLGRCEIIAPRQRAPQVRPAGVVIVIRDHVIVLPLFLIFLVASHRVK

SEQ ID NO: 170780 - protein, 126 aa, Triticum aestivum
  Clone ID: PAT_TA_65198.pep
FTRPGVPTTAMTEIELQYAATFFAKMLPPVHGKVFVVTGFGYTLGLDLATATFVILQLPAGVRYNYMLSSAEGSGIYLVTADRFQLSVWLHRMTGDNHGAGGWLLVDTFSVLEACTRFAGDSLGAL

SEQ ID NO: 170781 - protein, 53 aa, Triticum aestivum
  Clone ID: PAT_TA_65199.pep
FRKELGTEYLTGEKTRSPGEEVDKVFIAMNQGKHIDALLECLKEWNGEPLPIC

SEQ ID NO: 170782 - protein, 80 aa, Triticum aestivum
  Clone ID: PAT_TA_65200.pep
HQIASGRAGGLKKTAASMPRHSIRNPTPKLKPLAAVLQRWRQGKTLAKQNVIAWHNIPLSTAGEKTNRPERTAHSNTCAD

SEQ ID NO: 170783 - protein, 85 aa, Triticum aestivum
  Clone ID: PAT_TA_65201.pep
LLTRAPTRSSTRPLTRSWTRGIEEFLFVVVFNIYVDIVSFSAIYCFVSRCMYNDELFVLLVFLGFQLLFVVIFWFIKKNLFFFFQ

SEQ ID NO: 170784 - protein, 49 aa, Triticum aestivum
  Clone ID: PAT_TA_65202.pep
LYSFFFFFFFICFFLFFILFFFLFLRFFFFSAQTCLSFFRENRHIAARQ

SEQ ID NO: 170785 - protein, 38 aa, Triticum aestivum
  Clone ID: PAT_TA_65203.pep
MRHASTKKKKKKKKKKKKKKKKKKKKGGQRGGRLRGSG

SEQ ID NO: 170786 - protein, 99 aa, Triticum aestivum
  Clone ID: PAT_TA_65204.pep
RQQAPLQSKPPAAPNHLWSPSVCHHGTCVHPDIVVGHYSWVSPHGLLLRNSLAPNGHVTFSCTIKNLSGSVNNIGSIVYILVSHESDRRVKDTRGWATE

SEQ ID NO: 170787 - protein, 70 aa, Triticum aestivum
  Clone ID: PAT_TA_65205.pep
ADAHGEGVNASARDPKNCVYHRGYGARVHHDLDRTADAVVCPCGERVRTHVVIMGLLGHSCSVEETMSKE

SEQ ID NO: 170788 - protein, 38 aa, Triticum aestivum
  Clone ID: PAT_TA_65206.pep
DLNLMYNIRRVILADGSDTCVHVVARLYKHCLTHRKHY

SEQ ID NO: 170789 - protein, 107 aa, Triticum aestivum
  unsure (1)..(107): unsure at all Xaa locations
  Clone ID: PAT_TA_65207.pep
RTHPAAAPPQQRQDGALPRPMEGLHEAGPPPFLTKTYDLVEDPATDXVVSWGRAGNTFVVWDPHVFAEALLPRLFKHSNFSSFVRQLNTYGFRKVDPDRWEFANEGF

SEQ ID NO: 170790 - protein, 52 aa, Triticum aestivum
  Clone ID: PAT_TA_65208.pep
CTLHDQSLHLAHLRSRRRLPSFPSKSYSYCVRASGCRAMGVSTSYLQLTCCW

SEQ ID NO: 170791 - protein, 55 aa, Triticum aestivum
  Clone ID: PAT_TA_65209.pep
RILSHPPCGAFLTHCGWSSVLESMAEGVPMVALPLHIDQPLNANLAVELGAAATR

SEQ ID NO: 170792 - protein, 74 aa, Triticum aestivum
  Clone ID: PAT_TA_65210.pep
PIGWVQFLIFVSEQNDHLVTNTSSSSLYVLLPKGDPDSVSISNRYVDLLLAETFVSDTIMLNLSLLSAQSSFIL

SEQ ID NO: 170793 - protein, 130 aa, Triticum aestivum
  Clone ID: PAT_TA_65211.pep
ASRQKSMLGSSHYMERQVEFAGMLSDDEDQNPDFHNWNKVKIRYCDGASFSGNVKDEFQSGTKFFFRGQRIWEAVMDELLLKGLRHAKQAFLTGCSAGGLATYIHCDGFRALLPKDSRVKCLADGGFFLD

SEQ ID NO: 170794 - protein, 110 aa, Triticum aestivum
  unsure (1)..(110): unsure at all Xaa locations
  Clone ID: PAT_TA_65212.pep
LSWEPMVMWRALREKKQXSEHERLSVTALECLAWSEVEINTSFFFNGYSRGAVGPEGLPVLLKLKDWPQHSSFEDRLPRHLAEFISALXFREYTDHKSGPLNLAVKLPKK

SEQ ID NO: 170795 - protein, 95 aa, Triticum aestivum
  unsure (1)..(95): unsure at all Xaa locations
  Clone ID: PAT_TA_65213.pep
RPRWPVARYLAPRLQTQSRARGCQTACLTAGEARRVRASPPVSPAPPRPPQTALRLXSPASMTSWSASSCTSATGFDGTGRGRAGRVSTRAEGRG

SEQ ID NO: 170796 - protein, 66 aa, Triticum aestivum
  Clone ID: PAT_TA_65214.pep
RLNSCMKWLPPGSDHANGGGVGAGNRCRWRVEWRPAAMECASRSSTRPLPTDVYFWEAKGQTPVFP

SEQ ID NO: 170797 - protein, 67 aa, Triticum aestivum
  unsure (1)..(67): unsure at all Xaa locations
  Clone ID: PAT_TA_65215.pep
TTPYWCIHILSCVIMQEAQNLSCLGHNWRRYPECVIMIKASSTPSICTVLTTXCCLAILMDVCLYCS

SEQ ID NO: 170798 - protein, 80 aa, Triticum aestivum
  Clone ID: PAT_TA_65216.pep
VLYLILLATVRHVFFYVGYCLGWFLSRTNILLSWLLYQVVSQIIDWCYDLDLAECLNSSFRNIRWNLANLIFFLFFCWLK

SEQ ID NO: 170799 - protein, 48 aa, Triticum aestivum
  Clone ID: PAT_TA_65217.pep
FLTSITQRILSGTCQFDTKILAVIVEPCIFGMICFSCCLQTNVDFSCL

SEQ ID NO: 170800 - protein, 90 aa, Triticum aestivum
  Clone ID: PAT_TA_65218.pep
RSIIMLLFVYITIYRSPFLTVSFSSRHLFAFQALLSEECVGLLAKISRLENGNRIPEWLKAMAGVYLTKFQCKLTPNVFQNFRSLRAVEH

SEQ ID NO: 170801 - protein, 50 aa, Triticum aestivum
  Clone ID: PAT_TA_65219.pep
STTAHLNETNIVSVFSSAATQGREWAVQPVGPPAQAPALRQEQQQLELAG

SEQ ID NO: 170802 - protein, 196 aa, Triticum aestivum
  unsure (1)..(196): unsure at all Xaa locations
  Clone ID: PAT_TA_65220.pep
ASQREKGGIRLVPNSARGSVTPLYAQTCLQTAPDWLKPNSGLITLLVGSSAYLRINCSIALIRDGHGVRXGGILPNLNLFIQQGTWGLTLSVHCAGLVGDESDRRRTPASAGVLPSHPICCPQPESALEPAGTSTVAPLFATTTRGTRSGCSRLSANSSRSGNLSTASSSSQPVTAVTGYLALGINVPTGRRGRVW

SEQ ID NO: 170803 - protein, 147 aa, Triticum aestivum
  Clone ID: PAT_TA_65221.pep
MVYIKNQKTRAYSKRFQVKFKRRRQGKTDYRARLRLTNQDKNKYNTPKYRFVVRLGNKDVTAQIVYATIAGDIVMAAAYSHELPRYGLEVGLTNYAAAYCTGLLLARRVLKNRDLDEEYEGNVEATGEDFSVEPSDERRPFRALLDV

SEQ ID NO: 170804 - protein, 60 aa, Triticum aestivum
  Clone ID: PAT_TA_65222.pep
IRVWEVYPLGPTIHQFMNAFTDHRDSEILIISHFSLLLGCALPKWMSSGFNDRPLAPFAG

SEQ ID NO: 170805 - protein, 130 aa, Triticum aestivum
  Clone ID: PAT_TA_65223.pep
LCIARMGMPLPGPPMNGTPFPQDAYFEITIIYLNTRRPEWSASRTSRRGHDGSGDSERSKLINFAPGAPDPIQETRAAKDDQGDKQRHLVMSLGLAAGPAAPARPSLAGTYASSIGFHSNGAVYLDGMKL

SEQ ID NO: 170806 - protein, 59 aa, Triticum aestivum
  Clone ID: PAT_TA_65224.pep
AAAAPPAPAASALSAPAPAAAGTASARIGPSAATATISARRRISPPIAPPALAARNWRE

SEQ ID NO: 170807 - protein, 70 aa, Triticum aestivum
  unsure (1)..(70): unsure at all Xaa locations
  Clone ID: PAT_TA_65225.pep
LLFIFRGVCSELMTVMPERQDNQVISLRGLNSPASHFXNRSYPCDTAHPKKTARRDGATLGRTLTTWYFK

SEQ ID NO: 170808 - protein, 152 aa, Triticum aestivum
  Clone ID: PAT_TA_65226.pep
ADFGLARIYQAPLKPLSDNGVVVTIWYRAPELLLGAKHYTSAVDMWAVGCIFAELLTLKPLFQGVEGGATPNPFQLDQLDKIFKVLGHPTVEKWPTLANLPCWQNDQQHIQGHKYENTGLHTIVHLPQKGPAFDLLSRMLEYDPRKRITAAQ

SEQ ID NO: 170809 - protein, 56 aa, Triticum aestivum
  Clone ID: PAT_TA_65227.pep
VVWDLNTTDTDALDPQATMANAAFLGAGKETEEARRRVERGRDEVATGPEHQERVA

SEQ ID NO: 170810 - protein, 45 aa, Triticum aestivum
  unsure (1)..(45): unsure at all Xaa locations
  Clone ID: PAT_TA_65228.pep
MPGEMKYVLVTGGVVSGLGKGVTASXIGVVLKACGLRITSIKIDP

SEQ ID NO: 170811 - protein, 89 aa, Triticum aestivum
  Clone ID: PAT_TA_65229.pep
MASSLLHCSDKLPFMDVETILHMKEGLDESSYAQNSSLQKRGMDTLKSLIVNSATDVYISQMPERFTVADLGCSSGPNALCLVEDIIGG

SEQ ID NO: 170812 - protein, 43 aa, Triticum aestivum
  Clone ID: PAT_TA_65230.pep
VNRINVLSPYPLKGRTTKFVSYRVDKEHKTCTQVARRTTNVVA

SEQ ID NO: 170813 - protein, 66 aa, Triticum aestivum
  Clone ID: PAT_TA_65231.pep
NQEAQEEVSLEGCFREVEMTTPPPPICKSFCNELAVTKRHFFPFYEVVVRDYLILIICLSLITNYI

SEQ ID NO: 170814 - protein, 63 aa, Triticum aestivum
  unsure (1)..(63): unsure at all Xaa locations
  Clone ID: PAT_TA_65232.pep
QPAGHLCDSPAMSIINISNNAISGSIPDFNNCKRLVSLSLSSNGLTGTIPXSLGDLPVLTYID

SEQ ID NO: 170815 - protein, 178 aa, Triticum aestivum
  unsure (1)..(178): unsure at all Xaa locations
  Clone ID: PAT_TA_65233.pep
WGATKNLGLNIEALKMELLLVKATLKLAASKQICGQAMEELLGKLRDSAHCAEDLLDELDYFRVXDELHGTCDAADHHAKGGVHDFAFNARHTAKAVGKRVXCCAWPRAQRSNVNSSLNPKANPERSHVSSSKPKANQEVSGCIPKLGKILPCSSSPNVRGEHSGQPTLTLCDAPQRE

SEQ ID NO: 170816 - protein, 55 aa, Triticum aestivum
  Clone ID: PAT_TA_65234.pep
MEDRRTILMDRGGSGRQLGQGNFAKVYYGRNLAGGQAVAIKMIDKEKVSRIGLIV

SEQ ID NO: 170817 - protein, 68 aa, Triticum aestivum
  Clone ID: PAT_TA_65235.pep
GHVIRAPHPVRQTDDFCHVGEVGVTGLRSDQPRLGDHLVVVLGKGQRGDRPGARRSPAHPPVRPRRRR

SEQ ID NO: 170818 - protein, 82 aa, Triticum aestivum
  Clone ID: PAT_TA_65236.pep
RACYSHIQNCFHNITGRRSTVKANSQIIMLNTACRIKLHCYDLQVHNLKYRILGRISEFCQVQTQKNTQSSTPRSISSLATP

SEQ ID NO: 170819 - protein, 39 aa, Triticum aestivum
  Clone ID: PAT_TA_65237.pep
SSIGMQPQGVDTCERGQLLIVHRDHADGVAAHHTQNKMK

SEQ ID NO: 170820 - protein, 39 aa, Triticum aestivum
  Clone ID: PAT_TA_65238.pep
LVWDDEAMSMEERRLALPMYQVHDETSQVSSGFLCFHYQ

SEQ ID NO: 170821 - protein, 69 aa, Triticum aestivum
  Clone ID: PAT_TA_65239.pep
YGGYGMATPGYAAPVPYGMSQVNIDGNYGGRPMPPQPTVKIYCRANPNYAMSVRNGKVVLAPANPKDDY

SEQ ID NO: 170822 - protein, 86 aa, Triticum aestivum
  Clone ID: PAT_TA_65240.pep
QKGHLVPAGSAHSAPLKLQDRTPCPGRMGALEQTVRVYTDKLGEHAAIGLTSDSVGETKYFYNLYSRKHGFGLKYGKSRLNIEKTK

SEQ ID NO: 170823 - protein, 146 aa, Triticum aestivum
  Clone ID: PAT_TA_65241.pep
STIGGGSASTLQQAVLMYLHSCSGANEGGRTTGGHRSNACQLTSSDAIAAPPTSARDVAHTEQPEPARAHVLDVQTNCHPGPSFRRDDGDGGDGQGRAKGFETGSHVRLTQFQQVVLEYLWKCGIKHTVSNRGKTLNPSHIDGHKT

SEQ ID NO: 170824 - protein, 63 aa, Triticum aestivum
  Clone ID: PAT_TA_65242.pep
SHMQLRPMIHAEFCIYMYVLDWRTTRGGREEARKVTMDLAQLPPIFLPAAVGQIKDVVLGGVA

SEQ ID NO: 170825 - protein, 49 aa, Triticum aestivum
  Clone ID: PAT_TA_65243.pep
GTRPQPAARSCRQRDVHAAPRERAHPHLESVDSANIHAARAHSANIPLT

SEQ ID NO: 170826 - protein, 75 aa, Triticum aestivum
  Clone ID: PAT_TA_65244.pep
NTMATSSFLLPVLLLVAVAGAEAATFTVINKCQYTVWAAAVPAGGGRKLDAGQTWSIDVPAGTTSGRVWARTGCS

SEQ ID NO: 170827 - protein, 83 aa, Triticum aestivum
  Clone ID: PAT_TA_65245.pep
LRGLVKLQALVRGNILRRQAAETLRCMQALVSVQSRARASRATRSRQAAAHPGATTPEKYEQAAYDGALRHGRSGSLKGGSSK

SEQ ID NO: 170828 - protein, 102 aa, Triticum aestivum
  unsure (1)..(102): unsure at all Xaa locations
  Clone ID: PAT_TA_65246.pep
YWLLLITSHVLTDSGEGETLLIPEALQAGFTNVVEVAQHPVVTLSWSIINFSRQCLXPGVRGRYFSPRLMEAVIWFLARWVATYLVPLDVSREIDSVGRHGS

SEQ ID NO: 170829 - protein, 59 aa, Triticum aestivum
  Clone ID: PAT_TA_65247.pep
WKYCGGLPLAIVTMAGLVACNPTKNNDHWSKVCKSLFPEQVAPLTLEGVTRILDYCYND

SEQ ID NO: 170830 - protein, 47 aa, Triticum aestivum
  Clone ID: PAT_TA_65248.pep
GGSDHTVLWPSHGEAASAASIERSQCRREPVDCGVIKQRGSLACLAA

SEQ ID NO: 170831 - protein, 46 aa, Triticum aestivum
  Clone ID: PAT_TA_65249.pep
SHVLPALIRRFHEAKATDAPEVVVWGSGSPLREFLHVYDLADAVIF

SEQ ID NO: 170832 - protein, 126 aa, Triticum aestivum
  unsure (1)..(126): unsure at all Xaa locations
  Clone ID: PAT_TA_65250.pep
MALFAAARRAVSSSLPLLRASASRGAASRGAALLRPLAAAAARPMPFSSATALKPSSDDELLRGGKAEIKFXEDCDDHDRVEEIPXSFPFKITDNKGLNDITLTRTYQGEKIEVLVSMPNLVTGDE

SEQ ID NO: 170833 - protein, 104 aa, Triticum aestivum
  unsure (1)..(104): unsure at all Xaa locations
  Clone ID: PAT_TA_65251.pep
AEGGRRGLAAADSHQRQRLPVPSCGTSSVSVSAAGPGSXYDFEPXLPPLXDPSSIASLTSPSPPPSVPAPERRLAASXTPCRRTSHEWHAMLRGLAASDASLLL

SEQ ID NO: 170834 - protein, 46 aa, Triticum aestivum
  Clone ID: PAT_TA_65252.pep
RINHHFPNEGKTNFDKTAKIASIAYIQLLTSSPKKKHLPLVVLWIR

SEQ ID NO: 170835 - protein, 48 aa, Triticum aestivum
  Clone ID: PAT_TA_65253.pep
MKSSTLVAILILQAVLVMGILSQANAEFPKCCDNCRFFSGAVVCDDAG

SEQ ID NO: 170836 - protein, 62 aa, Triticum aestivum
  Clone ID: PAT_TA_65254.pep
GALVLVDEVKGRCLEPHIVLYNVCIDCFGKAGNVDMAWKFFHELRAQGLQPDDVSYTSMIWV

SEQ ID NO: 170837 - protein, 64 aa, Triticum aestivum
  Clone ID: PAT_TA_65255.pep
KARSSHEDEDGSLAYAAAQAGMPLHLASCSIDCFPVLLSRSAQVRASRRSLRAWMIEVGEERAV

SEQ ID NO: 170838 - protein, 122 aa, Triticum aestivum
  Clone ID: PAT_TA_65256.pep
GTTLMKAHHFIKASQIVDNPSGDFARKYRHISKGGWAFQVADQGWQVSDCTAEALKALLLLSKFPSDIVGDQMETCRFHDAVNVLLSLQNPNGGYGTWELARTYPWMENLNMTEIYADIMVE

SEQ ID NO: 170839 - protein, 211 aa, Triticum aestivum
  Clone ID: PAT_TA_65257.pep
TSLQTLQALEAQNESIKHLGELRQLRSLRLLNVKGIYCGRINESLVEMQYLSYLHVSASDENEVLLLNVSLPNLKKLSLRGRLAEGALDESPLFQAVGGHNLHMLSLRWSQLSKDPLPPLSRLSNLTDLQFSRAYNGEQLTFLTGWFPKLKVLELRDLPNLNRLDIQQGAMVSLKQLTLVNLKSMTEVPAGIEFLLPLQYLSFLEITNDFL

SEQ ID NO: 170840 - protein, 154 aa, Triticum aestivum
  unsure (1)..(154): unsure at all Xaa locations
  Clone ID: PAT_TA_65258.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAXIFSEGGLDYLGNPNLVHAQS

SEQ ID NO: 170841 - protein, 61 aa, Triticum aestivum
  Clone ID: PAT_TA_65259.pep
TTGLAGREAVVREDHPKPHRSGSQSGGGGAKRDERICAAAAILGLGTASPASPPAMAKRGG

SEQ ID NO: 170842 - protein, 111 aa, Triticum aestivum
  Clone ID: PAT_TA_65260.pep
PAFLPPAPKVNPRPRTWCRAVLPPLRLFHGHQQQQEESQAPTLTRFVPLYLVDLVCSSGCIAFFHSLVEEHIRCACHDCLFCLLFPSIVVMALGPSVAPIYKVAAGFWVLG

SEQ ID NO: 170843 - protein, 111 aa, Triticum aestivum
  unsure (1)..(111): unsure at all Xaa locations
  Clone ID: PAT_TA_65261.pep
LNLDASYDLCSNDFGRFSLVSRILCDHPGPARRFAFDRIHLHREEXKYAEEAAQLESWFNSPLLDNLQELDIVFSLLEYSCGQSEKEKRYPLPPSVLRLAPTLQLARIGSC

SEQ ID NO: 170844 - protein, 85 aa, Triticum aestivum
  Clone ID: PAT_TA_65262.pep
VKYPPLALFGNAHAAGSIGISSAIRSPAGCGVVLGDDLVLLELDWWWAAGGLRGGRGRRARGCCWIGGARGWGRGVAEVGGASAM

SEQ ID NO: 170845 - protein, 51 aa, Triticum aestivum
  Clone ID: PAT_TA_65263.pep
PPPPMLKVACWFCEEAGEMDARISTRTAMPRGKLCPCCMVTGYKEMNYLIV

SEQ ID NO: 170846 - protein, 87 aa, Triticum aestivum
  unsure (1)..(87): unsure at all Xaa locations
  Clone ID: PAT_TA_65264.pep
RKRSPVIGDSVPVLMYLDKGLLDQVVAEVARSIKLPRKQSPEKLVDLCYDVAGXDQGMGESFPXVTLGFGGGAVITLPESQTICVGR

SEQ ID NO: 170847 - protein, 110 aa, Triticum aestivum
  Clone ID: PAT_TA_65265.pep
KGAPPLTDKVLLPIMRWEATSFGRPVLALVLVMSMSVFPTVFLPSFPSMWLTGIIFGYGLGLLIILVGTGIGMSIPYWIGSLFLHHIHGWLEKKWPQQMALIKLAGRGGW

SEQ ID NO: 170848 - protein, 88 aa, Triticum aestivum
  Clone ID: PAT_TA_65266.pep
IAVNSVFEMHRLLAQPGALEKVLGTVRAVRPRIVTVVEQEANHNSGTFLDRFTESLHYYSTMFDSLEGGSSGGPSEVSSGAAAAPAAA

SEQ ID NO: 170849 - protein, 144 aa, Triticum aestivum
  Clone ID: PAT_TA_65267.pep
PSPRAFRLTRDMVRARARDGVIVVTFGNYAFMDFILTWVRHLTGLGVDNLLVGAMDTKLLRQLYLTGVPVFDMGSRMVTEDVGWGSPTFHKMGREKVLLINELLPFGYELLMCDTDMVWLKNPLPYLARYPIADLLTSSDQVIP

SEQ ID NO: 170850 - protein, 90 aa, Triticum aestivum
  unsure (1)..(90): unsure at all Xaa locations
  Clone ID: PAT_TA_65268.pep
MRECISIHIGQAGIQVGNACWELYCLEHGIQPDGQMPGDKTVGGGDDAFNTFFXETGAGKHVPRAVFVDLEPTVIDEVRTGTYRQLFHPE

SEQ ID NO: 170851 - protein, 110 aa, Triticum aestivum
  unsure (1)..(110): unsure at all Xaa locations
  Clone ID: PAT_TA_65269.pep
MGASGKWIKTLVGLKTAAAEKERHAGGKGRKWSRLWRSSSGGQRGAAXAAAXEVSETSSAAADALSSVVAAVVRAPPRDFRVIRQEWAAVRIQTAFRGFLARRALRALRG

SEQ ID NO: 170852 - protein, 126 aa, Triticum aestivum
  Clone ID: PAT_TA_65270.pep
SYGPNHSAMSGWVRGRDPTRLIHYEGGGSRTSSTDIICPMYMRVWDILKIANDPSENRPLILCEYSHAMGNSNGNIDAYWKAIDNTMGLQGGFIWDWVDQGLLKEDADGSKSWAYGGDFGDIPNDL

SEQ ID NO: 170853 - protein, 54 aa, Triticum aestivum
  unsure (1)..(54): unsure at all Xaa locations
  Clone ID: PAT_TA_65271.pep
IQSAINDRRLNFAEMQVDKQPFPINTMDLEGKKMLIRPXIAEFANKDNVVIGEP

SEQ ID NO: 170854 - protein, 92 aa, Triticum aestivum
  Clone ID: PAT_TA_65272.pep
PRARAAAVLALALLPTLAAAGIDFRREAPPPGHTCGAQGTYAPGSAYEANLRRLGATLPSQANASSCKCSPGNNAGERPDRVIASAYCYWLP

SEQ ID NO: 170855 - protein, 158 aa, Triticum aestivum
  Clone ID: PAT_TA_65273.pep
PLITWSEWYLNLEEMVRKYSGKRPDVIVVASENTTVGFSEEVINRHMSLVDYEKTRPENPEREAEESIPEVMRTTPDDATTSSNGESFFSPDLHQPKTLDHFWESFKSPTAVKIARIVNASAQGNKPKLGKISIIDKDSSTSAPAPAKSSRKNKWEAR

SEQ ID NO: 170856 - protein, 50 aa, Triticum aestivum
  Clone ID: PAT_TA_65274.pep
GTGPCLQLSTYRFVKSGCGCSKPWSQPGNTKSCFSLCLVLGGQNFASSIV

SEQ ID NO: 170857 - protein, 143 aa, Triticum aestivum
  Clone ID: PAT_TA_65275.pep
RRTLPEVGTCGRRSTTKGLQKSTEGRRTKRAYLTTRSSTNSRPFSSILPCRRPFSTPHGGGLVFSGHLELLPSRPRDLRSGSRFLDEHVRIADVELRRLTLTICKRIQQWGEGWERWRWLSGREAAAVAAEREMGAAPHERRV

SEQ ID NO: 170858 - protein, 95 aa, Triticum aestivum
  Clone ID: PAT_TA_65276.pep
RRRRPRWRRPSPPRRSRRRRRPPRRPRPRSRRLLPPSRSRRPRRWHLPPLRRRRPRSPSQQLRPSRRPRPPKRQRRQPWSRQRPRRPWLRQSQRR

SEQ ID NO: 170859 - protein, 112 aa, Triticum aestivum
  Clone ID: PAT_TA_65277.pep
GAQQLPTVLLAVCSTLLGLAAPLLAGDPDMLQDFCVADYKSLDGPLRLNGFPCKRPENVTADDFFSAALAFPGNTGNPVGSAVTAANVEKLPGLNTFGVSMSRVDYAPWGVN

SEQ ID NO: 170860 - protein, 102 aa, Triticum aestivum
  Clone ID: PAT_TA_65278.pep
PAIDNPLDPSIPRAALSLRPVALLPLRETHLCFRGDPLLWNHRSVAPEDMPGLHFRWWAARANQIEEVSHRLERSSKELCLAQHKAEAQVDLSGEMLRDVSS

SEQ ID NO: 170861 - protein, 71 aa, Triticum aestivum
  Clone ID: PAT_TA_65279.pep
GGKSLRQVYDVVLYIGIIDILQEYSMRKKVEHAYKSIKYNPQSISVVEPRFYSERFLSGGRTVFPENSPNQ

SEQ ID NO: 170862 - protein, 115 aa, Triticum aestivum
  Clone ID: PAT_TA_65280.pep
RSLGGLEESTREFTAGMEMLAGVQDGLNIEQEYINAMRTQSNVRFLSNKEEMEALLQPQQDLILPMLHKMGQKKSAEIKLAMSGYFDASAEASEICKQLLRNIKNTESNYQSMDS

SEQ ID NO: 170863 - protein, 106 aa, Triticum aestivum
  unsure (1)..(106): unsure at all Xaa locations
  Clone ID: PAT_TA_65281.pep
PETTKCPKASITVYEPDMGVYFTSDMTSSCEGPYSSATESLQRSKSSCKYSGRGNAIYMKPPYPPGKVVSSQKTQEVLASYQYNVHQKNTSCXNEQRSAKSSVSTN

SEQ ID NO: 170864 - protein, 85 aa, Triticum aestivum
  Clone ID: PAT_TA_65282.pep
TCCRHPPAATAAAGTGRPPYPVRVLGVGDGIVDLSVVALPLLPSVPPACRLDPSSPPGRPPARHCLRLAVKQPPATERSGENCRA

SEQ ID NO: 170865 - protein, 129 aa, Triticum aestivum
  Clone ID: PAT_TA_65283.pep
GASLKWLQSISSPPPLLKKLNLRGDLGEMPDWFGDLEHLVKIDLMLNNLKDGDKSMKLLGALPKLMLLRLSWDSYVEEKLVFRAETFTNLKRLNISYMEKLTELVFEEGTSLLLEKIEIRGCSLPSGIS

SEQ ID NO: 170866 - protein, 125 aa, Triticum aestivum
  Clone ID: PAT_TA_65284.pep
HQVQARPAVLAYRYTEVSNRLTASSVYVHGFRAQGIPLAVFLASVEPHSGHSGHTAGKACIRQSPAQGIPLAVFLASVDPHSGHNGHTAGKACIRQSPRRGLSRPGNGHASRAGEACGQGARNRA

SEQ ID NO: 170867 - protein, 79 aa, Triticum aestivum
  Clone ID: PAT_TA_65285.pep
VLLPGCVPLHGADLLEPLQNRSDPVYRLMIELGRNYLLAEGFIINTMDALEHETLLAFKELSDKGVYPPAYAVGPFTRR

SEQ ID NO: 170868 - protein, 66 aa, Triticum aestivum
  Clone ID: PAT_TA_65286.pep
QVDQDLRALFYSSVTLALALAVQWKRSVVRVWLCFQDPLMSYMLWNFVLFVVCCRCWGLLFSGLRF

SEQ ID NO: 170869 - protein, 166 aa, Triticum aestivum
  Clone ID: PAT_TA_65287.pep
CGSNTFHLVDLFPSSLLVRLLSGATSHLRSCHSRIQRILGDILVERKEKEAASDSAGRRDDEDLLDVLLRLQKEDTLNFPLTSEIIGAVIFDIFAAATDTSATTLEWAMSELIRNPEVMTRTKLEVRQISLAPGQSMITSADLGNLHYLRRVIKETLRLHPPAAVI

SEQ ID NO: 170870 - protein, 60 aa, Triticum aestivum
  Clone ID: PAT_TA_65288.pep
KRAKQFTRGLASAEHSKTNTHHHSYKEPKTNLSQSVRHHAVQMTRVSNPRLSSFAKHNKS

SEQ ID NO: 170871 - protein, 102 aa, Triticum aestivum
  Clone ID: PAT_TA_65289.pep
MHIKEVCLEGFKSYAGRTVVPGFDPLFNAITGLNGSGKSNILDSICFVLGITDLRAVRAASLQELVYKQGQAGVTKATVSIVFDNSDRARSPLGYEDSAEIT

SEQ ID NO: 170872 - protein, 161 aa, Triticum aestivum
  Clone ID: PAT_TA_65290.pep
RKVEVPGTLNIFLNEKLNVAASESSFKIIEAVLHRTDSTKDKDSLDCRSFSQHMAFNIIGAALFGDVLFDWSDAAAYEELLMVVAKDGCFWASYAVPPFWKPGYRRYRTLCAKLKILTESIIRKSIDQNGALRHNNLSSSKISEGVVKDPVRCTSLLDGMI

SEQ ID NO: 170873 - protein, 111 aa, Triticum aestivum
  unsure (1)..(111): unsure at all Xaa locations
  Clone ID: PAT_TA_65291.pep
SGWASLPTDIAGLVSGRLLGEDVVDYLTFRAVCSGWRASTSDLGILALSKPQLRPRGWIALCDGDGAPLDGAGEITLFNTRTARRLRVRLPDLRCXRVVGFTDGLGILLRK

SEQ ID NO: 170874 - protein, 57 aa, Triticum aestivum
  Clone ID: PAT_TA_65292.pep
LKVKEIKNGRLAMFSMFGFFVQAIVTGKGPLENLADHLSDPVNNNAWAFAPNFVPGK

SEQ ID NO: 170875 - protein, 74 aa, Triticum aestivum
  Clone ID: PAT_TA_65293.pep
TNGPETSPRGMAFHQRAFSASRSETRASRSAMRGDVAASSASRTHTFAATAAAASISSGGDGRGRRCGGTAVEP

SEQ ID NO: 170876 - protein, 115 aa, Triticum aestivum
  Clone ID: PAT_TA_65294.pep
PPPGHLRRRRRLVTSPRPTSREQAVRVVVKGRVQGVGFRDWTAETAESLGLAGWVRNNRRDGTVEALLSGDPAKVDEMVTRRLPVGPPAAAVTAVVTSPADHIHPSLGFEIKLTV

SEQ ID NO: 170877 - protein, 153 aa, Triticum aestivum
  Clone ID: PAT_TA_65295.pep
TASGQKATTAAEPSLGTEQKKTSSIKWSCNTCQATGSGQSGLEAHLKGKRHQQNISATSMPKNGAAGEAKSLGINVPKRSEKPPSAWSCSICQAICTSESDLNSHLRGIRHQAKVQSLLEGKNMARKEKLNPDSRWACRICQAHCTCESDLEN

SEQ ID NO: 170878 - protein, 80 aa, Triticum aestivum
  Clone ID: PAT_TA_65296.pep
VRVERITRREQVDSSCLSQNINKTAAFDSPCHGSKYCVHRSILQYRLAADIVHRPIYLSSQPQYWSHLPISGHTTPLGPN

SEQ ID NO: 170879 - protein, 57 aa, Triticum aestivum
  Clone ID: PAT_TA_65297.pep
KLEKLDRRASISAEKLCRLSTRSLLEEALLLVETRLLVLPSRRNLRSSFSAVDGEQL

SEQ ID NO: 170880 - protein, 121 aa, Triticum aestivum
  Clone ID: PAT_TA_65298.pep
LFLRRRRRPDRAGQGTTRRSPIRHGRKRNRAGRERTVCYDCFVRRCWRCSRAGSFLRSPTAPTVGTRSLALPSVLLFDLLFYSPHPDAPSLFPSIRTRKRSSSAHRHWLWLAVPRSSFLPA

SEQ ID NO: 170881 - protein, 63 aa, Triticum aestivum
  Clone ID: PAT_TA_65299.pep
PIHGGGRSRGDEMLDRPSHLIHPSNSLDPSSAGSWTSETRSWCVLDGLLVLATKFLSIYDVII

SEQ ID NO: 170882 - protein, 161 aa, Triticum aestivum
  Clone ID: PAT_TA_65300.pep
SGAVTATAITEDILFPLAMSLRSVCLKDLYSALCFVPLVSSSPNLRSLKILRCSGAWDLPLEVIAARAPGLVEIHLEKLQVGDRGLTAVSACANLEVLFLVKTPECTDGGIISVAQNCHKLRKLHIDGWRTNRIGDCGLMAVARGCPDLQELVLIGVNPTV

SEQ ID NO: 170883 - protein, 146 aa, Triticum aestivum
  Clone ID: PAT_TA_65301.pep
LYWAEQDREPSFSISSFCGVKDLKLYNVESLGFGGKLHINDGDSWINCSAGVSVSSLWCNLGLTFKQPGLFTATCSSRMGNRNTVLGGYISYSYEEDRTKFAAGVQHSVDSSMYLKSCIGSDKVLRSFVSKSFGKSRLILVTEVNF

SEQ ID NO: 170884 - protein, 45 aa, Triticum aestivum
  Clone ID: PAT_TA_65302.pep
RPPSSRANSRSPSAPSPRRSSPSSASTPPTWTTPSSPYRPSSWPP

SEQ ID NO: 170885 - protein, 93 aa, Triticum aestivum
  Clone ID: PAT_TA_65303.pep
VGISNEPSHVHLNPTTITLLALDSWHPTKHMQRSDLTNRELLQGVDMHTLLGCYWQKNKINNARDLAKQDCIHIKIFPDFNSEGNRSGYTTMS

SEQ ID NO: 170886 - protein, 90 aa, Triticum aestivum
  unsure (1)..(90): unsure at all Xaa locations
  Clone ID: PAT_TA_65304.pep
MASPAFAVSAAGLARPSTPRSGGAXRRGRGVELQSPSLLFGRNKGTRSPRAVSVGGSGWRVVMRAGGPSGEVMIPDGGSGGTPPSIDGPV

SEQ ID NO: 170887 - protein, 146 aa, Triticum aestivum
  Clone ID: PAT_TA_65305.pep
MAAAAGGTSSEGAARVLLQRYQPFGSPPGEYHHFGPADGGGSADMTEAVVLRTPLKRKHNREDNEVAESNDWMMSPGYANAANSPIPTPPSGKGSKMSAKPKAAKGQKSCPQTPLFSGSPGNPATPVGGCRYDSSLGLLTKKFLNL

SEQ ID NO: 170888 - protein, 116 aa, Triticum aestivum
  Clone ID: PAT_TA_65306.pep
HKSLVRLDAVEPSLMNVVHHFKLKPAFKSIWTALARVNHYKYQAWPEFKVKFKRRVSAYVADWKDPINLDSKDRAPGLGVDDTEPKGWAQRYCEVKDNILQLLTARWFGVGFGNPH

SEQ ID NO: 170889 - protein, 50 aa, Triticum aestivum
  Clone ID: PAT_TA_65307.pep
IQFVLPGVLHQPIKYTLPKKVLYHLIYMTTNMTHISIRLRFDKSSSPNAF

SEQ ID NO: 170890 - protein, 100 aa, Triticum aestivum
  unsure (1)..(100): unsure at all Xaa locations
  Clone ID: PAT_TA_65308.pep
ILLHSCYQIVTKWHVDSVTASYMIRRTDCALVGEQSMKLNSDNKPPTGTTANQDKQHMWPEWKLGAGPPANNPTLLAVSCHGKRXVFPHINKANHSRSTQ

SEQ ID NO: 170891 - protein, 101 aa, Triticum aestivum
  unsure (1)..(101): unsure at all Xaa locations
  Clone ID: PAT_TA_65309.pep
TFTPLHGADRSPEACARSTFAAANRQWRRLHLRSSSSWSGTCGPSRASSWGRRRGRFQPXGKAPVGRSVRHSPPPRRSGQARRQRAPAARVGSSMRLLPSR

SEQ ID NO: 170892 - protein, 146 aa, Triticum aestivum
  Clone ID: PAT_TA_65310.pep
SLCLTGPSRAILAVDPVDFEVELKIHDGGDERKDRELIWAINHYDIAYNGEQPSLTFHSPLCRAELRLERLPTTVQATILSVHVVGGGSLFKSGGQVFCSSSSADSSAARREKIVLLDYVETNSAAKNERHLDGYLPLSRNVVSVE

SEQ ID NO: 170893 - protein, 97 aa, Triticum aestivum
  Clone ID: PAT_TA_65311.pep
PWGPATSSPVHPLAARSKARAAAALAHVMARPGARVAAADSDSDENGHGDDDGGTDGRYGGGRSPLHGYVAKSAGGVKDKFFGMALPKLGRNGVDSG

SEQ ID NO: 170894 - protein, 83 aa, Triticum aestivum
  Clone ID: PAT_TA_65312.pep
DQNRHLHLLRALLVRRCPAAAASHALPAGTRGVPWRHCGCTPTVSPDGAVAAAAQSGTGMKEGRGEACGGRRAVMEKAKERSC

SEQ ID NO: 170895 - protein, 157 aa, Triticum aestivum
  Clone ID: PAT_TA_65313.pep
TSPPLASSPAGDFVCPLPPPSSSPSPSPPAGELVAVATSKLVSIAVAPSARLPLPLDLAMEHLQDMASVMYDDIPPDCFNAKVPLHVFKYPDNEVIPFSWSVRTQEGGSTKWIRASKFDPFVASCRTYGRTEAAPILPSSLHVTVMVYMPLRDAYQL

SEQ ID NO: 170896 - protein, 139 aa, Triticum aestivum
  Clone ID: PAT_TA_65314.pep
TRRPAVLCSAEGVYFVEATANCTLADVNFLERPLLLGKDQLVPYPTPELWAVEPQNSLAMIQVTAFTCGGFVIGLRTNHAVADGTGAAQFLNAIGDLARGLPEPRVKPVWGRDRFPDPDIKPGPLPELLALALEYIAFD

SEQ ID NO: 170897 - protein, 139 aa, Triticum aestivum
  unsure (1)..(139): unsure at all Xaa locations
  Clone ID: PAT_TA_65315.pep
MERELAKRFSYHNSSVQCIKALXRKVWVGYASGAVQVMDVEGNPLGGWTGHSCPVIQMAIGGSYIFTLAHHGGIRGWPLTSPGPLDDILRTELAKRELSYTRVENIKMLVGTWNVAQEKASPESLWSWLGTASSDVGLV

SEQ ID NO: 170898 - protein, 55 aa, Triticum aestivum
  Clone ID: PAT_TA_65316.pep
MTPGAGPHCGMAAAAGVWQLVGVAVATLLAAVLVAVALGRQRQRRRRAPLEGIPA

SEQ ID NO: 170899 - protein, 32 aa, Triticum aestivum
  Clone ID: PAT_TA_65317.pep
QIHEFVNGGSSHPDKDEIYMMLWNLSNMVASA

SEQ ID NO: 170900 - protein, 129 aa, Triticum aestivum
  unsure (1)..(129): unsure at all Xaa locations
  Clone ID: PAT_TA_65318.pep
VRPIWDAVDSRQYKSALKLCTALLAKHPTXPYALALKALTLERMGKPDEXALSVCLEAKELLYSNNIFHFDDLTLSTLQIVFQRLERLDLATSCYEYACTKYPNNLELMMGLFNCYVREYSYVKQQQTA

SEQ ID NO: 170901 - protein, 139 aa, Triticum aestivum
  Clone ID: PAT_TA_65319.pep
ESVQCSEHQKLRCKTFGKSIQANDHFELKYFGRIPCIEARGSEGGSGRWPGARWRRRSRRGPPRGFPIFISPASFSAIRASTGWAGSPRRGTGSRGHPGWSPSRTARHRCGGGRDEVRVGAGPTGARGAGSWKGNRHPW

SEQ ID NO: 170902 - protein, 136 aa, Triticum aestivum
  Clone ID: PAT_TA_65320.pep
YYDRKAALRTYGRHMTGQAVGPVVGRDDEIDRVISILCRKTKNCAALVGPAGVGFTAIAEGLVQRIATGKVPAALAGARVVEVDLGAMVAGTRYRGMFEERMKSVINQAEKAIGKIILFIDEMHMLLGAGAGRGVT

SEQ ID NO: 170903 - protein, 84 aa, Triticum aestivum
  Clone ID: PAT_TA_65321.pep
CLQQPCSFRLEADDLPIRGDIRPVIAVKSTAHAMVGFVNDAFAGNMSNSVIILFIQKQIPIASSNNCTKKRPHNHHQCREWSWK

SEQ ID NO: 170904 - protein, 105 aa, Triticum aestivum
  Clone ID: PAT_TA_65322.pep
QLMATGGEGGNGLEFLSDPVDRFPLPDLASSDLTPTGEPDTGLTQSAAESSMGYVGDLPLTIQLPMNNGCEELSLSAADSQQSTGKDDPQAPGWTKREKKATVNS

SEQ ID NO: 170905 - protein, 121 aa, Triticum aestivum
  unsure (1)..(121): unsure at all Xaa locations
  Clone ID: PAT_TA_65323.pep
GAECADPNQRRVYLSYLDSVKFFRPDVKTVSGEALRTYVYHEILIGYLEYCKQRGFTSCYIWACPPLKGEDYILYCHPEIXKTPKSDKLREWYLSMLRKAVKERIVVELTNLYDHFFITTK

SEQ ID NO: 170906 - protein, 61 aa, Triticum aestivum
  Clone ID: PAT_TA_65324.pep
MASKKILKELKDLQKDPPTSCSAGPVCEDMFHWQATIMGPSDSPFTGGLFLVNIHFPPDYP

SEQ ID NO: 170907 - protein, 58 aa, Triticum aestivum
  Clone ID: PAT_TA_65325.pep
MAGKGDGPAIGIDLGTTYSCVGVWQHDRVEIIANDQGNRTTPSYVAFTDTERLIGDAA

SEQ ID NO: 170908 - protein, 132 aa, Triticum aestivum
  Clone ID: PAT_TA_65326.pep
ASTPLLVSSSDALRLWHAPLDDLSASAPAPELRSVLDNRKASASDFCAPLTSFDWNEIEPRRIGTACGDTTCTVWDIERGVVETQLIAHDKAVHDIAWGEAGVFASVSADGSVRVFDLRDKEHSTIVYESPR

SEQ ID NO: 170909 - protein, 107 aa, Triticum aestivum
  unsure (1)..(107): unsure at all Xaa locations
  Clone ID: PAT_TA_65327.pep
HSSSRARRXHEPAEGRHSGYGKRRGTREARLPTKILWMRRMRVLRRLLRKYREAKKIDKHMYHDMYLKVKGNMFKNKRVLMESIHKSKAEKAREKTLSDQFEAKRAK

SEQ ID NO: 170910 - protein, 94 aa, Triticum aestivum
  Clone ID: PAT_TA_65328.pep
VNQDSKTHLRYTFDHHHHVHNMYISSQLTNSWSRHGLQLLANRKAPQRQHGKEGMGSHTSQGRGFSDIKRRESRASHCQDFTRRLHSSPKSQTS

SEQ ID NO: 170911 - protein, 90 aa, Triticum aestivum
  Clone ID: PAT_TA_65329.pep
SFLDCNQNRPCFEFIIRVSIGGGNPAAIYISGRADTAVPANLPRRPILVATTREPSAAKFTVTNSSRASADLRCSHGEGQSRRSVEQVAR

SEQ ID NO: 170912 - protein, 141 aa, Triticum aestivum
  unsure (1)..(141): unsure at all Xaa locations
  Clone ID: PAT_TA_65330.pep
QSRPTVLSRTPWTPRPPAPRGKKGAAGRKAGGPTKKSVTRSVKAGLQFPVGRIGRYLKNGRYAQRVGTGAPVYLAAVLEYLAAXLLELAGNAAKDNYNSRIIPRHLLLSVRNDEELGKLLAGVTIAHGGVIPNINPVLLPK

SEQ ID NO: 170913 - protein, 45 aa, Triticum aestivum
  Clone ID: PAT_TA_65331.pep
ASPSRASRFRSISIGYSDEAGELGKGWRWVIRIETIELEFCVWKN

SEQ ID NO: 170914 - protein, 115 aa, Triticum aestivum; identical to SEQ ID NO: 133896
  Clone ID: PAT_TA_65332.pep

SEQ ID NO: 170915 - protein, 156 aa, Triticum aestivum
  unsure (1)..(156): unsure at all Xaa locations
  Clone ID: PAT_TA_65333.pep
CLLHRFSCLSVFHCKSLEVIENRAPNLCFVRIDGAVEKLPVGDLLQMKRLHMLDYYESDLVDDARSKLPFIMPNLETLNLSSAGEMFNTPILTVRFLFLKNLLIDLNADRXGFSPSYDYFSLAYFLDACPVLEKFVLGVSQTRVKHELISDGYMNM

SEQ ID NO: 170916 - protein, 159 aa, Triticum aestivum
  Clone ID: PAT_TA_65334.pep
VSSKKVSLPTPQGWVLVLSSSGSSLEDAGTHLLNPKDGSIIELPTLNDDEVPLTCRCVLSNVVVAPGCSVIVFDHASPVMWFCRVGQDLRCSRHGYDIGCLDILGCPPTKRNFFHVAAVNGRFFFFQSNVDSLGTLDFQANDASEKPEARLGAIAVPRV

SEQ ID NO: 170917 - protein, 146 aa, Triticum aestivum
  unsure (1)..(146): unsure at all Xaa locations
  Clone ID: PAT_TA_65335.pep
MECIVELQQEREHCVTEVPEVDGAELLLELLDASLAAEDEEEAAALGGKHHQLGFPAEDVGEGWVDDGLQELNSIHPHXEAGCEDCGLDGIVVSGFNGCGCSPGPYVLDDVGNAVGYWAEEMEGAGFGFFNGDCVGEWYSDRMAVE

SEQ ID NO: 170918 - protein, 123 aa, Triticum aestivum
  Clone ID: PAT_TA_65336.pep
VKQGCLKKSSTKATTIEEARPPAWDLLTTPGRRRAPHSRRHPLGSSSSLRGWHHLAPGLHHSEHIGEVGEAGGGVESRRRRRTPAMYAVGTGSMASVRGGPARVDARDGRRRPHWTSWTSFRA

SEQ ID NO: 170919 - protein, 76 aa, Triticum aestivum
  Clone ID: PAT_TA_65337.pep
YLTTAHRQMELGSARRQQPHAHPNPAVGPAATTAASDRGVGLGCHSSMGRYEWRWAWRGVDWGVRAGIGGEWPHVG

SEQ ID NO: 170920 - protein, 83 aa, Triticum aestivum
  Clone ID: PAT_TA_65338.pep
PITLDLKSSAFDPKEKVWTRFPPESSKYTPPHSSCDFRWKDYCPQVFRTLRKLFKVDAADYMLSLCGDQALRELSSPGKSGSF

SEQ ID NO: 170921 - protein, 131 aa, Triticum aestivum
  Clone ID: PAT_TA_65339.pep
QPVCFLLPLDLLMPFPGATTSAALASGSILAARGAGAHDAPCVMGGGADVVPDSAIGSSDPAVGPVSPDVPELDQGVGLADGEFSGASCKTFSSGGGDVASGLATPAGVSHNSAQSSGCSGPADSCTTFSS

SEQ ID NO: 170922 - protein, 175 aa, Triticum aestivum
  Clone ID: PAT_TA_65340.pep
RFRKIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAIT

SEQ ID NO: 170923 - protein, 136 aa, Triticum aestivum
  Clone ID: PAT_TA_65341.pep
RPPGACPRARSPSPAAGTERRPIQRHRRQERTRAATARRARTGREQPRTAAANIYRIGEEEPREDFYKEETVKNVRSARAGFPKIWRLSTRGLPPATTRPPPPALPCLACGGDRRRGRGGGGRGFVGRSGGGKPWS

SEQ ID NO: 170924 - protein, 139 aa, Triticum aestivum
  Clone ID: PAT_TA_65342.pep
HLFAVFVRHGACGAACSGFARDALPRLLLLAAEDDGAGAGGSLLATDPAGAFRAAMIGVNEEMHAAAAVDDSMSGTTAVAALVAGGALHVANVGDSRAVAGVWRDGRVAAEELSWDQTPFRADERARVKACGARVMSVE

SEQ ID NO: 170925 - protein, 136 aa, Triticum aestivum
  Clone ID: PAT_TA_65343.pep
WSGTDRFHFNAIVTPQDLEDTFNVPFRSCVVDGRAASVMCSYNQVNGVPTCADESFLRGTIRGKWHLEGDIVSDCDSVNVFYRDQHYTKTHEDAGAATLRAGLDLNCGPLLAVYTDGAVSQRKVTDSDIDAAVTNT

SEQ ID NO: 170926 - protein, 146 aa, Triticum aestivum
  Clone ID: PAT_TA_65344.pep
LIKRFESPSRPHKCRLPPSKHQSQVPRLCKPNSSQHKEPLHLQGALDQFESFDVTPIIGKEFPTANLKDWLEGPNSDELLKDLAITVSQRGVVFFRRQDDLDNDLHKRLAQRLGELSGKPSTCKLHIHPVSNSGRTLGGEDDEISV

SEQ ID NO: 170927 - protein, 91 aa, Triticum aestivum
  Clone ID: PAT_TA_65345.pep
LARTPRWERLTSRLGNVQGQKQDPARAAAHRLTTGRRCGRLMSAAEAGVEEWMEQRLALADHPPATSGHPPRGHAGKPQRPVCQTTVPHPH

SEQ ID NO: 170928 - protein, 91 aa, Triticum aestivum
  Clone ID: PAT_TA_65346.pep
YPLETEGMSPAHAVQAQILKIDQQETSLCSTILIKGDHHIPFSRQGDLIRGPPMTIRRIHLTNRIIKAQVIQAEGLRQGDYLERSTVRINR

SEQ ID NO: 170929 - protein, 62 aa, Triticum aestivum
  unsure (1)..(62): unsure at all Xaa locations
  Clone ID: PAT_TA_65347.pep
PVLRDGFFCKMNLTIFCAYLCHASIVNTSHVHXLIGLQLLIFYIKLYESHAAFAKIIARNPH

SEQ ID NO: 170930 - protein, 82 aa, Triticum aestivum
  Clone ID: PAT_TA_65348.pep
PRHGDRLQPLNAVPDLLATRNRPPSAQHLQPPDLTRPSPLSAKPIARRLAASNGGSGVRCCRCRMGQESRWVGGLAHHFRAV

SEQ ID NO: 170931 - protein, 118 aa, Triticum aestivum
  Clone ID: PAT_TA_65349.pep
MDVDGQPRWAERWMASRASFDTNRSSARTAAAAAAAAPGRASTDHRDQVKTLEIDTGRPFSYSTPRRHAPPSQHGNGSPMHRAHNQASATPSPGKARPPIQVRSASPRVERGTSGGGG

SEQ ID NO: 170932 - protein, 113 aa, Triticum aestivum
  Clone ID: PAT_TA_65350.pep
QPRPPWTTRPRGSSGGCWAWSGRRINRAREIKQAGHGLSERRKGLSRCTCGSLPLILFGQSPTPSLRRRAFPGPPPSGVFVKDRGRRGATLRLISHCAEPVVGEEELNYRKDK

SEQ ID NO: 170933 - protein, 161 aa, Triticum aestivum
  Clone ID: PAT_TA_65351.pep
LGALRDEFPRVYTIGPLAAAMHRRVDHGASGLSLWEEDAACMAWLDAQPVAGSVLYVSFGSLAVLSLDQLAEFAWGLAASNRPFLWVVRPGLVAGDRGMEALPADFLAETKGRRFIAEWCAQEQVLRHRAVGGFLTHSGWNSTTESIWAGVPMICAPGFAD

SEQ ID NO: 170934 - protein, 109 aa, Triticum aestivum
  Clone ID: PAT_TA_65352.pep
HYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 170935 - protein, 118 aa, Triticum aestivum
  unsure (1)..(118): unsure at all Xaa locations
  Clone ID: PAT_TA_65353.pep
QRSGGPSSRGASGESRGGGPEPGVPEVSHLGWGHWYTLKELEAATAMFADEKVIGEGGYGIVYHGILEDGTQVAVKNLLNNRXEREFKVEVEAIGRVRHKNLVRLLGYCAEGNQRMLV

SEQ ID NO: 170936 - protein, 121 aa, Triticum aestivum
  unsure (1)..(121): unsure at all Xaa locations
  Clone ID: PAT_TA_65354.pep
RREDWEADPARLVVRGVIARGTFGTVHRGVYDGLDVAVKLLDWGEDGHRSXQEITSLRAGVSQEVSVWHKLDHPNVTKFIDAIMGAGDLNIQTEDGNIGMPSNVCCVIVEYLAGGALKTFL

SEQ ID NO: 170937 - protein, 79 aa, Triticum aestivum
  Clone ID: PAT_TA_65355.pep
SRRSRRIPGSSPQAPASPPSPRQRPPRPAAREATSSAAPPTTAPGARRRRHSKHLTPRSAAAPSPSAAPPGSVPRRIPP

SEQ ID NO: 170938 - protein, 93 aa, Triticum aestivum
  Clone ID: PAT_TA_65356.pep
PTMSSPTCSVSSPSTPCPAPSERPRISTSTGLLSATPPTTTPTSTAARETTASACSSTRLAAWPASSCPSRPRSWTTLAPPSTSWPSPSGAGT

SEQ ID NO: 170939 - protein, 84 aa, Triticum aestivum
  Clone ID: PAT_TA_65357.pep
TLALDIAYTIYMNLEDLASALRIALLLDNKSIQYVKQVYTATDDLVLKKQFSYIIARHGLAMEIDDEIAADENDKEMLQEIVNN

SEQ ID NO: 170940 - protein, 81 aa, Triticum aestivum
  Clone ID: PAT_TA_65358.pep
FNSQYGLENAIDRTTVHRTKKLVALESHAEALYVFYVMYLFFCSISRNKEVCLNYAAYDLMYMSYLFHCPFTFGMALCSPQ

SEQ ID NO: 170941 - protein, 43 aa, Triticum aestivum
  Clone ID: PAT_TA_65359.pep
MASLFKDPSKLSVYRDRRFPGTQEEFEAALLASLTVYVGNMSF

SEQ ID NO: 170942 - protein, 82 aa, Triticum aestivum
  Clone ID: PAT_TA_65360.pep
QSEQVCEHDRVRPLPLFSSIHLLQSGERGVGRAGRVAAEAEARARGGVLEVGEHPPVHEEEEGDQGAPAEQPARAAPRLRRR

SEQ ID NO: 170943 - protein, 80 aa, Triticum aestivum
  Clone ID: PAT_TA_65361.pep
FFFFLRGKIKSYKLYSNKSTYSVKKVKPNRKNPSSPYPQMHQNVQIQILTRSLHFASVFSDPPPSGEDDDCLIVDRVGAG

SEQ ID NO: 170944 - protein, 86 aa, Triticum aestivum
  Clone ID: PAT_TA_65362.pep
PRLVSSRLPHLFSHVLASPHPARLSHLLCSPAPPAPSLSADPMAAAGSGWRQNTMENPVSLGAAWVDGAADLGMIPPLGAPRRRPT

SEQ ID NO: 170945 - protein, 159 aa, Triticum aestivum
  Clone ID: PAT_TA_65363.pep
CLTVPSCQVILKNSFLQRDPRAVIEFLISALPWLESGIISGIDKGLLEDIRRICSEFENGSDRAKRNACLAVEKLLQSTNKLPLIFRLLTAARLCMLTKQMNDRRNDAAAAAVQPHAEADRWSDDDEADTGEAASTSKKAVQKHKGKKKSKKSKGRGKK

SEQ ID NO: 170946 - protein, 117 aa, Triticum aestivum
  unsure (1)..(117): unsure at all Xaa locations
  Clone ID: PAT_TA_65364.pep
FLTNGRWWVQVDGLTLRGAGTIEGNGEEWWNLPCKPHXGPNGSTLHGPCDSPTLIRFFESSNLVVRGLRVENSPEFHFRFDGCSDVLVDGLFIRSPANSPNTDGIHVENTERVGIYN

SEQ ID NO: 170947 - protein, 49 aa, Triticum aestivum
  Clone ID: PAT_TA_65365.pep
SRFYGLCDELNRSDHTEVNFDMEGYLQTVMLRLPHQRCTCEGFDFSERV

SEQ ID NO: 170948 - protein, 39 aa, Triticum aestivum
  Clone ID: PAT_TA_65366.pep
MIISKKNRNEICKYLFQEGVLYAKKDYNLAKHPQIDVPN

SEQ ID NO: 170949 - protein, 61 aa, Triticum aestivum
  Clone ID: PAT_TA_65367.pep
PRQDRPPRRITTAAAPPSPSPPAPFKAEAGDGASAAAAARARRNARPAGSSFAFGAGGGAE

SEQ ID NO: 170950 - protein, 60 aa, Triticum aestivum
  Clone ID: PAT_TA_65368.pep
GGGPSFGYTPGTPDGPENWGKLSPTYKACGDGKAQSPIDIVIANAVPNPNLDTLTRVYAP

SEQ ID NO: 170951 - protein, 83 aa, Triticum aestivum
  Clone ID: PAT_TA_65369.pep
LSLLNPAMHHHGIAAKTASHLPVLPARRGAVRFRVRAAAAAPPAPAAKPGSPKKRGKTEVNEWGLTPRFYTTDFDEMDQLFNA

SEQ ID NO: 170952 - protein, 82 aa, Triticum aestivum
  Clone ID: PAT_TA_65370.pep
MASYAAFLLLVAALFVCCCHAQGGDDGAVAAIYSLGDSITDTGNLAKEAPPGAFERVEHLPYGVTFGRPTGRCSDGLLVIDL

SEQ ID NO: 170953 - protein, 113 aa, Triticum aestivum
  Clone ID: PAT_TA_65371.pep
ANPAVTRSATAIASPAAAPALVSVRGQSPYYSSAWARVSAGCCSLASGLTWVLGGKNMGAPESLAVGKGADLEAWIWMEGRVGRSLGACCMRPEIAGTGRRGWWRRRRDRGGE

SEQ ID NO: 170954 - protein, 133 aa, Triticum aestivum
  unsure (1)..(133): unsure at all Xaa locations
  Clone ID: PAT_TA_65372.pep
SCTPPFLQPPPPRRSTPNHPPSSVPLAPARHTPLLTFSPHPLPPAAILQRIWLDPDPPSPPPPHGCGGAQPTPRRCAGRPQXTGGEPPSPLSFPSSSSXTSPATDPVPIPTVPPPSPTATVAPLSVPDPAGST

SEQ ID NO: 170955 - protein, 100 aa, Triticum aestivum
  Clone ID: PAT_TA_65373.pep
SHPPPTSPCSSPNAHLVPPSPNHLSLPSASIPQIQSTQPSRPRTQYCPPWPPPPRSGSPHQPTTPPWGCVRGGCPSTPSPSAPAAPQSPPSPPPAGLRLL

SEQ ID NO: 170956 - protein, 119 aa, Triticum aestivum
  unsure (1)..(119): unsure at all Xaa locations
  Clone ID: PAT_TA_65374.pep
SPPPPLRLCRRREGRVIRAQRKGAGSVFKSHTHHRKGPARFKSLDFCERNGYLKGVVTDVIHNXGRGAPLAKVTFRHPFMYKHQKELFFAAEGMYTGQFVYCGRRATLSVGNVLPLRSV

SEQ ID NO: 170957 - protein, 90 aa, Triticum aestivum
  Clone ID: PAT_TA_65375.pep
KIPIKLLFVIHIQGSFVFIFPRHKMFTTSLHSGSMLPKRFQTSCLDPYTRVLSFYFSPRHTNDTTCLHNNSKLPKRYPSSCSLSSIYKVP

SEQ ID NO: 170958 - protein, 82 aa, Triticum aestivum
  Clone ID: PAT_TA_65376.pep
YYIFSIPMSSLTWPCGLPGFVFTLYLCCTTATPALQKVFFISALLSCVQGFHSGMKNTTPHEVTSFQRENDHWFLYGFSAHK

SEQ ID NO: 170959 - protein, 63 aa, Triticum aestivum
  Clone ID: PAT_TA_65377.pep
LLLLAFLCSSPVDIFGVGSWGALYLSSTVQLLISSNLHGHLGVAVSSHYSEHHASKALTRLAA

SEQ ID NO: 170960 - protein, 91 aa, Triticum aestivum
  Clone ID: PAT_TA_65378.pep
YSPATAPILEYFGLETVSAPSTATYHSWKSPLIPIKRHGSNSREGIRSSSHLNASATPPMQSLEHQIRRLRRRRRGFGFGFGFRSEAAADT

SEQ ID NO: 170961 - protein, 109 aa, Triticum aestivum
  Clone ID: PAT_TA_65379.pep
ATDPEPGGTRREEGKGREEEITEPSARTGQQAPRSRTGAEMGLTFTKLFSRLFAKKEMRILMVGLDAAGKTTILYKLKLGEIVTTIPTIGFNVETVEYKNISFTVWDVG

SEQ ID NO: 170962 - protein, 102 aa, Triticum aestivum
  Clone ID: PAT_TA_65380.pep
MKTILASETMEIPEEVTVKVSAKMISVTGPRGTLTRNFKHLNLDFQLQEGGRKLKVDAWFGTRKTMAAIRTAISHVQNLITGVTKGFRYKMRFVFAHFPINA

SEQ ID NO: 170963 - protein, 64 aa, Triticum aestivum
  Clone ID: PAT_TA_65381.pep
ATVEMVALSLIVLNGLSLSSLVSKSQVNEKNITAATRFCNKFRSENREATEQKGEVNEKHITKT

SEQ ID NO: 170964 - protein, 118 aa, Triticum aestivum
  unsure (1)..(118): unsure at all Xaa locations
  Clone ID: PAT_TA_65382.pep
CYHHGEGAVTYGGFTVAPGRAPDFCVPWKGAREVPFRLSWDWNDGVGLPENLRGRIAAAEKVGAVEVEVQVRLLRGGDARSGTGTPTWMWCKAGTGGAPGAVTPCTVFAPXNWFSPLA

SEQ ID NO: 170965 - protein, 75 aa, Triticum aestivum
  unsure (1)..(75): unsure at all Xaa locations
  Clone ID: PAT_TA_65383.pep
AVPAGIITLGSLFLPDTPNFLIERGHPEAARRMLNRIRGSDVDISDEYADLVVASEXSKLVRHPWRGILHRKYRP

SEQ ID NO: 170966 - protein, 146 aa, Triticum aestivum
  unsure (1)..(146): unsure at all Xaa locations
  Clone ID: PAT_TA_65384.pep
ACPRAPPGRLTPSRRVPRASPRAGRQNDMFSQDPVTMLYTSTSSATNDDSKLSPVKKDEAKQGLWGLLAXQAKAMLDESAPTEDARSQPLVTSAGSPQAQSRWSYDPVRKSESPTFQNGSEGPKFDMGGHIKNALEEGLHAATMAE

SEQ ID NO: 170967 - protein, 98 aa, Triticum aestivum
  Clone ID: PAT_TA_65385.pep
PMEGPLPKDMNRRSYRWMFTVQITRIWEYRSKDFAELYELDFVVLPLLPAPHNTVLSLLWSRTNGQVIPKERSIAWFIYWRKRHTCSTTDSKGVFGSS

SEQ ID NO: 170968 - protein, 84 aa, Triticum aestivum
  Clone ID: PAT_TA_65386.pep
WCGDRFLTVVTMATVVAVASEHVYEVHHGHLRPSRALAQVGAACTLAIAIICIVYIAGVCRRFSSFKSTPTLSDLVLGSAVSLS

SEQ ID NO: 170969 - protein, 110 aa, Triticum aestivum
  Clone ID: PAT_TA_65387.pep
LSYDSAADYKLTAMLPINGIMNHKPQTSSDASWNWYTLGGESWRVIPVLACEMYRSMHDEWNRTVRISLSIISGSIQICKPIQLVEVQLIDTRYYMTTVQSTRQKDNIVQ

SEQ ID NO: 170970 - protein, 81 aa, Triticum aestivum
  Clone ID: PAT_TA_65388.pep
VTGEVDIVAFLDGTEQVYGKATEGGLLGEIGVLCNKPQPFTFRTTKLSQVLRISRPKLMDIIQENAEDGEIIRINLEQVNV

SEQ ID NO: 170971 - protein, 66 aa, Triticum aestivum
  Clone ID: PAT_TA_65389.pep
WKFNVILRRSFHCNSQWVYTVIQLICCNSNCFYSVNPITVILSVGLQCNSSVDLHCNSSCYCNVIL

SEQ ID NO: 170972 - protein, 66 aa, Triticum aestivum
  Clone ID: PAT_TA_65390.pep
MAAVSTKSIALLAAVVLVALVASAAGRIVEREEEFFLGSLAPSLAPAPAPAAVVGAAGAVAPGAWA

SEQ ID NO: 170973 - protein, 62 aa, Triticum aestivum
  Clone ID: PAT_TA_65391.pep
EGPRGEWYAGGAQGCRGGGGEDSGGEGGVRVERGGGAGRTGRKVEQEHDADHHGRGISQRAR

SEQ ID NO: 170974 - protein, 159 aa, Triticum aestivum
  Clone ID: PAT_TA_65392.pep
MSTSPLQIYVWCILLFAIVGISTSLPLEKDALLDIKIHLEDPQNYLSNWDESHSPCQFHGVTCDEISGVVTGVSLSNASLSGTISPSFSVLHQLRTLDLSANSISGTIPAALTNCTNLQVLNLSVNSLTGQLPDLSSLLKLQVLDLSTNSFSGAFPVWI

SEQ ID NO: 170975 - protein, 84 aa, Triticum aestivum
  Clone ID: PAT_TA_65393.pep
PPTLQLHSCRIRRIPTHPSLSRPISLCTQLLAAPHAAAESGDVRRILLPRSTDQGPLTPQCPLSRLDPVLMATKAHPRPVLPHG

SEQ ID NO: 170976 - protein, 111 aa, Triticum aestivum
  Clone ID: PAT_TA_65394.pep
RFSTTVKDEEGMPAFALVNKATGLAVKHSIGQSHPVKLVPFNPAYEDASVLWTESKDVGKGFRCIRMVNNTRLNFDALNGDKDHGGVHDGTTVVLWEWCKGDNQCWKIWPW

SEQ ID NO: 170977 - protein, 147 aa, Triticum aestivum
  unsure (1)..(147): unsure at all Xaa locations
  Clone ID: PAT_TA_65395.pep
SLHVSNLNSKRSKIVLKTAGVVLEQMRDKGLAALKYKVIILDEIHERSVESDLVLACVKQFMMKKNDLRLVLMSATADITRYKEYFXDLGRGERVEVIAIPTSPRTRIFQREVLYLEQIADILKMNSESLSTKYCSGEDADADAGLN

SEQ ID NO: 170978 - protein, 40 aa, Triticum aestivum
  Clone ID: PAT_TA_65396.pep
FFFFFFFFQTSLENSADMLRLGGHTNIIITPSVMYPLLLH

SEQ ID NO: 170979 - protein, 72 aa, Triticum aestivum
  Clone ID: PAT_TA_65397.pep
GEGSQRCPDARASAGGIAASCARRPPAAGQRITLFRLLVLVLDKGDGRIEVGREGGRKRRTEELEIGFPIRP

SEQ ID NO: 170980 - protein, 112 aa, Triticum aestivum
  Clone ID: PAT_TA_65398.pep
DLNSFSLVSKQLYSIEASQRGVIRVGSGLHPARKALASLCSRFPNLWKVEIDYSGWTSGHGNQLSNKGLLVISSCCPSLTDLTLSFCSRIKDSGLGYLVNCKKLMSLRLNSI

SEQ ID NO: 170981 - protein, 124 aa, Triticum aestivum
  Clone ID: PAT_TA_65399.pep
EWARKATAHEFIQEGASVVIADVNSALGLETAQELGPQAHFVHCDVTVEESVAAAVDATVTKHGRLDVMFNNAGIVGALSGTSEVASLDLGQFDRVMSVNVRGTLAGIKHAMRVMAPAGSGSIL

SEQ ID NO: 170982 - protein, 103 aa, Triticum aestivum
  Clone ID: PAT_TA_65400.pep
PPAAKDTYYIIRMRTRGIKKTGRPRVFFEFLFKDQDNYLIAWRGLTTPEQCKTAHWLFFIDTGIHMNDEPFKDMGQKCNYSSAYAHELPEVEIHTTVLEDIEI

SEQ ID NO: 170983 - protein, 155 aa, Triticum aestivum
  unsure (1)..(155): unsure at all Xaa locations
  Clone ID: PAT_TA_65401.pep
MDDDIDSSCSTPFASAPSSPGRSPSIFXGGGGGGGYFFSAPASPIHHLLFSSSSAAAGAPNGGGYRGLSDAEFEFGGPGEHMISADELFQNGQIRPLTLSPLPDLDPDSEEDDSERRHGPARGREPTFRSGSVHRRARSMSPMRSPSPRLKLLSA

SEQ ID NO: 170984 - protein, 110 aa, Triticum aestivum
  Clone ID: PAT_TA_65402.pep
NLLLLLLLLRRRLVCCGYIRRGEIDQMTGCNGNGNGNSSASTMGQQTVTEKKFGGIAPKKPLISKVRNSANVHHQAWLPTHSIAMDLFHHSRFINNYRRGCRTSTTTIVF

SEQ ID NO: 170985 - protein, 47 aa, Triticum aestivum
  Clone ID: PAT_TA_65403.pep
MDSGTGMGSGTGEAAWRSRAVCGTEYSWCRAAPGGTGTTLIALRLSR

SEQ ID NO: 170986 - protein, 172 aa, Triticum aestivum
  Clone ID: PAT_TA_65404.pep
ATLLLPSHTASHHRAVFSGGAHHHLLLQRELLRDALLAPRRRPIAVACRAASAAARAKAPPSASPPPQALAKEAHKYFDHAVVSVRAGDGGHGAVLNMPPGSSADAATSKPRGGGRAADKGKAKKGSGKKVSFKRNYDGSVSLPVGGHGGDVVLYADEAEESLLGFHAKARH

SEQ ID NO: 170987 - protein, 71 aa, Triticum aestivum
  Clone ID: PAT_TA_65405.pep
MKTLTFIKNMENSTFNIIMIVYLLKLDIKNDMKQVVPFLSPGATHGHLYYSLYSFLQVVSDNSKCVVLHIV

SEQ ID NO: 170988 - protein, 175 aa, Triticum aestivum
  Clone ID: PAT_TA_65406.pep
MQMQEAILLSIESSRAPADIPTSSSASSSASPSGPDVAGTSEKSTEESPRDRKGKRKLLEDEPSGSGKRRKRNRFRCAICMEKVQVSEQFIVSHCSHAFCNGCVGRYVATKIGENVESIGCPDPECTEGFVEIEPCRDIIPQELFDRWSVTLCEQSLGNEKYYCPFKDCSALLIK

SEQ ID NO: 170989 - protein, 62 aa, Triticum aestivum
  Clone ID: PAT_TA_65407.pep
TILQLLLKLCTLWTTHHGLIKGPQKYIFSKPTFFYFEQPIFISANDLSACKLFFFLLDQHFF

SEQ ID NO: 170990 - protein, 169 aa, Triticum aestivum
  Clone ID: PAT_TA_65408.pep
MAATADDARRAAAVAKYRASLLACRERQSLLTTGEENLKKARKEREITDEHVKAFQCVGQIVGEVLRPLAGDRFIVKVRSGPRYLVNCRNKLNTESLKTGTRVCLDPSTLTIVRMLPREVDPLVFNMVHEDPGNVSFSAVGGLSDQIREIRETIELPLMNPELFLRVGI

SEQ ID NO: 170991 - protein, 168 aa, Triticum aestivum
  Clone ID: PAT_TA_65409.pep
SAWRYNYKPASRRRPCTEKSFELRWSRPAVVSECGGCENGGGLCVHKREAGKKSWTFTCVTNASATALVVATKSPVNKEGTVLKIALPIMAGLLILTCASFVWAYKLRGERRISNIQNNATRQPLDIFTLNELEINIELPSVSFEEISTATNNFSNNNMIGRGGFGVV

SEQ ID NO: 170992 - protein, 131 aa, Triticum aestivum
  Clone ID: PAT_TA_65410.pep
DISKNFLVGQIPASFKDLKSLKFLSLAANNITGQIPSSLGQLKSLEVLDLSSNSLSGNIPSNIVTLRGLTTLLLNNNELSGNIADLTPSVSSPSVFNISFNNLAGPLHSNVRALSENDGSPEPENTPSDGG

SEQ ID NO: 170993 - protein, 62 aa, Triticum aestivum
  Clone ID: PAT_TA_65411.pep
RTRRRHIPTPHHPLSLAVVEPVPGGDVKLFNRWTFEDVHVSDISLNDYLAVTSMKHYTFLPH

SEQ ID NO: 170994 - protein, 117 aa, Triticum aestivum
  Clone ID: PAT_TA_65412.pep
PSPPPPLNPEQQSSARAPPLAPLCSIPFVLATPSCTAIRRSTGAPSTAEHHQQMSLAPPFLPFHRSLSLAHWTPSLFLVTATPPSSSRRRTSTRTPPAVPRSFPARPRSADTPCVML

SEQ ID NO: 170995 - protein, 90 aa, Triticum aestivum
  Clone ID: PAT_TA_65413.pep
MLYTWSHPIEQSDQSNITAGGHDLYSGNCVTVREAVGRAEQTSNSTVSKPNSPASDESSGKHHPAKRLKVNYPIPVHADETEFPKEQQPA

SEQ ID NO: 170996 - protein, 95 aa, Triticum aestivum
  Clone ID: PAT_TA_65414.pep
DGIPLPVDGHGGTSFNVINDVIPRVVQMIEDTTEHVLRFEVPEMLERDRFSWFRDEEFARQTLAGLNPICIRRLTEFPIVSKLDPAVYGPAESAL

SEQ ID NO: 170997 - protein, 138 aa, Triticum aestivum
  Clone ID: PAT_TA_65415.pep
MAPAMRPEQEASCKATEDHRSEFDAAKPPPFRIGDVRAAVPAHCWRKSPLRSLSYVARDVAVVAALAAAAWRADSWALWPLYWAVQGTMFWALFVLGHDCGHGSFSDSGTLNSVVGHLLHTFILVPYNGWRITHRTHH

SEQ ID NO: 170998 - protein, 100 aa, Triticum aestivum
  Clone ID: PAT_TA_65416.pep
MSRGGSAGGGQSSLGYLFGDGEPAKPAAAPAAKPAPAEKPAPAAADVAKQIPAGIPGSRANNYYRADGQNTGNFLTDRPSTKVHAAPGGGSSLGYLFGGK

SEQ ID NO: 170999 - protein, 167 aa, Triticum aestivum
  unsure (1)..(167): unsure at all Xaa locations
  Clone ID: PAT_TA_65417.pep
LLDCCFKXESVAFTGGSDGSVIRYDLNSGAQDTVGLHDDVVVSTEFSQITGQLVTSSLDKKLLFWDTHTRSVNPNHTFMLDSVVVSLSVCGMYILVTVENDVYWYDMRNLTASIKAKDSPLRHHIRCLCASAEWNGYAAGSMDGTVALKYFDHKVDNDMGYTFRCHP

SEQ ID NO: 171000 - protein, 146 aa, Triticum aestivum
  Clone ID: PAT_TA_65418.pep
MSSRIKEMVRVATARLGGEPSPRAGPSQPGRAESSRTARLGGGGASLRRQPQPQAPTVRTIYCNDREANAPVAYKGNSVSTTKYSVLTFLPKGLFEQFRRVANLYFLMISILSTTPISPVHPVTNVVPLSLVLLVSLIKEAFEDWK

SEQ ID NO: 171001 - protein, 140 aa, Triticum aestivum
  unsure (1)..(140): unsure at all Xaa locations
  Clone ID: PAT_TA_65419.pep
LRDHCHANSFCFKCGDRYSREHWCKQATQLLTIHVRYYGEVLSDDAVHALGLLDSPAPQDPAHECCVLSTHVVAGTESLLXRALVGNQIMLLLMDSNFISMAFTDCIKATTVAMPAVEVXVANGKRMTCNSMVHRLQWWI

SEQ ID NO: 171002 - protein, 95 aa, Triticum aestivum
  Clone ID: PAT_TA_65420.pep
ASGASRRRRIRSSSTQSAVPSLCHLPPAFALCAIELLHFGTSSDNGVQPEWDVCWIFACRQYHGVPYEMKQICRLLQLSEMGKRLRQGKDTSRTY

SEQ ID NO: 171003 - protein, 40 aa, Triticum aestivum
  Clone ID: PAT_TA_65421.pep
AKVFFVLLRDNNPLQTNGFCCLSFAASCALQFIIVILTGR

SEQ ID NO: 171004 - protein, 106 aa, Triticum aestivum
  Clone ID: PAT_TA_65422.pep
SPRMHSLRQLPKPIAKFDPSPSGLWINDGLEWFELLGPRRSESRVVNANVAGDTVLYDADEGIILNLPSLHEPKGTNPVCLSITHPDAEEDALYVMDRCPGRALAR

SEQ ID NO: 171005 - protein, 44 aa, Triticum aestivum
  Clone ID: PAT_TA_65423.pep
LYIQLHAFGMATDDQLTPASSLPSHDNDSPIFKPPIASNRPGGT

SEQ ID NO: 171006 - protein, 76 aa, Triticum aestivum
  Clone ID: PAT_TA_65424.pep
INQPIDYLFLLKLNKRYRCDGHICPQLTGWNYCKCSDQMQGPIHANSFESKKRKEIDFPAANNKGASWRKNLFRII

SEQ ID NO: 171007 - protein, 146 aa, Triticum aestivum
  Clone ID: PAT_TA_65425.pep
RHFKQERENVWKDNPRRPPASAGEGGEGNGWQPFATENLAFEAYYKGQQIVPEEEWDAFMSMLRKPLPAAFRINASSQFCQDICSQLENDFRKSLETEVNDDHEKEAIRPLAWYPGNLAWHLNFSRMQLRRNQALESFHEFLKQEN

SEQ ID NO: 171008 - protein, 77 aa, Triticum aestivum
  Clone ID: PAT_TA_65426.pep
GAVPVAAISMLQTAGRGSLLRSHCRHRHPCGWICSLRLARAAHCIRERRGHPNYLGCRGGRPWWPMWEDEVDLGWIR

SEQ ID NO: 171009 - protein, 55 aa, Triticum aestivum
  unsure (1)..(55): unsure at all Xaa locations
  Clone ID: PAT_TA_65427.pep
KPPFCIIMHKKYIKNNYVYASLXIVKTRQFFSPVLHKALSIGIFKASLEAISFHL

SEQ ID NO: 171010 - protein, 126 aa, Triticum aestivum
  Clone ID: PAT_TA_65428.pep
PLSLPIPSGSGHLSPPPSFDPAALPVAVARGHLVGPPHRRLRPATPPSVLVPPSSARTWPDLAPPCSAALIPDPPLHGSGRGQPPLPQPQRQSSSPDHAVAATGLPRPIASSSSPPRRHHRTSPPP

SEQ ID NO: 171011 - protein, 107 aa, Triticum aestivum
  Clone ID: PAT_TA_65429.pep
WANEGFLRGQKHLLKIIKRKKRPQEAGRELEKAPVKAAPGTENIEIGRYGGLVKEVETLKRGGGVLMQQLVDLTHYQQSSNLEVQSLIQRLQVMEQNQKQMMALLSI

SEQ ID NO: 171012 - protein, 54 aa, Triticum aestivum
  Clone ID: PAT_TA_65430.pep
MASSSAALLALLVVVSCAGMAAAVSYTVGDEKGWVRGVDYSGWTSGKSFAAGDT

SEQ ID NO: 171013 - protein, 63 aa, Triticum aestivum
  Clone ID: PAT_TA_65431.pep
DPARQVDWDNFQQSSDIVDVLSTIHAQVPNGIVLGDYVIEYGDDDTGDDYEVLRRVRRKWWSF

SEQ ID NO: 171014 - protein, 129 aa, Triticum aestivum
  Clone ID: PAT_TA_65432.pep
RRRLLFFPRPCLLPAPRSAASCCSRTAAVFHPAYRLAEQMADLPPLSSPVRRSQTGAGESRRRGQEAVASGRLLLWWSGAAGRGRRPATGEKNMSALVRHGEHNCSPSSASSSLVHGFVVGLYWRCWGL

SEQ ID NO: 171015 - protein, 84 aa, Triticum aestivum
  Clone ID: PAT_TA_65433.pep
TLLRSTAEAQAPATSQQKENFNMALPSSAVVPPWMEIMSRMPPAMLRFERSGSDGTKLDFLPFYERSSGGASKILCLDASGRSF

SEQ ID NO: 171016 - protein, 44 aa, Triticum aestivum
  Clone ID: PAT_TA_65434.pep
NMYCHIHIYILLMPPRKNKLELASLSGVYSSINIFTFYMVVHLF

SEQ ID NO: 171017 - protein, 60 aa, Triticum aestivum
  unsure (1)..(60): unsure at all Xaa locations
  Clone ID: PAT_TA_65435.pep
GMVNSPRLLHAPITLGGPHXKSSLTSRSGSCSVSARAPGRCTDAVDLPRRSPAAADADAA

SEQ ID NO: 171018 - protein, 57 aa, Triticum aestivum
  Clone ID: PAT_TA_65436.pep
KRRAGRAAIASGVAQSPWIPSIPWMCRAHVLPIMPFRTILDLRHRLGKRRSIVIMTH

SEQ ID NO: 171019 - protein, 149 aa, Triticum aestivum
  Clone ID: PAT_TA_65437.pep
MVYIKNQKTRAYSKRFQVKFKRRRQGKTDYRARLRLTNQDKNKYNTPKYRFGVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGL

SEQ ID NO: 171020 - protein, 207 aa, Triticum aestivum
  Clone ID: PAT_TA_65438.pep
MAFDSEFANQQSSMYSQPTDEPIWSGILKINNEVYISLTAHLSTTACGFVREFSRSLQPVVKVIKLPRLEAWPESWRTSRPTDGDIALYFFPPSASPNEESDGPVEEIIDSGAVLQAVIGVAELLIFPSTMLPAQYHLCQGKRYLWGMFKRREDESDSDHLVEEQDGSACAKVGEIQEHIFMDRQYEVQCVSPDHETSAVKHVVHVE

SEQ ID NO: 171021 - protein, 49 aa, Triticum aestivum
  Clone ID: PAT_TA_65439.pep
GSGTEGCRFAITNESVRSTSGRIRSTRPYRAEREEEGGDSSGGRLAAPV

SEQ ID NO: 171022 - protein, 116 aa, Triticum aestivum
  Clone ID: PAT_TA_65440.pep
GLGLDGGGAGSGGNVHDEMLHQHADGSWKRRKGVSARLADYVADSFIDSDDDCVVPAKGGASTLAVSAADYVPDSESDREDFVLPGDRGMKVLANLFTPFNLTEPNVVPMGSHITG

SEQ ID NO: 171023 - protein, 113 aa, Triticum aestivum
  Clone ID: PAT_TA_65441.pep
AVRWGNGGCAARQGKCFIYRAWRSATVASRANIEDAGAEDDSSCRRFCSRTPACSPPSAPAPERCFLRALACSPPFAPFSSPLPATPFSSPPSAFCRVPTAPGDRLYLPCLPL

SEQ ID NO: 171024 - protein, 78 aa, Triticum aestivum
  unsure (1)..(78): unsure at all Xaa locations
  Clone ID: PAT_TA_65442.pep
ASASMATPPREPSCTPRHGSSVPHGGQDAGVDQERTVAAGARIWWWFMILDCITKCSXVGENLGECSSSMWITITKNK

SEQ ID NO: 171025 - protein, 111 aa, Triticum aestivum
  Clone ID: PAT_TA_65443.pep
MAISSRAAACAALAFPSTAAAAAPPSSVSVNRRARPRKALAAVARATSAGGAVLDPPAFDQSQLDTLPPAQEGGDTGRLKDRKGTGSGDSYKVLLLDDPRHTEKHVETALP

SEQ ID NO: 171026 - protein, 53 aa, Triticum aestivum
  Clone ID: PAT_TA_65444.pep
RRRRPPHLILNLVSNLVISPNNPLAVTQLKLAQIEKRAPRVPRPPPTASATAA

SEQ ID NO: 171027 - protein, 92 aa, Triticum aestivum
  Clone ID: PAT_TA_65445.pep
APSSSSSRLPAPGISASPAAGSPHHSQTRKMGNVGPRPERRTRQFEATWMKICRSAPSTWPSPPRSWRMDLTYTVDFPPTCLCSLVMRWGKE

SEQ ID NO: 171028 - protein, 161 aa, Triticum aestivum
  unsure (1)..(161): unsure at all Xaa locations
  Clone ID: PAT_TA_65446.pep
TPTSNKNIFKLMGLQYKIFYKPGITNKAADALSRREHDQEVYAISAVQPKWLDTVIEGYRLDPKAQQLLTELSLSNTNDKGFSLVNGIIKYKNRVWLGTHKAAHAAVLLALHSSAMGGHSGFLATYHRIXKLFAWPHMKEDIQKFVQTCEVCQQAKTEHNK

SEQ ID NO: 171029 - protein, 79 aa, Triticum aestivum
  unsure (1)..(79): unsure at all Xaa locations
  Clone ID: PAT_TA_65447.pep
GSGRSESSATMRRALRERAGGRQRVXVGQKTEEDWARMRYTSXCTSTNSPTFSSAPCWLTISNSIPELLITRNQRLHQA

SEQ ID NO: 171030 - protein, 53 aa, Triticum aestivum
  Clone ID: PAT_TA_65448.pep
NKQGSNSQPFVPTCLPNSHPNFHVTKPCPCTIVPNKQQSIHTGQVKHACTNQT

SEQ ID NO: 171031 - protein, 127 aa, Triticum aestivum
  Clone ID: PAT_TA_65449.pep
YTALHVVGDLVALVDSLGQKQVFVVAHDWGALIAWSLCLFRPDRVKALVALSVAFNPRNPAVKPVDAFRALYGDDYYVCRFQEPGAVEVEFTRLGTELVLRKFFAYRTPGPLFIPKSGWGSPDEEVP

SEQ ID NO: 171032 - protein, 74 aa, Triticum aestivum
  Clone ID: PAT_TA_65450.pep
TCGGGCQDKSGAVSDSPRSSSLWNQVRVVHHGCWRVAGGGYIRPVSVIKTDTGKAAVVHSIQMIILRSLPQNYI

SEQ ID NO: 171033 - protein, 125 aa, Triticum aestivum
  Clone ID: PAT_TA_65451.pep
LLRPPGPAATSFQAPLASASLLLRFQQRAIYLSCAPSVALEQSPRRPPVLVRPPDACDISVMAFAMSLASCPGASLQAATDRPSSLGSPAPRPRPVPRWRWPRLRPSAFASDQQALLAALREQAD

SEQ ID NO: 171034 - protein, 120 aa, Triticum aestivum
  Clone ID: PAT_TA_65452.pep
AATGGGGGQEPLSHPQAGAFYVRRGAPPAGPPAQLTSEHSDAAARTASHTPQAGGAFACGATAFRQSCRPSSLCVPRVVPPAGPLAYLPSDFLTTLSGCVPLLVPSSPPVPDKTHLPFVG

SEQ ID NO: 171035 - protein, 46 aa, Triticum aestivum
  Clone ID: PAT_TA_65453.pep
LLLLHRLGRRRATISAAASSPSSPSSVVQVPQQLVHVAFQYYFHFS

SEQ ID NO: 171036 - protein, 61 aa, Triticum aestivum
  Clone ID: PAT_TA_65454.pep
ISCICVLNRELIVAQWQKVFYRQTLVEGSTRATHCFFKLLEMQKCLPMKNSGEDRDRTRGA

SEQ ID NO: 171037 - protein, 137 aa, Triticum aestivum
  Clone ID: PAT_TA_65455.pep
ILITGAAGFIASHVANRLVRNYPRYNIVILDRVDYCSSLRNLDPSRGSPNFKFVRGDIASADLVNHLLVTESIDTVMHFAAQTHVDNSFSCSFEFTKNNVYGTHILLEACKQVKIRRFIHVSTDEVYGETDVNAVVG

SEQ ID NO: 171038 - protein, 45 aa, Triticum aestivum
  Clone ID: PAT_TA_65456.pep
YLLGDPSNMYHGGPGMSPAAAGGRGGTARKVAPWILACGFLLCSS

SEQ ID NO: 171039 - protein, 128 aa, Triticum aestivum
  Clone ID: PAT_TA_65457.pep
PPPRASSSPSTPCAASPRQPRPPSSAAPAPPSTPPSPRSPATSRGRNPSTRSPASSPPSSNPPPATRGTPRTMPWASSRRSSTASARAPPPRRRRCARRRMRWRSGRRSWRRDWSGCRTPSTACSARR

SEQ ID NO: 171040 - protein, 186 aa, Triticum aestivum
  unsure (1)..(186): unsure at all Xaa locations
  Clone ID: PAT_TA_65458.pep
CAATCAGSSAATAVRSVNGLTAIAAASGGVAAMGNPAAAAITHVLHNKQEFPLAAGVDDLLVVSIGSGSSSGGTASGSATPSAGWRTPIPPRSPSPAEMVRLTAEGVADMVDQAVAMAFGHTCGRNYVRIHAXGAGALDQGAPVAGGAEGGGXADGMLTHRNVEAELFRGRRLSEKSNREKLDAFA

SEQ ID NO: 171041 - protein, 73 aa, Triticum aestivum
  Clone ID: PAT_TA_65459.pep
LFTITCKHILPSFKFIIFPTENCRAIITLSFVLVMRLSCYVGIGVTYFEFARVSYTGKFCLTSNMLSRILLPF

SEQ ID NO: 171042 - protein, 35 aa, Triticum aestivum
  Clone ID: PAT_TA_65460.pep
LVGIPAKRQSLTNPQNTFFGTKRMIGRRFDDPQTQ

SEQ ID NO: 171043 - protein, 146 aa, Triticum aestivum
  unsure (1)..(146): unsure at all Xaa locations
  Clone ID: PAT_TA_65461.pep
PPTAAQRLDLAPPAVVKHSPEALLLVVSNPVDVLTYLALKLPGLXFEVSGVICSGTNLDVSRIWFLINEPSWVQRAGRAGFPAHPSIPFNPEPVYCCASATLQAAAVDAAASSRAHCRTRASQVHLLAAVSAITGSIVTVHLLLNI

SEQ ID NO: 171044 - protein, 149 aa, Triticum aestivum
  Clone ID: PAT_TA_65462.pep
MKTFLVFALLAVVATSAIAQMETSCIPGLERPWQQQPLQQKETFPQQPPSSQQQQPFPQQPPFLQQQPSFSQQPLFSQKQQPVLPQQPAFSQQQQTVLPQQPAFSQQQHQQLLQQQIPIVHPSILQQLNPCKVFLQQQCSPVAMPQHLA

SEQ ID NO: 171045 - protein, 211 aa, Triticum aestivum
  unsure (1)..(211): unsure at all Xaa locations
  Clone ID: PAT_TA_65463.pep
PLFATANIAAGFFIYIXTPIAYWFNVYEAWNFPIFSDGLFTVTGQKYNISSIVDSEFHFDANAYEKNGPLYISTFFAVSYGLGFACLTATIVHVLLFHGSEIWELSKSAFQDRKMDVHTKLMRRYRQVPEWWFICILVASAAITVFTCEYYIEQLQLPWWGILLACALSIFYTLPIGIITATTNQTPGLNIITEYIMGYLYPGRPVANMCF

SEQ ID NO: 171046 - protein, 52 aa, Triticum aestivum
  Clone ID: PAT_TA_65464.pep
TCIVAKYETVDTYYRRCSSASFVGNVSVPLLCISALDDPLCTREAIPWDECR

SEQ ID NO: 171047 - protein, 110 aa, Triticum aestivum
  unsure (1)..(110): unsure at all Xaa locations
  Clone ID: PAT_TA_65465.pep
VKLNVSRNFADLRALPRSIGNLEMLEELDISSNQIRMLPDSFEFLAKLRVFHADETPLEVPPREVIKLGAQAVVXYVADMVASRGASQKKTDGTSFWAWFRSLFGCCKKR

SEQ ID NO: 171048 - protein, 84 aa, Triticum aestivum
  Clone ID: PAT_TA_65466.pep
GHTQSTTNAAGGTIQLQQLKDLDLDGVSLQSLAWLITMLEGHYGVLLPGAGKSVEDVDREQGCNSSCSYANQKLLLTLTSCSEE

SEQ ID NO: 171049 - protein, 148 aa, Triticum aestivum
  unsure (1)..(148): unsure at all Xaa locations
  Clone ID: PAT_TA_65467.pep
GGFIKVILPRLFSLIDDKYKLHRGVKSDVKFLVKELRMIVGAIDXTSSQTRGAAARLSIQDLRELAGGIEDCIDGLMYRATWEQQASFLRRSVRLRPPKALKTSAQLAREMQRLRQMAREAHERKQRYAADFPAGGQPSSSATPPVDE

SEQ ID NO: 171050 - protein, 56 aa, Triticum aestivum
  Clone ID: PAT_TA_65468.pep
RGHSGVLGNKVYVPCVESGSVVEYNTRENKLSVIKAPFEVQHHKIELMGVEDGMLL

SEQ ID NO: 171051 - protein, 72 aa, Triticum aestivum
  Clone ID: PAT_TA_65469.pep
AISPPTANTAPATARAGAGDAQTPRGRRPPRRTRVLAGRRRVAALRKGRSRGGRRAQASHASLDSDLEAFSH

SEQ ID NO: 171052 - protein, 178 aa, Triticum aestivum
  unsure (1)..(178): unsure at all Xaa locations
  Clone ID: PAT_TA_65470.pep
RKSTVKTLLILTILAMAITISTANMQVDPSGQVQWPQQQLVPQPQQPLSQQPQQAWXGAQQTFPHQPQQQVGGAQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQPFPQFQQPHQPF

SEQ ID NO: 171053 - protein, 49 aa, Triticum aestivum
  Clone ID: PAT_TA_65471.pep
FIGMAALCLYYSKCCYFFSLFVLHGGGVDPSEWRARINLGGGNYAAYEN

SEQ ID NO: 171054 - protein, 56 aa, Triticum aestivum
  Clone ID: PAT_TA_65472.pep
LNYCALGPSMRSGPDRNRYHRSPTLSDFCSLATASSPTALGWACPHLPITWAAATS

SEQ ID NO: 171055 - protein, 106 aa, Triticum aestivum
  Clone ID: PAT_TA_65473.pep
MQQQQRQQHQQQQQQYQQQMAGCTQSQMPGTVWMVPRNNTHSGGAPSGGGNGGGGGGSGESIWTFPQVGSAGAAAAVCRGSVPSGLHFMNFPAPMALLTGQQLGLG

SEQ ID NO: 171056 - protein, 93 aa, Triticum aestivum
  Clone ID: PAT_TA_65474.pep
AIIYILEQRRRDLKSKVFSVQYPQTSNRGKERHGKTIGEEGCRVSCQCHYCVKVVSSYNCLEHHLAGIRGNVSTSLRSSLVDRKKRKLGCSEK

SEQ ID NO: 171057 - protein, 40 aa, Triticum aestivum
  Clone ID: PAT_TA_65475.pep
TPRYIPISTLYTTPFEPTVPVEVSQLIYAQPTVVSFSFGK

SEQ ID NO: 171058 - protein, 40 aa, Triticum aestivum
  Clone ID: PAT_TA_65476.pep
DRGEGDADEDRPPDGHSLKRPNRSITPRRRWSSAHRNWLR

SEQ ID NO: 171059 - protein, 57 aa, Triticum aestivum
  Clone ID: PAT_TA_65477.pep
NPTPPRARPPRTIEPAPRIEPDAVPSQLIGRGGSGIGRFGGESGGAGGGGSVAAYPG

SEQ ID NO: 171060 - protein, 134 aa, Triticum aestivum
  Clone ID: PAT_TA_65478.pep
GACGRGLGVLVVRTSAENMPASMTTDVHRHRRSLISYGLPHASIFINGNHLTITSLFTSLIAATHDAERAPLVTFPRRQRRGDGGRGATKEALALEHLHPRQPWTTRWRLQLHGRTTTTAASLPVSSSAPTPPQ

SEQ ID NO: 171061 - protein, 157 aa, Triticum aestivum
  unsure (1)..(157): unsure at all Xaa locations
  Clone ID: PAT_TA_65479.pep
AVALPRTPLPPPLACYSPSTHPFHPWSQAPTQQQHRFHLRTQPAGSPPPADTWPGGGSPPAPVAAPPSPPPXRPAAPRPRPPAGPAAATPPXAPPPPPPXPRPASQPPQPPRPRGCSTPLRCAGGAXGSRATPPPPRRGSPPPSWWRCPWRRRGRGS

SEQ ID NO: 171062 - protein, 170 aa, Triticum aestivum
  unsure (1)..(170): unsure at all Xaa locations
  Clone ID: PAT_TA_65480.pep
SGPIPPAIGKLSNLSSLRISWTAVSGPVPSFLGALKKLTFLEPSFNSLTGAIPASLGAIPNQSGINLSRNRLTGAIPMFLSKSADQVYLWLSHNNLTGPLPAGFAAVNFTHFDLSRNALTGDASGLFXRGKELQYMDLSRNDFNFDLSAVVLPEQIYTVDLSHTAIHGII

SEQ ID NO: 171063 - protein, 48 aa, Triticum aestivum
  Clone ID: PAT_TA_65481.pep
GSAAAQVAAVVVLGVAPENKAGQFEVAAGQSGEGCSCGDNCKCNPCNC

SEQ ID NO: 171064 - protein, 71 aa, Triticum aestivum
  Clone ID: PAT_TA_65482.pep
IGSHFFYHNLLLSHDLLIFFVFSIDISVCKTIIRYWRINEVWLLPSMLSEVHDSRDFLFWQKLVCLLTSVL

SEQ ID NO: 171065 - protein, 113 aa, Triticum aestivum
  unsure (1)..(113): unsure at all Xaa locations
  Clone ID: PAT_TA_65483.pep
TRQQLGQGQPGYYPTSPQQSGQGQQSGQGQQGYYPTSPQQSGQGQQPGQGQSGYFPTSLGEXGQGQHPGQGQQSGQGQQRQQPGQGQQACYPTSSRQSRQRQHAXQWLRPGQG

SEQ ID NO: 171066 - protein, 98 aa, Triticum aestivum
  Clone ID: PAT_TA_65484.pep
RRTAAAKTRRRSGALPVNLLEHRGGSCSELADGGLGGWASTGSSTLSVHHDHAPPPLSATAEDVPCAHRRKPSGRYVLAAHRADEKDGLCREMPCAPK

SEQ ID NO: 171067 - protein, 131 aa, Triticum aestivum
  unsure (1)..(131): unsure at all Xaa locations
  Clone ID: PAT_TA_65485.pep
RRTLAPPALAPLPIPCPRRRRDTSPGKARPPVAAAGLHHLSLGVVLRGETTVGGCALXGARRCLGKHWATVTRSSRSGAVGYAVVVSHDAAAARSIRSGCYLVVAGGFXAAGGAPLSSFSSGGAHSEEGWR

SEQ ID NO: 171068 - protein, 119 aa, Triticum aestivum
  unsure (1)..(119): unsure at all Xaa locations
  Clone ID: PAT_TA_65486.pep
PTSWPCRSARWGTAAGKHATAQRPREVSVSGRIAAAGGPARACGNXAPSREPRRGLYRMALRDAGVKSSGRGHAVTLGRRCPILARRQPRANHGGLDQEGGVRAARRPVVSVRAGEFGS

SEQ ID NO: 171069 - protein, 178 aa, Triticum aestivum
  Clone ID: PAT_TA_65487.pep
CGADSDICDGCYYYYGDPGHGPHYDRNNCIFLKGLSEATDLELSAHSDVTVFNRDLKWCPTFTKLKTLLLNDWCLAANHNALICFLQHSPILEKLTLELSKGPLYETEAEGIYKPLGQSIASNCLKIVEIKCANVDSKVHKILEILTTYGIRLEQISVQQTSQIPGSGCFNFVCTEFS

SEQ ID NO: 171070 - protein, 57 aa, Triticum aestivum
  unsure (1)..(57): unsure at all Xaa locations
  Clone ID: PAT_TA_65488.pep
NDLPVFIFDIIIGDTLTHTQYIYKYYLYIGTYFIYLRXCLRFYFQSFMILYSLIILF

SEQ ID NO: 171071 - protein, 143 aa, Triticum aestivum
  Clone ID: PAT_TA_65489.pep
MEDERSTQSYQGGEAAEQVEVTDRGLLGNLLGKKKAEEDKEKQEELVTGMEKVSVERARVKKEEHEDGEKKETLFSKLHRSSSSSSSSSDEEEEEVIDDNGEVIKRKKKKGLKEKLKEKLPGHKDTEGEHVTGLPAPAAPASV

SEQ ID NO: 171072 - protein, 63 aa, Triticum aestivum
  Clone ID: PAT_TA_65490.pep
KQGCKHSVMNCKGITPRTNFTKASYKADNFFTKASYIADKYSSCCCLQLKLQDQTTKQTTTTN

SEQ ID NO: 171073 - protein, 115 aa, Triticum aestivum
  Clone ID: PAT_TA_65491.pep
RRRQFHSLALGEIKIGINGFGRIGRLVARVALQSDDVELVAVNDPFITTEYMTYMFKYDTVHGRWKHSDIKLKDDKTLLFGEKPVTVFGVRNPEEIPWGEAGADYVVEYTGVLTD

SEQ ID NO: 171074 - protein, 57 aa, Triticum aestivum
  Clone ID: PAT_TA_65492.pep
YMEQSVTLRFTYSRETEILSGSYDRLGKKKRKKRTKGERNFVFGNSPVIMFNLECNL

SEQ ID NO: 171075 - protein, 40 aa, Triticum aestivum
  Clone ID: PAT_TA_65493.pep
SSLTLLAIVATTATIAVRVPVPQLHPQNPSERQPQAASTI

SEQ ID NO: 171076 - protein, 92 aa, Triticum aestivum
  Clone ID: PAT_TA_65494.pep
RSVPTNTIWGKTELSLARQTVYYSELLEFFWHGPAGVVVIQLKKWKVLSRTAVFLNNSLSASSLTRICSLLIAVAYSSRCFRLQMCFRVGLF

SEQ ID NO: 171077 - protein, 173 aa, Triticum aestivum
  Clone ID: PAT_TA_65495.pep
CACAERGFHRRIYKQKGVTRCYENSTALPCTGFVEIVAPVFSRAAWHCVWHMIHNYLIHAWGLDFKFGCCAQGGRSKNVGVVDSEYLLHLGIPTLGSSSSPPSKDNKSSSDAAPGDESEAPIESMMAPPPEASPSFGDRSLIRHRAQEEQVRFQERWKYATQSDACWVDPYVN

SEQ ID NO: 171078 - protein, 69 aa, Triticum aestivum
  Clone ID: PAT_TA_65496.pep
HVHVRNDVEELAAKMNCVWTCGVNFFSHFIFHICTDAPHASSQLAFVHWRQTNLSHACVHQWYKKTTHL

SEQ ID NO: 171079 - protein, 183 aa, Triticum aestivum
  Clone ID: PAT_TA_65497.pep
RRRPPEHFSLVAGDDFADHMRIRPPVASHLRNLITEFDKIQLEAPNGRSYPVKIGWEFGDIVLRSGWHDFVEAHHIEQNYSIRFVYRGNSSFEVHISGSSGHDNSSPPPPRDRHVLNEQVVPDPAHVQTSINIDYTAFPGTRLSHEQEKKVLELAQSSMRSERLHVAAVNKGMPTGTAMFTYP

SEQ ID NO: 171080 - protein, 156 aa, Triticum aestivum
  Clone ID: PAT_TA_65498.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSN

SEQ ID NO: 171081 - protein, 56 aa, Triticum aestivum
  Clone ID: PAT_TA_65499.pep
FIKSTTSNATEIQQSSCTIRQINNETRQFFRYAISSTPHQVFLKFIVSIDTSPTYL

SEQ ID NO: 171082 - protein, 128 aa, Triticum aestivum
  Clone ID: PAT_TA_65500.pep
MSSFAGQQSRPWMGDAAAATPSGDARDDGASSMKDLGSSTNASAISFGFAATAILIAMFLLMAIFEHLIKPGWAASRGSRGGSDNGDGDVHGRHAQPPHPGRHPRDHGSPEKLAPPPNMDAVVAAADL

SEQ ID NO: 171083 - protein, 67 aa, Triticum aestivum
  Clone ID: PAT_TA_65501.pep
RQCYMVNIHNVIWCTHKCKVCELVTDMVSYLAYGILSSNKISDNHVCQSGYYSKFVIRFLNFSSCRK

SEQ ID NO: 171084 - protein, 83 aa, Triticum aestivum
  Clone ID: PAT_TA_65502.pep
RTAFAMFNILYLPCSMNYVCHVQTKCISIFHDNIRCYKKKAHNSLTENTQKMQIPGRNKACQYVHGFPGGRTYVQGVFYFGHV

SEQ ID NO: 171085 - protein, 152 aa, Triticum aestivum
  Clone ID: PAT_TA_65503.pep
PRPRRPFQLPSSGPADGRSTTPASPWATRSPTHSSSPPSPCGASSGRTPRPPSRAPSVSGCCAAPYSRRPRRRWRCTCRAAAAGSATPWPTSRSWSPSSATACTSPPSASSSPLTALDTSCSGSCAPRTLPSSYGATCSTSLASSWEVTTDE

SEQ ID NO: 171086 - protein, 178 aa, Triticum aestivum
  Clone ID: PAT_TA_65504.pep
MLSPVGQGLSPAGAQTSAQGSKGKRRTKTEKTVSLPVLRQYFAGSLKDAARSLGVCPTTLKRICRQHGINRWPSRKIKKVDHSLRKLQQIIDSVHGGETAFQLNTLYKDLTNTSVSSDNNLSGSVTVPPHKQSNLTDFEGHRHHRLSSIVPSTSHSHSSCSQSSDSSPSSCSGGSTKH

SEQ ID NO: 171087 - protein, 172 aa, Triticum aestivum
  unsure (1)..(172): unsure at all Xaa locations
  Clone ID: PAT_TA_65505.pep
HINIVVIGHVDSGKSTTTGHLIYKLGGIDKRVIDRFEKEAAEMNKTSFKCAWVLDKLKAXREMGITIDIALWKYXTTNYYCTVIDAPGHRDXLKNMITGTCHADCAVLIIDSTTGGIEAGVSKDGQTREHTLLAFTLGVKQMICWCNXMDATTPKFSEARYDEIVKEVSSYL

SEQ ID NO: 171088 - protein, 148 aa, Triticum aestivum
  Clone ID: PAT_TA_65506.pep
MMGSEPAALHDDALAEVLRRLLPHVLAEARRVCKAWRDAVDGRLRGNLLLRSVRGIFINFAANHYSEFFARPSTGPAIDGGLNFLPCAGVTITDHCDGLLLCRESRADAPPRDHGPLRRSSALLLLLCPSDPRRTCQDSSRPPTSRFE

SEQ ID NO: 171089 - protein, 57 aa, Triticum aestivum
  Clone ID: PAT_TA_65507.pep
IHPECNLIFFTLAWEDITFMCYDMDRGQVKVICNLEESEPPYFPYVPLYEELQSLHK

SEQ ID NO: 171090 - protein, 204 aa, Triticum aestivum
  unsure (1)..(204): unsure at all Xaa locations
  Clone ID: PAT_TA_65508.pep
QQPQQPFPQQPQQPFPQTQQPQQPFPQFQQPHQPFPQPQQQFPQPQQPQQSFPQQQRPFIQPSLQQRLNPCKNILLQQCKPASLVSSLWSIIWPQSDCQVMQQQCCQELAQIPQQLQCAAIHSVVHSIIVQQQQQQQQQQQQQQGMHILLPLSQQQQLGQGTLVQGQGIIQPQQLAQLEAIRXLVLQTLPTMCNVYVPPECSII

SEQ ID NO: 171091 - protein, 153 aa, Triticum aestivum
  Clone ID: PAT_TA_65509.pep
MDATGAQSHAAHISTPYPMASFETPAHRCHHHSCGELHCCALRPPMVKFSKQFEGQLVPEWKEAFVDYWLLKKDIKKLQAAAGVEAAPPQSQFQAPVAASHWVMRLPFLNPHGHHKEHSAIQVHRKLASSGNHGAVAGEVYETEVLDAAGFAG

SEQ ID NO: 171092 - protein, 180 aa, Triticum aestivum
  Clone ID: PAT_TA_65510.pep
LQNRQFFSLNRPSPLYKSVQRGAFPPSVLRKESEMNPINPSSVHVPPAYSRKVPLTTKAEPPPKSVITLDNKKLCSISNQAALKCQPTKRDADPIVEKETTVKLPLLSPTSVLSSSSTEVCLDTGRSSSRLNLFDGKSKLDSLQPETNIPQAKSPESTIPTPCAQLSDDLRVVSSTKSHV

SEQ ID NO: 171093 - protein, 201 aa, Triticum aestivum
  unsure (1)..(201): unsure at all Xaa locations
  Clone ID: PAT_TA_65511.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIXTIPAMCDVHVPPYCYTTISPSSDVTTDMGGY

SEQ ID NO: 171094 - protein, 83 aa, Triticum aestivum
  Clone ID: PAT_TA_65512.pep
TSLETKFLVEYNCVICVHSFTYMCIQKGEKHLARSPRLATSELNFVLCRNSSGFSRGASMYRGVTRCPIFTPIRQLFHHPKTC

SEQ ID NO: 171095 - protein, 52 aa, Triticum aestivum
  Clone ID: PAT_TA_65513.pep
HVHQCTCMGGTSVSGLNSSECFKCEEDLMTKLEVSQDKSLDSVPRSVLRDES

SEQ ID NO: 171096 - protein, 74 aa, Triticum aestivum
  Clone ID: PAT_TA_65514.pep
VLTAKPWAGRRGVGRAGRCSVSYARDLRVDEPGGVHFRVLAASHGCSTVRGRDRHGVDVDVHAAAVLAAIEVDG

SEQ ID NO: 171097 - protein, 149 aa, Triticum aestivum
  Clone ID: PAT_TA_65515.pep
MVKAVAVLTGSDGVKGTIFFTQEGEGPTTVTGSVTGLNEGLHSFHVHALGDTTNGCMSTGPHFNPAGHVHGAPEDEIRHAGDLGNVTAGVDGVASVNITDCHIPLTGPNSIVGRAVVVHGDADDLGKGGHELSKSTGNAGARVACGIIG

SEQ ID NO: 171098 - protein, 178 aa, Triticum aestivum
  Clone ID: PAT_TA_65516.pep
AGQTDLSGNASKDAILMQKLGETIYPMKEDFIMVHLQHSCSHCSTLMVAGKRWVCHQCKSFYICDSCYDSEQRLEEKERHPSNSRDLHVLHPVDIVGVPEDTKDRDDVLECEFFDTRQAFLSLCQGNHYQYDTLRRAKHSSMMVLYHLHNPTAPAFVTTCNICNNNIEAGQGWRCEEC

SEQ ID NO: 171099 - protein, 63 aa, Triticum aestivum
  Clone ID: PAT_TA_65517.pep
TYPPSPPSPLIPAEWQPKNTCAPPSSPMLLVEVGAYGERGMDWWICRVSTRASSSPTAAGAAP

SEQ ID NO: 171100 - protein, 213 aa, Triticum aestivum
  unsure (1)..(213): unsure at all Xaa locations
  Clone ID: PAT_TA_65518.pep
HAPGMGYMKSKVRKGRGPAKLTEPRRVADRPVLTPTNVDTWDIDPPCPKVASTITLLLKQWHXRSTYVMACQQTSEVHPQQLVLHFHQYHSDRRAIILDEFLRRYKWAPGREAECLKLFNRRTVRQFTGLLCDEKRKARVKLFASRKVKGASDATKSNGQSNLDDKGASKKSKLPRRDPAGVGHXDDDPLQWKQFPPEWMLPKWWEMLCEHWA

SEQ ID NO: 171101 - protein, 158 aa, Triticum aestivum
  Clone ID: PAT_TA_65519.pep
VGIDGPRDDLAKWMMEEENEQRRRVLSIVGFGGLGKTTLANEVYRKIQGHFDCHALVSVSQKPDTKKIIKDVISQVPHNDDFTKDMESWDDKKSIGKLRELLQDKRHLVVIDDIWSTLAWKHINCAFPENNSSSGIITTTRILEVARSCCPDRADQIY

SEQ ID NO: 171102 - protein, 45 aa, Triticum aestivum
  Clone ID: PAT_TA_65520.pep
MSAVRIGSRPPRCEGRCALCGRCEAVQVPVAPRDKGGSHFRLSGA

SEQ ID NO: 171103 - protein, 191 aa, Triticum aestivum
  unsure (1)..(191): unsure at all Xaa locations
  Clone ID: PAT_TA_65521.pep
FPPQLPYPQTQPFPPQQPYPQPQPQYPQPQQPISQQQAQQQQQQQQILQQILQQQLIPCRDVVLQQHNIAHASXQVLQQSSYQQLQQLCCQQLFQIPEQSRCQAIHNVVHAIILHHHQQQQQQPSSQVSYQQPQEQYPSGQGCFQSSQQNPQAQGCVQPQQLPQFQEIRNLALQTLPAMCNVYIPPYCSTT

SEQ ID NO: 171104 - protein, 61 aa, Triticum aestivum
  Clone ID: PAT_TA_65522.pep
LSHPAYTQTDNIDYWFSLRKGEPTGISHMPHKSFSGSFSLFLAFLSSINLLLLPPCVGIYR

SEQ ID NO: 171105 - protein, 174 aa, Triticum aestivum
  Clone ID: PAT_TA_65523.pep
MATAPNIEMIASSLRSCSLNGGGWRPGRRHRHGHARGAEGSNDSEGVTVELNSDVALPYHWQQCLDIRTGQVYYINWEDGTRTTIDPRTPSLCSALSTPRSTCFTSHRAAFTSSSSSGYTSAASSVTGGYGYGYDDSDGYSEGYGDDEESSSSSSRSSGVSSVLSSFFPSNEPS

SEQ ID NO: 171106 - protein, 105 aa, Triticum aestivum
  Clone ID: PAT_TA_65524.pep
LARTNRADLRPRQRPPVSRWRLLRRSAPQLLPVAVDLEGTGSAASAAQRGQWIRHPQAPPQFSSGVRRKSVVSLDSVVDWMVDASTASDSECGRRRRLDGWGETS

SEQ ID NO: 171107 - protein, 157 aa, Triticum aestivum
  Clone ID: PAT_TA_65525.pep
MQFTLSAVVLGLAATVAALPPSAGAGNGIGNKGNTNVKFPVPDDLTVKQAQAKCGDQAQLSCCNKATYAGDTTDVNSGILGGTLSNLIGSGSGADGLGLFDQCSKLDLQIPIIGIPIQDIVNQKCKQNIACCQNSPSSANSDLIGLGLPCVALGSII

SEQ ID NO: 171108 - protein, 205 aa, Triticum aestivum
  Clone ID: PAT_TA_65526.pep
SQCSSSVVLAISVVALLNAAVALCGCSYKRIFAFGDSLVDTGNLLYSIGNSASPIKELPYGMTFFKHPNGRVTDGRVVVDFYAEALGLPLLPPSIPEEASGQFPNGANFAVAGAIALPPEYYKTNYNFTMNAPSNLDRQLASFKKVLARIAPGDGATRALLSESLVLMGEIGGNDYNFWFIDPRNPRETPEKYLPDVVTCIGATL

SEQ ID NO: 171109 - protein, 119 aa, Triticum aestivum
  Clone ID: PAT_TA_65527.pep
CNPRGRSAADTTPDRASGGVGRRSSRRRGRGRPLAGSAPRTACMPASSSTPSPSTATPQVLRRDPRVHSRREGDVDIRGLSLPSASRPEGTASGGLQVREKRGAVKLLYSSHKCYTGYI

SEQ ID NO: 171110 - protein, 126 aa, Triticum aestivum
  Clone ID: PAT_TA_65528.pep
DYAGEHQQQAAPPPCPKLHSPSPSFLFLLSLNSLTLLIATRPQVKQSKHGPVAPITPSHCSPARLHVVPRAEPQLLVCIEIQGDDRMPLFVCASTTEDEAVSSILPPCPYSHTSPWLGCAWQRGGG

SEQ ID NO: 171111 - protein, 233 aa, Triticum aestivum
  Clone ID: PAT_TA_65529.pep
TATTAVRVPVPQLQPQNASQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHNVAHAIIMHQQQQQQQEQQQQLQQQQQQQLHQQRQQPSSQVSFQQPQQQ

SEQ ID NO: 171112 - protein, 161 aa, Triticum aestivum; identical to SEQ ID NO: 129051
  Clone ID: PAT_TA_65530.pep

SEQ ID NO: 171113 - protein, 167 aa, Triticum aestivum
  unsure (1)..(167): unsure at all Xaa locations
  Clone ID: PAT_TA_65531.pep
MFSRRVKPQTVAGIAKNAQNFSTSGQNNVKVAVMGASGGIGQPLSLLLKNSPLVTELXLYDIVHTPGVAADLSHINTNSKVRASNGPEQLKDSLKGMEVVIIPAGVPRKPGMTRDDLFNTNASIVRDLXQACAEVCPKALIGIISNPVNSTVPIASEVFQKAGVYDP

SEQ ID NO: 171114 - protein, 215 aa, Triticum aestivum
  Clone ID: PAT_TA_65532.pep
QPILPQQPPFSQQQQLVLPQQPPFSQQQQPVLPPQQSPFPQQQQQHQQLVQQQIPVVQPSILQQLNPCEVFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVP

SEQ ID NO: 171115 - protein, 76 aa, Triticum aestivum
  unsure (1)..(76): unsure at all Xaa locations
  Clone ID: PAT_TA_65533.pep
FGLCIIPYPTNDFAGQTWDVIKKVGKHHSFSGGAIVKCTGIXQQKLYINSLNILGRTSRQXVQHLDETPNFKCSQV

SEQ ID NO: 171116 - protein, 126 aa, Triticum aestivum
  unsure (1)..(126): unsure at all Xaa locations
  Clone ID: PAT_TA_65534.pep
KNAAYIGTPGKGILAADESTGTIGKRFASINVENVEDNRRALRELLFCTRCAVQYLSGVILFEETGGESTKGGKPFVDILKAGNVLPGIKVDKGTIELAGTNGETTTQGFDDLGQRCAXCYEAGAR

SEQ ID NO: 171117 - protein, 70 aa, Triticum aestivum
  Clone ID: PAT_TA_65535.pep
KMKTSQTNMYVEPEIISYVSKRLYNLPKSEGGPYIIQYSFPALPRRPPPNASKVISMAYRRRFTYNRISR

SEQ ID NO: 171118 - protein, 99 aa, Triticum aestivum
  Clone ID: PAT_TA_65536.pep
QGIVIDEANAHHAKEIHQLVNQFSQRLNPLQLPIDENFQLMKLIVFVDCIVLTHFQPTQTCKLQKVKTIGGTHIILILCNTSILGSYLLWPNIAFTCVP

SEQ ID NO: 171119 - protein, 219 aa, Triticum aestivum
  unsure (1)..(219): unsure at all Xaa locations
  Clone ID: PAT_TA_65537.pep
VLTLKXLGIDDLVHFDFMDPPAPETLMRALEVLNYLGALDDEGNLTSLGEMMSEFPLDPQMSKMLVISPRYNCSNEILSISAMLSGXADSCCMLSYSDKANGIVSPLCICXPTVGFVCYYHILCLVPNCFLRPXEAQKAADEAKARFGHIDGDHLTLLNVYHAYKQNNEDPTWCYENFVNARAMKSADNVRQQLVRIMTRFNLKMCSTDFNSREYYVNI

SEQ ID NO: 171120 - protein, 153 aa, Triticum aestivum
  unsure (1)..(153): unsure at all Xaa locations
  Clone ID: PAT_TA_65538.pep
MASGPPGKLSSFEPSLWGDFFMSYEPQPLQIYXWMMERADXVREKIHMLFRSCDGVWEKMFLXDSLQHLGIDHHFKEEIDNMLSEILGSEFSCSSLHEVALRFRLLREHGHWVSPDVFNKFKCESGVFNKDITYDTRGLLSLYNAAHLLIHGE

SEQ ID NO: 171121 - protein, 132 aa, Triticum aestivum
  Clone ID: PAT_TA_65539.pep
ATVISRARVFLRRLRLPALPAQGCRPPRRRSGPASLALSPRSTTRPCPPLYAQLHHGRYACLLCSSWTTVPEVICTRGCNAGARRPARTGAQMAAASRGRGWRINYELQNARRARVQRRRNQDEQQKRGKEP

SEQ ID NO: 171122 - protein, 152 aa, Triticum aestivum
  Clone ID: PAT_TA_65540.pep
EDSNEYDGSASEENSNESDGNASEGDSNESDGTASEEHSNQSGASQDALTLDLSAGGYKLKQLRDISKLHFNLEIYGLEKVKSTDEALEVNLAAKFEVIKLTLDWGDADDGTRCSPEVEAKILEVLCPPVRLLTLYIGGYKGSRYPDWMVSK

SEQ ID NO: 171123 - protein, 104 aa, Triticum aestivum
  Clone ID: PAT_TA_65541.pep
PSDRSPVPRSLLRHPRHPEIPLNQPATRNYNSSLHFFRFDFFDFSIQTCCSHPLSAPPPSENSFLTGRRTTVCELASRDLQSQRHNKGTAAAAKAAPHGTHHGP

SEQ ID NO: 171124 - protein, 186 aa, Triticum aestivum
  unsure (1)..(186): unsure at all Xaa locations
  Clone ID: PAT_TA_65542.pep
MAITIGTANIQVDPSGQVQWLQQQLVPQLQQPLFQQPQQTFXGAQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASL

SEQ ID NO: 171125 - protein, 154 aa, Triticum aestivum
  unsure (1)..(154): unsure at all Xaa locations
  Clone ID: PAT_TA_65543.pep
MSSPPPTSGGEQIADIKAPRPHAADTTGAAGDIGAVEANQAVSVGEAKATPSPATICPACTEAWSXDGPHRMCCIPCGRVYGXSCMETLLGRSGQNSAKCPQCGKQFEEKLIINLYAPXNMLEGCCSPEEIKAFYEHIFVAVMATCIEIQQWFR

SEQ ID NO: 171126 - protein, 131 aa, Triticum aestivum
  unsure (1)..(131): unsure at all Xaa locations
  Clone ID: PAT_TA_65544.pep
MPLSPITHACRVVALPYPGRGHVNAMLSLCRLLAARGVATTVILTEEWVGLVGAAEPLLPACVRLTAIPNVIPXXHGGAADYPGFSDAVNTRMEAPVQRLLEEMLQLQSPDMAVVVVVADFLLQWAVPMAL

SEQ ID NO: 171127 - protein, 173 aa, Triticum aestivum
  unsure (1)..(173): unsure at all Xaa locations
  Clone ID: PAT_TA_65545.pep
NVLLNTIWYDTAFPAQDEFLIDMLCTKSLARLEQRSMAGLVTFVRALFPELAENVAMLYLLKANANLREAISKLQLEDHHLSGSYKKAYKMAAQVACHPNPKALREXALSTAPSIMSSVRSLVKTTAHTLSSREVGDISALLASLRPSVQKVPKLTPCASSFVSRRQARFEDD

SEQ ID NO: 171128 - protein, 93 aa, Triticum aestivum
  Clone ID: PAT_TA_65546.pep
KGKSLWSRLKNKEKKLPQVKVRPRPEKGKSLWSWLKNKIFRREGRQICSEHVKHQIFRREGKQIGSAHVEHQQQINISDGIIYGSGFKNRILE

SEQ ID NO: 171129 - protein, 130 aa, Triticum aestivum
  unsure (1)..(130): unsure at all Xaa locations
  Clone ID: PAT_TA_65547.pep
LPSAVSRFTVRMVTGDNINTAKQLPGXCGILTEGGLAIEGPDFRTKSAEEMYKLIPKIQVMARSSPLDKHTLVKNLRTTHEEVVAVTGDGTNDAPALHEADIGLAMGIAGTDVAKESADVIILDDNFSTI

SEQ ID NO: 171130 - protein, 60 aa, Triticum aestivum
  Clone ID: PAT_TA_65548.pep
PCTLVNKSGVLLIGFCVLCMYIWIFITPQRFDGLLCSSGVRIRILQYHNSEMNSTSMLHY

SEQ ID NO: 171131 - protein, 43 aa, Triticum aestivum
  Clone ID: PAT_TA_65549.pep
VQRTSLMPGITLMFILLLEMYLLFRCISLSLTSHLSNLIRESG

SEQ ID NO: 171132 - protein, 181 aa, Triticum aestivum
  unsure (1)..(181): unsure at all Xaa locations
  Clone ID: PAT_TA_65550.pep
RSPSPARAQDSRRRDLGAEMGLTFTKLFSRLFAKKEMRILMVGLDAAGKTTILYKLKLGEIVTTIPTIGFNVETVEYKNISFTVWDVGGQDKIRPLWRHYFQNTXGLIFVVDSNDRERVVEARDELHRMLNEDELRDAVLLVFANKQDLPNAMNAAEITDKLGLHSLRQRHWYIQSTCATS

SEQ ID NO: 171133 - protein, 174 aa, Triticum aestivum
  unsure (1)..(174): unsure at all Xaa locations
  Clone ID: PAT_TA_65551.pep
MAVGKNKRISKGXKGSKKKAVDPFTKKQWYDIKAPLLFTSRNVGKTLVSRTHGTKIASEGLKHRVFEVSLADLQNDEDQAYXKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVN

SEQ ID NO: 171134 - protein, 93 aa, Triticum aestivum
  Clone ID: PAT_TA_65552.pep
MADGTESEQAAVVGDGNPSQLSKSAKKKLLKQERQAARKAERIAGEKERRRADIERRRREWEESLAAAPSHDAREAMLAARRETRLERVGKRV

SEQ ID NO: 171135 - protein, 78 aa, Triticum aestivum
  Clone ID: PAT_TA_65553.pep
WFCFMNKWRANSLVSFRCVGRGNKRIIIPGLGMHMVTDHKVGRNMCSIVIFSKRKRNIVNCTYFKLHYVMLLYYKGLA

SEQ ID NO: 171136 - protein, 109 aa, Triticum aestivum
  Clone ID: PAT_TA_65554.pep
CPSSPAGVGQLAFVTTSESAEGWDGHRPRGRRRSATPRQGSGRCVDMVVVAADVVDVAPRRGEQQKPRGGCRRCSWLPAKATPPLPPPTPPRRRGCRHRTGGVRPRRWG

SEQ ID NO: 171137 - protein, 133 aa, Triticum aestivum
  Clone ID: PAT_TA_65555.pep
SSSSSSPPPPSCSSCSSSSSSPFSSPSPICFFLASLALGLSYSSPSEISSSPSAKSPSSSPSSSSPSSSPASVGADSSPLFPPILKSGIPQIMPSVPVPALPVSGSARPPSSAPAGCMAVSIRSGRGCGGLLF

SEQ ID NO: 171138 - protein, 132 aa, Triticum aestivum
  unsure (1)..(132): unsure at all Xaa locations
  Clone ID: PAT_TA_65556.pep
MDAASCCRVFSTQRCPFPLRRLGAAPFSTGLSELFDPSSSVSKRRSRGPVMAAKKAADGTKQKDGKYKHTVDLPKTTFDLRANSVMREPELQKLWEENXVLKRVSERNTGATFTLHDGPPYANGDLHMGHAL

SEQ ID NO: 171139 - protein, 59 aa, Triticum aestivum
  Clone ID: PAT_TA_65557.pep
YEDCPQKCREGLCPIACFPYPPAKAMDHVTLVLRSKSYNSVSVKCNMFASMKPKLRKLG

SEQ ID NO: 171140 - protein, 93 aa, Triticum aestivum
  Clone ID: PAT_TA_65558.pep
QLSLRQGSGRRDVCTVQNKKCHNRYRNSPSRTMSSASESSYSDAVGRSSEPVINLDQALQGGRAVPPGDSAGRTEFAVGAMPVARVKHMCSLE

SEQ ID NO: 171141 - protein, 74 aa, Triticum aestivum
  unsure (1)..(74): unsure at all Xaa locations
  Clone ID: PAT_TA_65559.pep
TLQMGEGRGDPSSVYKSIRCIDDKTRASRRGLDLASGPLPXRQRSNHVRSEPTALSPAPKIITGSSVLSSQPQN

SEQ ID NO: 171142 - protein, 148 aa, Triticum aestivum
  Clone ID: PAT_TA_65560.pep
FLASLLRPASSCPSFRLPSSTAPAPPPSLLSRRHKAPPVPPTPHTPPSRPRVAAAAAYGGAQLLGPVDTQTFIIAASVVAAVSLSLVLGLKGDPVPCDRCAGNGGTKCVFCNDGKMKSDNGVVECRVCRGAGLILCKKCSGSGYSKRL

SEQ ID NO: 171143 - protein, 82 aa, Triticum aestivum
  Clone ID: PAT_TA_65561.pep
ELVQLSLNHDPLARSTVGRSCIIQCLIVPPYRFTVEDDRDDVDSSSDGWKASECCCLLSSKRATVANCPICFSFVSYNLVRL

SEQ ID NO: 171144 - protein, 96 aa, Triticum aestivum
  Clone ID: PAT_TA_65562.pep
KQNLIDELLPKVTKHQLVSSHKTRTIFYKCETKQIACCKHFIKSEHYTSQVHRKFRERTAATTQNGVEEAAGVVVIVLMVKRSSSKIGKKSFRSVA

SEQ ID NO: 171145 - protein, 79 aa, Triticum aestivum
  Clone ID: PAT_TA_65563.pep
RVDTAKEHSTTCNSSSMKLQTGKLIEIKFQSGWLPLLRYPPLQTTNPLIFVVANCTKELFESRGRSKGPTVVFSLGSFA

SEQ ID NO: 171146 - protein, 137 aa, Triticum aestivum
  Clone ID: PAT_TA_65564.pep
ADGADPFSSSSTGDTPITPLPVPPAAAIVQELGTRECVCEREERFVGAMAPPKRQLALTGAGAGREEAKRLRVGVAKANAAGWRAPTSPASPGTRLMRRTVLVVLFLLRMSDGITVTESISQIGRMVQRKMEGIHKV

SEQ ID NO: 171147 - protein, 81 aa, Triticum aestivum
  Clone ID: PAT_TA_65565.pep
IRGSDVIEGVFISFAVNAELTKAFELQPTWAKPAIWFSYQSPWLSTIPVAVTLISFFHSFITNGEPNWPSCWGKAFLACAG

SEQ ID NO: 171148 - protein, 144 aa, Triticum aestivum
  unsure (1)..(144): unsure at all Xaa locations
  Clone ID: PAT_TA_65566.pep
MPAGGGEASKHGRTGKEQSHPPAIRRRDGSRPAPPFPAVASQKTKKQRNQRQPPPTAAAAGSVSSEGPLAEILARLPYRSLCRFQCVSKQWAELCSDLIKSIKTAPQTLSGFFHNNLAGSLCFXNLSGGRPLVDASLPFLRESY

SEQ ID NO: 171149 - protein, 71 aa, Triticum aestivum
  Clone ID: PAT_TA_65567.pep
HQSQQHPYWTDAWSRACLVLASQGWWWTMRPMCPLSWRVPSTSFGVLLLEQQQGQQHHPLTEHGDWGGASV

SEQ ID NO: 171150 - protein, 137 aa, Triticum aestivum
  Clone ID: PAT_TA_65568.pep
ESSDTIDNVKSKIQDKEGIPPDQQRLIFAGKQLEDGRTLSDYNIQKESTLHLVLRLRGGAKKRKKKVYTTPKKIKHKRKKTKLAVLKYYKVDGDGKIERLRRECPQAECGAGVFMAAMHNRQYCGKCHLTYVFDEAK

SEQ ID NO: 171151 - protein, 163 aa, Triticum aestivum
  Clone ID: PAT_TA_65569.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPNPLIKANDTIKLD

SEQ ID NO: 171152 - protein, 105 aa, Triticum aestivum
  Clone ID: PAT_TA_65570.pep
MGGRAPPAGSRRNSGLGPEKQQQEPWPEEMSLNELAMILAYLQKGVIGMGYLALTWSTVVLLGGFVTALGKKDFWCLTAISMIRAAWNGLPSIWDKTDCIQYQEQ

SEQ ID NO: 171153 - protein, 191 aa, Triticum aestivum
  Clone ID: PAT_TA_65571.pep
RVLAVAFSREHHPITRPSKFSIPESISQLKHLCYLAFRTFKCTVILPSALAELHHIQLLDFGHHSQTSEFTTDNLTNLRYIMCKSVKCPNIGRLISLQALPCNTFTVRNVQGYEIKQLRDLNDLRGNLVINGLENVKGKEEALEANLGAKERITELMLEWDYDDDTRCSPEVEAEVLEGLCPPAKLETLMI

SEQ ID NO: 171154 - protein, 167 aa, Triticum aestivum
  Clone ID: PAT_TA_65572.pep
GGDDEDDDDCVVLDGDPEKAITIGEDKGSVGDSSSDELQIVGEKGPVACRDFPHSRHLCSNLPFSATSHVKHCSMCHCFVCDAPAPCNYWGKGIQLNDHCHATDKESKWKQLRQAFKSKSLPASRPEQCQNVIYPTMAPSIKKDIQCQVSSFANRSPLLHVMSQNKQ

SEQ ID NO: 171155 - protein, 116 aa, Triticum aestivum
  Clone ID: PAT_TA_65573.pep
SSMPGGPGGALPAAGGARMPLVGAGRLWPRLDAGCRTRSGSAVPSSRRIAGGPAQWWRARCAGVHVQWRYGLTLACCVGVAGLGESLPGDGRPAATASVGVARNLHSLYSRIMFLG

SEQ ID NO: 171156 - protein, 70 aa, Triticum aestivum
  Clone ID: PAT_TA_65574.pep
THYTRGKTSVSWGVNVDTFMYQQHLVCPHQGAVSWPYAIQASTPTYQLAGPAVSKHQLTIFVGKKQRACA

SEQ ID NO: 171157 - protein, 182 aa, Triticum aestivum
  Clone ID: PAT_TA_65575.pep
SAAASQRQRHASFLPPRSPFLAPDRDAASRSAPNAPHRIVRGPAPMDRADGPAPPRSGDRAVHDQDDTAQGAQGNNSRRPNLSLQIPTRTLDNHIPSSTRINISASPSSTRAGLPPRPNSARPKSSIKQQSFRLRNSTQEGDRTILLLPGTASEGSQDNPTQPGSFSFRKVINSLSAKRTYS

SEQ ID NO: 171158 - protein, 50 aa, Triticum aestivum
  Clone ID: PAT_TA_65576.pep
KILDGHPVVCQMHHFVMQVRKCVVPVKFGSVRPIRYAHKTCVDSQKKKKK

SEQ ID NO: 171159 - protein, 80 aa, Triticum aestivum
  Clone ID: PAT_TA_65577.pep
NHKKSLQSGSFHQACLEAWKEKSSSVNVLQSPDLLGMLLVSVRCKRINRRQVYIRLRHQANKLLETRNDVLIVVASLVFK

SEQ ID NO: 171160 - protein, 171 aa, Triticum aestivum
  Clone ID: PAT_TA_65578.pep
MAIANPLLNFVVRGFQALFGIVVLGISVSLIRGHHWGGLPASLGFSAFVGGVTILGAALGVAGLFFSFLDGMIGLIVDGVVAVINAAGGIVLALKISGVDCDADTTIENATKLILNDIFNGGCRAEDECWYYFAKNGDNTMKSRCKSTQADCVFMFLTVIVLAVTALLAFL

SEQ ID NO: 171161 - protein, 64 aa, Triticum aestivum
  unsure (1)..(64): unsure at all Xaa locations
  Clone ID: PAT_TA_65579.pep
PPAAWSKGDSSSLPSCSPPGRQRRPGDPFRPSARHGTAGHGERRRXRGRRPPHGRGPRGGRGTR

SEQ ID NO: 171162 - protein, 118 aa, Triticum aestivum
  unsure (1)..(118): unsure at all Xaa locations
  Clone ID: PAT_TA_65580.pep
GSWSTTAAARDADEAQLVRDRVHGMGVICEIARCEWPNGRPKLGHLQEAAREMRYQKLLDICIKQQIGVLLIAHHSDDQAELFVLRLSRNSRVLGLAGTAFVSXLFAPNLKYDGHNFC

SEQ ID NO: 171163 - protein, 133 aa, Triticum aestivum
  Clone ID: PAT_TA_65581.pep
TPAVVEAEAGVPLQRLPTVARVPGDAAAPPRLPSPTPSNGHSGRSGSRSPAALGLANGTASGPLALARCARPQHWRRCTRPRRGLALARLAVAAPLYGLHLTSEDSPLVTPARVTTRRCSPPRGFVGAVRGGQ

SEQ ID NO: 171164 - protein, 82 aa, Triticum aestivum
  Clone ID: PAT_TA_65582.pep
ISSLITARHSHRKIECSTSSASRANTHNFNLSSLNCDGLALCSLMYQLLSSELSRRIIAGMILCWSFLAYPVIINQFSTTFF

SEQ ID NO: 171165 - protein, 159 aa, Triticum aestivum
  unsure (1)..(159): unsure at all Xaa locations
  Clone ID: PAT_TA_65583.pep
TSNLGTGVKFRFKTDGASSASSSPVPSWKSEPSISPTESSTGNALPDRLTHRQQISRFGQSAFQTGSLAFAGLQDSASSTSLSLKGSLTSNILMNLQNKGILSNTQSSLETSSASLQTSVSSSFMSKTLPSVNSDLPGAAPSXSAWKPSTLTDRLSTSS

SEQ ID NO: 171166 - protein, 219 aa, Triticum aestivum
  Clone ID: PAT_TA_65584.pep
CGAAWGTWPWPAARRGLSRLAPPAPAAVVRVDSNNVARLGAPKPGPRPRQLLSLPPFPAGADPLPGRNVAPRRVTAVSWVKHCFADVPQEVVQAHFNKRQVYTECSDQEVSAESIWCRKHHLKKIKHSEVMEPGMRIHLPVSVAEAEIKKRYQTIPTATLHPNRDEIEYLKRLVIYKDSAILVLNKPPKVPMKGNLPLHNSMDVLAAAALSYGNEEGPK

SEQ ID NO: 171167 - protein, 43 aa, Triticum aestivum
  Clone ID: PAT_TA_65585.pep
QSCVGQHSKHNLVLKHMDCSLIFYDQVVYNVNDRSGQAIWHRL

SEQ ID NO: 171168 - protein, 87 aa, Triticum aestivum
  Clone ID: PAT_TA_65586.pep
NPEQIPHPKSPHPPTPTTGTLGSDPSATNRLPRDHAQEHITPQTQADRGRTRPRPNLTTDETRRPQIRAKTTPARSWLQIGRTNFAD

SEQ ID NO: 171169 - protein, 151 aa, Triticum aestivum
  Clone ID: PAT_TA_65587.pep
TANQGVFYIDTVKEEWEGYYSNEDVELWKRSNYGLREALLRDVRKHNRKTTAISCCGANPGMVSWFVKQALINLAKDIGFPLPEEPKTRNEWGKLMKDLGVKGIHIAERDTQRSNEIRDPKEFWNTWSVDGFISEGYYQPSELGWGTHEKW

SEQ ID NO: 171170 - protein, 184 aa, Triticum aestivum
  Clone ID: PAT_TA_65588.pep
PAASSSGDLPADALYEVLLCIPAKELCRLHAVCPAWRALTSDPLFVAAHKSRHHKAPPLLAVAYDDDGNHNGVEILDLSGNVVKRIPNTEYKAVLMHDSIRVVRTRLDLICLSWVVCSRAFWVLNPATGATIALPLGFSEELEHELEGFIWDCQVESCAFGHVSSTREYKALRVSRINHHQQVS

SEQ ID NO: 171171 - protein, 71 aa, Triticum aestivum
  Clone ID: PAT_TA_65589.pep
MPQVMVVARNFMDMVAALPAAKLDMLYDSAFICEAVLRSFPPLAKKYVIQMLYVSAPMPAAAMQEWVLDEY

SEQ ID NO: 171172 - protein, 77 aa, Triticum aestivum
  Clone ID: PAT_TA_65590.pep
FRCGSTRDDGCRPFISDDALQRAWGALLSAQPSRGDSRRSQQAEPAATVLKMGSLDAAFPGVQNGCRGCGATKYGAQ

SEQ ID NO: 171173 - protein, 86 aa, Triticum aestivum
  unsure (1)..(86): unsure at all Xaa locations
  Clone ID: PAT_TA_65591.pep
GFTVYPSPQVSTSVVEPYNSVLSTHSLLEHTDVAILLDNEAIYDICRRSLDIERRTYANLXNRLVPQVISSLTASLTFDGALNVDV

SEQ ID NO: 171174 - protein, 166 aa, Triticum aestivum
  Clone ID: PAT_TA_65592.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSK

SEQ ID NO: 171175 - protein, 103 aa, Triticum aestivum
  Clone ID: PAT_TA_65593.pep
KFRDLFVTWNPPSLEVEETGNLGDHDWLLSGAKKPDASDSSCKASDGLAPMEVEFSWQPTAIHLPDLHMYQLPYVVPFYVCVRRLRLYDKYKRCWEIAVPVWE

SEQ ID NO: 171176 - protein, 211 aa, Triticum aestivum
  Clone ID: PAT_TA_65594.pep
SVLIPIGRLGVILLILEHISETLLSSDMKVPIFMISGAAEKIISFTNAVPEWLCKPRQEKLFSREEEALFGHVELLKEGKLSLFPHLYSKGLLAAWKEPCIVFCPDWNLRHSTAVHLLRRWHADKRNLLVLEQGVDAELALKPFMPVAIQVLECSFLSGIKVRKVNPLLSVLKPKLVLFPEDLKSRCPSKEDAPWSYLYYSKGKTIEIPNT

SEQ ID NO: 171177 - protein, 90 aa, Triticum aestivum
  Clone ID: PAT_TA_65595.pep
SPQEGCAVMNQRMCNYCGPSCLSIQLFKSIYILSPFLFTPHISFGQSQALQTLTKFIDKNINIYNNKSIPLDSFVECTSTSYRFVMLNIY

SEQ ID NO: 171178 - protein, 100 aa, Triticum aestivum
  Clone ID: PAT_TA_65596.pep
RRRLLLERDIFGRSALNVIACEGADRVERPETYKQWQLRNHRAGLTQLPLNPDVVRLVLDKVKDNYHKDFVVDDDQRWLLHRWKGRVLYALSTWVADNAT

SEQ ID NO: 171179 - protein, 81 aa, Triticum aestivum
  Clone ID: PAT_TA_65597.pep
HRACEFLYWFLRNNFSRQQSGLGNDYMPQILAEVSKDTDVGEFLLKLISSEREKLTNLWGFGTNGSQQINPDNQEGSMIVL

SEQ ID NO: 171180 - protein, 109 aa, Triticum aestivum
  Clone ID: PAT_TA_65598.pep
AQTGSTRSLATKGADQDSQGFSSLCKISNPSHASIDKLLYNRLSDRKVPRPFTYSHGETTSASNPKQRCAWVRGGVPGGGCPVGNVEGVGGAGAPPASMATPHTSGPSG

SEQ ID NO: 171181 - protein, 207 aa, Triticum aestivum
  Clone ID: PAT_TA_65599.pep
LVLLNPHQWQWIKILQDFHSRPGGPPELRLTVVHEDSEFLDNMQACLCKQAANLKLCFYFDKVIGKLETLDFSNLREILKINFGEAVVISCALQMHRLLAVDDSISRDFTAQLQQMANMARLKQMACSACSPASTLNYPQTPSPQRQIPSLLVSFLYAIRALEPKIIVMMEQDADHNAPLFHDRFTKTVDYYAALFDSLNAVDAASP

SEQ ID NO: 171182 - protein, 71 aa, Triticum aestivum
  Clone ID: PAT_TA_65600.pep
LNYRYPYSWHQLFISKDLFLIAVIYYSLRFSLQVLCVYLGCQFYHPNINYIAQKLYRLKIEHMKFILVYFL

SEQ ID NO: 171183 - protein, 81 aa, Triticum aestivum
  unsure (1)..(81): unsure at all Xaa locations
  Clone ID: PAT_TA_65601.pep
MALPNHNTVDYPSFKLVIVCDGGTGKTTFVSRHLTGEFEKKXEPTIGVEVHPLDFTTNCGKIRFYCWDTAGQEKFGGLTDG

SEQ ID NO: 171184 - protein, 182 aa, Triticum aestivum
  Clone ID: PAT_TA_65602.pep
VGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAEL

SEQ ID NO: 171185 - protein, 90 aa, Triticum aestivum
  Clone ID: PAT_TA_65603.pep
PPPHPWRLCRCPSAGGSSTPACYRRGTGGFMLLLLSRRCGAADEPRAGTPALSPPRGQTWTEGNGSGAQRLSPPTARPPRLSGDGSTSSD

SEQ ID NO: 171186 - protein, 187 aa, Triticum aestivum
  Clone ID: PAT_TA_65604.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNS

SEQ ID NO: 171187 - protein, 54 aa, Triticum aestivum
  Clone ID: PAT_TA_65605.pep
FFFFFCYIAMQCVGTTIFVLILRLAMHCYMYACKHLCLIRRLVLHACMHIRLAS

SEQ ID NO: 171188 - protein, 200 aa, Triticum aestivum
  Clone ID: PAT_TA_65606.pep
IWFWMTAAAPSPSCHAVMTGGWTPSAQDRDAGLLPGYGMTTYILNGGTECNRTSQAAQDRVNNYYKKYCDILRVGYGNNTFCQNDELAQPPSSSLHPPPPPPGTPGEPSPPPASRSVLIGVSSSVSLLIIIGSLICFLLWRRRTRRRKQAEIREEAMEHGSEEGNFFDVDQAMEDDFEKGPGPGGFATETWSSPPATSVM

SEQ ID NO: 171189 - protein, 82 aa, Triticum aestivum
  Clone ID: PAT_TA_65607.pep
WCLGARHGTLHSTSSSWCGRWHQRVGDGRRHQLVGDGRQPQQVADNTCSWCYTHGFRHSLKHSGQIKPGWSSRCVQVYLELE

SEQ ID NO: 171190 - protein, 208 aa, Triticum aestivum
  Clone ID: PAT_TA_65608.pep
VDCQNSLAGSARLQELKIRIRIMSIFLGLELISLALLSIWAASIRAKPFERGPNASQTSKKLLLLPICTLPQRPKALTPLSTPSSRRKDKRRTSVPFPLCPLPMPTTQIHLTPLQVFRLDVLKEGKTSYQLALQGQGNTLNSVNSSQNLLISNRKCCLEPSAWLLQSIWPMFLLLTHIHLFPLFNKMPKNNADLQHSVDTHANYYKRL

SEQ ID NO: 171191 - protein, 97 aa, Triticum aestivum
  Clone ID: PAT_TA_65609.pep
RDFRQDDRHLGSHYYLSYASCLDAIAMSRYLPVIYQASQIAMIAPNLFHHPSKPLFGYVTALLSPSYSVASCRCRCRLFHVGTWISWISWDITITLI

SEQ ID NO: 171192 - protein, 112 aa, Triticum aestivum
  Clone ID: PAT_TA_65610.pep
NGDEVDGYDEALCPHDFEDRGVILDDEINETIVRPLGAGVKLHAIIDTCHSGTILDLPYLCRISRCVCTPSNLLPVNFQYTDGSFALVKNNFLLCGIKNWVLAMGEPQPSTG

SEQ ID NO: 171193 - protein, 61 aa, Triticum aestivum
  Clone ID: PAT_TA_65611.pep
RNFCCLGCLLLDQVMLVAIQNMLPVWSLTLLSALPIHVFLLVCWPAGLVLCSICWNWWVCP

SEQ ID NO: 171194 - protein, 71 aa, Triticum aestivum
  Clone ID: PAT_TA_65612.pep
TVDCRVVHFLEHCNALPSSNCMKIVHSTKTMCNGSITYNLYVNTMCNDCYFLHRLNIFLLLYCFSLMIDLL

SEQ ID NO: 171195 - protein, 191 aa, Triticum aestivum
  Clone ID: PAT_TA_65613.pep
SSTTLQGPKFSNERYYCSKEGLKDDEQLTEANFNKPETRTNCKAMVRFRVDSEGQWRVIQIIPEHNHELVPPEEIHLLRSVRILSIPKPGTLNAMVNAEIQSMHDSLHVHDDGAECHSQVSIQSYALLEPEDAEALVGYLKRRTIEQGMFYWDVQVDQEGQMTNFFWRDGRSRVDYDCFGDVVVFDTSYRT

SEQ ID NO: 171196 - protein, 76 aa, Triticum aestivum
  Clone ID: PAT_TA_65614.pep
WARAPCSPVRGEAGMATAGAGAAATLTGRAASGWKLKPPRCPVRADLTGCGEIGDGRLSVGCRSMWDGGFWGRRAG

SEQ ID NO: 171197 - protein, 195 aa, Triticum aestivum
  Clone ID: PAT_TA_65615.pep
LWVVDRLMRLGISRHFTSEIQQCLEFIYRRWTQKGLAHNMHCPIPDIDDTAMGFRLLRQHGYDVTPSVFKHFEKDGKFVCFPMETNHASVTPMHNTYRASQFMFPGDDDVLARAGRYCRAFLQERQSSNKLYDKWIITKDLPGEVGYTLNFPWKSSLPRIETRMYLDQYGGNNDVWIAKVLYRMNLVSNDLYLKM

SEQ ID NO: 171198 - protein, 145 aa, Triticum aestivum
  Clone ID: PAT_TA_65616.pep
ALMLYGFELRQWKIAYSFSDALSDSARVQWKMAWSLCYACSVIGNGNISRRSIYDYGTKLRKGKDCLLLINDLSLSAGILFALEYAEFQAALIANCVVIRSLGVATTNGFLHVPAADCDALFNSEEKLYQCIIQMLQLQWDPGDC

SEQ ID NO: 171199 - protein, 93 aa, Triticum aestivum
  Clone ID: PAT_TA_65617.pep
GENSLFERFSTVAQSAGVYTARDYGDLVEHFVRRWRVAELAGLSGEGRRAQEYVCGLPPKIRRMEELANQRAARSELRPARFSWIFDRHVMVG

SEQ ID NO: 171200 - protein, 138 aa, Triticum aestivum
  Clone ID: PAT_TA_65618.pep
SARPSLRSRTLRPTTASPSVLRGAQHPSFRPPRRQRRVKLHLASSSSPAGCPHPSSSSRAPEPVRRPHPELRLARFAGRALPIPDHPRVPPRGTGASQLPSTAGPERHGSAGPSPAVEHRPSPTSLACLLATPERVSS

SEQ ID NO: 171201 - protein, 173 aa, Triticum aestivum
  unsure (1)..(173): unsure at all Xaa locations
  Clone ID: PAT_TA_65619.pep
HPNRKXAGKNAHSARGICTNNSRPLSADDIQKAKMRAMFMQEKYGKVDTSKVSDKPEMTENKKPSGLVNSNEPPMPRSPLTSTAKQPVDPSPSTSIQNAVPLSDNPEILATPKLNIAPSETPIEKLDSKRVHWQIPPEVWIDPSWSVSAGENSKELDVQAQRNRREKETFYAS

SEQ ID NO: 171202 - protein, 200 aa, Triticum aestivum
  Clone ID: PAT_TA_65620.pep
MADADAKAPPKSNLDADLIASISPSSTSSGARSAVAIESQFADLAISDELPKPSGWGDDAVRGIAGSDEITGEITGGKVQPVATADSRPRFPQRHAEPDCTYYLKFGTCRFGMKCKFNHPARKKKNRVKESGSSSIGSNDISNKAFPPDDDQTPKEEYEDPVPNISAEVDLLKGRMEAMQLKIADETEKGFYLKKFKETE

SEQ ID NO: 171203 - protein, 189 aa, Triticum aestivum
  Clone ID: PAT_TA_65621.pep
AALAYDPFHPSHSGYYLCTYDSKDPRWRRTPAASPQPPPPEDFVSSKVITIRRSGSGSCSGIMGWVDLWSGMLLCDVLAAAADTLCIPLHYLTFPEPRQLRTELPLATDIGYHFRDIALANDSGIIRFVDLQVHAEPSPRSQTPSGWTVVTWTLEGLNGGLDALFFRQEHEIHSGHIHGYNLPQSLFVS

SEQ ID NO: 171204 - protein, 50 aa, Triticum aestivum
  Clone ID: PAT_TA_65622.pep
LCVHKCLVRVALQIITRSIPSSSAQMHHNCSYHNCTTENCLDHYCSADIY

SEQ ID NO: 171205 - protein, 213 aa, Triticum aestivum
  unsure (1)..(213): unsure at all Xaa locations
  Clone ID: PAT_TA_65623.pep
VAAATTLVEPSTYREAAAHSEWQHAMAEEIHALERTGTXDLVPLPTGVRPITCKWVYKVKTHSDGSLVRYKARLVARGFQQEYGRDYDETFAPVAHMTTVRTLLAVAAVRQWSISQLDVKNAFLNGELREVVYMQPPPGYTVSDGTVCRLRRALYGLKQAPRTWFECFSAVITRIGFSASVHDPALFIHTSPRGRTLLLLYVDDMIITGADHQ

SEQ ID NO: 171206 - protein, 138 aa, Triticum aestivum
  Clone ID: PAT_TA_65624.pep
RLVPSRSPPPPPSSGARRRTWPPPCPTPLAPPLPPPNQTNQPTRHPSSSKKAKPCPLTGDEICACGEFIGSLHRRGLGRPAFPVETRRARPPAPPAARRVHHHPGAPRPGRPLVPAPPGACRRHGHHAPPSPSSGRRR

SEQ ID NO: 171207 - protein, 98 aa, Triticum aestivum
  Clone ID: PAT_TA_65625.pep
RSAGIITETAWAGAAFNLLIYMLASHVFGALWYLLSIQREDTCWRKECGKINCNFASLYCGSNTARDNIFLQNVCLTNGSDDIDPTFGIYLPALRTVS

SEQ ID NO: 171208 - protein, 149 aa, Triticum aestivum
  Clone ID: PAT_TA_65626.pep
KPPKYVSLNCILNEPKSENVCSEVPLLDSSLIATGITDDNRKFPKIAPLSLVLKKAKRCNAVKTPCNTENIHSCEEKSAVRPVGKYSFGNQNYSSKAEDGIQSSKKSRYPPNALRLRPNIERDCKRPCIDLWEGKPIGPTDAETSQLSV

SEQ ID NO: 171209 - protein, 69 aa, Triticum aestivum
  Clone ID: PAT_TA_65627.pep
GGPDKEHGVPGVVKLLLETPSGFAIFSFAEDYLDKDIQIIWLHDFQMFEDKSSAINLTTRRLGAKLAQM

SEQ ID NO: 171210 - protein, 116 aa, Triticum aestivum
  Clone ID: PAT_TA_65628.pep
HIAGEPIRPPRLEDAGLEDCALPPESIAKAFSLAAWAVSSRLPHLPLSDDEDDVDPLAPRGGCVEDAGPTYGVIPDALVGARGGSDRGADEVVVGRGDRVVVIGQKLGPDEGCAEG

SEQ ID NO: 171211 - protein, 59 aa, Triticum aestivum
  Clone ID: PAT_TA_65629.pep
SCWVSSSSSKRFALSWCFSRGRIRSELEPPLEIQGGLEAGGRAVAMDDMCEALKELGTG

SEQ ID NO: 171212 - protein, 58 aa, Triticum aestivum
  Clone ID: PAT_TA_65630.pep
GTGTGTTRSPSHNPASAAPTRGLKSRKLTNPQTPAASEETLGRRNSKVSSAARKIRQL

SEQ ID NO: 171213 - protein, 88 aa, Triticum aestivum
  Clone ID: PAT_TA_65631.pep
GVHGGSAAPLAGLACNGGIPARCFVERGHPCSYTTFIAGCRRREHWCQFGHKCPPAVTRGTPRHPLCVLNLRLVRRCGWHAFNDAAAA

SEQ ID NO: 171214 - protein, 31 aa, Triticum aestivum
  Clone ID: PAT_TA_65632.pep
SLNELLDHGIQPHATIFQYDLPQILEDEYGG

SEQ ID NO: 171215 - protein, 119 aa, Triticum aestivum
  Clone ID: PAT_TA_65633.pep
AAGSSCTSSFSPARQDASPAGTSWRSQRSTRLRASPPRRGPGPRDKDRPPAQQGPRPPPLLQRRRLRRRCSSAPATSSAVQEVAAPSPLRLLPWSRRPPLLRLPWRPRLSGRHPLRRGR

SEQ ID NO: 171216 - protein, 90 aa, Triticum aestivum
  Clone ID: PAT_TA_65634.pep
AGTSMSRARRGLGSRSWSYRPRVRLHACAWARASFGRRQPYFASSRPPLCGGARDEAIGRWRRRSLNLAACRLCGLVCSIPHACAFTFFF

SEQ ID NO: 171217 - protein, 104 aa, Triticum aestivum
  Clone ID: PAT_TA_65635.pep
PQPRPPWSLSRPRRAPRPPVRPQLLARAPSSPLPQLLPAPPPWSPQPRRGQAPRLRPPPERGLPPSSRPPRRRPASPPRAPPPSARPMGSGHQRWPLPSWMQRK

SEQ ID NO: 171218 - protein, 139 aa, Triticum aestivum
  unsure (1)..(139): unsure at all Xaa locations
  Clone ID: PAT_TA_65636.pep
MTPLQAKLXKVAHSIGKFGLYSAIIILLILLVRFSIEKGIDKNWXTSKDVKELISYFILSITVIVVAIPEGLPLSVTLSLAVSVKQMLTDSNLVRKMEACETMGGANNICSDKTGTLTMNKMTLTQIWNGQTIDIDSHK

SEQ ID NO: 171219 - protein, 90 aa, Triticum aestivum
  Clone ID: PAT_TA_65637.pep
LNPPWGPAHAPAAAPSSGASSPPPAPRTCPSCDPIGARTMAPWRIWMNATGRTPHLLFPSRSKLQPQRELNILPLQLARASILCPAAGVP

SEQ ID NO: 171220 - protein, 138 aa, Triticum aestivum
  Clone ID: PAT_TA_65638.pep
VTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGAAPKSPKKTTKSPKKATKAIRPCR

SEQ ID NO: 171221 - protein, 74 aa, Triticum aestivum
  Clone ID: PAT_TA_65639.pep
VACFLAQDKSPAFQLGNHFLATICNVRPKQSKLAASNQMVVYHFGAVASLHKIMICQPHQRINCKKQTVTLTSL

SEQ ID NO: 171222 - protein, 189 aa, Triticum aestivum
  Clone ID: PAT_TA_65640.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNA

SEQ ID NO: 171223 - protein, 63 aa, Triticum aestivum
  Clone ID: PAT_TA_65641.pep
SRHQSLKHSGAPLGKYLPQCMLNSVSISFCNSRCSAQTTFVGTLGFKFTWGGGPEGTSSETPR

SEQ ID NO: 171224 - protein, 201 aa, Triticum aestivum
  Clone ID: PAT_TA_65642.pep
MASPTVAASPTRALADTTAPSPASPPRRLASAPPGVDAPAVSSPVSAHSGDLSACDVLSPLLASRSEEYRLMFRLPPDEVLVQDFNCALQENILLQGHMYLFLHHICFYSNIFGYETKKTIPLQDVTDVRKAKTAAIFPNAIEIVAGAKRHFFGSFLVRDEAYRIIVDGWEQHVSDARLLIERQDAKSASSSDENGYVLLE

SEQ ID NO: 171225 - protein, 177 aa, Triticum aestivum
  Clone ID: PAT_TA_65643.pep
MFGFGHHGHHGQNPPANAPAAGGGNQPTFKIFCKADEGYCLSVRDGNVVLAPSNPRDEHQHWFKDMRFSTQIKDEEGNPAFAIVNKATGLAVKHSLGQSHPVKLVPFNPEYLDESVMWTESGDVGKGFRCIRMVNNIYLNFDALHGDKEHGGVRDGTSLVLWKWCEGDNQRWKILPW

SEQ ID NO: 171226 - protein, 152 aa, Triticum aestivum
  Clone ID: PAT_TA_65644.pep
PPPPLPARRRGEPSRPKPPLPRPRYRIPAAPPSVKQPLPPAAPPSPEQALPPSNAADRSYAGDQSIGRASTLSIGGAWNCFGIHSRANTKDNGSSWTPRWTNAPWCILWSRPLWPPAFGAFSCHHTGDPGKQACRADRRGRKTYPRKSAIGR

SEQ ID NO: 171227 - protein, 137 aa, Triticum aestivum
  Clone ID: PAT_TA_65645.pep
TLGATRAPPAALTEERKRKRKESNRLSAQRSRARKLLQVDELEAEAAALRARNCAVAAAAQEAARRCAVVQAENELLHARALELGARLESLAELIQYIDAAAAMGASSIPLAGVNGTALPQQPILQTELYCNYPYYC

SEQ ID NO: 171228 - protein, 131 aa, Triticum aestivum
  Clone ID: PAT_TA_65646.pep
SRPESRGLHPVGALVRPHERLQETKQETREEFCPAANSRQNRRKKKKGVARRLAAWLVEPDRPGPPSSTRGLEGYTQLVRRCTPRATSRAGCLRQTPHRLHENKFELLTRIFLHHASTDNPERCSGAISAF

SEQ ID NO: 171229 - protein, 203 aa, Triticum aestivum
  unsure (1)..(203): unsure at all Xaa locations
  Clone ID: PAT_TA_65647.pep
KHVSAMGLYGWNSICETVGAEWLEDISKNQVHKLLKGLPPLKSVSAVVSGTKKLISLPIESYKKDRKLVKGMQRGAVAFIRSVSIEAVGLGVHLAAGAHDMLLKAEHALTALPPPLAACEAKRNKDNVRANQPENATQGIKQAYESFTDGLGRTASALIXNPINVYNRGAGARSALTTAICGAPAAVVAPVSATARAVHYALL

SEQ ID NO: 171230 - protein, 211 aa, Triticum aestivum
  Clone ID: PAT_TA_65648.pep
PYYREVLYKPDFINVSRGKPVIFDMDMSPGDFVSLIYLLKAPREVIDVKGVLVNGNGWANIASIDIVYDILHMMGRDDIPVGLGNTTAMGNPTLGCNNVYAIPLGSGGFIDSDTLYGLARLLPRSPRRYTPESTDDPEHRQPLAFEVWQSVRRQLCPGDKITLLTSGPLTNLANISLSDRDASSVIERIYVVGGLIKDGGHEKGNVFTVPS

SEQ ID NO: 171231 - protein, 55 aa, Triticum aestivum
  Clone ID: PAT_TA_65649.pep
NWVSIEGFSDNTCVAAYNSLIYLHNISMLVSLFSMPLIVHGSNCITRLIKTTCIM

SEQ ID NO: 171232 - protein, 204 aa, Triticum aestivum
  unsure (1)..(204): unsure at all Xaa locations
  Clone ID: PAT_TA_65650.pep
QSEHGRRFEKGTAPKWFCYSDLAMATDNFSDDKKLGQGGFGSVYKGFLKELDLHVAIKRVSKGSKQGRKEYASEVRVISRLRHKNLVQLIGWCHGGRELLLVYELMPNGSLDRHLCAANNAILPWSVREYHIASLXVHAGTMGYMDPECMITGKANAESDVYSFGVVLLEIACGRRPVVVVHQEEEDDDEDAVHLAQWVWSSYG

SEQ ID NO: 171233 - protein, 103 aa, Triticum aestivum
  Clone ID: PAT_TA_65651.pep
IKDHHSIDTLTLFWLLSFSFFLNPSIHQRSSSPSRGSSWTSEQRQGTKNPPMSKESPNAQRCQHHYMEKCCFLMFTRGIYISLSKNDFMFWYSFLVMSWDHTH

SEQ ID NO: 171234 - protein, 117 aa, Triticum aestivum
  Clone ID: PAT_TA_65652.pep
PSPSHHPPLSLLPPSQRRPCLLPSSAREQEVLQQASAGEICRPASIFHLSYSPLVQQRHHAVRPLLGARFMTKFAPYIIIMSFIFSNYSNSLYILNCKKKYCTLTCDKHIYLNNCPQ

SEQ ID NO: 171235 - protein, 180 aa, Triticum aestivum
  Clone ID: PAT_TA_65653.pep
MAAAFSSTVCAPASTPTNCLGKKLKKQVTSAVNYHGKSSKANRFTVMAAENLDENRNTDKWKGLAYDICDDQQDITRGKGIVDSLFQAPTGDGTHDAVLSSYEYVSQGLKKYDFDNTMGGFYIAPAFMDKLVVHLSKNFMTLPNIKIPLILGIWGGKGQGKSFQCELVFAKMGINPIMMS

SEQ ID NO: 171236 - protein, 130 aa, Triticum aestivum
  unsure (1)..(130): unsure at all Xaa locations
  Clone ID: PAT_TA_65654.pep
ALLLNNEYTCILALDCKTMWNSTYIMLKGAFQYKDVFXRLSIHEKKFTCPTGEDWVFAKEVCDTLKVFFDVTELLSGTSYVTASLFFSQICGIRLAIPKWETSKHSVIKAMSKEMKDKFEKYWTDVHGLM

SEQ ID NO: 171237 - protein, 140 aa, Triticum aestivum
  Clone ID: PAT_TA_65655.pep
MSAMAATGAALRLRLLFRMLRVGELIAVAALLSWSSSRAPSVAAAAMRVAGSLLFSPRFVFVLGNAIVLLLLALSRRERVEPSPASSAAASSAGAGVEQGQTPAASFASFAVQTTPTPTPMPTQASEAPVVVMPAMAMAM

SEQ ID NO: 171238 - protein, 82 aa, Triticum aestivum
  Clone ID: PAT_TA_65656.pep
LQIVTIDVTPPVIALQTMQQQTGHEPLVKGLNIQSVHQPQTMKLVSADHNTLEARERRSFLHQNLTLNSSASFLSQICTHLV

SEQ ID NO: 171239 - protein, 104 aa, Triticum aestivum
  Clone ID: PAT_TA_65657.pep
PRQVFVVNFPVYRELLAVELGGERSWEDLLPVSCSALACEGTLNHRCHISFCLTSWIWRRQSTCLVGACSRARMRRRTQAVVLAIAGGMALQEKERGWRGTKEK

SEQ ID NO: 171240 - protein, 140 aa, Triticum aestivum
  Clone ID: PAT_TA_65658.pep
TSPPPSPRRSLPALRSPFAGPGMVLPRRRGGHNHHPCPCPCPRRAVLPAAALLLLFLLAAVTLLYVSPPPLSDHPALAYSRRRSPHALLNSSGGGSLVEPGRREISRVPKGGWIATDGLWGSKLASKFYGCSNSSSKFLD

SEQ ID NO: 171241 - protein, 53 aa, Triticum aestivum
  Clone ID: PAT_TA_65659.pep
RQNLYHLHYFSRSDENNMVLSLNKNIIWYFSCSVTVRIRRGLVDQYWHETFLT

SEQ ID NO: 171242 - protein, 80 aa, Triticum aestivum
  unsure (1)..(80): unsure at all Xaa locations
  Clone ID: PAT_TA_65660.pep
ISSPEEVFDEEQDDGWQPVQRPKTAAVLGKQIKHYRPAIRMFFYPDNHAPRXASQYKPRNSYSNNRYYFLKKKTIVPAAY

SEQ ID NO: 171243 - protein, 52 aa, Triticum aestivum
  Clone ID: PAT_TA_65661.pep
LQQIPPETSRPPMAGATSCFATLAIARPAASGAAAQRALLASKSPRQTSPSA

SEQ ID NO: 171244 - protein, 130 aa, Triticum aestivum
  Clone ID: PAT_TA_65662.pep
EVMDTMKHVINLSNVVDTLCKQMCQCIENDLLYPLRTPHNIAPYKSKGLDRASELHICLDSAEQSSPSTKCSQDEHKSQPGLCSEPGSSLTGKRPILQMHGSSSDNSGRPSHKRERRDAHGGGALFDLNM

SEQ ID NO: 171245 - protein, 141 aa, Triticum aestivum
  Clone ID: PAT_TA_65663.pep
FRKFDGLAWDIERAQPPVDLWRKFVYCTSLSGSILGSVDHMKQEDFNKVISPISVAHFSQYKLVDLLLKKLDGVGFQTCFPDELGGSSTQDLLLENKILMGHECSSIQLTDDGILVGASFNNGGRVHERKLHCGLLLGADG

SEQ ID NO: 171246 - protein, 141 aa, Triticum aestivum
  Clone ID: PAT_TA_65664.pep
RLLLTFSAALVGVSHGSDGTNSSVPPGKFPLGFALTLTASALFSLILSLMQLTFDKVLRSDTFHDVMEMQFWSNTAAAVVSVAGLFISGEWSALHGEMDGYRQGRVAYGMTLAWTAISWQLTTMGLMGLVAAVSSLFTNVI

SEQ ID NO: 171247 - protein, 149 aa, Triticum aestivum
  Clone ID: PAT_TA_65665.pep
SSDPSLSSIPYKWCYRAGAATARGCMGPSDGGCYKLLAAGARAGQDGSYNWQTFLLQPTTHMLEPAVFLATTRGAATVACCFCWNRHLDLLELAIKIATSIAASKPPSAGTDDLFCCNRQEVCWNQQMLDTGLGRDGELRPADQRKSYN

SEQ ID NO: 171248 - protein, 74 aa, Triticum aestivum
  unsure (1)..(74): unsure at all Xaa locations
  Clone ID: PAT_TA_65666.pep
SAVLCGSSAFFAAXAPEPNAAAGARRIEVDGVDNVAAFRDAVELMFQADAARWLAKAGVSRAIAVLEVAPSVVF

SEQ ID NO: 171249 - protein, 205 aa, Triticum aestivum
  unsure (1)..(205): unsure at all Xaa locations
  Clone ID: PAT_TA_65667.pep
TFSRTSFLHASXNKLHGSLPEDLQYMSAEHIQLGSNKFIGQVARLPINISRLNLSSNSFSGSLPSDLNAPLLGELLLANNQFTGTIPLSICQLTRLNRLDLSGNNFTGDIMQCWKKSDANSTNQFGFDMLSLALHNNSLTGEFPKFLQRSTRLMFLDLSYNRLFGGLPEWLPEKMPHLKILRARSNMFSGHIHKSLTSLDSLHYL

SEQ ID NO: 171250 - protein, 55 aa, Triticum aestivum
  Clone ID: PAT_TA_65668.pep
FLACLISPSFQVYRLHQLNRAAQLVTALTFSVRGTEATNQTLSIMNSLGALLTVL

SEQ ID NO: 171251 - protein, 207 aa, Triticum aestivum
  Clone ID: PAT_TA_65669.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAEL

SEQ ID NO: 171252 - protein, 127 aa, Triticum aestivum
  Clone ID: PAT_TA_65670.pep
PFPSPHHPAPVPRKRASCRRNQQPAKMVAAFAVTPSSSICGVCIPTACRPEARGVVPAPRFFHSHNRANRRSATAWSLKAGLWDSLKSGFLKTSNGAETVEPLSTALEEEEIVPEELVLLQRTLPDG

SEQ ID NO: 171253 - protein, 127 aa, Triticum aestivum
  Clone ID: PAT_TA_65671.pep
IIISDSISFMHWAICNTCSSLPYYSSNNDCNCSKCDKNSGSPNHPFSFVHLLAHLQLMHAIKIITHHHIPKDVLDNSKLNKKMYYTTTIGAKKKIWTSAQKGRGRGVCTSREMVVHRLPPRRCSTRP

SEQ ID NO: 171254 - protein, 172 aa, Triticum aestivum
  Clone ID: PAT_TA_65672.pep
KHCKEEHNYSESRHNKSRLHDSKGKKRSYEESGHNGDLEPRNAKEYHGDAKRRSDVSSFVSNEDRRREYEKVDSRRRDFERKSPTRSSTYPVKEQSRHFPKQEESSPRENGAALGRHRRTSDFQSVEGLSKTDANSNESSLPLKDGRNLRSDGRPIHFNDRPPSASDCQVSN

SEQ ID NO: 171255 - protein, 113 aa, Triticum aestivum
  Clone ID: PAT_TA_65673.pep
LLSPNQTLSVLLHSPKLTRPPVCHSLLTAANRWSPVLPTLAALCSEGPPGLHARCRVLAAGASPSLTASAGRCMLPCSGPLMLPRGRKLNSELLLKRRRSKTAARAKVFFQIN

SEQ ID NO: 171256 - protein, 56 aa, Triticum aestivum
  Clone ID: PAT_TA_65674.pep
REPPRSGSLPPQPPEPPHRALRRLWSRSLASVTPPLRLRRKLLTSVKFGWIDASPN

SEQ ID NO: 171257 - protein, 109 aa, Triticum aestivum
  Clone ID: PAT_TA_65675.pep
RNTYMVGSIKLSSMITDGATIFEIEEPQVVQRNRGLVTIYNKMGQLRRRFYKLMIEGRQGSKEGNFIKDKLKVFLKEVKILQDQVKKLRGVDGYFKMPPVLAEDLVLLK

SEQ ID NO: 171258 - protein, 48 aa, Triticum aestivum
  Clone ID: PAT_TA_65676.pep
RWVAANVDVCPSLRRPLSDEVSFLCHSKCDASLGILLEIHVLSTDKRC

SEQ ID NO: 171259 - protein, 57 aa, Triticum aestivum
  Clone ID: PAT_TA_65677.pep
QHQHRHRPNRSYPLHSFVAVAHSTSFGCVGHVVPAISWTIGVNHFNRQKQTYCYHNQ

SEQ ID NO: 171260 - protein, 71 aa, Triticum aestivum
  Clone ID: PAT_TA_65678.pep
QSIYIRDVWCISFSATRVAVIDVLKISVMEMSSLAYTSQILQLHKLKNQHVATDGRPHCWQSALPQSKSVQ

SEQ ID NO: 171261 - protein, 80 aa, Triticum aestivum
  Clone ID: PAT_TA_65679.pep
AAALLNSQRRRRLPGGVRRSRRINPLPHPTAIMTHLSPWSSVFDQYWVAAVLPVAWWRCGWSREHSVGGVPLHTLDHRGA

SEQ ID NO: 171262 - protein, 76 aa, Triticum aestivum
  Clone ID: PAT_TA_65680.pep
RPPAATAAAAGGSPHAARRGSPTSARLRASPGPGLLLQAAAAERRCACRRACVPGEAAWPSVREGGPLWIKGLIPF

SEQ ID NO: 171263 - protein, 47 aa, Triticum aestivum
  Clone ID: PAT_TA_65681.pep
MHWARAVPSDFGGQAPAPRSGHTAVAIGGSKVVVFGGFSYKRFLADI

SEQ ID NO: 171264 - protein, 64 aa, Triticum aestivum
  Clone ID: PAT_TA_65682.pep
SYAVQPVAVRGLAGRCISGRKLAVRPASAAVSRSTRRARGAAVVAKYGEKSVYFDLYYIANTTG

SEQ ID NO: 171265 - protein, 88 aa, Triticum aestivum
  Clone ID: PAT_TA_65683.pep
FLVQESLVEAELSKLACPICYYPLVSSIDHQSAPSKSDSTLECSTCKKLFSKDDYWDLTVAVGSTEYSETMPAATELFRTQLVSFLYE

SEQ ID NO: 171266 - protein, 163 aa, Triticum aestivum
  Clone ID: PAT_TA_65684.pep
PMEFAVAAFSTVAGVALSKLCSVKGKLNTDATIISEELKWIEAAMKDHASSVEPMSFLQAEYFAQLRALAYDIQDCIDSFNAKMTTDDEFADKIAQLKERSTATTERIKRFGFPVQGAAAQAAAAAVPAEIQNFHFLMRGGNLNGDYHNCLLYLRLFPHEHHV

SEQ ID NO: 171267 - protein, 64 aa, Triticum aestivum
  Clone ID: PAT_TA_65685.pep
RVALRPHVAHSARHRRHLAPRHGSPYRRQLDLHGAARRRAPRRQEPGRGRTADGGDGGRRSGHC

SEQ ID NO: 171268 - protein, 125 aa, Triticum aestivum
  unsure (1)..(125): unsure at all Xaa locations
  Clone ID: PAT_TA_65686.pep
AQTMASMTGLCAGVRLPCPAGRRASRFTVRASSAEAEAAGRRAVLGLMASGVVWSAFAHVVGAGTVAAIKVGPPPPXCGGLPGTDNSDEARDFDLPLKNRFYLQPLPPAEAAVRAKESAHDILNL

SEQ ID NO: 171269 - protein, 123 aa, Triticum aestivum
  Clone ID: PAT_TA_65687.pep
YLHPAQSVFDGFFLCAINPNPAEFEAPSPLLVGSPRPISDPKFQPPPPPLGSSLGGSVGGEDEGGEELGYRRAAVGGSAMEVAHAPRRSLCAGAPLKMRWARRSRGWRCRMGGAPPEVGVAGG

SEQ ID NO: 171270 - protein, 153 aa, Triticum aestivum
  unsure (1)..(153): unsure at all Xaa locations
  Clone ID: PAT_TA_65688.pep
GIVDSLFQAPTGDGTHEAVLSSYEYVSQGLKKYDFDNTMGGFYIAPAFMDKLVVHLSKNFMRLPNIKIPLILGIWGGRGQXKSFQCELVFAKMGINPIMMSAGELESGNAGEPAKLIMQRYREAADMIKKGKMCCLFINDLDAGAGRMGGTTQ

SEQ ID NO: 171271 - protein, 130 aa, Triticum aestivum
  unsure (1)..(130): unsure at all Xaa locations
  Clone ID: PAT_TA_65689.pep
IYRSQELCVWKRAWASALRPFNPEVLLRDLALQLQNTIDEQPARTKEKVSXMKLEDLKEQLADVLKIKECLVVLDDVSTTFEWDLVKHCLGNARRIIVTTRKKDIAKHCSIEDKYICHLDGLKDDAALDL

SEQ ID NO: 171272 - protein, 76 aa, Triticum aestivum
  Clone ID: PAT_TA_65690.pep
QVWQPFQGLPRCMPPSPPPAPSFVDILHILIIWVRRLKNDVHAYYVLIDWMSLSKELVEFSLTCFICFDHSFKLHN

SEQ ID NO: 171273 - protein, 167 aa, Triticum aestivum
  unsure (1)..(167): unsure at all Xaa locations
  Clone ID: PAT_TA_65691.pep
YSECKTLQXFRINKNQLTGSIPERLWGLPAVTIIDVSDNGFTGTISPLIGEAQNLNQLWVQNNRLSGTIPAETGRLGQLQKLYLSNNSFSGTIPSQIGNLAQLTALHLEDNALGGALPADIGSCSRLVEIDVSRNELTGPIPASLSLLSSLNSLNISRNAITGMIPA

SEQ ID NO: 171274 - protein, 158 aa, Triticum aestivum
  Clone ID: PAT_TA_65692.pep
KVFKGVSAAKYHTLVFGADGEVFTWGHRLVTPRRVVIARCLKKGGNANVKFHRMERLQVISVAAGVMHSTALTADGALFYWNSSDLDLRCQQIFSMCGRNVVSISAGKYWTALATSTGDVFMCDAKKRKDETPVFTRVNGVKRASSVCVGETHMLVLS

SEQ ID NO: 171275 - protein, 127 aa, Triticum aestivum
  Clone ID: PAT_TA_65693.pep
RGVERDPRGAMAGIPEHGEGRVRYLVDTFERLLSLSRGDREAQSGGGAGTRRRKKESASVPSSPRKAEEIDMASYPSVASSSDLSYCIIGLPRRNRSSSGARDEHQSAGSSERSSCRKATRPHPFNL

SEQ ID NO: 171276 - protein, 110 aa, Triticum aestivum
  Clone ID: PAT_TA_65694.pep
TSPAFFLSLPCRSSSPHISPSLSVRTGRTGASVIASWCRSPIMAPERLKFVTASLRRACSLATSTTRPLLCPSLSPLLLPISHMVSLYHLHRIPTLTPCTPPPRASSLHP

SEQ ID NO: 171277 - protein, 74 aa, Triticum aestivum
  unsure (1)..(74): unsure at all Xaa locations
  Clone ID: PAT_TA_65695.pep
WRRRRPSPPPASPPPPRRRSTTTRTTSSASAAPAAXAQRLVAMAGSGKFFVGGNWKCVSTRRSLHAPPALRARV

SEQ ID NO: 171278 - protein, 77 aa, Triticum aestivum
  Clone ID: PAT_TA_65696.pep
PQHQHSHHPAQFPTRCLPPSRCRPRGLHSTSRSCVSCGLLPPLSFILCAIHHTLNRITIAVHTPMKMILLTPMMGCA

SEQ ID NO: 171279 - protein, 87 aa, Triticum aestivum
  Clone ID: PAT_TA_65697.pep
PPTTTSTASCTELRRGIGREAYSEGWWKRLQIAVCRLLRSPGNVAAGCSLLRRCTRLLSCPVDVVVGGLPLVLHLAPVEQLCKNPDE

SEQ ID NO: 171280 - protein, 180 aa, Triticum aestivum
  Clone ID: PAT_TA_65698.pep
MEASIARQICHVLLFPLKRSFDSFMFFLFSELVRYISRHPVRKRTPRVPVLLPLDINATIKANEEINNDGSSPDGSSGITEAKVVQGQTFLEIKGTEDTEISQSQQHLNLKKRRIQQSMDEGQTSKVEPGATMVAKKEGHNLSDYERLSRLFSPEEMMVLDVLESLVTVPNETSQAKINS

SEQ ID NO: 171281 - protein, 158 aa, Triticum aestivum
  Clone ID: PAT_TA_65699.pep
ALLAVAACCAALLVAAAPPQHQQHKHVRISGNAGDVLEDDPVGKLKVFIYEMPRKYNHYLLEKDNRCLYHMFAAEIFMHQFLLASAVRTMNPEEADWFYTPVYVTCDLTQQGFPLPFRAPRIMRSAIQYIAATWPYWNRTEGADHFFLAPHDFGACFH

SEQ ID NO: 171282 - protein, 164 aa, Triticum aestivum
  Clone ID: PAT_TA_65700.pep
MAAATKIVGITTNSLLKSAAPASLSAAAPSRHNSWWSHVQMGPPDPILGVTEAYKRDQNSNKINLGVGAYRDDNGKPFVLPSVIEAEDRMRKKNQDKEYAPISGPAEFCKHSITLALGEDNEHVKNSLNATVQGISGTGSLRIGGAFLQRFLPGKDLYLPTSSW

SEQ ID NO: 171283 - protein, 111 aa, Triticum aestivum
  Clone ID: PAT_TA_65701.pep
GMQRISFFLLGSGWAQTGAFGLINICTVAYYIPYWLDLFYLKISLTSGKCIFLLLCCIAPIKNRSFLDDFFYCQLYMALALFHRFIVAGKHVLHSHKLLQHAPLKEPTSAC

SEQ ID NO: 171284 - protein, 95 aa, Triticum aestivum
  unsure (1)..(95): unsure at all Xaa locations
  Clone ID: PAT_TA_65702.pep
MVDEEHEVYGQEIPVDGEDVDMGAGGDDAAKLHELDEMKRRLKEMEEEAAALREXMQAKVAKEMGGGDPNATTSESKEEMDSRSVFVGNVDYACT

SEQ ID NO: 171285 - protein, 187 aa, Triticum aestivum
  Clone ID: PAT_TA_65703.pep
LAEGRPSQLKVIAVVGFCGLGKTALAAEVYNRETRSERFERHAWVYAALKSPREVLADLLRKLSSDAPSCQGKSVLETSDVGQLCTELKQHLVMRRYFIVIDDIRTEDQWKTIKSALPADKDISSRILVTTTIQSVANACSSSNGYVHKMSRLDKMCSKQLFTKKACPDKYSCYKQPDPAEVLKKCD

SEQ ID NO: 171286 - protein, 104 aa, Triticum aestivum
  Clone ID: PAT_TA_65704.pep
YHTSVYFFASYKYPKGPGERIQRGEPASDDTPCALAGTRRVAAGRWPSIVGAVVRLSGSGERRRGVQCGAALDFFYLLQETKNRIREDKNSGVLSPFNCSFFKT

SEQ ID NO: 171287 - protein, 105 aa, Triticum aestivum
  Clone ID: PAT_TA_65705.pep
SRTGPSETPLQKIVTAFHCSKSPLIRNQIPPAVPMLRFKRLRILTTRSAGQSGCIGRRAAAPEGISGRPRWPARAAGARAPAASAGGTLLAGGRLGCDLLMFWWM

SEQ ID NO: 171288 - protein, 75 aa, Triticum aestivum
  unsure (1)..(75): unsure at all Xaa locations
  Clone ID: PAT_TA_65706.pep
ATTDCTEELGYNRSSYYGSTQPACHDYRNTATYEYIISTYGDXMSLSQVLGDIKNDRSWWGLRMKDALANGLSWD

SEQ ID NO: 171289 - protein, 64 aa, Triticum aestivum
  unsure (1)..(64): unsure at all Xaa locations
  Clone ID: PAT_TA_65707.pep
PPPPQPAAAAARKTASTSCPAPPPXAAAAPPRPAAAGPLRWPPPSSRPALAYLPRPTDLPPPPP

SEQ ID NO: 171290 - protein, 201 aa, Triticum aestivum
  Clone ID: PAT_TA_65708.pep
LPPAGAKPGPVVYWMLRDQRLADNWALLHAASLAAASAAPLAVAFSLFPKPFLLSARRRQLGFLLRGLRRLAADAATRRIPFFLLTGGPMEIPALVQRLGASALVADFSPLRPVREALDAVVGALCRDAASVAVHQVDAHNVVPVWAASGKLEYSAKTFRSKMNNVLDEYLVDFPEFAEVVPWDRDQPKDIDWDTLIDTVC

SEQ ID NO: 171291 - protein, 91 aa, Triticum aestivum
  Clone ID: PAT_TA_65709.pep
TAQRRVWLTLDILSSTLPHSPDGGGGGTSRPCVAVRVTNASLADVFFVPFFASLSYNRHSKLRGRDMVSRNRILQAELVRYLMRQEEWRRW

SEQ ID NO: 171292 - protein, 176 aa, Triticum aestivum
  unsure (1)..(176): unsure at all Xaa locations
  Clone ID: PAT_TA_65710.pep
HHGPPVMASSATSVAPFXGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 171293 - protein, 184 aa, Triticum aestivum
  Clone ID: PAT_TA_65711.pep
MAELIISAVVGDMVGRVISLLAGQFKGQGCTDAKLRRICHMLVKVHSAVEEAKGRHITNCGTLEWLSELNDGVYQGRYLLDTVRCREQELEDDHADKVGTQPFSLSLFNPAKRVRVAACAVKSLLSRNDVGGPEEIDRVVEILETISGDLKEFMMLLQNCQPIHRPLATNIFIEGQMFGRHVEK

SEQ ID NO: 171294 - protein, 148 aa, Triticum aestivum
  Clone ID: PAT_TA_65712.pep
APPSSASRRISGMARTKQTARKSTGGKAPRKQLATKAARKSAPATGGVKKPHRFRPGTVALREIRKYQKSTELLIRKLPFQRLVREIAHDFKTDLRFQSSAVSALQEAAEAYLVGLFEDTNLCAIHAKRVTIMPKDIQLARRIRGERA

SEQ ID NO: 171295 - protein, 161 aa, Triticum aestivum
  Clone ID: PAT_TA_65713.pep
LIMVVIAGLHVVVATSSVVGVVVDGGVWLLGSNIGEAHVGPVEALEQRGRCSRRRTPVMQTRESARSASCGIARVRLILVVDEEEAGKVPGHGEAERGSRLSRGRSHGVDGAWVRADLEKRARPKGDRAGVGHRERGDKYPRGRRSGLLISPRGAVAAWPA

SEQ ID NO: 171296 - protein, 108 aa, Triticum aestivum
  Clone ID: PAT_TA_65714.pep
KRRAARNCTWKIDDVETTPCLHFFILYLRVIMYSIKMHSEFYIFRVSFMPCPWWKVQPLYFTLYHPCWSSLAMDGSIHSIILWRRVPLFEIYWYTCLLLLCMLRSAVF

SEQ ID NO: 171297 - protein, 189 aa, Triticum aestivum
  unsure (1)..(189): unsure at all Xaa locations
  Clone ID: PAT_TA_65715.pep
MAVGKNKRISKGXKGSKKKAVDPFTXKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFI

SEQ ID NO: 171298 - protein, 112 aa, Triticum aestivum
  unsure (1)..(112): unsure at all Xaa locations
  Clone ID: PAT_TA_65716.pep
MDPWSPQRRPHQTPPRRHRRPFXXPPQPHRRHPPAPAQPPRPRPLLWHPRSRRYHPPPRRPHRAPVRHRPARAPPPPRRLRPGFPDPPSPAGASRQWRCRPSRAPTARGAQP

SEQ ID NO: 171299 - protein, 194 aa, Triticum aestivum
  unsure (1)..(194): unsure at all Xaa locations
  Clone ID: PAT_TA_65717.pep
KVAPLHWLTQHHAVPRRSTRPPPSTLTQPAPPPRALAPHTLTXPPRPRLPPPVLPQQQRERPARPRQQAPPLPSPPRPPPALPQPRPPWSLSRPRRAPRPPVRPQLLARAPSSPLPQLLPAPPPWSPQPRRGQAPRLRPPPARGLPPSSRPPRRRPASPPRAPPPSARPMGSGHQRWPLPSWMQENDRSGRGWL

SEQ ID NO: 171300 - protein, 185 aa, Triticum aestivum
  Clone ID: PAT_TA_65718.pep
MLHRDHTHTDWVKFTSMCWRWMCSPSMDVCAAPQPRPCARHLSSQLTDTRRRLIARHPRIGSPFPSPDPIWKLPNRRDGLGKVRLEGNRESGACPHLLPTAHWRASSHNDATGGPCSTTRDQPVGPPRGLLTERRHVRHRLHARRLFNGRRLCPGSWWWQPLTSCVALQLRYGATNGRFLPAAWS

SEQ ID NO: 171301 - protein, 150 aa, Triticum aestivum
  unsure (1)..(150): unsure at all Xaa locations
  Clone ID: PAT_TA_65719.pep
MRKHHRGLGSVAAPALLLLLLLALVLPSTQTQSQKQSARETAAMAAEPARRLAGGIVESPGRENDLHIVGLARFAVSEHSSPXSLNTPLELEKVVRVKEQAVAGRLYYITIQVDEGGAKKLYEAKVLEQLWLDVRKLVEFRPAEGASPNV

SEQ ID NO: 171302 - protein, 62 aa, Triticum aestivum
  Clone ID: PAT_TA_65720.pep
QVPIMDEIDRKVDKANTELRKTNVRLKEIVNQIRSTRNFTVDIILICIILGIGAYLYNVLAQ

SEQ ID NO: 171303 - protein, 187 aa, Triticum aestivum
  Clone ID: PAT_TA_65721.pep
FPPVVKPSAPSSVAAGEPPRLGDAGGEGAPRMIERAPEEESAGRGGTTGRSPAREEARASRGDKPFFGLLFIFVDHFVEDVGLDDYTQIIESLGGKVGTGINYNEATHIAVKGQVPPGARIFWEADGKTVTTTAWIENCFNMRKLLTNPCKDSSESLLPSPDMTPLATIKSRNCLSDSKISSKNCSP

SEQ ID NO: 171304 - protein, 124 aa, Triticum aestivum
  Clone ID: PAT_TA_65722.pep
TCLPPCPTTVRRTILLLIGSTAFSPPRWIAGHGRLLPAWISSCRRALPLGLRLRPHLAVGAGGQPQVPQRERGRGRRGRGRGRSAAAVHAGGGASRRHAPSHAAAVARERAGQAQAKVPRRRME

SEQ ID NO: 171305 - protein, 102 aa, Triticum aestivum
  Clone ID: PAT_TA_65723.pep
ALAGFGRSVTPLEEFADSFESPDLAPLALLMPDQTNPAIQADSNAALDAGNKLASAGPGGRTVESGGVRRHLRLSAQPRATQKRLVGQRCYASLMRHLTGRH

SEQ ID NO: 171306 - protein, 56 aa, Triticum aestivum
  Clone ID: PAT_TA_65724.pep
QHHVRAAAGGGRAGHRGVDADLPLVPVEGPPRSDAVVVVHALGQAEAVDLEQPHRA

SEQ ID NO: 171307 - protein, 90 aa, Triticum aestivum
  unsure (1)..(90): unsure at all Xaa locations
  Clone ID: PAT_TA_65725.pep
VELVDDNDPFMATEYMTYMFKYYTGQSHWKHSDIKLNDYKTVVFGEKPVTALSVRNPXEEIPWGEAGADYFVESTGVFTDKDKAAAHLKG

SEQ ID NO: 171308 - protein, 103 aa, Triticum aestivum
  Clone ID: PAT_TA_65726.pep
PIVVSIISNISFWMSCRTFDCSIPNCPLYSTTPKVWAKKSDTRPPHPHSYITEQNLRIFQGRRMHSEQNRRKSRAETGSGHSRTCSGVPSTSASGTGSPPAAT

SEQ ID NO: 171309 - protein, 236 aa, Triticum aestivum
  Clone ID: PAT_TA_65727.pep
FVRGVSGGERKKFAFGNEIIINPSLLFLDEPTSGLDSTTALRIVQLLHDIAETGKTVITTIHQPSSRLFHKFDKLILLGRGSLLYFGKTAEAMPYFSSIGCNPLIAMNPAEFLLDLANGNTNDVSVPSELDDKVHMENQNLQDTNSKINLRPSAQDVHEYLVDAYEHRVAYKEKKKLLAPLPISDDMKATITSSKREWGTNWCQQYSILFCRGLKERRHDYLSWMRITQVIATSVI

SEQ ID NO: 171310 - protein, 143 aa, Triticum aestivum
  Clone ID: PAT_TA_65728.pep
ESNILGKGGFGNVYKGTLEDGKEIAVKRLRVGSVQGAVEFKNEIALISRLQHRNLVKLIGCSIHEDEKCLIYAYLPNRSLDYFIFNDRRKSLLNWPTRFKIIAGVARGLLYLHQDSRLTMIHRDLKASNILLDAEMIPKISDF

SEQ ID NO: 171311 - protein, 99 aa, Triticum aestivum
  Clone ID: PAT_TA_65729.pep
MCTWPSLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 171312 - protein, 114 aa, Triticum aestivum
  Clone ID: PAT_TA_65730.pep
RGRGGGRPGQVTVGPSRCAEATGNREEVGHRVKEQAGPPGSTAAAQPGRRPGSPLLCHERRRRLCLHPHLLFHASSSAYADFGETPRIIIQVDGRCTLLFSGLMIGESMFYIAR

SEQ ID NO: 171313 - protein, 206 aa, Triticum aestivum
  Clone ID: PAT_TA_65731.pep
KGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDM

SEQ ID NO: 171314 - protein, 132 aa, Triticum aestivum
  Clone ID: PAT_TA_65732.pep
MAGTCAHVEFLRAQPAWALALAAVGLLVAARAALRLALWVYAAFLRPGKPLRRRYGPWAVVTGATEGIGRAIAFRLAASGLGLVLVGRNPDKLAAVSEEIRGKYPKTEVRTFVLDFASEGLAAGVEALKDSI

SEQ ID NO: 171315 - protein, 170 aa, Triticum aestivum
  unsure (1)..(170): unsure at all Xaa locations
  Clone ID: PAT_TA_65733.pep
GVDATIDYRNRLLACANATSAETCYITSDIHAHGLNSECTKQADTDMDNIVDSKSRAQSQPSGYKHDLQKVTSNNCLEHCYRTDTSRFSKDLSVTGKVDVEEDDSQYEDGELRESGDRYWADDIYEEVKCANYQVSDYKDEKAAPDIHHVPVGSVXNNMVMPVANYNGTL

SEQ ID NO: 171316 - protein, 50 aa, Triticum aestivum
  Clone ID: PAT_TA_65734.pep
KKNPLTSLWSRALALHRRRPLLRRDRKQAALSELSSSSTLDLYRQVAAAS

SEQ ID NO: 171317 - protein, 39 aa, Triticum aestivum
  Clone ID: PAT_TA_65735.pep
LPLLSLIGTWRSTSDRWRHRWCGRGARWSVMVVAAAMVV

SEQ ID NO: 171318 - protein, 150 aa, Triticum aestivum
  Clone ID: PAT_TA_65736.pep
APSPPPSPPRAAARPRPPPAPSPGPGHLPRRRRPPSLPPPPGSRASAAATTSTRRCSHRPPPRAPWRPSSTGPADSWIHWQPAPSPQPPSFTVARASWPPSRTTPPPCPVDSDRRRPSSPASTAEVASICRQPPPRPAPGRPRDLSMAPA

SEQ ID NO: 171319 - protein, 173 aa, Triticum aestivum
  unsure (1)..(173): unsure at all Xaa locations
  Clone ID: PAT_TA_65737.pep
AQLTLPPQGRANCPIVHLNLSPXNVLLDENYIPRITGFDFSKLIGEKNTKSVVLKLNGPIAYLPPDFLHSKGPDLKYLATVDIYSLGLIILEIVTXKRSKATTGVLIKSIEENWREESQITRLYTSLEADELQQVKMCIDIGLYCVQSKPEKRPTAEDIMLWLDKGIKPVPTP

SEQ ID NO: 171320 - protein, 66 aa, Triticum aestivum
  unsure (1)..(66): unsure at all Xaa locations
  Clone ID: PAT_TA_65738.pep
GGGGPPAVAGVVCVTSXGTTVPLEQRCVRYIDNFSSGQRGAASTEYFLKAGYAVIFVHRRGSKQPY

SEQ ID NO: 171321 - protein, 47 aa, Triticum aestivum
  Clone ID: PAT_TA_65739.pep
WVFLGCPGVGKGTYACRLLRLLGMPHIATCDLVCGELASQGPSPSRS

SEQ ID NO: 171322 - protein, 157 aa, Triticum aestivum
  Clone ID: PAT_TA_65740.pep
HPPSAPGAQAEKKPAAKKPAEEEPAAEKAEKTPAGKKPKAEKRLPAGKSAVFEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 171323 - protein, 74 aa, Triticum aestivum
  Clone ID: PAT_TA_65741.pep
YLFPVVSVSVFISGVFVFVSASAKKYENKYDSTQFRPFPLRFHPYTSALSLSFELQGRETAACCVHKQGVEGQN

SEQ ID NO: 171324 - protein, 145 aa, Triticum aestivum
  Clone ID: PAT_TA_65742.pep
SGGQVVNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVV

SEQ ID NO: 171325 - protein, 72 aa, Triticum aestivum
  Clone ID: PAT_TA_65743.pep
PKRRRAAIHRHNTTDIYQKQMISIRLLVILWLHLLKWGIYVGLMVVTGQDLNLFRFNLASAGPAGNYEIKQP

SEQ ID NO: 171326 - protein, 138 aa, Triticum aestivum
  unsure (1)..(138): unsure at all Xaa locations
  Clone ID: PAT_TA_65744.pep
MPVSHFGKDPGVSHSHTKSYVRSKERKFENACGMRNRGGFKILLRGPNNAREAVRHFGKAPGVPHXHIKMYVCSKERMFEKACGRRNSHGFIKLQIHGPLELPIFSNLPPHTDPAPASATLTSTKWLRCSPICLHLEP

SEQ ID NO: 171327 - protein, 150 aa, Triticum aestivum
  unsure (1)..(150): unsure at all Xaa locations
  Clone ID: PAT_TA_65745.pep
MVKIPSPRRLFRSRSKSTTGSIGGVDMCAMVAEHERIEWEVRPGGMLVQKRRGPDDDAVVEAILVKVCTAGGAWQHDVSIDATATFGELKVLLSLATGLWPXEQRLLYRGRERDDGDHLHMAGVQDKDKVLLLEDPAVTERKLRSTTLAQ

SEQ ID NO: 171328 - protein, 183 aa, Triticum aestivum
  Clone ID: PAT_TA_65746.pep
TWNRVNMSIAILPMSAEFGWSPATVGLIQSSFFWGYLLTQILGGIWADRFGGKVVLGFGVVWWSIATILTPFAAKLGLPFLLVVRAFMGIGEGVAMPAMNNILSKWIPVSERSRSLALVYSGMYLGSVTGLAFSPFLISKFGWPSVFYGFGSLGSIWFTLWQLKARSSPSEDPEVTEDEKRHI

SEQ ID NO: 171329 - protein, 122 aa, Triticum aestivum
  unsure (1)..(122): unsure at all Xaa locations
  Clone ID: PAT_TA_65747.pep
THDEETMNYFQDTDVHCVLCPRDPDDSGSFVQDLQISTMFTHHQKTVIVDHDMPQSGGGRRRRILSFVGGLDLCDGRYDTPFHPLFGTLDGPHHDDFHXPNFATAAIAKGGPREPWHDIHCR

SEQ ID NO: 171330 - protein, 118 aa, Triticum aestivum
  Clone ID: PAT_TA_65748.pep
IFCCDHANEQNRNDRRAKGDTKNSQHHAQEYLDIFLQSGAAIALVHLYLSDFSSSRFYAERAIRCFLSTDPATLPPNVMLVTAPVLLEFCRLLSLTAGNKDRLYKSCRHTLASALCLP

SEQ ID NO: 171331 - protein, 35 aa, Triticum aestivum
  Clone ID: PAT_TA_65749.pep
DVELCADPATDEVYARLALVAEGEVFEKNMGGGRF

SEQ ID NO: 171332 - protein, 32 aa, Triticum aestivum
  Clone ID: PAT_TA_65750.pep
LNFSMGMTSYLHHNIIPNVSFFNGLPFMYLLL

SEQ ID NO: 171333 - protein, 94 aa, Triticum aestivum
  Clone ID: PAT_TA_65751.pep
STYAINRRCYGSRIPLNFFSLPPPPIEPTFLPHERRAMSDRRSRSRHVLITAADSRGRSVAPYSISAAARGCRRSVDRSAAEGRRRSVDRSAAL

SEQ ID NO: 171334 - protein, 105 aa, Triticum aestivum
  Clone ID: PAT_TA_65752.pep
CHIAPSPPMLVKEMGRGGAKVYLQAAAQFLENGHYETKSWCHGNSTISDDEERRISLHRDRLRIRRARRSNFTWVASNEFSGQWGRIVGASTTAAAQYRRRRPGS

SEQ ID NO: 171335 - protein, 82 aa, Triticum aestivum
  Clone ID: PAT_TA_65753.pep
AAHLEVLVSEEQVELGGVAPPQAVLHPPRLVEAVPEDGIAVEPEVVLDLEDGLEARAVGEQRLHVPVALPQDGHHPVVDAQP

SEQ ID NO: 171336 - protein, 82 aa, Triticum aestivum
  Clone ID: PAT_TA_65754.pep
AVAASYRRRQPSSAPAEAQPERPADAEAPVLVRIKRERDPVRLYELFKANADNRVLVENRFAFEDAVARLAGARRSDLVEEI

SEQ ID NO: 171337 - protein, 134 aa, Triticum aestivum
  unsure (1)..(134): unsure at all Xaa locations
  Clone ID: PAT_TA_65755.pep
MPGAMAAAAASFDASRAQQLPLPPGEVHGPESVAFDAQGRGPYSGVSDGRILRWNGPKLGWTTYAYGPGYDSETCTTSXFGTEADIESRCGRPLGLRFNEKTGDLYVADAYKGLMRVPPGGGEATVLVDQIDGM

SEQ ID NO: 171338 - protein, 43 aa, Triticum aestivum
  Clone ID: PAT_TA_65756.pep
GASVYLAKIGLAFVFLFLLGGLFTYLLETVPDMILASTPPQSM

SEQ ID NO: 171339 - protein, 115 aa, Triticum aestivum
  Clone ID: PAT_TA_65757.pep
EDIIRWGTEELFRNNDEVNGKDNDEASGAKHDVSDIEVKHRRKTGGLGDVYEDKCIGSSTKLIWDENAIMRLLDRSSLPTTVAESTDGDLDNDDMLGTVKSIDWNDDLNDDPGAA

SEQ ID NO: 171340 - protein, 165 aa, Triticum aestivum
  Clone ID: PAT_TA_65758.pep
QAGGSGVAGPLLSQTRSWRGRGQQDDERGAAACCRGRRERHGEAGLGAAMGNLPDPRRRDRIRGAVGLGARRRGGSSRDRGDADECTSSMQRRRATAACGSGDEVRAVPRRWTRQLAGAGIGGRWRRRRGGMEEGEQRRSTPSCAAATEPPAVRILSRIGAGGES

SEQ ID NO: 171341 - protein, 104 aa, Triticum aestivum
  Clone ID: PAT_TA_65759.pep
AAAELAQRLRAAANDRLAGQEPLLLVAAPLLALLAARAVHAAAADVADRGLRTVLITLAMATVKLVPGVSGYIAADKSKVVEQLQSCSASARKNLRTEPARRRG

SEQ ID NO: 171342 - protein, 72 aa, Triticum aestivum
  Clone ID: PAT_TA_65760.pep
MEYSSDDDSDISDSEIDEYEGKIHARLVSGDLKFRNGDSYSCPFCTGRKNKDYNMQSLLQHSSGVGAAPNRP

SEQ ID NO: 171343 - protein, 47 aa, Triticum aestivum
  unsure (1)..(47): unsure at all Xaa locations
  Clone ID: PAT_TA_65761.pep
GRIGIRKKEKEKQEIDLVTTEYLAKXLPLKILFCHVCAQVPYILTPP

SEQ ID NO: 171344 - protein, 90 aa, Triticum aestivum
  Clone ID: PAT_TA_65762.pep
VNEINRIVWRNTKLKKLFIFQNACTQAKLSQDNIFFKPFREPQTFTGMRRRLYFRQNQRNQQVGDTHKTQHMQAWSHFIDAEVDATQSAK

SEQ ID NO: 171345 - protein, 171 aa, Triticum aestivum
  Clone ID: PAT_TA_65763.pep
TSISDDELDEKLVRINAANAAVVKATKSMLAHRDPGGCTIRLLSTAFYLRDDAPISIGHTVGNAMATHKVEKAEFTVLTEKEHKVIPDDALNFGARFVSFFNECLNAFAGLTRLDLANLRFVKSDYVSSILVTCKQLHYLGFDNCDTSDWITLQVEHAQLSELSIVYCRVD

SEQ ID NO: 171346 - protein, 119 aa, Triticum aestivum
  Clone ID: PAT_TA_65764.pep
DLDVLPGAAADGAGDVWPQELLQRAAPAEEAPLLPAAVSLLVPGARGRSVQLVAAAEQPAHQQPQALRLRPDLQRPRSHPSDYLLPPLPLSTSLPHRDMAVGLYTSQSLIVFLSSRRRS

SEQ ID NO: 171347 - protein, 103 aa, Triticum aestivum
  unsure (1)..(103): unsure at all Xaa locations
  Clone ID: PAT_TA_65765.pep
VRRWPGPHLAVPLTGSSRPSAVPLALXYVVRGAVSRVRRRPRLLLVPLSATTHVTHRRPHHLQSPSAARASRTPLRGGRAASTTGANRIGQSRRAMRRPQRQG

SEQ ID NO: 171348 - protein, 84 aa, Triticum aestivum
  Clone ID: PAT_TA_65766.pep
MDSRLREVDAPAEPADGAAALATAKAEVEVTKPRNDRRGYRRVVLPNALECLLISDPDTDKAAASMNVSVGYFCDPDGMEGLAL

SEQ ID NO: 171349 - protein, 135 aa, Triticum aestivum
  Clone ID: PAT_TA_65767.pep
FHGSEVLPLGTYDAILGMDWLEEHSPMTVDWRARFIETITLAGPIRLNGHDAASVVCETINSIQLQSLCSNGAVSHIIHLCMIAPDQESTAPVPDCIQKVVDDFADVFSEPKGLPPRRACDHKIPLTPRAQLVNI

SEQ ID NO: 171350 - protein, 129 aa, Triticum aestivum
  Clone ID: PAT_TA_65768.pep
TVPGSVTGEAQALVKAVAELVGAFNVEDYIAVCRGWDLQGLGRRAADVHRRFDALLEQMIRHKEDAREARKMRGGAEGETPEKKTATGTTTESSKDLLDILLDKLEDDAAAEVKLTRKKIKAFVIDVVT

SEQ ID NO: 171351 - protein, 85 aa, Triticum aestivum
  Clone ID: PAT_TA_65769.pep
AGLRLPYSTDEKPSEGCGSVLEPSVFRVIWGKASSNTAGTSLAPNYSPYTPIEADMFARARKVCHIALPSLNPHDSFPSLLIGSV

SEQ ID NO: 171352 - protein, 79 aa, Triticum aestivum
  unsure (1)..(79): unsure at all Xaa locations
  Clone ID: PAT_TA_65770.pep
CCFLNLAFNCSLKERISCVPAXGSSSSSSSYSSSTSTSSASGSSSSSSWATLSPSSSLPTMKSSRSSYSSSTRLVSLSS

SEQ ID NO: 171353 - protein, 81 aa, Triticum aestivum
  Clone ID: PAT_TA_65771.pep
ISVDTCISQYHQRFYVRISKKTDRAAKNLTQFSLNQNKTMQISQNPLEPVAHAPFPFPGPQSTAATVDRREREGKSSSSGG

SEQ ID NO: 171354 - protein, 41 aa, Triticum aestivum
  Clone ID: PAT_TA_65772.pep
RWTNVHMNSKACLASYLTVLQNNILWFYPRVDAEHRGVLQE

SEQ ID NO: 171355 - protein, 95 aa, Triticum aestivum
  Clone ID: PAT_TA_65773.pep
AQAQPPQRRRARRACPTLAKRVASTSLHRHASGLWPRSAARRLTYSPSRRLISAASGTARRPPALASRAPGVLHPRLPAQPKKTAGWSQHPRRWH

SEQ ID NO: 171356 - protein, 111 aa, Triticum aestivum
  Clone ID: PAT_TA_65774.pep
SVSATAARASTTTASPAAPAAPALVPFAAAEEPASERAATAQTQKQKQSLAACGSSNPAAIPAKPRTKNYTGWPEERAGSNAALTGEGSYKLASSCQERGRGRKSKGMWWF

SEQ ID NO: 171357 - protein, 92 aa, Triticum aestivum
  Clone ID: PAT_TA_65775.pep
QQIVQIRSVGNQNRTVETKEQNRGSDNYPNAKQSKMCLSAKPYNSNFWRTNISKNILRPRLPKYILQLITRRRPAQGSRVQTTNPARKRDRP

SEQ ID NO: 171358 - protein, 123 aa, Triticum aestivum
  unsure (1)..(123): unsure at all Xaa locations
  Clone ID: PAT_TA_65776.pep
KYSHANGRQTFCFIPIQCXAGVALPGHGPAKEDGSAKSFLGSRTGGGARLAGHGRSHPISMACLLSFLLSCRDGSMGSLSAWRFLPPPENLASVPARLVSVEMGEMREDGGGSEPGGGLGTGA

SEQ ID NO: 171359 - protein, 128 aa, Triticum aestivum
  unsure (1)..(128): unsure at all Xaa locations
  Clone ID: PAT_TA_65777.pep
AGSRPRPLASKRILXELKDLQRDPPTSCSAGPVAEDMFHWQATIMGPSESPYAGGVFLVTIHFPPXYPFKPPKGAFKTKGFHPNINSNGSIWLDILKEQWSPALTVSKGLLSIWSLLTDPNPYQPLGP

SEQ ID NO: 171360 - protein, 105 aa, Triticum aestivum
  Clone ID: PAT_TA_65778.pep
QGLLPWPSLFSTVLNFQRESLSSVLQMEATSDRTAMGRPGNYRRGGFLGKPLVPGRACATADVDLALLKLLSSIPQVVTKFSIRLFIFILIRVRFLYLHYFVPGN

SEQ ID NO: 171361 - protein, 149 aa, Triticum aestivum
  unsure (1)..(149): unsure at all Xaa locations
  Clone ID: PAT_TA_65779.pep
ANQVRELAYEMEXVESFLVGVQGFEPAANPDASKXVKKVWGVFTKGKKRHQIADAIKSINDQVQDVADRRDRYKIDDLAASLAAATIVDPRLMAQFKDQRELVGIEEPRDDLIKRLADGDDCVSKQQLKILSIFGFGGLGKTTLAKAVY

SEQ ID NO: 171362 - protein, 135 aa, Triticum aestivum
  Clone ID: PAT_TA_65780.pep
KISSLPSSLCRRRRRLRFPPPSRPPCLLRVHRLLLPLSRHPSSTATSRLRPRFATSSASSCHHTASTSPLVPRRSLLPVRLRGASPSLPVATSSAASSLLANRDCHDLGPRCRPLGYQGRQPSVEIEPATWVEEV

SEQ ID NO: 171363 - protein, 107 aa, Triticum aestivum
  Clone ID: PAT_TA_65781.pep
MMVGFTAGELREMMDKQNNIRNVSVIAHMNHGKSTLTKSLVAAAGIIRHEADVEVPMTDTHADVAEPGRSVRSAGTSLLFEMNKELLKAHKGERDGDKYLINLIDSP

SEQ ID NO: 171364 - protein, 37 aa, Triticum aestivum
  Clone ID: PAT_TA_65782.pep
GIHNAIFRTIADGKYRTADLGGKSSTSDYIKAVCGHI

SEQ ID NO: 171365 - protein, 61 aa, Triticum aestivum
  Clone ID: PAT_TA_65783.pep
PKGAPSGAVACPATFPASAPTFVGSPSATLGRHLARRLVQIGVSDVFAVPGEFNLTLLDHL

SEQ ID NO: 171366 - protein, 117 aa, Triticum aestivum
  unsure (1)..(117): unsure at all Xaa locations
  Clone ID: PAT_TA_65784.pep
AMKIIEGEFERPVSQVFSYISDEPVASASFGQVYXGRTFDGAGVAIKVXRPNLLPSVGRDIYILRLGLSFVRKVAKRRSNISLYADELGRGFVDESDYNIEPDHATKFLDTHSNYSF

SEQ ID NO: 171367 - protein, 145 aa, Triticum aestivum
  unsure (1)..(145): unsure at all Xaa locations
  Clone ID: PAT_TA_65785.pep
SSLIWACQSPFSKKKETISCSLSRCCAGAGTFGCCDLLVLPDALFLLLGRGFGPGAFVDSSSFPFRETVFLADGDNFSPTXXWPREVTPSSSSLRSAAEGLGVADGLAAFGGSSPAAAIAANARAAVSSSVASPPFRTWSEWEAS

SEQ ID NO: 171368 - protein, 164 aa, Triticum aestivum
  Clone ID: PAT_TA_65786.pep
GESGDDMSEQYVAVTKQEKRRRRRRMACNRCGKRKWESKEACIVCDARYCGYCVLRMMGSMPEGRKCVSCIGGPIDESKRSKLGKSSRTLARLLSPLEVRQILKAEKECQANQLRPEQLIVNGCPLRPEELTDLLSCSRPPQKLKPGRYWYDKESGLWGKDGQK

SEQ ID NO: 171369 - protein, 161 aa, Triticum aestivum
  Clone ID: PAT_TA_65787.pep
KTMEEVAEGYLYQLVNRSLLQVVERNESGRVRSCRMHDIIRLLALAKSNEERFCIVHDGPGSSSAENTRRLSIQSANIEQLTLSSEVQLRSIYVFDNGLTIDSLESLLKSFKLLSTLDLQGSKIRRLPNEIFNMFNLRFLGLRDTEVEDIPRTVGRLQKLE

SEQ ID NO: 171370 - protein, 169 aa, Triticum aestivum
  unsure (1)..(169): unsure at all Xaa locations
  Clone ID: PAT_TA_65788.pep
APLFSGLQDEGAKPESVGERAYKILSNVVENSNEIMKAHGAERLGDVQVYPETSSVAFASCLHGWAFTXGGFAKKYALKCGVDEGGVXKRLWGDNFYDSAKKKWTRKNSGSDNCIRGFVRFCYNPIDTVLMACMNDNKGELWDLCQKLEVSLRDDEKDLTRMALVKCVM

SEQ ID NO: 171371 - protein, 121 aa, Triticum aestivum
  Clone ID: PAT_TA_65789.pep
CPFFLDEMKRVGRRASTPSHGNVSNQMGGPSPLSGFEPPMNYSYGQGVHAPGAPAGYSNAPYQTQPSYSNAPYHQQTYASYPNPSYPNTADQHQVHASYPSTADQHQVHTSYTSTANQHQA

SEQ ID NO: 171372 - protein, 109 aa, Triticum aestivum
  Clone ID: PAT_TA_65790.pep
HQPPHHDGSIHANPPNQEQRVQEVGRRAGKGVQQAAKQRYPGPPGNEPSALRWPGPICGKQVQPRLVRRRRTSMREGPRALARRGASSVAMDASSRARPAGGGTEPATG

SEQ ID NO: 171373 - protein, 82 aa, Triticum aestivum
  Clone ID: PAT_TA_65791.pep
ELLKLAQLIKIKWCPHQLASSLFRLPIDLKDCQSSPTIACPSSVEIPNLLSQVIHVAPRLYHRELKKHKQQIRYMPVCVHVL

SEQ ID NO: 171374 - protein, 165 aa, Triticum aestivum
  unsure (1)..(165): unsure at all Xaa locations
  Clone ID: PAT_TA_65792.pep
SVAPFQGLKSTAGLPVSRRSSSAGLGSVSNGGRIRCMQVWPIEGIKKFETLSYLPPLSTEALLKQVDXYLIRSKWVPCLEFSKGGFVFREHNSSPGYYDGRYWTMWKLPMFGCTDATQVLNEVEEVKKEYPDAYVRVIGFDNLRQVQCVSFIAFRPPGCEESGKA

SEQ ID NO: 171375 - protein, 186 aa, Triticum aestivum
  Clone ID: PAT_TA_65793.pep
PPPWQHRRRAAAPGAPAIPDELFEEFLLRLPPDDPACLLRASLVCKAWSHTVSSPRFRRRLHELHRGGAVLGVLHNWEDDAMPRFIHTTASSFSLAAPDSRSWRALDCRHGRALFLSKGQDAEELLVWEPITGAQQRVPVPAAFQGDYPTAAVFCAMDGCDHRDCFGGHFRVVFVFCVDEEDTEQD

SEQ ID NO: 171376 - protein, 92 aa, Triticum aestivum
  Clone ID: PAT_TA_65794.pep
RRRQQPPPSRQHLYFAAGRSRGGVGLATLRVVRFPAVRSRLAAARLLLGSHRPTSCCSSGGGRSPRRSAGLLCFGDGGSGRHGLTSTGSGGS

SEQ ID NO: 171377 - protein, 33 aa, Triticum aestivum
  Clone ID: PAT_TA_65795.pep
GTRSNCQRLERFEKTTEPLEPSGHKHIAYGSNP

SEQ ID NO: 171378 - protein, 40 aa, Triticum aestivum
  Clone ID: PAT_TA_65796.pep
EHRAEPQPAAREEDADNASLSGRRLAVAVAHPDAVINLQA

SEQ ID NO: 171379 - protein, 57 aa, Triticum aestivum
  Clone ID: PAT_TA_65797.pep
ISPPRQTFLQRFDKASPSYNCLEDLARKDVSSVSEHAVLHCFNSIPFFNLLSLSRPN

SEQ ID NO: 171380 - protein, 34 aa, Triticum aestivum
  Clone ID: PAT_TA_65798.pep
CKNHRGFGKHFANSTDQVIWLISSLSDKWDQIVR

SEQ ID NO: 171381 - protein, 98 aa, Triticum aestivum
  Clone ID: PAT_TA_65799.pep
RRRRPRWRRPSPPRRSRRRRRPPRRPRPRSRRLLPPSRSRRPRRWHLPPLRRRRPRSPSQQLRPSRRPRPPKRQRRQPWSRQRPRRPWLRQSQRRPRR

SEQ ID NO: 171382 - protein, 53 aa, Triticum aestivum
  Clone ID: PAT_TA_65800.pep
LHFSLYTNLFHRVYSFCAHLIDSEFILLHSTRQMYSLHRISTLHSICFYTSKF

SEQ ID NO: 171383 - protein, 135 aa, Triticum aestivum
  Clone ID: PAT_TA_65801.pep
MLSGCSVSSLAARFAFFPPDPPTYALRKDEATGRLVASGVPRDNALDVLLLDTTRGTKVVAFYLRNPCARLTLLYSHGNAADLAQLYDLFVQLKVNLKVNLMGYDYSGYGASTGKPSEENTYADIEAVYQCLETE

SEQ ID NO: 171384 - protein, 161 aa, Triticum aestivum
  unsure (1)..(161): unsure at all Xaa locations
  Clone ID: PAT_TA_65802.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSXVNIVSNASCTTNCLAP

SEQ ID NO: 171385 - protein, 189 aa, Triticum aestivum
  Clone ID: PAT_TA_65803.pep
SSLSAESVVTFVEVGLVQCLTKTLQVLDLDHSDSAKIVTGIVKALEVVTKEHVHLADFNAKGENSSKTVLEQNNVDSSSNRFQVLDTTSQPTAMVTDHRETFNAVHASRSSDSVADEMDHDRDIDGGFAHDGEDDFMHEIAEDRTGNESTMDIRFDIPRNREDDMAEDEDDSDEDMSADDGEEVDEDDD

SEQ ID NO: 171386 - protein, 48 aa, Triticum aestivum
  Clone ID: PAT_TA_65804.pep
NTTVCPVGQYGLNKQKMHHSPFNGLKILACLDEIFIYMYKPWAIPRRG

SEQ ID NO: 171387 - protein, 68 aa, Triticum aestivum
  Clone ID: PAT_TA_65805.pep
RKCMESFVVCFNQGGNYISSVAEKAEVNSMTVRVDDRSTSNSDVSVTTLCTILSWSCFYCCTTSLIFQ

SEQ ID NO: 171388 - protein, 133 aa, Triticum aestivum
  Clone ID: PAT_TA_65806.pep
FEKRKDTTNLVGKKRRDPGDTGNKSTPDSNGENGSVAPMTQSGAENKPKDKDEIGLLREQVDELQKQLVEKEEALRSAESTVSEMNAVYSTVDGLKRQVAEKEALIKYANSQLQNAKVNCPPACNYIVLYIFL

SEQ ID NO: 171389 - protein, 137 aa, Triticum aestivum
  Clone ID: PAT_TA_65807.pep
MGFVDPAAPLLATCGGDTVKLFDVTVESGDPCVLAYSPAPGHPVNAVKWNHTNLIVASAGDDKKISLWHKKGQNVGQLPTSTVDRGDDIEESIYSISFSNKGSRYLCSGGSGHIVRIWDLQRKRCIKWLSGHTDTIT

SEQ ID NO: 171390 - protein, 135 aa, Triticum aestivum
  Clone ID: PAT_TA_65808.pep
QSLIAFGPPHFIFLAPPLLTWRGTLSRNGPSRRLCSASGLYKMIALSLLAAAGARSTGTRIPAHRCVLHQSKLATCCVPDGGDGRTTPATRCTHQAADLGGAGGGGEFDVAVDVAQRQVRRISAFQQIVTTLRWL

SEQ ID NO: 171391 - protein, 182 aa, Triticum aestivum
  Clone ID: PAT_TA_65809.pep
GVVDSLVARSPVLEVLNILGCINGLRLRLLSQSLRCLQISCSKMEHIAVVKAPCLERLIIFGSGEIARGLCSRLKIGDVPKLHAFGYLDPGQVLQVRDTIIMPGIASTSTMMRSVKILSLNVRFGVRNEVKMVPNFLRCFPNAERLHILSEKCDKPTGNHLSLKFWEESGPIENVLSRINVM

SEQ ID NO: 171392 - protein, 90 aa, Triticum aestivum
  Clone ID: PAT_TA_65810.pep
YPYTHISTHVLTEFDESKRSCRKRLAEHNRRRRKPASSSTTATSKDSAPPSKKPNPGAISSSYAADNNNLSATKSNISSNTSAISCLQQH

SEQ ID NO: 171393 - protein, 166 aa, Triticum aestivum
  Clone ID: PAT_TA_65811.pep
LSIVLVGVGDGPWEDMQKFDDKLPARAFDNFQFVNFTSIMSRNATLQQKESAFALAALMEVPIQYKATMELGILGRSTGKAKRVVPAPPPLPGSAQRQPSSFRREASGANAAAAEPREDQVCPICLTNAKDLAFGCGHMCCRECGENLRCPICRETIRSKLRLYTG

SEQ ID NO: 171394 - protein, 49 aa, Triticum aestivum
  Clone ID: PAT_TA_65812.pep
GWTLREPWRQLYNNNNNNNNNNNNNNNNNNNNNNNNNNRILSPFIFVSF

SEQ ID NO: 171395 - protein, 135 aa, Triticum aestivum
  Clone ID: PAT_TA_65813.pep
MRCGRGCSFLRPGVHPMPLLATPPYIMPRTSAATAGPATATSSGTCSLRVRLRAPGRSAAAASSSRLPRAMAATGADAAAAPPSLLVFSGGTAFNGVVEELKKVTTRVAHVLPVSDDGGSTAEIVRVLGGPAVGD

SEQ ID NO: 171396 - protein, 156 aa, Triticum aestivum
  unsure (1)..(156): unsure at all Xaa locations
  Clone ID: PAT_TA_65814.pep
CYHGQKSLFYLTIYGSVLGVGSYAAHYFSSMVASILENFGLSEEMHNPVSIFLLVAVVLTGAGFGYWMVRRFIISKDGSVDAGIAQFVKWAMRVVSMFFVMQSTLDPILASAALAASWWICSVLTAKKVHKPTAPKRKQSNVXSHPRFTQVSPNTR

SEQ ID NO: 171397 - protein, 192 aa, Triticum aestivum
  unsure (1)..(192): unsure at all Xaa locations
  Clone ID: PAT_TA_65815.pep
LARASAACVTFRRVVTDGSFLRRFRRLHPPPVLGFLCLGGFHPAQPPHTSAPAARALALAADFSFSFLPSRRRWAVQDIRDGRVLLVGKQNMMAEGPSISMFPELVVCDPLHRRYILLPPLPDGLVASVERQDDEFLGWSCEPSLIPLXDEEAALVEETTLXVIWSASCKTNMAVFVFSSTTGQWRATASQT

SEQ ID NO: 171398 - protein, 158 aa, Triticum aestivum
  Clone ID: PAT_TA_65816.pep
SVALALRNGLLLLCLPSAEASRRRRLFFLASAAVAFSSSPPPPPQGLRTLKLTPKKNFPLIWRTCDVLQLYLKSFGRTARLTSPEGRQRDYFEAEFFFKEEAEDALQNCKIPNMTIEWAEANISDNPLTGPAQISYDPPRCDYDDFNILVNSSSTTFK

SEQ ID NO: 171399 - protein, 65 aa, Triticum aestivum
  Clone ID: PAT_TA_65817.pep
PPSGAQVRLVMESEEGRQLMARAAQHQEGAAAAWSDGGSSRAALALFLSDVDRRWQARARGGEAA

SEQ ID NO: 171400 - protein, 95 aa, Triticum aestivum
  Clone ID: PAT_TA_65818.pep
ASLPSSHAAASLPHSLLIRRSLPLLPQPPPSLTRSSSGDGSSGHRGGRRINGVGDGVRGGGGRRGRGAPFGDVTRAAGGGAVGAGARAIWASILI

SEQ ID NO: 171401 - protein, 86 aa, Triticum aestivum
  Clone ID: PAT_TA_65819.pep
KNPWILQQHPTNILLFYASLGKKDNITLLHLLSREKNNIASSRIVHKHKGSVLNHVLLAYLLPCMNPWLDILFDIRKDNRRKCQQS

SEQ ID NO: 171402 - protein, 76 aa, Triticum aestivum
  Clone ID: PAT_TA_65820.pep
MAGSVGTGRVAPRSSPKRYNGMDPPLSLTRPTMFDLQKTAELEKFLVEAGLYESEEQSAKREEVLREIDGIVKEWV

SEQ ID NO: 171403 - protein, 86 aa, Triticum aestivum
  Clone ID: PAT_TA_65821.pep
HCGGWEDEEDHYASTTTSETRSEEGEVGNRSECGFAARSEYGGTAPSEYAAVPMQLRRAERSEVGDSFSTVTGATEMRMVVRHRTL

SEQ ID NO: 171404 - protein, 92 aa, Triticum aestivum
  Clone ID: PAT_TA_65822.pep
ISCSGRAAAVVLSYSKTSSLAERCPSQPDAGSGGSLATSPPQHQGSRPPIRSQERAVCQTSLVLEFFFSISTDTSAYHLEIYEAIVGASSST

SEQ ID NO: 171405 - protein, 165 aa, Triticum aestivum
  Clone ID: PAT_TA_65823.pep
PRGIEARNEVATLAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHN

SEQ ID NO: 171406 - protein, 106 aa, Triticum aestivum
  Clone ID: PAT_TA_65824.pep
VTCANGCQIDMVVEEKHTNGETHRNICKKRNQGAAWIFTKHLVGIYTKESARAEPGQPMATRAQTLSFLFSSCPVTFLFSSCPRLLFVHPSPYLSWWGRQRGRGKR

SEQ ID NO: 171407 - protein, 135 aa, Triticum aestivum
  unsure (1)..(135): unsure at all Xaa locations
  Clone ID: PAT_TA_65825.pep
MAGVQERQYEEFFGGFYFDEDALSKDISLDGLDKELEEHKNYDVLISILTNGEKQRDMATMVEGNLXHIEQDLIQDYIKDNDSLVLLHDQIHDCDIVLSQIGSLLSGFQVHIGSLSSELISLHEKSLDLGVRLNN

SEQ ID NO: 171408 - protein, 62 aa, Triticum aestivum
  Clone ID: PAT_TA_65826.pep
KEIVRKVQIVIEYVKNYTCKCYESFVCLQLSINLVIQKPFFTTDFFFLHRTQKCSFHDNLQV

SEQ ID NO: 171409 - protein, 135 aa, Triticum aestivum
  Clone ID: PAT_TA_65827.pep
SLSPPCAAIVERSKRMAASNGLEGVLLGMGNPLLDISAVVDEAFLAKYDVKLNNAILAEDKHLPMYDELSSKGNVEYIAGGATQNSIRVAQWMLQTPGATSYMGCIGKDKYGEEMKIATEAAGVTAHYYYDEAAA

SEQ ID NO: 171410 - protein, 56 aa, Triticum aestivum
  Clone ID: PAT_TA_65828.pep
KLPSMYFWHSLDFRCHLSLGIRGCPTGQSISVLICVLEIMNFLKFVYLRIQSSSVY

SEQ ID NO: 171411 - protein, 58 aa, Triticum aestivum
  Clone ID: PAT_TA_65829.pep
MVHVNFYRNYGKTFKKPRRPYEKERLDAELKLVGEYGLRAKRDLYRVQYALSRIRNAA

SEQ ID NO: 171412 - protein, 103 aa, Triticum aestivum
  Clone ID: PAT_TA_65830.pep
TCCVKWLFRRTVLTTSRLVVSDRSARRSIDPPAASFLRSSRFPIFFLLDFLSTDFYLTSVHRFFFSLGWFYINYSRWRRKRNKVLCSLPIWSPGLGECRRFHF

SEQ ID NO: 171413 - protein, 109 aa, Triticum aestivum
  Clone ID: PAT_TA_65831.pep
MNGVSEGLIIGTTVGVVIGVLLAVGILLCMRYRRSQAQIRSSSSRRSSTIPIRANGVNTCAELSNSTTGQESPREFEDRGPSLWIEGPGRKSLISASGIPKYAYKELHK

SEQ ID NO: 171414 - protein, 59 aa, Triticum aestivum
  Clone ID: PAT_TA_65832.pep
MSAAATGDYPCPVSPPYPAVSKDVELRRALTASARSGAYSSAGVVFEDEWLAVVDKPAG

SEQ ID NO: 171415 - protein, 76 aa, Triticum aestivum
  Clone ID: PAT_TA_65833.pep
SAPVICPWWSRRRSMASSLVWSRRALVVMAVAAMVLAAQSSEAAARSGGADEDELRFPGFPGGRQRNPGFPGVPGG

SEQ ID NO: 171416 - protein, 70 aa, Triticum aestivum
  Clone ID: PAT_TA_65834.pep
REQLVEERTFGSFQMITWTWRSLSRHWKSSGHSLQIFSFLFFVCIFSFLDGFFCFFVFFVFSSVLAFERN

SEQ ID NO: 171417 - protein, 160 aa, Triticum aestivum
  Clone ID: PAT_TA_65835.pep
MPCGDNCGVSINWHVMNNYKSGWSVRMTIFNWQDYTFKNWFAAVKMGQHYGGYENVYSFNGTRLDAPFNNTIFMQALPGLEFLEPITDGRTSAYPKLPGKQQSVISFKKKDVPNINIPKGGGFPKRVYFDGEECALPHKLPSSARRRAGAPSLLQAVTGV

SEQ ID NO: 171418 - protein, 34 aa, Triticum aestivum
  Clone ID: PAT_TA_65836.pep
SCNGSVRYRNDIRYSKICSKYCFVWLVVLDYVRF

SEQ ID NO: 171419 - protein, 86 aa, Triticum aestivum
  unsure (1)..(86): unsure at all Xaa locations
  Clone ID: PAT_TA_65837.pep
VVVLFSLTIAXAAPLIGAQSVIPPHLYPAPLRDFKRWYAAEFDDYLMAQPPAFLRGIFWLEIAFLWPLSVATIYGVLARRRWAATT

SEQ ID NO: 171420 - protein, 150 aa, Triticum aestivum
  unsure (1)..(150): unsure at all Xaa locations
  Clone ID: PAT_TA_65838.pep
HGVWRLDLLQQHFLPADVVAIHKIRTSPPQQQDFLAWQSDPKGXFSVRSADKLVMVHHEEAFTEGASSASPNGERKIWNLIWHADVPHRMRLNAWKAAAGALATMQCKRACHLQCRLTCQLCGIADEDTYHALVACENASKLWDALGEIW

SEQ ID NO: 171421 - protein, 110 aa, Triticum aestivum
  Clone ID: PAT_TA_65839.pep
PPTSPPPLPPAYAIPPHCRPETPSSPSLPGRAVAGEAEAAAKSAVLLPDSRPPHHRFISNPATDTHPHPHMRPPLTPSPPVTSLPCSSTQPNPDSIQFRDESPPTSPLRP

SEQ ID NO: 171422 - protein, 69 aa, Triticum aestivum
  Clone ID: PAT_TA_65840.pep
LLPSHILEHLHIVSIFNLYFVEYPSTPVTCSRGCNMVAHILATYGINLKSSDGVHKTLCHRSDAAGLKG

SEQ ID NO: 171423 - protein, 76 aa, Triticum aestivum
  Clone ID: PAT_TA_65841.pep
ASFRSPLHAFADFCFKTYGDRVKNWFTINEPRMMAWHGYGDGFFAPGRCTGCRFGGNSATEPYIAGHHLILAHAVA

SEQ ID NO: 171424 - protein, 107 aa, Triticum aestivum
  unsure (1)..(107): unsure at all Xaa locations
  Clone ID: PAT_TA_65842.pep
MADRANHPSVMQKFGGQFHLASSFSEGVRARNICPSVPSYERRFTTSSYMTQNLGISVPIMSSSPMFANAPPEKKGVKNFAIDFLMGGVSXAVSKTAAAPIERVKLL

SEQ ID NO: 171425 - protein, 67 aa, Triticum aestivum
  Clone ID: PAT_TA_65843.pep
RSSRPLSATSRGNPRSVDRMTAALWCRFPPWGRHFWRCTRARGTRGRRLWWSGASSFTLMVADLGDV

SEQ ID NO: 171426 - protein, 58 aa, Triticum aestivum
  Clone ID: PAT_TA_65844.pep
SAVARWSLGAGHGGRDLDGRTFNNSNVELGVRPWRRDLDGRTLSSDRWSLGGRPWRTG

SEQ ID NO: 171427 - protein, 120 aa, Triticum aestivum
  Clone ID: PAT_TA_65845.pep
TSFFMHIIRWCFEKAYGSCCFGVLKLFLLLFLPRRRQAMRGKLFHLLVRYCILIYSQHMTSCVVSIHIYCSRIYTRIFCNVVANKEAQKSRCKLLSTGAPSGFGIHFHMGCILCSKKTIG

SEQ ID NO: 171428 - protein, 159 aa, Triticum aestivum
  unsure (1)..(159): unsure at all Xaa locations
  Clone ID: PAT_TA_65846.pep
MDFGTDERQHSHGDGGDAAEWKKVVELRAVAEAQDPAAKEEDDFVLRRFLRARDYNIGKASMMLLQYLAWKRVAKPHGSISDEEVRGEIAKKRVDMQGFDCLGRPMAYIYGARHFPARRDLDGFKRYVAYVLDKICTMLPVGXEKFAAVIDLKGWGYAN

SEQ ID NO: 171429 - protein, 42 aa, Triticum aestivum
  Clone ID: PAT_TA_65847.pep
MGSFLSSLWTPPPLPGDDPDSAVVAVHSKPAWDRHWEAHRNA

SEQ ID NO: 171430 - protein, 118 aa, Triticum aestivum
  unsure (1)..(118): unsure at all Xaa locations
  Clone ID: PAT_TA_65848.pep
RPRRGRDESVRGGGRGEGAKEWWTLVRLSVHSCMSVCLEWWWYEIMVLLCGVLADPKAAVAAMGVLIXTTSLIYIFPHSLGCAVSTRVGHELGARRPERARLVARVGLGLGAVLGLVA

SEQ ID NO: 171431 - protein, 63 aa, Triticum aestivum
  Clone ID: PAT_TA_65849.pep
AAAAGTADIPVAATADTLAFTCGMRGPASQLNLIEPPKQILEAGEEGNRSSARGWGWLPASSQ

SEQ ID NO: 171432 - protein, 131 aa, Triticum aestivum
  Clone ID: PAT_TA_65850.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQFPQQQFPQQQQFPQQQQLTQQ

SEQ ID NO: 171433 - protein, 152 aa, Triticum aestivum
  Clone ID: PAT_TA_65851.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATQEA

SEQ ID NO: 171434 - protein, 130 aa, Triticum aestivum
  Clone ID: PAT_TA_65852.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCT

SEQ ID NO: 171435 - protein, 48 aa, Triticum aestivum
  Clone ID: PAT_TA_65853.pep
SLPLTGLKTARVEVSSFHHCVQASEPTGDKQSLLFQPPLGNFVLMHYQ

SEQ ID NO: 171436 - protein, 124 aa, Triticum aestivum
  Clone ID: PAT_TA_65854.pep
SLFMNKYGWYSSDVLACLYAADISFRLLKTVPACLPADSIRSSPFLCSKSDMGVSAANCQLSTVNSFQAVAIVNQKPKQARSGCLDRRGINETRAAHLNDEIQTPHSTKKKHKSMDLSHTGVLL

SEQ ID NO: 171437 - protein, 94 aa, Triticum aestivum
  Clone ID: PAT_TA_65855.pep
EIQRGINARIGHRGPRARTRRRSAVALRRTPPPEGTSTTCKRKTDRAAHSKKPLDKIQTERTLYTHAKQSSPTLPPPQRPTVGQGTTAKRRRRG

SEQ ID NO: 171438 - protein, 138 aa, Triticum aestivum
  Clone ID: PAT_TA_65856.pep
SANGVSRTTGPPILTAPAIKSLLDGTATGIDAGWSPPVLCLSLSSSPPASNGVLSASAIRMALLIRELTRAQQEKARRERARKVTKRTTLLCSGGGDGCIFLSTTIQGTARRVGEEICRQNPVKFAAGELQPQEPSYR

SEQ ID NO: 171439 - protein, 198 aa, Triticum aestivum
  Clone ID: PAT_TA_65857.pep
HRDKYGVSTQDAAFKTELCDLYGSFLYSVLPPGDEDLKGNEVEVIAKFKRGLGLDDVDAANMHMEIGRRLYRERLETRDRDADIEQRRAFQKLIYVSNLVFGDASAFLLPWKRLFGITDSQIDIAMRDNAKNLYAIQLKSIGRGLDIGTLIEVRRAQLACKLSDEIAADMFREHAKKLIQENISSALDILKSRNKATN

SEQ ID NO: 171440 - protein, 57 aa, Triticum aestivum
  Clone ID: PAT_TA_65858.pep
IATSGAHASQEAGAMKLKETVYAGYYCINFVILTSIDMVSFLVASFWRNFPRGDILF

SEQ ID NO: 171441 - protein, 53 aa, Triticum aestivum
  Clone ID: PAT_TA_65859.pep
WCKILLSTHHIYHYVVSDVASYIHLAVLITNLWGKFQSSSQAVPPEGNTSLRP

SEQ ID NO: 171442 - protein, 191 aa, Triticum aestivum
  Clone ID: PAT_TA_65860.pep
LEMKHQVDIKILEKTTHGLCKLVCMMSFPDEYLLFRAEGKIWNGPDGAQVSPDCPFVVRQVAELKNKSFEQVRHAVLKNFQLNEATHELTLQHILYVRTDPSAPPYNLLIDIVGEESWRAFFKVACRHVRSFKLFAKWTVKKTSSASNATDSNITTALDEDPAVTDESDDGSWPACKHDKPCTIETSWDRQ

SEQ ID NO: 171443 - protein, 174 aa, Triticum aestivum
  Clone ID: PAT_TA_65861.pep
MRECISIHIGQAGIQVGNACWELYCLEHGIQPDGQMPGDKTVGGGDDAFNTFFSETGAGKHVPRAVFIDLEPTVIDDVRTGADRQLFHPDQLISGNEDAADNFGRGHYTIGKEIVDLCLDRIKKLSDNCTGLHGFLVFNAVGGGTGSGLGSLLLERLSVDYGKKYKLGFTVYPS

SEQ ID NO: 171444 - protein, 118 aa, Triticum aestivum
  Clone ID: PAT_TA_65862.pep
CGPVPRSLVTMFPRSSTTLLGGRGARMELPPWLFVLLCLLVVDTPIPLSSPVSSSCRQSYAQKQILHATFLWMKSGRDIYCKVLHHIHLVVLLRRRPHDPYRQRYGREDPPCTARPGS

SEQ ID NO: 171445 - protein, 110 aa, Triticum aestivum
  unsure (1)..(110): unsure at all Xaa locations
  Clone ID: PAT_TA_65863.pep
CPAHTEALLKQVDYLIRSXWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 171446 - protein, 169 aa, Triticum aestivum
  unsure (1)..(169): unsure at all Xaa locations
  Clone ID: PAT_TA_65864.pep
RWPPRRPAPLPRPRVPPPQQPVLLGXRPQPPARQQAPPPPSPPRPPPALPQPRPPWSLSRPRLAPRPPARPQLRARAPWSPPSQRRPAPPPXSPQPRRGQQALRLRPPPAWGPPPSSRPPRRPGVSPPRAPPPSARPPGSGHQQWPLPSWMQENARSGRRWLAQASATV

SEQ ID NO: 171447 - protein, 61 aa, Triticum aestivum
  Clone ID: PAT_TA_65865.pep
MVKNHPGSGTSRCDAAAAMAESGGGGGTAALCGGGSRQPAMAARQFKGVLFLSWGSWVSEI

SEQ ID NO: 171448 - protein, 144 aa, Triticum aestivum
  Clone ID: PAT_TA_65866.pep
RAAGHGPAPATLDDALGSDDDGSEDEAEVAAQEKAMRREVVDDDEDSESGESEGEGVPFVTIAAAAKRKRVRKLSDEFDRIAAAQLEGGGKKKPAAAAPAKVLLRKKAVAAAAPAPATDAPAKKSLKRNAVAPAAGAVARTSPN

SEQ ID NO: 171449 - protein, 150 aa, Triticum aestivum
  Clone ID: PAT_TA_65867.pep
MADRANHPSVMQKFGGQFHLASSFSEGVRARNICPSVPSYYRRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGSGSLWRGNTAN

SEQ ID NO: 171450 - protein, 148 aa, Triticum aestivum
  Clone ID: PAT_TA_65868.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDERFGSLWRGNT

SEQ ID NO: 171451 - protein, 71 aa, Triticum aestivum
  Clone ID: PAT_TA_65869.pep
WWWWQATVTSRSAEEGSFGCRHGSDLAPWKPPRHHLRASPLPPRRPRRRPQFIRKLGGIEKPLGGKALQAI

SEQ ID NO: 171452 - protein, 107 aa, Triticum aestivum
  unsure (1)..(107): unsure at all Xaa locations
  Clone ID: PAT_TA_65870.pep
VHSVVEKLLDVLNTPSEXVQRAVSXCLSPLMVSKQKSPXLVSRLLXRMMKCEKXGERRGAAFGLAGVVKGFRITSLKKYGIAATLQQGLEDKASAKSREGALLGFEC

SEQ ID NO: 171453 - protein, 67 aa, Triticum aestivum
  Clone ID: PAT_TA_65871.pep
WLGSPGIPGAPVIGRWRTLSQRPCRCPVARCSTSSRRAGMVQLQQAGCAPRPSGWLARVSRPVRVLA

SEQ ID NO: 171454 - protein, 34 aa, Triticum aestivum
  Clone ID: PAT_TA_65872.pep
LVVYVIMGSMMNALSDGLCLADNSGLSPQTLVDV

SEQ ID NO: 171455 - protein, 130 aa, Triticum aestivum
  Clone ID: PAT_TA_65873.pep
MTMMKSPTSTSYLILAPVAILLLLFLLSSLNRTGAGGGSDGLGVLCARRAGTRHPTAAVSARAEAAEPELSLLVGILTMPKRRERRDIVRLAYALQPPAAGARVDVRFVFCNVTDPVEAALVALEIMHHG

SEQ ID NO: 171456 - protein, 58 aa, Triticum aestivum
  Clone ID: PAT_TA_65874.pep
RPGTVALREIRKYQKRKKLLIRKLPFQRLVREIAQDFKTDLRFQSHAVPALQEAAEAY

SEQ ID NO: 171457 - protein, 74 aa, Triticum aestivum
  Clone ID: PAT_TA_65875.pep
SPYQRRLWVKDRSSEWWELRSSPGYPEAEFLREFRMGRATFGMVCDALGAAVAKEDTVLRAAIPVRQRVAVCVW

SEQ ID NO: 171458 - protein, 78 aa, Triticum aestivum
  Clone ID: PAT_TA_65876.pep
EGGIQLGWLPSRVHGESTESQRWKISRASASSAATAATSGSGTGAPWRRRTQSTGPGRCRGPLDRHNVHQRLVLQRSS

SEQ ID NO: 171459 - protein, 146 aa, Triticum aestivum
  Clone ID: PAT_TA_65877.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTNGRFRLHSVRDEDAKFKLCKVRSVQFGQKGIPYLNTYDGRT

SEQ ID NO: 171460 - protein, 147 aa, Triticum aestivum
  Clone ID: PAT_TA_65878.pep
ASSSSTSKSLVFSPLLIPRQQWEEATTSWVPTRARGIPSQGTRPQEVTLHSNDSACPGLTHLHLGHTLLHWAYPLPGRVAVTEKGSFNYARLPAHGGAMATHLWPRVPPQQHGSSTSSLSHAPTDSMATLHSSMAIPCWLPGYLVTV

SEQ ID NO: 171461 - protein, 138 aa, Triticum aestivum
  Clone ID: PAT_TA_65879.pep
MSTDVVADVPAPEVAAAADPVVETTAEPAAGDAKPAKETNAKAAKAFLPSAPRKPRAAPAHPTYGEMAPEAITALKERTGSSPYAIAKFVEDKHKAHLPANFRKILSVQLKKLVASGKLTKVKASYKLSAAAAKPKPA

SEQ ID NO: 171462 - protein, 139 aa, Triticum aestivum
  Clone ID: PAT_TA_65880.pep
RVSLMVKYITLHRETSEHRSKYFFYGTSLKFRYHFVEQLSTCMTLGHGDGWLREGRGSKGMDPQQQQVPLQQVRQQQEPRDGAPATAGAAAARAQRWSRGNSRGGGRGGQEMGPRQQQGRGLARTTAGCRGGGPRTAIV

SEQ ID NO: 171463 - protein, 81 aa, Triticum aestivum
  Clone ID: PAT_TA_65881.pep
HLPPQDPVKPGPQSPDHPLGEQAHQYQILSPLTTDLHEKSRHNTLSSSSLKPQEKISRCQKCTTFSQKLPLISLMAKSVVN

SEQ ID NO: 171464 - protein, 183 aa, Triticum aestivum
  Clone ID: PAT_TA_65882.pep
VDTFNKAGATGAAQSYNRPAAPSVTPPTIGARFFVPTATAVAAEQMPSQSVETRGETFQRDERSSSPPAETSFSSPPPAAQFSSPMSSTIQRYPSMDNIATPNQAPWMSPGSNSSSFASRSRAASWSGTYSDQFSSTAGARSPDGPTVPSPQMPGRPPSHSRSNSNSSVQFTGLTEDLHEVEL

SEQ ID NO: 171465 - protein, 74 aa, Triticum aestivum
  Clone ID: PAT_TA_65883.pep
MAMRRLLQGVVLPRATGRCVGASSFSTSTEAIRATLFFCDGIGPEIAESVKHVINVAGVPIEWEEPCVGTEVDP

SEQ ID NO: 171466 - protein, 81 aa, Triticum aestivum
  Clone ID: PAT_TA_65884.pep
RRFERRKKRKGANQTVSLILNPFHRICTSVICSQPTKSIIISFYHWKEGMNHAGGGQFRCCQRPWTFSALPSLRLNTPTPL

SEQ ID NO: 171467 - protein, 119 aa, Triticum aestivum
  Clone ID: PAT_TA_65885.pep
STQGADSSDSRKAEYSAAKRTRTERTLSFRPKPFFSLHGQSHLGQKYMVAAASGSRRVLPCIYVAAPLDIHPSSKRRHEQELRCFSCSSFSRCDRWLSRLPRTDLRRATVQHERAGPAP

SEQ ID NO: 171468 - protein, 148 aa, Triticum aestivum
  unsure (1)..(148): unsure at all Xaa locations
  Clone ID: PAT_TA_65886.pep
SLLTVAAFSQSSPSSPRHHPPRKGGCLAAAATADAAPAASAATAAAGARCSPTLRPPPAPPPWSCPPPPTRGAPAGSRRPAGRPAAATAPPASAARPAAAPAAAATEPAPXRPAGXGEHEDEEDNWTSNHXPPPPPSLAAACARPRAR

SEQ ID NO: 171469 - protein, 119 aa, Triticum aestivum
  Clone ID: PAT_TA_65887.pep
VDEARTRTTIDLFTYWKKPTNSWLDPISYLHVLEKPLTQLTYNDQIWRWAEKGRQGTTHPPEAYLLYSVGGAEERRSAEAEVAHGEKSAVDPWWRLTALLFLGVADGAVLLGGWCLQGG

SEQ ID NO: 171470 - protein, 70 aa, Triticum aestivum
  Clone ID: PAT_TA_65888.pep
VQVHKDDEVRALFKQVQGEVPGLPIIIMKVASQEPSIELFYWLNLAALEHPAALCPKTVTICKYYVLVAV

SEQ ID NO: 171471 - protein, 125 aa, Triticum aestivum
  unsure (1)..(125): unsure at all Xaa locations
  Clone ID: PAT_TA_65889.pep
MALPNQNTVDYPSFKLVIVGDGGTGKTTFVKRHLTGEFEKKYXPTIGVEVHPLDFTTNCGKIRFYCWDTAGQEKFGGLXDGYYIHGQCAIIMFDVTSRLTYKNVPTWHRDLCRVCENIPIVLCGN

SEQ ID NO: 171472 - protein, 102 aa, Triticum aestivum
  unsure (1)..(102): unsure at all Xaa locations
  Clone ID: PAT_TA_65890.pep
MAPKRGGKAPVPAKKKAADKVVNPLFEKRPKQFGIGGALFFFXDLHRFVKWPKVVRIQRQRRILKQRLKVPPALHQFTRTLDKNLATNLFKMLLKYRPEDKV

SEQ ID NO: 171473 - protein, 58 aa, Triticum aestivum
  Clone ID: PAT_TA_65891.pep
NEGAAVGECGAIVWQRRIVYGESHEGRGATLLRIHGGSTSSSNISGIQDGGHVAVACA

SEQ ID NO: 171474 - protein, 178 aa, Triticum aestivum
  Clone ID: PAT_TA_65892.pep
SLNGTISASFGGLSRLTELQMGGNRLSGSVPVELGKLNALQIALNLSYNMLSGEIPTHLGNLRMLEYLFLNNNDLQGEVPSSFTELSSLMECNLSYNNLVGSLPSTLLFQHLDSSNFLGNNGLCGIKGKACPVNSAYASSEAAARKKRFLREKIISVASIVVILVSLVLIALVCWLLK

SEQ ID NO: 171475 - protein, 192 aa, Triticum aestivum
  Clone ID: PAT_TA_65893.pep
QCLRFPECLSEPTGERCTELCRNLGSHLREKHGHDNFAELRKVLMHNYDSLSVYAMTCLLYLGVFPNNRPLKRKVVIRRWLAEGYARSDSLRSEEDIADETFKALVDRNIIQSIGTRNNAQVKTCMTHGIMHEFVLHKSVSQGFIATSSRDHPRPHAYVNNACHLSIHGGNVTDSEASDEDLSRVRSLTVFG

SEQ ID NO: 171476 - protein, 77 aa, Triticum aestivum
  unsure (1)..(77): unsure at all Xaa locations
  Clone ID: PAT_TA_65894.pep
ASWRAGAAQCGCSMVLVLGGAVVADLVSPVVGSGLRRTWRFVLCVWRXVAAGNHGGSWPRAAHLRPLPAWCSAGCGG

SEQ ID NO: 171477 - protein, 121 aa, Triticum aestivum
  Clone ID: PAT_TA_65895.pep
MARGAAAAAAAAKGKKKGSVSFVIDCTKPVEDKIMEIASLDKFLQERINVAGGKAGNLGDSVTVTRDKSKVTVTSDGAFSKRYLKYLTKKYLKKHNVRDWLRVIAANKERNVYELRYFNIA

SEQ ID NO: 171478 - protein, 168 aa, Triticum aestivum
  unsure (1)..(168): unsure at all Xaa locations
  Clone ID: PAT_TA_65896.pep
MSSFVGVLVSDPWLQSQFTQVQLRTLQTKFTSAKRSDAEHVTIKDLPPVMEELRGIQEVLTEEDITNFLSESYPDMNEPIEFEQFLREYLSLKAKGTTKSGGQKNLKGSVSFLKASTTTLLHVINESEKTSYVNHINNFLGDDPFLKXFLPLDPTSNDLFNLIGDGVL

SEQ ID NO: 171479 - protein, 94 aa, Triticum aestivum
  Clone ID: PAT_TA_65897.pep
GDRFNCPSAAAGDGCASGTPSATCSPSSDGGAAADAGSRFSTRSMKRRSPSCRSSSPRRPPPRPRCCRLAGRAGARSPRTRGPPLVSCSNAAAA

SEQ ID NO: 171480 - protein, 160 aa, Triticum aestivum
  unsure (1)..(160): unsure at all Xaa locations
  Clone ID: PAT_TA_65898.pep
QCGKGKVWLDPNEXNEISMANSRQNIRKLVKDGFIIFFPQKIHSLSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHA

SEQ ID NO: 171481 - protein, 161 aa, Triticum aestivum
  Clone ID: PAT_TA_65899.pep
MPAFAESTAEPPLADSYYALLRGGNKADECASAPPPGCQAPPVSECELPMIDVGCLTACGGGTEERAACAAAIASAAAEWGFFQVVNHGVKQELLEAMRREQVRLFRLPFEAKATAGLLNDSYRWGSPTATSPRELSWSEAFHVPLAGISGTPCSYGELAS

SEQ ID NO: 171482 - protein, 152 aa, Triticum aestivum; identical to SEQ ID NO: 126262
  Clone ID: PAT_TA_65900.pep

SEQ ID NO: 171483 - protein, 157 aa, Triticum aestivum
  Clone ID: PAT_TA_65901.pep
TKMQPARIKICTDRSGRGCKSMSTTADLARTSLGEDQPQVQAQRRRPWATPCTGDYGARVSRSRPPCTGDRGDRVRRGRPRRSGASDQRGGEERAEQQRQRQPPLLLVMGTLKLDGGAAAPPAAAPFRRCSRTTDGGRGRWGGEEAGRGGWLVAAEA

SEQ ID NO: 171484 - protein, 186 aa, Triticum aestivum
  Clone ID: PAT_TA_65902.pep
LPRRGIRAAARHLVWRRVRPRKAFPGRAASTQLVEDIVLFLAKNEQTVLNMLFWGAPEDADAVAAVIVQHAVPLIESSHGTRLLVVVLNRCNHMLQEAIVARITRDHKKFFKICAARSGEVVSMINSCISEKSLELLRDAIVPWVTPFMMARLVTDSSRLMVVHALVQCVPHPYFAEKLHCSVRPE

SEQ ID NO: 171485 - protein, 186 aa, Triticum aestivum
  unsure (1)..(186): unsure at all Xaa locations
  Clone ID: PAT_TA_65903.pep
VTFLGPAGAEAHAALASKVASFVLAGRGLAQAHGATGVWVDASLRLSPTFADTAAAVYKADARSVDFSNKPREAMAEINEWFESKTRGLVKNIVSERDCDGSTALVLGNSVFFSGYWNSPFFPXATEEGRFYVNASPEDHTVRVPFMKGSPFQQIGVHPXFKVLRMPYRGDFGDSDPLFAMYIYLP

SEQ ID NO: 171486 - protein, 121 aa, Triticum aestivum
  Clone ID: PAT_TA_65904.pep
DVGSWAVTDSDVGRAHVSPRGCAYKYAVSPNPSRHEQITSAHAHAHRRSFAAAAAGDSIPSATYTVDGRAGLRNHALLVPVRGEGRIGFWAAITRLLASDRLLPLRPRRLRHHHVHRRRPC

SEQ ID NO: 171487 - protein, 173 aa, Triticum aestivum
  Clone ID: PAT_TA_65905.pep
RPAAAADDTTKRRTTKNKSFKDVENYEVLVLEKNCGCKFKSLRYLLIAIVSATFLTLLTPTLYERQLQSSSRYVDVDWIWDKTSADPRYVSSADVQWADVYTAIEDLSAGNQELKIGLLNFNSTEYGSWSRILPESHVSIVRLEHAKDSITWPKLYPEWIDEEEESEIPSCPS

SEQ ID NO: 171488 - protein, 134 aa, Triticum aestivum
  Clone ID: PAT_TA_65906.pep
APPPPPPPVLPPLVRPSDRRVCSSPSRICRRTMSAGPSSCAGKVQEAGGQDGMSAVRRSDGRRGSRAQDHACRPCHLPAPATRGRAGPGGWLGSGKLFYCCQTSELRCAAMSDLRHRILVLDQRQGDHTESPLS

SEQ ID NO: 171489 - protein, 92 aa, Triticum aestivum
  Clone ID: PAT_TA_65907.pep
LLPPPVLLPSPGAGAVGFRRRAGDSGARRHPRTPAPPTREQLPIDSAAHRRRAGPRFHRASPGPTADHLRDSAAAYLRDCAGHLSDGIAHPT

SEQ ID NO: 171490 - protein, 114 aa, Triticum aestivum
  Clone ID: PAT_TA_65908.pep
VLIDSPVLHVPDWMRALVNLQELRIEVKGITQSDLCILGSLPALLKLELEGRYHDSKDRMLTVSAEAGFPYLTKFRYYADQEGINLKFAAGSMPNLEMLVIVLRACGTEALADC

SEQ ID NO: 171491 - protein, 150 aa, Triticum aestivum
  unsure (1)..(150): unsure at all Xaa locations
  Clone ID: PAT_TA_65909.pep
ASAAGHHAKREPSSAAASTPKLQQFQNLVRFLTRSNGSAPELAKKTKSARVSPVSRKAACSGAAWGRSYSFVGTEEYVAPEVVSGDGHGFAVDWWAVGVLVYXMAFGRTPFKGKNRKETFRNVLHREVEFPGDTXRRMPELTDLISRLLQ

SEQ ID NO: 171492 - protein, 98 aa, Triticum aestivum
  Clone ID: PAT_TA_65910.pep
RRPRRRTPRDGVWPPCHRISRRCSRSGSGNAAGARHLRRRARARASRERDWPPCRRTPHRSAAGRRRRRRAADPTTRSDLAATRSWRRWRGSRRSTCL

SEQ ID NO: 171493 - protein, 126 aa, Triticum aestivum
  Clone ID: PAT_TA_65911.pep
MPSKPSSAMAVAAASPAGGGGVARLEALAMDKVAEAADAVAIASSAGEVVRAIHAVAVLLFPVDSATVAGTLDEPIKSQIISVLSLSHDERESWRRAFYHGPAFPTMSKILLGNIALKWLRQIHNT

SEQ ID NO: 171494 - protein, 146 aa, Triticum aestivum
  unsure (1)..(146): unsure at all Xaa locations
  Clone ID: PAT_TA_65912.pep
HVCGCRQARDAAFECSCINRSVVNEYVEAVKQLACDILDLLGEGLGLEDPXLFSKLITETDSDSLLRINHYPPSCTVHKLDHDDQCKLKGVARTKAGSGGNPAAGGRIGFGEHSDPQLLSLLRANDVDGLQVLLPDINGKDTWIQV

SEQ ID NO: 171495 - protein, 97 aa, Triticum aestivum
  Clone ID: PAT_TA_65913.pep
VVSCSGEFLGIANKRHLYIWSIPTKDFNHDNIRKIKLGHTKKLSTLAFHPSERIVAGGDATGRILIWRGFGKAKFSGTHGAKSQVDEERDGVRGKDD

SEQ ID NO: 171496 - protein, 65 aa, Triticum aestivum
  Clone ID: PAT_TA_65914.pep
INKLNTSCYLSRKTKHSSSLTLIANSTKKNMVFHRADAYHLSPSSMVQLNTKFHLFQRSADVKHI

SEQ ID NO: 171497 - protein, 97 aa, Triticum aestivum
  Clone ID: PAT_TA_65915.pep
HHPHRQVKANGNLLYFFVLVFQASKKITIVLEKDACTLPKQFLIVPKTGVIKRDSAVSTKHVHQDALSVGGGPPAIPVDILHTHARGQTALDAGRTV

SEQ ID NO: 171498 - protein, 121 aa, Triticum aestivum
  Clone ID: PAT_TA_65916.pep
MARLNSKAVVSAVVLAAVVLMMAGREATALSCGQVDSKLAPCVSYVTGKAPSISKECCSGVQGLNGLARSSPDRKIACRCLKSLATSIKSINMDKVSGVPGKCGVSVPFPISLSTHCHNVN

SEQ ID NO: 171499 - protein, 120 aa, Triticum aestivum
  unsure (1)..(120): unsure at all Xaa locations
  Clone ID: PAT_TA_65917.pep
SSISFPIPVFSSAKHYPVAMLVTRIANSSSASSPTSFRSMLPSLSLQFCIEFFALWLDRLNLGSTWLADSTALEAFLILSKQQRKVQIIVFSLKVFALHRSIPXCSYMLKSVCMGSCLAF

SEQ ID NO: 171500 - protein, 132 aa, Triticum aestivum
  Clone ID: PAT_TA_65918.pep
PSSPSPRSASPGASSSPPAPARPPASRRSPRRRQLPPPSPGPTGRGERAALGARLGAHRRGVPPRDQVHRKGVEAEGYTINVISAHLDRIASDVQAAWHLLRPKYTMPLTSTSSSTPSSQKMLTSSVNSGGI

SEQ ID NO: 171501 - protein, 87 aa, Triticum aestivum
  Clone ID: PAT_TA_65919.pep
PTTPRGDHRRPTSRTSPYIHQRSSRRNASRCALPSTMPLGIEERCPKPRATRVPSSTNVPHARHRSHWRPDLHHSQLEALFVANLGP

SEQ ID NO: 171502 - protein, 178 aa, Triticum aestivum
  Clone ID: PAT_TA_65920.pep
FNESDYKYYSAVESLEKASMTNNQDERDILAREAFNLLTKIPDSADLSAICKRFENLRFYEAVVRLPLQKAQALDSNADVINGQIDARHHDTITAQRVQCYEIVMNALRTLKGAGRSGAPGPVTALDPASRSKCIKQIIQLSVQWPDTAFHEHLYRTLIELGLDNELLEYGGSDLVAF

SEQ ID NO: 171503 - protein, 80 aa, Triticum aestivum
  Clone ID: PAT_TA_65921.pep
MAPLARKHRKASPSPSPSEASSNSGSDSELHLDDHSDPEDSFFSTRSAADDDVQESSTSDEEEDDEESLHEEEDDGEMGE

SEQ ID NO: 171504 - protein, 119 aa, Triticum aestivum
  Clone ID: PAT_TA_65922.pep
RSDEIYSQTAEWRFPYLNRLRRGRLTELPNAKTSNRVRFLDIPVIRARRSEPRICSLSGTAKPIADPRRRGSRIPPEKRSCASRRFCFDSRSIRSSSVRLRSNDGGVERGDRRDSGSGS

SEQ ID NO: 171505 - protein, 161 aa, Triticum aestivum
  Clone ID: PAT_TA_65923.pep
VTNTDVLKNGLLVKEDTEWARKLSMKEDEINTLRQKLDRLLSIENAGAAGSDTVYLELEKENETLRVKIQELEKDCSELTDENLELIYKLKESSVGKGQDSRVSNNSELQIEKLTSQIYELEEELRNKEMMHDGSFTESSVSNAKELQRKCADLELKLLRF

SEQ ID NO: 171506 - protein, 200 aa, Triticum aestivum
  Clone ID: PAT_TA_65924.pep
DGVPVLFIPGNGGSYKQVRSFAAESSRAYQNGPLEPSFYREPSSAFELEDSSLPSQYGRILDWFTVDLEGEHSAMDGRILEEHTEYVVYAIHRILDQYKESHLARSKDGVRSTGNLPSSVMLVGHSMGGFVARAALVHPGLRKSAVETILTLSSPHQYPPVALQPSLGHFFSHVNEEWRNGYKKGVSHTSSPKLSNVVVV

SEQ ID NO: 171507 - protein, 126 aa, Triticum aestivum
  Clone ID: PAT_TA_65925.pep
TGASSSPSPPCSTRRPSPRRTPPTGPSSSPLSRRPSRSSPSPSPSLRPCTPPPPATSATPSATSSPPPPSSPTPISSPSRDPSSPRRRRRSHHLPIFSPSSPPAPQALSSSFSRTARMRRRLLSLL

SEQ ID NO: 171508 - protein, 104 aa, Triticum aestivum
  unsure (1)..(104): unsure at all Xaa locations
  Clone ID: PAT_TA_65926.pep
GRSTTQWWFGTWPVPTISNGGHGVVLXGPVCKQGQVVGWHTSGDGNKXLERFYVAISGFTVNSTMLWDPKLRSHQVWNTTRHPENGVTGLPIFMDASRQYVEDS

SEQ ID NO: 171509 - protein, 186 aa, Triticum aestivum
  unsure (1)..(186): unsure at all Xaa locations
  Clone ID: PAT_TA_65927.pep
WKYLVEEXNLKNHTYMTQLYEIRHKWAKPYFKGIFCAKMTSTQRSESTNQMLKNYVPPGCPMHIFVRKYMRLLFSXRESEENYKEKRTRIGRPLLRANMATERHAGKIYTRAIFEQFGHILYECGAYQVEEIEKGKSYVAIHTEADRREKWCRTSYKFTVLDGGDEFDYECRQFAHMGLPGSHVLK

SEQ ID NO: 171510 - protein, 155 aa, Triticum aestivum
  Clone ID: PAT_TA_65928.pep
AVCLCEFADDDRLRLLPKCSHAFHVECIDTWLLSHSTCPLCRCSLLADFSPCGGGCSSLVFVLESGSEGSVSGRVDRPPAAHLSLVMEQEEGCESQTHSDVKEKDEVVVPVKLGKFRSQATEGGAGCSSNPDQDVRRCYSMDQSSLLRVSVKPPA

SEQ ID NO: 171511 - protein, 107 aa, Triticum aestivum
  unsure (1)..(107): unsure at all Xaa locations
  Clone ID: PAT_TA_65929.pep
LRLFASAGPPPPSRXSPHLAGPAMELDLPPPRQAPPXPTWPPPSAWPPRPRPRSPRHHPPRPQPLRPPPSATLTPPSAASSPASMRPPPCRPTTISPWRMAARRGSR

SEQ ID NO: 171512 - protein, 129 aa, Triticum aestivum
  Clone ID: PAT_TA_65930.pep
DRGRGRARRCPYRCRHHRRRRSGRALRLPRSPPAAAPPPLVGALIESLSFRSCWFCRAASSAFEKEDLRLRVALPHRLRDSLHAALKAKDPSAGAFALEEAPWVGTAANPWFALAPEDAPENPLVAFVN

SEQ ID NO: 171513 - protein, 88 aa, Triticum aestivum
  Clone ID: PAT_TA_65931.pep
PRRHLRSHPSPALKRPRSSATSSPPPTQTPCSPSSPASASPARTSPPSSPPTRCSSGPGWTTSPPASLPCATASASLRPRSPASSWWA

SEQ ID NO: 171514 - protein, 127 aa, Triticum aestivum
  Clone ID: PAT_TA_65932.pep
ADKYGMDIVQHDAESWVVLSSYAEETFPILTYSTESVSPESDKVKNESMLTLLVSLMRKYNEENDSTFSGSKYCNVPSLVESLLKRFAKLSEQCMSTLREMAPQVVPSIPDHGSTKQNSGSPDLMDK

SEQ ID NO: 171515 - protein, 196 aa, Triticum aestivum
  Clone ID: PAT_TA_65933.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQPFPQFQQPHQPFPQPQQQFPQPQQPQQSFPQQQR

SEQ ID NO: 171516 - protein, 73 aa, Triticum aestivum
  Clone ID: PAT_TA_65934.pep
GLLTYMQEKNGSSTLHKKPSQSALRTKKRTPTTSNNYSAMLNHAQAHARWLNFQVTHTWQRNSRKMNYAQYHR

SEQ ID NO: 171517 - protein, 209 aa, Triticum aestivum
  Clone ID: PAT_TA_65935.pep
ECSTVKPCTHTCINTKGSFNCVCPSGMNGDGRKEGSGCSGIGTLQISIVVGLALLLLLLVLGFWTHCLVKRRKLAKKRQRYFMQNGGVLLKQQMLSRRAPLRIFTSAELDKATNKFSDSNIVGRGGFGTVYKGVLSDQMVVAVKRSQRVDQSQVEQFVNELVILSQVTHKNVVQLLGCCLEAEVPLLVYEFISNGALFHHLHNTSIPMS

SEQ ID NO: 171518 - protein, 68 aa, Triticum aestivum
  Clone ID: PAT_TA_65936.pep
AGGDLGSHASTLPAAYRWTTLTVSHDLLALEHGSRHLQILLHNFIILHNLNLPHAHMLIQHHMIPDPM

SEQ ID NO: 171519 - protein, 76 aa, Triticum aestivum
  Clone ID: PAT_TA_65937.pep
NKCVVSGPVASRRCGSRRPSTAHRRGIPTGRSPGEVEFSGKALSPSFSCVCLLLRLGVDLRQEAQRLQGGMVEAVG

SEQ ID NO: 171520 - protein, 209 aa, Triticum aestivum
  unsure (1)..(209): unsure at all Xaa locations
  Clone ID: PAT_TA_65938.pep
AILHVQRKITPPTSXQEGPAISRLIVSPNQVGCLLGKGGSIIAEMRKLSKAHIIVLSKDKIPRGVQEIDEVVQITGDSEAIQEALMQITARLRNNLFRDRMASMGPSMQPPFGLLDPQFGAFAGIHESTSPRIYPNASQFHKDFMGRPLDEMPAPWTTKDVGDPMSISGIPGMAHRGMGGFSGPVHSSRPIITGNIMVPRLVIPALCGH

SEQ ID NO: 171521 - protein, 112 aa, Triticum aestivum
  Clone ID: PAT_TA_65939.pep
ASDATFLTLLVLGAVVMGAAADGPPATYLFFVDPTPPGVTCMQYHLGILTAALGSEEKAKAAIIYNYKNVVSGFSARVTPAELEAIKKQPHVNRALPSATLQLMSSNFDGVS

SEQ ID NO: 171522 - protein, 224 aa, Triticum aestivum
  Clone ID: PAT_TA_65940.pep
PWELFRHYDELYFRGALADAGFSVERAAPRTKTITSFGYCSLGDLSKITLYKPMPRYRTNANLKNALLHLMIHGIVFVKRGLTSLGHGPAFRDWMDAINTSSVDDYARPISGYCITTTHDFSQEKSCNIQGSMWKCDKCGNTLVRAKSLGPPSDSCCIENVSEDPTCGNKLCHWHNHKKGCRGKYVVTKPAVTPGQKMAPKGTLRLRTETTKMPKSQQGAVQQS

SEQ ID NO: 171523 - protein, 56 aa, Triticum aestivum
  Clone ID: PAT_TA_65941.pep
QRCSPLHDVVETEPIGRFLFLRGRGRRRRCLLGCIRLRCVSGSRCVGFLLLGAAGA

SEQ ID NO: 171524 - protein, 149 aa, Triticum aestivum
  Clone ID: PAT_TA_65942.pep
LAKLFAQDWEGDVTMVMPATVAQYLKIIQNPTYPELQMAANHCLRCTWEKISAIRANCAIELALDESIAALNHKRRLRRSIERAAASSQGYTDSVRLKTPRRVPSWSCISRENSSGSLSEDHFAAAISSNHQGTIRVDGAPHTSHHVRQ

SEQ ID NO: 171525 - protein, 100 aa, Triticum aestivum
  Clone ID: PAT_TA_65943.pep
RDTNWARLTRPTSTAATSFTLAPASFPTQRSPRAPMDGDGQHVRPRSRALLTDFMMTGRTPATCTAAASPPRAGLVLAGSWGGSSTWCSAAAATTAASGS

SEQ ID NO: 171526 - protein, 50 aa, Triticum aestivum
  Clone ID: PAT_TA_65944.pep
ENVNYEDKNAIFKLGVNTEGRRINRTEVYRVFITRIYFYGFLFPVLLTDK

SEQ ID NO: 171527 - protein, 101 aa, Triticum aestivum
  Clone ID: PAT_TA_65945.pep
RSGQPLLQFESESRAERNRGSKTRELVDYREAGQRDWWEKRVRIKLHKNPKLREGDAKNDIRMASSRSSSMQQRTSWRLQQVERLQCCSRGELRTSGNYYC

SEQ ID NO: 171528 - protein, 48 aa, Triticum aestivum
  Clone ID: PAT_TA_65946.pep
AFRRAAPQGGPISYVRCREDSRPAGRSVMRPVPEPDGGCSPPCSERTP

SEQ ID NO: 171529 - protein, 42 aa, Triticum aestivum
  Clone ID: PAT_TA_65947.pep
PPPPHRRPQLTGAALSYPRRHAHLLPRDDIGALVAGTPPSQL

SEQ ID NO: 171530 - protein, 53 aa, Triticum aestivum
  Clone ID: PAT_TA_65948.pep
LVKPIQGYKSVGKDAPSGSLPDEQLEAECREVLHVSYLIPDILTGPIIHFENS

SEQ ID NO: 171531 - protein, 105 aa, Triticum aestivum
  unsure (1)..(105): unsure at all Xaa locations
  Clone ID: PAT_TA_65949.pep
AAPQQVRAVPLARALRLRTRASAAAPPETSRRALLGLTEPELRQLAVDLGQQSYRGKXLHDLVYLRGGKQVEEFAYVPKVWREALVGAGWKVGRSPVHPAVAASV

SEQ ID NO: 171532 - protein, 85 aa, Triticum aestivum
  Clone ID: PAT_TA_65950.pep
MDEVTQAVENLKKEWSQAVEQLEVCIAAIESCGKMGKGTEEAMSLPRLNGSAQDALQLLNALQCRLDLLAEQLPTFEEVQSGQAT

SEQ ID NO: 171533 - protein, 43 aa, Triticum aestivum
  Clone ID: PAT_TA_65951.pep
FRGSPTKKEEPDLGADDCRRTPPAMEICQRHRAGTPCQHPPFF

SEQ ID NO: 171534 - protein, 38 aa, Triticum aestivum
  Clone ID: PAT_TA_65952.pep
DWMVSSRDNGSSLLLNHPETANGIEFLQFNLGQISLMR

SEQ ID NO: 171535 - protein, 89 aa, Triticum aestivum
  Clone ID: PAT_TA_65953.pep
MAEGFLVCVRYSTKYHAWLSEIIENGTGKNLNLSSFIVLIFIYSAKDMSIRGGTFRLLNLLNEFYIGGVKLPFYKLILPLLIFVALLLM

SEQ ID NO: 171536 - protein, 121 aa, Triticum aestivum
  Clone ID: PAT_TA_65954.pep
SPSSAWPGPRIAGCAARGWCGGTSRRARARWLGRRAQSPRTGSRRTPPTTPSSMTDVTPSPRSRRSVHKRARGHCWFVAVAPAPSSKSPLQHHRREYSHGAEGGRGGYRRRRRSGTGRKRR

SEQ ID NO: 171537 - protein, 34 aa, Triticum aestivum
  Clone ID: PAT_TA_65955.pep
AHSVADRVIAWRSIAKHARHWRAAHFLVFNTYIW

SEQ ID NO: 171538 - protein, 78 aa, Triticum aestivum
  Clone ID: PAT_TA_65956.pep
MESRGSARGGDRDHLDHHRQVLLLRPAAAWSYASGGGGMSWPAQRSPSSSYTCGYCKREFRSAQALGGHMNVHRRERA

SEQ ID NO: 171539 - protein, 64 aa, Triticum aestivum
  Clone ID: PAT_TA_65957.pep
NKQLNQDEFDALLQEFKTDYNQTHFIRNPEFKEAADKMQGPLRQIFVEFLERSCTAEFSGFLLY

SEQ ID NO: 171540 - protein, 92 aa, Triticum aestivum
  Clone ID: PAT_TA_65958.pep
KLDWITGNWTFRKQAVKYQLMREELSLGIEPLKHENEQPKLADKMDKPEVNHKKFQSYLESAKKIALSMPDISNQIASIPKGVDPALVLFHI

SEQ ID NO: 171541 - protein, 105 aa, Triticum aestivum
  unsure (1)..(105): unsure at all Xaa locations
  Clone ID: PAT_TA_65959.pep
ELLSERNTPGGPHPVQESGGRPPYRAPPISWVPWWASGVHLLXXESFXPXKFVGKLTGRNFAATRRNLGGINLGLRRSCSARDTSLREGEIITNVVINDPLIGRG

SEQ ID NO: 171542 - protein, 42 aa, Triticum aestivum
  Clone ID: PAT_TA_65960.pep
SIRLLYHGYHITTYTYLNLHNLLPTEAGDAGTLGIWYSVPQS

SEQ ID NO: 171543 - protein, 111 aa, Triticum aestivum
  Clone ID: PAT_TA_65961.pep
RAKMSDLFSGIQAAMVINRVENSEQSPEDWNSDCDGSGGSTVGHVLAPTAKHDYISIDFWAALSDISKIKDWNWGGYVLKNLFQAVKKFNADVSKRNPTVHIVGCHLFLQL

SEQ ID NO: 171544 - protein, 35 aa, Triticum aestivum
  Clone ID: PAT_TA_65962.pep
IVAIVLGDVAGILIIALVFYCYWKKVSPKEKGHGA

SEQ ID NO: 171545 - protein, 129 aa, Triticum aestivum
  Clone ID: PAT_TA_65963.pep
FESLGEAFSLDRHNPDLIFDMGVEYAEQRNMQAALKCAKQFIDTTGGSVSKGWRLLSLVLSAQQKYSEAEVVTDAALEETTKWEQGPLLRIRAKLKAAQSLPMEAVEAYRALLALVQAQRKAYGSLKNG

SEQ ID NO: 171546 - protein, 58 aa, Triticum aestivum
  Clone ID: PAT_TA_65964.pep
AQIRRDGGHERHARTPLSTVALPLRLRCHRRRRRRRTQRTQGMVRQGMACCVACSNGS

SEQ ID NO: 171547 - protein, 102 aa, Triticum aestivum
  Clone ID: PAT_TA_65965.pep
QNKPIPTNWACQNKLACKSNCVLLLAAVLVSIFAAVAAIGNEDCTPWMSTLITPLPSCRDYVEQQACRIEAPGSPYLAKQQCCGELANIPQQCRCQALRYFM

SEQ ID NO: 171548 - protein, 95 aa, Triticum aestivum
  unsure (1)..(95): unsure at all Xaa locations
  Clone ID: PAT_TA_65966.pep
ILPQQPFVIGGSGGTASGKTTVCDMIIQQLHDHRVVLVNQDSFYRGLTAEESALAQDYNFDRXGAFDTEQLLECMGQRGGALPVNVPIYDFKNHR

SEQ ID NO: 171549 - protein, 45 aa, Triticum aestivum
  Clone ID: PAT_TA_65967.pep
MVGIMVSASTGVMNSLLGKLATLMGDEFAKLKNLRKEVKYISDEL

SEQ ID NO: 171550 - protein, 63 aa, Triticum aestivum
  Clone ID: PAT_TA_65968.pep
DPPHDLVHAGARPLVELVVQLRRAAAGAEAERDGGGQEDGARAAVMDATDHLCLLGRSVCEHV

SEQ ID NO: 171551 - protein, 89 aa, Triticum aestivum
  unsure (1)..(89): unsure at all Xaa locations
  Clone ID: PAT_TA_65969.pep
MGGLFAAFPAASGGRVDAGDMLMMDRFRQWQATHNRSYLIADERLRRWGGDRXNVEYIDATNRGGDLTYELGKNQFADLTGEEFAGRYA

SEQ ID NO: 171552 - protein, 168 aa, Triticum aestivum
  unsure (1)..(168): unsure at all Xaa locations
  Clone ID: PAT_TA_65970.pep
PAEEEPATEKAEKPPAAKKPKAEKRLPAGKTASKRAAXEEGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSSIQSLAAVVGCCLPRIIVAQWKSVEYRLVC

SEQ ID NO: 171553 - protein, 114 aa, Triticum aestivum
  Clone ID: PAT_TA_65971.pep
GIGAPAKGRAQHRPSLLPAADDHTSGQDHSQANRIYNSGFKFPKTLYPESLKNQIKGRGEKTSQQLPENERPLPYVLGKQKRPEPLADSSDDYSRSFLPSRNNDANGCLSSLII

SEQ ID NO: 171554 - protein, 141 aa, Triticum aestivum
  unsure (1)..(141): unsure at all Xaa locations
  Clone ID: PAT_TA_65972.pep
STNDAEVPYNLAKSPTIKSNSASKILVIPCLVVHILQVXGRETPSTHLIYARPVCRQTSTEADHRSQLPLHRLCHGDIRKDDXRSGPPLXRPQASQKPGRFRRMAGVRATRGAEAGGTRPCASKPSAEGASPVGVAAAAAP

SEQ ID NO: 171555 - protein, 56 aa, Triticum aestivum
  Clone ID: PAT_TA_65973.pep
GRRRGGAAAYNGNLVRRVLSRNAGTPRRPDADVDVYLFALFNENQKPGPTSERNYG

SEQ ID NO: 171556 - protein, 38 aa, Triticum aestivum
  Clone ID: PAT_TA_65974.pep
AMDTEHGGLAGSSCRSTSTSLLPPSSSPRTACVDAGAR

SEQ ID NO: 171557 - protein, 53 aa, Triticum aestivum
  Clone ID: PAT_TA_65975.pep
AVAWEAGNRCPWRGGVAPPSHGVRVKTSYLPLPHRRLLLGGQGQTPMFPRIFG

SEQ ID NO: 171558 - protein, 68 aa, Triticum aestivum
  Clone ID: PAT_TA_65976.pep
VAYQTEESKESNELMKLKQQLDEFIEERQSWIDEINQRQSELGAARITVEQLRQKEHFMVAEVDLLKV

SEQ ID NO: 171559 - protein, 58 aa, Triticum aestivum
  Clone ID: PAT_TA_65977.pep
RGRVDPPSTGVRGSVSKGHGPDPRSKESRGPWSCQPDAPRTRPPALRRAPHHGRAPRR

SEQ ID NO: 171560 - protein, 133 aa, Triticum aestivum
  Clone ID: PAT_TA_65978.pep
MLFSGGSAANSTRGRGEFDGSYENPFSRFNKQNDYPFAEFYRQGDGPFSNQFYKVFSKVGQHDVDVHASDIEIELNLSFGEAAKGCTKEVPFSAKNLCYSCDGRGYLANARKYVCPSCKGARKVSMYPFTSIC

SEQ ID NO: 171561 - protein, 101 aa, Triticum aestivum
  Clone ID: PAT_TA_65979.pep
AATAVVVVPRILSGFLGLPSRLTHGRAERKNQLEKGTCSPVRGTRTLFYDARVPPHISLSREVPGSGGSETIPHGHSYTKTGWILLVPVGDDAVNLQVGGH

SEQ ID NO: 171562 - protein, 90 aa, Triticum aestivum
  unsure (1)..(90): unsure at all Xaa locations
  Clone ID: PAT_TA_65980.pep
PKDPNTTGNMQYAHQXYLGSKICYIVIFIVLLSVKKNYMQISMGSCTLLHLKLHADFYATLVFMVCNLVDLENLFLMWLGHIKFIVLMSM

SEQ ID NO: 171563 - protein, 148 aa, Triticum aestivum
  Clone ID: PAT_TA_65981.pep
PSALALSNAITNLAAAVFGEQRKLEPMAPDRKARWKKEVGWLLSVADQIVEFVAKKQVLDNGVEMEVMGTQQRRDLQSNIPALRKIDAMLLDYLDAFKDRTDFWYVKRDSCSDAEKEESNTSEEKWWIPIVKVPPNGLPPASRAWIQH

SEQ ID NO: 171564 - protein, 82 aa, Triticum aestivum
  Clone ID: PAT_TA_65982.pep
LLACRVVASFGTRTYLLNYGVVQLFRVPTSKSTHVQHTNNSFNTPPQAPPQALACDSLRPKHEKWAAIQLRQPGLGKQETET

SEQ ID NO: 171565 - protein, 116 aa, Triticum aestivum
  Clone ID: PAT_TA_65983.pep
LIYRSLLQVWYPVTTAMGKTSFQGPDCIKEVKIGPSEKPISNFFTKKAGGSVKPEKAHGELAETQAFKTTKEECGDDSGEDPSNKTEQQQQASSEKQSAIKNEPVTLDPQIFYKAD

SEQ ID NO: 171566 - protein, 88 aa, Triticum aestivum
  Clone ID: PAT_TA_65984.pep
STKEQGHFSLPCFICTLKHDGHAMFPEVSQGLVRAIIGLVHRYTSCEGRNFNRPEPGSASHQRGGTGERQLFSTKQRLTIAGWATEII

SEQ ID NO: 171567 - protein, 61 aa, Triticum aestivum
  Clone ID: PAT_TA_65985.pep
PLALGAPCTSAPERLLDGEVVRRRLIRRRRAPERGAGGEVAGVRDGRQCPRRQPHFWLQLH

SEQ ID NO: 171568 - protein, 63 aa, Triticum aestivum
  Clone ID: PAT_TA_65986.pep
RSVCRDATPADGGRDGEEEEADGDATSGRGRCTATHGVIGRGGGGARDEEGHIAIGVERGHAA

SEQ ID NO: 171569 - protein, 146 aa, Triticum aestivum
  Clone ID: PAT_TA_65987.pep
IAAAGLAALRDHAHGHDGGAAPPAAPDSPFDTNVVIILAALFFALLFAIGLNSLARCALRYVGRGAAAAAAGEGGATARGASRGGSGIKRRVLRSLPVEVYGSGEVIDDVCAICLGEFVDGEKVRVLPRCAHGFHVRCVDAWLVSH

SEQ ID NO: 171570 - protein, 55 aa, Triticum aestivum
  Clone ID: PAT_TA_65988.pep
CSGRSMNRDAGRTGPLSRERGGVAGGPCDWIRRGVAQRAPGRGRGMKSGSMDGVG

SEQ ID NO: 171571 - protein, 164 aa, Triticum aestivum
  Clone ID: PAT_TA_65989.pep
MPALAKPAARPAKPAAAAPKPKPAAAKPKAAAAGAAHPTYFEMREGAIAALKDRTGSSWGGGAKYIEEKHGKALPPNFKKMLSVQLRASAAKGKLVKVKASYKLSDAAKKDSPKAKPAAKPAKDAAKPKKKAAEKPKKTAAVGTKRKAPEKKKLVTKAKKSPAA

SEQ ID NO: 171572 - protein, 98 aa, Triticum aestivum
  unsure (1)..(98): unsure at all Xaa locations
  Clone ID: PAT_TA_65990.pep
RSIGKLFNTIVTKTDVLNQPSWEDQHVLHAPRVXKLTKAPGCGNVPSPDSTLAAMDIGLPSPSSSVLVITSLRIDQMLRESLIMRDQSATRFTRMRWR

SEQ ID NO: 171573 - protein, 124 aa, Triticum aestivum
  unsure (1)..(124): unsure at all Xaa locations
  Clone ID: PAT_TA_65991.pep
ALLARWGINYSFAEYKASANELEPIRHYLSIEREEEKNFDDAPAEKKXIGSDEWSGVLLRIXNNARVGLGIICLQLPFELAYAHLYEKTETEALRYVLTALYLVAIQYYTTIGGKVSVILIKSE

SEQ ID NO: 171574 - protein, 163 aa, Triticum aestivum
  unsure (1)..(163): unsure at all Xaa locations
  Clone ID: PAT_TA_65992.pep
LRVSSVPARLQRRRLVRLPRAGTVVFGSRPLQLLMPVEAVMDGKRLRLHDAGAGHPASPPGKRXRDGGDHDFRASKKQAAASAVPQLSCARIRPYVRASRPKEEQTQVIAGGNSQVVITKQNADKRTSCIGGNMAAVHAPRPTEASTQVRARAVAVADNVINK

SEQ ID NO: 171575 - protein, 105 aa, Triticum aestivum
  unsure (1)..(105): unsure at all Xaa locations
  Clone ID: PAT_TA_65993.pep
GRLELVSVVIKPSNQLKITFLEAXAKIYSARTIKVKDQEGIRTYYFYEWGGDRQHVALMATVDSGGGKAAYYKPKVVGPFPDPAQAGATCTGLPFSSCILCCYFL

SEQ ID NO: 171576 - protein, 105 aa, Triticum aestivum
  unsure (1)..(105): unsure at all Xaa locations
  Clone ID: PAT_TA_65994.pep
QKMVSPALRALFSPNTSNTSGVSASFSKKERNTSPTPAVVATRPAKAPHPLSDKICSITPPXXVALAQGTSKRTPTPMAPANGMWLIRSTARPSRQKERRRTLSP

SEQ ID NO: 171577 - protein, 56 aa, Triticum aestivum
  unsure (1)..(56): unsure at all Xaa locations
  Clone ID: PAT_TA_65995.pep
NHWEQQPNYAAICKMTSXTEGPTSVGRPVSKNRTSSDISHVECYCNFSIPFGFWLK

SEQ ID NO: 171578 - protein, 32 aa, Triticum aestivum
  unsure (1)..(32): unsure at all Xaa locations
  Clone ID: PAT_TA_65996.pep
DILSLSLLYYXIHLSSSFLYKCLSDASIVLIL

SEQ ID NO: 171579 - protein, 199 aa, Triticum aestivum
  unsure (1)..(199): unsure at all Xaa locations
  Clone ID: PAT_TA_65997.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKXFDVGNGVMVTXGRTTWRGGLIKNR

SEQ ID NO: 171580 - protein, 161 aa, Triticum aestivum; identical to SEQ ID NO: 129051
  Clone ID: PAT_TA_65998.pep

SEQ ID NO: 171581 - protein, 266 aa, Triticum aestivum
  unsure (1)..(266): unsure at all Xaa locations
  Clone ID: PAT_TA_65999.pep
SDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFACKQLEDGRTLADYNXQKESTLHLXLRLRGGMXIFLKTLTGKTITLEVESFETIDNVRGQIQDKEGFPPDQQRLIFVGKKLKKGRTLR

SEQ ID NO: 171582 - protein, 274 aa, Triticum aestivum
  unsure (1)..(274): unsure at all Xaa locations
  Clone ID: PAT_TA_66000.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEXVSSYLKKVGYNPEKVPFXPIFGFEGDNMIEXRSTNLDWYKGPTLLXAXLDQINEPKXPSDKPLGLPFXMFTRLXGIGTGXCWTPLKMXVXXPGIGLVTFG

SEQ ID NO: 171583 - protein, 258 aa, Triticum aestivum
  unsure (1)..(258): unsure at all Xaa locations
  Clone ID: PAT_TA_66001.pep
MKTFLILALLAIVATTATTAVRVPVPQLQPQNPSQQQPQEQVPLVQQQQFLGQQQPFPPQQPYPQPQPFPSQQPYLQLQPFLQPQLPYSQPQPFRPQQPYPQPQPQYSQAQQPISQQQQQQQQQQQQQQQQQQQQILQQILQQQLIPCMDVXLQQHNIAHGRSQVLQQSTYQLLQRIVLQHLWQIPXQSQCQAXHNGGHAIILXXQQKQQQQPSARLXQQAXXQYPLXXGFFPGIXQXPQXQGFXQAXQLAQSREIRN

SEQ ID NO: 171584 - protein, 69 aa, Triticum aestivum
  unsure (1)..(69): unsure at all Xaa locations
  Clone ID: PAT_TA_66002.pep
LSLSLSLSLSLSLCXSLXXXLSXCRXRHQAFNFEXHRPLXHXKGNRSRERSHGPYQADRRKSTXGKAPR

SEQ ID NO: 171585 - protein, 228 aa, Triticum aestivum
  Clone ID: PAT_TA_66003.pep
MSQHLHDSDITNSSDSNSQCIQSSRPDPEPSTDIIGDISYISSAESTSGDGFDGSNIAAAPEKLNTHKKEASGKKFKETFDDETHTGTRISLNPQTILISMSSQNIRNKAVCEQSHLSRITYYGNCDTSLGMHLQDTLLNEKHNCLSCGEPPEAHMYSYTHHDGTLTVLVKSLPLAEALSGEGQRRIWMWTKCLRCHGMPTPRVIITSSARNLSFAKFLEPKVLTHSS

SEQ ID NO: 171586 - protein, 247 aa, Triticum aestivum
  unsure (1)..(247): unsure at all Xaa locations
  Clone ID: PAT_TA_66004.pep
MKTLLILTILAMAITIATANMQVDPSXQVQWPQQQPFLQPHQPFXQXPQQIFPQPQQTFPHQPQQQFPQPQQPQQQFLQPRQPFPQQPQQPYSQQPQQPXPQTQQPQQPFPQSKQPQQPFSQPQQPQQSFPQQQPSLIQQSLQQQLNPCKNFLLQQCKPVSLVSSLWSIILPPSDCQVMRQQCCQQLAQISQQLXCAXIHSVGHSXIMXXNNQEQLQXXQNLGGQLFKATRGGIFRRVLNSTLKNQG

SEQ ID NO: 171587 - protein, 139 aa, Triticum aestivum
  Clone ID: PAT_TA_66005.pep
IITLLIVTPTIHHHGKGVFVRTRYPSKSSSSDPDLATLGLLRLRPGKSTMGLPMLAAATLVGVIFLLGGAALALICDPRRAAGETLGPVLRIEWRRRHNGVPLLEGAILLDRCVPALDLKMFDVLLIWFAPLVLVLVGL

SEQ ID NO: 171588 - protein, 57 aa, Triticum aestivum
  unsure (1)..(57): unsure at all Xaa locations
  Clone ID: PAT_TA_66006.pep
FGFLHDSACHFIFSLLQRPNHGLRKRXFIYLVLEFFSSQLVPKMPNGAMVVEQCGGM

SEQ ID NO: 171589 - protein, 156 aa, Triticum aestivum
  unsure (1)..(156): unsure at all Xaa locations
  Clone ID: PAT_TA_66007.pep
PAGRIVMELYKDAVPRTVENFRALCTGEKGVGKSGKPLHYKGSSFHRVIPDFMCQGGDFTKGNGTGGESIYGEKFADEKFVHKHTKPGILSMANXGPNTNGSQFFICTVPCNWLDGKHVVFGEVVEGMDVVKNIEXVGSXSGTLFKQVVIADCGQX

SEQ ID NO: 171590 - protein, 185 aa, Triticum aestivum
  unsure (1)..(185): unsure at all Xaa locations
  Clone ID: PAT_TA_66008.pep
QQLVPQPQQPLSQQPQQAFPQPQQTFPHQPQQQVPQPQQPQQPFFQPQQAFPQQPQQPFPQTQQPQQPFPQQPQQPFPXTXQPQQPFPQQPQQPFPQQPQQPFPRLNNHNNHFPSTTQPFPXTQQPQQPFPQFQQPHQPFHQPQQQFPQPXQPXQSFPQEQRXPVIQPFFTTNGWNPCKNIPFGN

SEQ ID NO: 171591 - protein, 187 aa, Triticum aestivum
  unsure (1)..(187): unsure at all Xaa locations
  Clone ID: PAT_TA_66009.pep
APPPRPLPPTATSCSRPNMTPPPXNPPPPPPPPLPTPASPSTPWPRLLPPPTRPGACRPRAGPPRRPSRSRAPTPRAASPSAAPTSPPPTGPPSPRPPPRPRPPGSXPPQGREAPPPPPLQAPPPLPHPGRHRSARRPXRRPPPAPTPRPRRRPPPRFPPLPPHPRRGSGPIPMKKGMPGRATCRSR

SEQ ID NO: 171592 - protein, 99 aa, Triticum aestivum
  Clone ID: PAT_TA_66010.pep
MLSARSQRKASVQPCLLFDPSPGCLQPTRLVVHVNGDGGSCSAYFGSGCRVYKLEISMEEEMLSRGKESLSIPISAQVISSSVADRCPHQSEIQSVTPG

SEQ ID NO: 171593 - protein, 75 aa, Triticum aestivum
  unsure (1)..(75): unsure at all Xaa locations
  Clone ID: PAT_TA_66011.pep
MHNEGGDMEDLYVPSKCSGTNRIITAKDHSFVHSNLGNGVDNGLYDGRFNXFVSYGFLSAHGDAVGFHYVLWPKY

SEQ ID NO: 171594 - protein, 220 aa, Triticum aestivum
  unsure (1)..(220): unsure at all Xaa locations
  Clone ID: PAT_TA_66012.pep
MKTFLMFALLAIAATSAIAQMETSRVPGLEKPWEQQPLPPQQQPPCSQQQQPFAQQQQPIIILEQXPFSQQQQPVLPQQQXGIILEQPPFSQRQQPVLPQQPPLSQQQQQQQQQQPPFSQQQQPVLPQQPPFSQQQQPPFSQEQQPSSQQPPFSQQHQQFPQQQIPVVQPSVVQXQLNPCKVXLPQQCSHVAMXQRFAXXQMWEQSIXHVMQQQCWQQLA

SEQ ID NO: 171595 - protein, 192 aa, Triticum aestivum
  Clone ID: PAT_TA_66013.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTCSKQVVIADLRSIPPRSPVVIRPRVFPCRVRRSK

SEQ ID NO: 171596 - protein, 254 aa, Triticum aestivum
  unsure (1)..(254): unsure at all Xaa locations
  Clone ID: PAT_TA_66014.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPXQPQQPFPQTQQPQQPFPQQPQQPFPQTQQPQQPFPQLQQPQQPFPXQQQLPQPQQPQQSFPQQQRPFIQPSLQQQLNPCKNILLQQWKPXXLXXFXWXIIWPQRDWQGRRXQWWQQLAQILXQVQXAAIXSXGISLLWRXRXEQQQQPGX

SEQ ID NO: 171597 - protein, 236 aa, Triticum aestivum
  Clone ID: PAT_TA_66015.pep
KKPRAAGDGQGGGEASGSVGGGLVDILPEALLVEVVGRVGLEAACSAAASCRALRGAAGAALSSVASLDLSAFTPTNAIANRILAGNGRLRSLAVNCSLLNDSAVAAIAKESLRELSLLKCSSFSPYLFVVIGERCTNLRSITLEMANLNGSEHFVICRKSIAHMFKGCDYLENLSLKFSLLASGSVDFDSLVPIMPSTIKVLLVMPGANWEAKENFPISAFLKTPFSDSLRLTGF

SEQ ID NO: 171598 - protein, 111 aa, Triticum aestivum
  Clone ID: PAT_TA_66016.pep
LQLKDHEFFWDSNMKKIFFAYDVPQIFKNDAVKQKFQESSSMPSLPWTTSWKPGVIPDELMKHMLIYRGEHGLAPYDAYNVEEFLRIISGMYSHENELRQKNPGLVLDGLS

SEQ ID NO: 171599 - protein, 204 aa, Triticum aestivum
  unsure (1)..(204): unsure at all Xaa locations
  Clone ID: PAT_TA_66017.pep
MAAALLAAAPSLLPPASWRRRPLLVAPPPALRRLRAPASAPPRRALAPVARAARGAAPARGGGEATEGLGQAPRDWGALPRRLVLFALLGSAALLGCRGAALAAAEDSIKASGFGLRVAAXLRSLGWPDDAVVFTLATLPGLELRXAIPAGYWMRLXPGRLTVLAVLXGNMVPGPFINLYLKETRNFPLAKEPLGANRIMDLLF

SEQ ID NO: 171600 - protein, 186 aa, Triticum aestivum
  unsure (1)..(186): unsure at all Xaa locations
  Clone ID: PAT_TA_66018.pep
WQTTTQARAFDLDSLWGGSPLLKSRVVSTLPWPCDGMLGRKHPALGTHVLSPLEGVLGLLNSVQKRSPSSPADIXLLLALRSPSSXAESLYLSVDCSPLSXAGSLLLLVSCLPPSPAESLLLQALCSSRSTPHLAHMYLLHLKGYLACLNSVQMRRPSSPTESLLRRITTRSGLPLLVDILSLCTL

SEQ ID NO: 171601 - protein, 179 aa, Triticum aestivum
  Clone ID: PAT_TA_66019.pep
PPEGEPLPAFIRIGGFDISFKHFSNGLKKRAHLNNEVMSLYIESFNIEQTYNSTKPRKFAFSPHVATKLCVDPSSFKTSSCIRDLTRVCEKNDIVKFDQLFFTIVQRDHWAVVVVNFMKTQFNVSDSRSLDPDYVSILEKPCCNLITNFKALVTEFNPWKQDFAHFKVQATSYPHSQHN

SEQ ID NO: 171602 - protein, 65 aa, Triticum aestivum
  Clone ID: PAT_TA_66020.pep
MASDGAITHRSVDVNGVRLHVAEAGPAGAPVALLLHGFLEVWFTWLDLMLALCAVVFCALSFDCI

SEQ ID NO: 171603 - protein, 115 aa, Triticum aestivum
  Clone ID: PAT_TA_66021.pep
PTPYSRFRRSKYAINKSNRTSSLVTSATRALNTTATTDGIDANRNHSWKSPHGGSYVGGGSQHAAAKATARARDGAAAGAPALTAARRSGREKRHIDIGLRGRAGVRRVREARVG

SEQ ID NO: 171604 - protein, 108 aa, Triticum aestivum
  Clone ID: PAT_TA_66022.pep
ICRQQQITQYSRVYLNAAGVGVIDRIISYSSVVMFLASYIFVLLIVFTFDQKVSYRILRNLFTSMVVIASACRTVNFKLSIEGCVHERRGMLLEIIAYCIWLLSNLKV

SEQ ID NO: 171605 - protein, 98 aa, Triticum aestivum
  Clone ID: PAT_TA_66023.pep
MEKEAPRAVPGEREYSGISAQRARIGDCGETEDDLISKLPDAVLCTIIYLLLTKDGGRTHALSHRRRRLWRFAPLNLEVIIWPTDDTIPTHSVCNIRR

SEQ ID NO: 171606 - protein, 204 aa, Triticum aestivum
  unsure (1)..(204): unsure at all Xaa locations
  Clone ID: PAT_TA_66024.pep
MKTFLILALLAIVATTATIAVRVPVPQLQPQNPSQQQPQEQVPLVQQQQFPGQQQPFPPQQPYPQPQPFPSQQPYLQLQPFPQPQLPYPQPQLPYPQPQPFRPQQPYPQPQPQYSQPQQPISQQQQQQQQQILQQILQQQLIPCRDVVLQQHNIAHGXSQVLQQSTYQVVQQLXVSKLWADPRASRXGQAXHNGGHAIILXNNN

SEQ ID NO: 171607 - protein, 117 aa, Triticum aestivum
  unsure (1)..(117): unsure at all Xaa locations
  Clone ID: PAT_TA_66025.pep
AQLKSIIFGKREVLIRLIHWTIGMQSHSIKGRRQATSLGTDLKTTTTPTKHXHPILXYSSDLFVGFSYYTRVGGCGDVDPEEASSICIENSRSLLDHLTVRSHTIEQHRICRTQIWF

SEQ ID NO: 171608 - protein, 178 aa, Triticum aestivum
  unsure (1)..(178): unsure at all Xaa locations
  Clone ID: PAT_TA_66026.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQPQPFRPQQPYPQPQPQYSQPQQPISQQQQQQQQQQQQQQQILQQILQQQLIPCRDVVLQQHNIAHGSLQVLQESXYQLGAQLCCQATG

SEQ ID NO: 171609 - protein, 210 aa, Triticum aestivum
  unsure (1)..(210): unsure at all Xaa locations
  Clone ID: PAT_TA_66027.pep
QQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQCCQQLAQIPQQLQCAAIHSVVHSIIMQQXQQQQQQQQGMHIFLPLSQQQQVGQGXSLVQGQGIIQPQQPXQLEAIRSLVVQTLPFMGT

SEQ ID NO: 171610 - protein, 185 aa, Triticum aestivum
  unsure (1)..(185): unsure at all Xaa locations
  Clone ID: PAT_TA_66028.pep
TNFQVLPFLPPVPPPPPILPPTSSSGLAAPEPGRMEYPRSPGAPYHAPPPPMSSLRPPTPSSAVHAVAAPTPSADAMKRKRQGNHLIQGGPADAAPPSFGPASVPXSRPPAGGRRPAPPAQPVHVRSPRGRMQSQQEVGLLLRLRATTSPFTTPPATPTMCSMKRPGAKGCLPHIPKCWPRVKGI

SEQ ID NO: 171611 - protein, 116 aa, Triticum aestivum
  Clone ID: PAT_TA_66029.pep
RAAPPRVDLATTDPAWLTPTSRTSLQKVCALISTFNESKCILVVEIGFGGMLRLPAIPRLNLKFSTWIMSMVDGPNRCIKLSHDRSIKFWPEDIHKVFGIPCGTIGIHRPEYQQAE

SEQ ID NO: 171612 - protein, 96 aa, Triticum aestivum
  unsure (1)..(96): unsure at all Xaa locations
  Clone ID: PAT_TA_66030.pep
PQNKMRLIRGSPSPGWPKRKNFFSPFQIHTSLVDPTPPSKSPCQSXSVPWGSNGGMWMGRXRGGAAGATDGGARRFWRLVARYDNMGENKXRAGAL

SEQ ID NO: 171613 - protein, 111 aa, Triticum aestivum
  unsure (1)..(111): unsure at all Xaa locations
  Clone ID: PAT_TA_66031.pep
TCTTTPGDATSTPTTCTSTPSRPDQQVPTPCTTTSSTXPSTTTSTTPRVPLPSTLEDSVDGKFLVVTPNIYENVSNYRGHVNNDFQYAGYDYFPRTTGNVNLQYGPGTFTK

SEQ ID NO: 171614 - protein, 274 aa, Triticum aestivum
  unsure (1)..(274): unsure at all Xaa locations
  Clone ID: PAT_TA_66032.pep
QLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQXSDCQVMRXQCXCQQLAQDSQQLPXAQAXHSXXHSIIMQQQEATTTQPGMHIFLAXSXQXTRXVKGXLVQXQGXIPTQQPSLIGRGINGGWKTLSHGATGFVPT

SEQ ID NO: 171615 - protein, 238 aa, Triticum aestivum
  unsure (1)..(238): unsure at all Xaa locations
  Clone ID: PAT_TA_66033.pep
QKPASPRGGELRLLDLTRRDAAAIINLLALLSSAHVLAILGYITVHSIALGTVFASVAGRHLPERRRGFFLSGAAMGARRLTGFAFLRWATRDAVVQMLCLWFFADVHDQAQLFRLFVVAKLMPFSASANPWLAAAISGPELDGFFIAXALLDAXVSXVVTGVPWVGAMDRDPRSPGRKAGKGGCYLWXLMATEAHLNKCWETRGWCSMGPAQYWLHLGGKVLGRGPSPQLQRGDFHG

SEQ ID NO: 171616 - protein, 219 aa, Triticum aestivum
  unsure (1)..(219): unsure at all Xaa locations
  Clone ID: PAT_TA_66034.pep
NQRHRPTSFRRADDLTPPQPTPPPSGAPPTSPQLDRPPIPRPPIILRRRPPDLRRRAPKLSFFLLLIFSSAQQRPKSYAHPRAXTGAWNPRCRRRSRIPARRHGAMDSRAPPHXPRSHTPPLRQRIPTRXXXLPNAPPLADSSALHQSQCWIHGGLLDLVPSSAWSPAGGPSPRQDAGHLGPVGASRRGFSIAPGGTSKYFYRFWGGTFLFLKEPKIFL

SEQ ID NO: 171617 - protein, 159 aa, Triticum aestivum
  unsure (1)..(159): unsure at all Xaa locations
  Clone ID: PAT_TA_66035.pep
PLHRRFYRPTPSSCSAAPVLLQIPNLHRRLPPPSSKQAKTPPPAPCTRRPLPPQRRTRPTATAPTPRPRRLPAPPWATRPTPRPTPATPAPPTTPRRRPPSPTATARPPSASPTPTRXRPXTSININKHSRSTTTTISTSLYLGFLSRSLPCLDRFFSL

SEQ ID NO: 171618 - protein, 87 aa, Triticum aestivum
  unsure (1)..(87): unsure at all Xaa locations
  Clone ID: PAT_TA_66036.pep
FLFSSPVPDFIKKGRPQFHTRFQSVFRDKKKEAKETWGSNCFCQAKVYPFFLPFSSIFCVNFXLNAASSETPPKITKVPKNNQSRKL

SEQ ID NO: 171619 - protein, 277 aa, Triticum aestivum
  unsure (1)..(277): unsure at all Xaa locations
  Clone ID: PAT_TA_66037.pep
QEQPPPQSQQPFSQQPQQIFPQPQQTFPHQPQQAFLQPQQTFPRRPQQQFPQPQQPQQPFPQPQQPQLPFPQQPQQPFPQPQQPQQPFPQSQQPQQPFPQPQQQFPQPQQPQQSFPQQQQXMIQSFLQQQMNPCKXNFLLQECTLGSLVSSLVSIILPRSDCQXMQQQCCQQLAQIPQQLQCAAIHNVAHSIIMXQEQQRXVQILRXLFQLAQGLGIXQPQQPXKWEGIKVLGIENSFQPCANVYVPXPDXSTXNGAYCQXXXPXIXXPWKNSKNFA

SEQ ID NO: 171620 - protein, 122 aa, Triticum aestivum
  Clone ID: PAT_TA_66038.pep
TGDTNCNAHVSEATVRCRVGRQVSAVGQDRRSLCTRSASAGVNLPPGSCMAAACEQQHAMTRFIHRKAQNHQDPEREAEDQRQITGRHRYRPMRRPRRNARCLFLPAPGHHAPPRRRVQRTT

SEQ ID NO: 171621 - protein, 227 aa, Triticum aestivum
  Clone ID: PAT_TA_66039.pep
MSMRDLVAGRAGCAAAGSSSSANPLTALADAVLGSSKSEQQIKELSGSAVRGKASFDSMPIPLSTLPGSEDEIKLGQGPIRSMKGTDFINGCHGDACGDNFQASIPSVPEHIVVEPHLGEPEQVDSATRLHFKPKFEGPPEMAAQAFLPQSSFEPYSIPGNGPEEYSGGKDGLLDHIDGLYDDEMRTSGNISTEIDRCLAAFEQGIHPRSMNDDQLAGDGWLPFLRI

SEQ ID NO: 171622 - protein, 207 aa, Triticum aestivum
  unsure (1)..(207): unsure at all Xaa locations
  Clone ID: PAT_TA_66040.pep
TYPHQPQQQFPQTQQPQQPFPQPQQTFPQQPQLPFPQQPQQPFPQPQQPQQQFPQSQQPQQPFPQPQQQFLQPQQPQQSFPQQQQPLIQAXLQQQMNPCKNFLLQQCNPVSLVSSLISMILPRSDCQVMQQQCCQQLAQIPQQXLQCAAIHSVVHSIIMQQEQRXGVQIRRXLFQLVQGQGIIQPQQPAQLXXSRALVLRTLPTMCN

SEQ ID NO: 171623 - protein, 224 aa, Triticum aestivum
  Clone ID: PAT_TA_66041.pep
MLAVAAGQATLGEPSSSAAAAAAVPKRRDPTPDHPPYSWMIEEAIQALGEDGGSAESAISGFIRGRYPGVPAAHDRFLRYYLAKHVAEGLFVCAAPGRYSCCSDDEPQPELALTDVLAACAAPAQSKRARGRSKKDSSLVVAKRGAVGLRGKDSKPPAGPVSAWPSDYRGQTRPRSGLPRMVRRPIPVSGSKIVIGSSLRVAQNPGTALSLSTKERPASPPPGN

SEQ ID NO: 171624 - protein, 260 aa, Triticum aestivum
  unsure (1)..(260): unsure at all Xaa locations
  Clone ID: PAT_TA_66042.pep
MKTFLILALLAIVATTATTAVRVPVPQLQPQNPSQQQPQEQVPLVQQQQFLGQQQPFPPQQPYPQPQPFPSQQPYLQLQPFLQPQLPYSQPQPFRPQQPYPQPQPQYSQAQQPISQQQQQQQQQQQQQQQQQQQQILQQILQQQLIPCMDVVLQQHNIAHGRSQVLQQSTYQXLLQELXCQHLMARSLEQXSKCQAIHNGGHAIILHQPTKNHQPXTIWRPGLSNKPNNNIPRGFLFRAFLKKPTGPRGFCPLKKPQYRR

SEQ ID NO: 171625 - protein, 224 aa, Triticum aestivum
  unsure (1)..(224): unsure at all Xaa locations
  Clone ID: PAT_TA_66043.pep
QQPYLQLQPFPQPQLSYPQPQPFRPQQPYPQPQPQYSQPQQPISQQQQQQQQQQQQQQQILQQILQQQLIPCRDVVLQQHNIAHGSSQVLQESTYQAGAQLCCQQLWQIPEQSRCQAIHNVVHAIILHQQHHHHQQQQQQQQQQPLSQVSFQQPQQQYPSXQGFFQPSQQNPQAQGSFQXQQLAQXEAIRNLALQTLXAMXNGDIPXXXTIASFGIFGTNWRRE

SEQ ID NO: 171626 - protein, 171 aa, Triticum aestivum
  Clone ID: PAT_TA_66044.pep
KQEETSVAQKGSILGTMNFRRCEIGDTASRSRNLGSTIASRISQLESASRPVKDVHPKVNKQRRTSKGFCKGIPEAASTATQQPEQRSPYVSVTRVKEMLFGSTSPPTHPETNIAKENMGKANDEPELKEIHQSVRFKARSLPNFYWRSKESKDSRGHERPTKIRRTAIID

SEQ ID NO: 171627 - protein, 164 aa, Triticum aestivum
  Clone ID: PAT_TA_66045.pep
ICINPHRLLLRRRTASTGPMSHRPCRRRGGEADEREGEQSKGTVKSLPKASSAVPATPAVKADVTAAEAKDSIVRIAEMVPPQGSARSSALPDSGLFEKHGGDCGDMEGRDGMGRRCRWRQRRRRLGHGEHGASGRRRRCASSVVIRHWPHGLFWAVHLCHLFF

SEQ ID NO: 171628 - protein, 214 aa, Triticum aestivum
  Clone ID: PAT_TA_66046.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCCQQLFQIPEQSRCQAIHNVVHAIILHHHQQQQQQPSSQVSYQQP

SEQ ID NO: 171629 - protein, 173 aa, Triticum aestivum
  Clone ID: PAT_TA_66047.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPQLPFPQQPQQPFPQPQQPQQPFPQLQQPQQPLPQPQQP

SEQ ID NO: 171630 - protein, 230 aa, Triticum aestivum
  Clone ID: PAT_TA_66048.pep
MKTLLILTILAMATTIATANMQVDPSGQVQWPQQQPFPQPQQPFCQQPQRTIPQPHQTFHHQPQQTFPQPQQTYPHQPQQQFPQTQQPQQPFPQPQQTFPQQPQLPFPQQRQQPFPQPQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIM

SEQ ID NO: 171631 - protein, 157 aa, Triticum aestivum
  unsure (1)..(157): unsure at all Xaa locations
  Clone ID: PAT_TA_66049.pep
LVVPSVGVEERRWRXWVVVEEAPTSIGVLKQSPAGRRARRSGRGMASPSSRLLHIIPLSIWSPSHHPSLYLLRVQEDLDGVDRWGRGGASSFRCGFVVVAGEHGGEHQRGLLGGDLQPLREHSASACYCCSPPRKSKSARAARRGKVWRGGGARGRR

SEQ ID NO: 171632 - protein, 160 aa, Triticum aestivum
  Clone ID: PAT_TA_66050.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQP

SEQ ID NO: 171633 - protein, 75 aa, Triticum aestivum
  Clone ID: PAT_TA_66051.pep
MKTLLILTILAMAITISTANMQVDPSGQVQWPQQQLVPQPQQPLSQQPQQAFPQPQQTFPHQPQQQVPQAQQPQQ

SEQ ID NO: 171634 - protein, 190 aa, Triticum aestivum
  Clone ID: PAT_TA_66052.pep
TVAGVRQNVENLLNYSLNEKKRNFNETIELQIGLKNYDPQRDKRFSGTIKLPTVPRPNMGICVLGDQHDLDRAKHHGIDAMSVEDLKKLNKNKKLIKKLARKYDAFLASEALIKQIPRLLGPGLSKAGKFPTPISHAEDMAAKVTDVKSTIKFQLKKVLCLGVAVGHVSMEKEAIVANLMLAINYLVSLL

SEQ ID NO: 171635 - protein, 138 aa, Triticum aestivum
  Clone ID: PAT_TA_66053.pep
MKTFLIFALLAVAATSAIAQMENSHIPGLEKPSQQQPLPLQQTLSHQQQQQPVQQQQQQQPSSQVSYQQPQQQYPSGQGFFQPSQQNPQAQGFVQPQQLPQFQEIRNLALQTLPAMCNVYIPPYCSTTIAPFGIMSTN

SEQ ID NO: 171636 - protein, 118 aa, Triticum aestivum
  unsure (1)..(118): unsure at all Xaa locations
  Clone ID: PAT_TA_66054.pep
SVADTPPPTAATSPHLPSRGTXEKDLATHVLPSSSSSRSFSGCAAAARELLHRPLPPHLPARPPLADQGELRRRQARRAAVCCTRLLDAARDRVCSVQLEMHVCPPFHWSIVLTKWAQ

SEQ ID NO: 171637 - protein, 37 aa, Triticum aestivum
  Clone ID: PAT_TA_66055.pep
IAFDYHTTSFIPIFFIALVRIPGKLQAHVMFHKHMHW

SEQ ID NO: 171638 - protein, 76 aa, Triticum aestivum
  Clone ID: PAT_TA_66056.pep
SISNSSFTDSNLSIAVCFTKFRWKVANIEIIKHCKHQATTNESKEGMHSKTISPHKSIAKMEVTENIEEQKMDQVF

SEQ ID NO: 171639 - protein, 74 aa, Triticum aestivum
  Clone ID: PAT_TA_66057.pep
KTYMIHLSLKRNNHIWTSTSKCLFVQCLKEPLATERYTYWFQSFILRVLNELTGKKSWFQSSLCQWLAESGLLF

SEQ ID NO: 171640 - protein, 63 aa, Triticum aestivum
  Clone ID: PAT_TA_66058.pep
PLQPHSGAISTGASPRSPHIEAAGSPLHARTPSWQCHLGAAAPWLIQRRRHRCCWRSTCSHLP

SEQ ID NO: 171641 - protein, 171 aa, Triticum aestivum
  unsure (1)..(171): unsure at all Xaa locations
  Clone ID: PAT_TA_66059.pep
ILAMAITIATAXMQADPSGQVQWXPQQQPFLQPHQPFSQQPQQIFPQPQQTFPHQPQQQFPQPQQPQQQFLQPRQPFPQQPQQPYSQQPQQPVPQNXQPQQPFSQFQPPQQPFXPNPQQRNHYFPQHQPSWIKQSLQHQWNPCKNFLWQQCKPVSWGXSLWSIILPPTNGQ

SEQ ID NO: 171642 - protein, 46 aa, Triticum aestivum
  Clone ID: PAT_TA_66060.pep
AGGISPHRLNKPRMTNTEVLIIKKLHHKLLPDPGGGGSKVGADKSG

SEQ ID NO: 171643 - protein, 81 aa, Triticum aestivum
  unsure (1)..(81): unsure at all Xaa locations
  Clone ID: PAT_TA_66061.pep
MSCCGGNCGCGAGCKCGNGCGGCKMFPDVEATAGSXFMVMPTAWPKGSSGGFXTAGGDTGGCDCTTCKCGTACGCSCCSCN

SEQ ID NO: 171644 - protein, 134 aa, Triticum aestivum
  unsure (1)..(134): unsure at all Xaa locations
  Clone ID: PAT_TA_66062.pep
EWPANLGRGHINDANMSGXISQLNLTSHLNXMRQMLLTQIQGATASEQMMGRNNVEFPGQFAGQVFDSLHXHRQSINPPAPEXHLLRVQFELEHTATPTASQEQHXRSFSKTSPEQLQQEQHQSSCTAPSPLLQ

SEQ ID NO: 171645 - protein, 46 aa, Triticum aestivum
  Clone ID: PAT_TA_66063.pep
WLWWDYVHDFAIRCPMKEKKYTTDCAHGVIKSLGMDIDKITQCVGD

SEQ ID NO: 171646 - protein, 160 aa, Triticum aestivum
  Clone ID: PAT_TA_66064.pep
QQQQQQQILQQILQQQLIPCMDVVLQQHNIAHGRSQVLQQSTYQLLQELCCQHLWQIPEQSQCQAIHNVVHAIILHQQQKPQQQPSSQVSFQQPLQQYPLGQGSFRPSQQNPQARGSVQPQQLPQFEEIRNLALQTLPAMCNVYIPPYCTIAPFGIFGTN

SEQ ID NO: 171647 - protein, 107 aa, Triticum aestivum
  unsure (1)..(107): unsure at all Xaa locations
  Clone ID: PAT_TA_66065.pep
HEGVGRNRSLLGAAEALAARRVREMEAETFKAARRGVELEERLARLRAEAASWQAKAMSEEATAAALHAQLXHAAATAQARSGKAALDDDGAADDAESGFINPDRVV

SEQ ID NO: 171648 - protein, 156 aa, Triticum aestivum
  Clone ID: PAT_TA_66066.pep
RHGSSKTLVLGLLLVVTVANVGAASVVVGLAKCAGCTRKDMKAEETFKRLRVAIKCRNADGEYESKAVGGLDRRGAFSVPLAADLQGADCVAQLHSAASNAPCPGQEPSKIVPLSEGATTFGVVAGAKTTATQSVASPECASAFCPSTTQKKPRGG

SEQ ID NO: 171649 - protein, 43 aa, Triticum aestivum
  Clone ID: PAT_TA_66067.pep
KPPTDVTAMLEKSGKYSKFVQLLKETRVETQINAQLTDSYNGL

SEQ ID NO: 171650 - protein, 30 aa, Triticum aestivum
  Clone ID: PAT_TA_66068.pep
KWLLGCHEVNTKKFSNVNFRLEMQSKITKK

SEQ ID NO: 171651 - protein, 61 aa, Triticum aestivum
  unsure (1)..(61): unsure at all Xaa locations
  Clone ID: PAT_TA_66069.pep
SLGTGPQPAARSCRQRDVHAAPRERAHPHLESVDSPNIHAARAHSANIPLTKSXKNRSGRT

SEQ ID NO: 171652 - protein, 39 aa, Triticum aestivum
  Clone ID: PAT_TA_66070.pep
IIFSTRCSSSRSAANRRPVSSICFWRFVFHGSGHTSCFS

SEQ ID NO: 171653 - protein, 145 aa, Triticum aestivum
  Clone ID: PAT_TA_66071.pep
IADLWSPLGISNVQFPFPHWKRWAEMNTRFSIDVRNFLKGEALISDLATRLCGSGDLFSNRGPAFSFNYVSRNSGLTLVDLVSFSNGDLASESSWNCGEEGPSEDSVVLQKRLRQIRNFIFILFVSLGIPILNMGDECGHSSAGS

SEQ ID NO: 171654 - protein, 152 aa, Triticum aestivum
  Clone ID: PAT_TA_66072.pep
MKTLFILTILAMATTIATANMQVDPSGQVQWPQQQPFRQPQQPFYQQPQHTFPQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPLF

SEQ ID NO: 171655 - protein, 77 aa, Triticum aestivum
  unsure (1)..(77): unsure at all Xaa locations
  Clone ID: PAT_TA_66073.pep
STACKSSSSTSTTPTHSTPSSHLISCLTVLLLLIIQCFHFTRFELCNTPCENGMEGXLNLGSIFHFLXTSVNYTDMS

SEQ ID NO: 171656 - protein, 55 aa, Triticum aestivum
  Clone ID: PAT_TA_66074.pep
RVTMLIACHHSSQLISFLASHHASLIHTEYIQKGVHPQDSFDWSMCLHSTLNCID

SEQ ID NO: 171657 - protein, 68 aa, Triticum aestivum
  Clone ID: PAT_TA_66075.pep
LGSTAASAAMVNVPKTKKTYCKNKECKKHTLHKVTQYKKGKDSLSAQGNLFYDRKQSGYGGQTKPVFH

SEQ ID NO: 171658 - protein, 103 aa, Triticum aestivum
  Clone ID: PAT_TA_66076.pep
IVLLPVWGAGHFMPMLQAGKQLLASSSRPLSLTVLLMPAPTAQSASDISDHIRREEGAGAVDIRFHHLPDVKLPTDHSGVEEFISRAVQLHVPHLRAAIIGLT

SEQ ID NO: 171659 - protein, 95 aa, Triticum aestivum
  Clone ID: PAT_TA_66077.pep
PNPRSPLPSSAPLPYKSHRRPRWLWWQRASSPAVTPAPRCRATPPPPAASRRRCRPLLPSARPWRRAPGDPWRRRAPRPPSSRPRTAWRSATSPP

SEQ ID NO: 171660 - protein, 133 aa, Triticum aestivum
  Clone ID: PAT_TA_66078.pep
TPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAK

SEQ ID NO: 171661 - protein, 54 aa, Triticum aestivum
  unsure (1)..(54): unsure at all Xaa locations
  Clone ID: PAT_TA_66079.pep
LERPGVNRSSFXKGVMKKKKIRHMTNDFTTYSHVITIMKELYADISLLKKFSLQ

SEQ ID NO: 171662 - protein, 104 aa, Triticum aestivum
  Clone ID: PAT_TA_66080.pep
SAAVGIRYSPRLAGSTPGSMALRDCQAGKVRQLVQFDAFQLLDNGFVPCVVSMYLLKHLLCSSIWRKKPGAAYQAGESHRMPILELAVRLNVRDKDIATSFEYA

SEQ ID NO: 171663 - protein, 108 aa, Triticum aestivum
  Clone ID: PAT_TA_66081.pep
MADTVGHCAPGGCASAAGSGPEHAALERHVLAALNELMMLMKQGEPMWQPAALGGEVLDHQLYRATTVPGLLELPPPGFTANGTRDTGMVMCTGTDLVRIFMDENCWL

SEQ ID NO: 171664 - protein, 62 aa, Triticum aestivum
  unsure (1)..(62): unsure at all Xaa locations
  Clone ID: PAT_TA_66082.pep
YQRLNYFNXPWLTRITLVLVAFWWGIGEVLRLTFVNGEGRFTSDXMWQANVCKFYIIFFLGF

SEQ ID NO: 171665 - protein, 105 aa, Triticum aestivum
  Clone ID: PAT_TA_66083.pep
IHNVVHAIILHQQQQQQQQQQQQGQHQPSSQVSYQQPQQQYPSGQGSFQPSQQNPQAQGFVQPQHLPQLEEISNLALQTLPAMCNVYIPPYCSTTIAPFGIFGTN

SEQ ID NO: 171666 - protein, 142 aa, Triticum aestivum
  Clone ID: PAT_TA_66084.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVR

SEQ ID NO: 171667 - protein, 163 aa, Triticum aestivum
  Clone ID: PAT_TA_66085.pep
IIPICFSHLSVVSSSHRPPRSTLAPNQSPLRHHLSSAPIASACPRPDPACPTTLVIGSAVQHLAFPAGSRQHRRPHPCPEETRTRTIELTALSSLESMAASPRQPTNATCSALLHKRCAARGCGRRGVGGAGRRRKGGGGVERWCGKEWEEGVMASSNSDRQE

SEQ ID NO: 171668 - protein, 122 aa, Triticum aestivum
  unsure (1)..(122): unsure at all Xaa locations
  Clone ID: PAT_TA_66086.pep
LPALLFLWLMSKSAAPKQRLIISSSMFVCLREFHFTCWSNGEGLMFEAGAMPRLEKLWVPFDAGSGLDFGIQHLSSLRHLAVEIICIGATARDVEALEEAIXDAAHLLPNRPAVEFRTWDDE

SEQ ID NO: 171669 - protein, 91 aa, Triticum aestivum
  Clone ID: PAT_TA_66087.pep
PTIPRQWRRFQTAVSQPRPRPEHPRVGSRHSAAGSCGLQGTRGGLSPGSRNSRGILASPTTDGGLMFKRDGLHVLKRAHLAAIFGSGDSAS

SEQ ID NO: 171670 - protein, 121 aa, Triticum aestivum
  Clone ID: PAT_TA_66088.pep
KLLPEFDEEAVEPPQSKSRETTRSDRRPHGKHKTANGAARKPTRDPHTDSHQRDGPVRSIYGPRKKALVSNATHQVSKCYGTPKYTGAAHPLCFTDEVLDYEFPAGFKPVSIEAYDGTTDP

SEQ ID NO: 171671 - protein, 96 aa, Triticum aestivum
  Clone ID: PAT_TA_66089.pep
WEMRRIKSDFELLFNLVQHYRQRTITCTLESSNFSYKVCVHCLMLTYLFNFCIYVRVLNSLLPGNKLNLNYENFKFWRKMYDYYQIFYFKKTLELV

SEQ ID NO: 171672 - protein, 118 aa, Triticum aestivum
  Clone ID: PAT_TA_66090.pep
CAARIRWRLRPQSKRRLLNDITFLCTGLRPVILMDYGGTMPQLQENLCSLLHHAFLEASILNPLRVMVMKDMLYLIHAEGLAEHVSPNARSQHQLAFVDLEKSCCELLANTEKNETMV

SEQ ID NO: 171673 - protein, 198 aa, Triticum aestivum
  Clone ID: PAT_TA_66091.pep
SDSTFKLYDEMIRGGLSPDLFTYSTLLSGCMKLKHGYAKAMELINELNSRGLQMDSVIYGTLLAICASHNYCEEAEAYFKKLKDEGHNPNLFHYSSLLNAYSVNSYYEKAELLMKDLRSSGLTPNKVILTTLLKVYSKGGLFEKAKELLTELEASGFAQDEMAYCILIDALAKGGKIWEATMVFNEMKEKGVKSDGYA

SEQ ID NO: 171674 - protein, 201 aa, Triticum aestivum
  unsure (1)..(201): unsure at all Xaa locations
  Clone ID: PAT_TA_66092.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIXTWVIQTIPAMCDVHVPPYCYTTISPSSDVTTDMGGY

SEQ ID NO: 171675 - protein, 193 aa, Triticum aestivum
  Clone ID: PAT_TA_66093.pep
FLVFALLAVVATSAIAQMETSCIPGLERPWQQQPLQQKETFPQQPPSSQQQQPFPQQPPFLQQQPSFSQQPLFSQKQQPVLPQQPAFSQQQQTVLPQQPAFSQQQHQQLLQQQIPIVHPSILQQLNPCKVFLQQQCSPVAMPQHLARSQMWQQSSCNVMQQQCCQQLPRIPEQSRYEAIRAIIFSIILQEQQQ

SEQ ID NO: 171676 - protein, 89 aa, Triticum aestivum
  unsure (1)..(89): unsure at all Xaa locations
  Clone ID: PAT_TA_66094.pep
IVESRAPAEQRLDGDTNGSXTQSTGALLFVRREILRNVVHEPHLLHCHLALSLLLGGLVEFGIILEAAAEVVGYKDDAGRHHSHQRHQP

SEQ ID NO: 171677 - protein, 104 aa, Triticum aestivum
  Clone ID: PAT_TA_66095.pep
TSVLNAVIMPARAQIPLPHELPLDAPPPTLRPRLRPCPRPLPSPLLPRRKEKRRDAGISNHQIEWRPDPSATVAQGSRASDDAAVPVCQGPSRRCFCSAMAMEL

SEQ ID NO: 171678 - protein, 211 aa, Triticum aestivum
  Clone ID: PAT_TA_66096.pep
MKTFLILALLAIVATTTTTAVRVPVPQLQPQNPSQQQPQEQVPLVQQQQFLGQQQQHFPGQQQPFPPQQPYPQPQPFLPQLPYPQPQPFPPQQSYPQPQPQYPQPQQPISQQQAQLQQQQQQQQQQQQQQQQQPSSQVSYQQPQQQYPSGQGSFQPSQQNPQAQGFVQPQQLPQFEEIRNLALQTLPAMCNVYIPPYCSTTIAPFGIMSTN

SEQ ID NO: 171679 - protein, 51 aa, Triticum aestivum
  Clone ID: PAT_TA_66097.pep
YYYTSHICSLVPQLPSTPSSRNSRGHGGREAHHRPRDGLLAVQQGGDEVGG

SEQ ID NO: 171680 - protein, 129 aa, Triticum aestivum
  Clone ID: PAT_TA_66098.pep
GDRVALHVLLDHLPPNSSAPLLAASHEILTAVDAFPWPHGEKRIHYRVANAGLQAQWIEAWWPGSDDEFAFVVEDDLEVSPLYYRFLKRVVMRYYYDRENYSPYVFGASLQRPRFVAGKHGNKIQLDSE

SEQ ID NO: 171681 - protein, 177 aa, Triticum aestivum
  Clone ID: PAT_TA_66099.pep
RPVQRRAVRGDDKPSIQEGHGDFSPPRPRPLPPPSLQVPTQQHRRVKSVDKASKQEGDAHFTPQPPRPLPPPPPLEPVRSAKTEEDNKSKSKEDEKRSPTPQAAPKHRKATSCDNSNGNGFCGGSGRLDGSVAVVKQSEDPLGDFRRSMLNMIVENGIVTGDELRELLRRFLALNAP

SEQ ID NO: 171682 - protein, 53 aa, Triticum aestivum
  Clone ID: PAT_TA_66100.pep
GTDVPLLEGHSSGRDEAVGFIQAWRIPGVAPFALCLFFCKLVAYTFLCWLPFF

SEQ ID NO: 171683 - protein, 49 aa, Triticum aestivum
  Clone ID: PAT_TA_66101.pep
VEQNGLGDEHPELQVVAVGARPELLHLVERHRRPLPGLVADGGASERVS

SEQ ID NO: 171684 - protein, 71 aa, Triticum aestivum
  Clone ID: PAT_TA_66102.pep
ARDMEVGGYAAACCSDDDAEGVDERPCADQWDVIPDLLVGLARRQPMRRFAVHGDPSVTSRAGRMQGSFSS

SEQ ID NO: 171685 - protein, 54 aa, Triticum aestivum
  Clone ID: PAT_TA_66103.pep
RGSRRASERGSSCRRRRGGRALRGSRRREEVGKQSCPGGGAVMWRKCADGKRKA

SEQ ID NO: 171686 - protein, 80 aa, Triticum aestivum
  Clone ID: PAT_TA_66104.pep
LSFPVPFPPLPSPEQFRTDTLTLPKALTARPLRRHEVQGQRRHRVQGLRQEQDGHRRRRQAEARPHGGASPSWLSSGHST

SEQ ID NO: 171687 - protein, 64 aa, Triticum aestivum
  Clone ID: PAT_TA_66105.pep
TRPPQSPVATAAAAASTSPGEQIGGGAEPRPALSSGAGPDPTPASAREAREQPENSPQFPARPT

SEQ ID NO: 171688 - protein, 72 aa, Triticum aestivum
  Clone ID: PAT_TA_66106.pep
CCPSINKPKTAETLSEFRIHVQGVSNNVIQMDDHLVIDGRLNELSTHWTLTMQQVSSSSCFWMSGSDTCQSV

SEQ ID NO: 171689 - protein, 73 aa, Triticum aestivum
  Clone ID: PAT_TA_66107.pep
LFDSFGGGVKKEKGKPAWVAWKSMTQPKFMGGAFKILNFLTTPISKEHEEFLLGHHETDFLKLLFNYTYFKRT

SEQ ID NO: 171690 - protein, 177 aa, Triticum aestivum
  unsure (1)..(177): unsure at all Xaa locations
  Clone ID: PAT_TA_66108.pep
AAVAAAAAATAGSGGKDDRAARTDMAMASAATLVAAQCVEAAESMGAEREHLAAAVGSAVNARTPGDIVTITAAAATALRGAATLRARVXKEAWNVAAVIPVEKGSMGMGGHGHGHKHGATQRQLQQQQPHHKVQEMGSSNSSSFSDDLPAVDQDENNFLGICCQDLLARGIELLKR

SEQ ID NO: 171691 - protein, 124 aa, Triticum aestivum
  Clone ID: PAT_TA_66109.pep
SWCLPDPEHRVSRGPASFWLASHLIFFLRFVFRPQKYQSEKPQERNRGREISIECSWCPWLLLVTCQSWIVAVRRSTTKPHVALPILDRDPRTWVRTQEARPMGMSRPSGICAPRAKIRICWRC

SEQ ID NO: 171692 - protein, 161 aa, Triticum aestivum
  unsure (1)..(161): unsure at all Xaa locations
  Clone ID: PAT_TA_66110.pep
MKGAKSXGAAKADAKLAVKSKGAEKPAAKGKKGKAGKDPNKPKRAPSAFFVFMGEFREEFKQKNPKNKSVAAVGKAAGERWKSLSKSEKAPYVAKANKLKGEYNKAIAAYNKGESAAAAAPKKAAAKEVEEEDEEESDKSKSEINDDDDDEGSDEDEDDDE

SEQ ID NO: 171693 - protein, 60 aa, Triticum aestivum
  Clone ID: PAT_TA_66111.pep
MFCLAYSSHGLILSYGSFLARRLTSCVLFIENCPMWYTYPVSMCIYFFLCVSSAFGELAF

SEQ ID NO: 171694 - protein, 133 aa, Triticum aestivum
  Clone ID: PAT_TA_66112.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAK

SEQ ID NO: 171695 - protein, 83 aa, Triticum aestivum
  Clone ID: PAT_TA_66113.pep
MRECISIHIGQAGIQVGNACWELYCLEHGIQPDGQMPGDKTVGGGDDAGNTFFSETGAGKHVPRAVFVDLEPTAIDEVRTGTY

SEQ ID NO: 171696 - protein, 55 aa, Triticum aestivum
  Clone ID: PAT_TA_66114.pep
HQVSEADAASNPTPSISIRPGLSSVAFSNGIRQHYKFSARAPPRPTTESCSRTTA

SEQ ID NO: 171697 - protein, 105 aa, Triticum aestivum
  unsure (1)..(105): unsure at all Xaa locations
  Clone ID: PAT_TA_66115.pep
PATSGTQPRPLPPPLQPHPPPPPATXPPPPPLTPRDAAPXQPRPPPPRQPLMPPPPIPEARCGGGHRQAGRRQLPLRPSATQRLQHIAAPFMKLTCIPASSLDPC

SEQ ID NO: 171698 - protein, 172 aa, Triticum aestivum
  Clone ID: PAT_TA_66116.pep
MAPARAAKRPKLEPSTSAAGAPHQRGDDDYVPGNIVEIELCNFMTYDRLVCRPGPRLNLVVGPNGSCKSSLVCAIALALAADPAILCRAASVRAFVKRGEESGHVRLSLRSQDQGRDIGITRKIDTNNKSEWLLDGATVPKKDIIDVINKFNIQINNLTQFLPQDRVCEFAK

SEQ ID NO: 171699 - protein, 75 aa, Triticum aestivum
  Clone ID: PAT_TA_66117.pep
LPKPSHRRLPRSAHLRKRASSPHLSPSPGRRTSRAQRRCSGPQGDPSAPAPQPAATPPPSRSPETPPPPPPPPPP

SEQ ID NO: 171700 - protein, 154 aa, Triticum aestivum
  Clone ID: PAT_TA_66118.pep
MSHDGDEGDGEDEDDDEDDDDEEDDEDEDDDSTPDASPRAEVKAEGDGSAGLAQCASQQPVEPDPFLEGHDSGTEEEQAAFMSELERFHREHSLEFKPPKFYGKGLNCLKLWRQVAHLGGHEQVTVCKLWRQVGETFRPPKTCTTVSWSFRIFY

SEQ ID NO: 171701 - protein, 86 aa, Triticum aestivum
  Clone ID: PAT_TA_66119.pep
RGYSVSRSLNIIQSDSPSYRPNYFLPIHEAHYLNSLPNTICPLAGPCVTTCKEIKYGVWVKLYIKKIGSKHVDKVIYEAYRMKACG

SEQ ID NO: 171702 - protein, 51 aa, Triticum aestivum
  Clone ID: PAT_TA_66120.pep
IYVITVDTMSYMTHGDCTYTIRAIYMYIYIRVSVQICNDSSIKLCSQSQSC

SEQ ID NO: 171703 - protein, 137 aa, Triticum aestivum
  Clone ID: PAT_TA_66121.pep
TVGTTLKHWERRCRGRSLAPASPRCLPPIVQYRAHLTASASALGKHIRRASQILRSLAGAGAASDESAPLAAAAPSAALARTLERISRGHHHFFCWIRPSGNGDRGDETLAAAEQEEKLGAGGSFRCSMREGRCLRQ

SEQ ID NO: 171704 - protein, 165 aa, Triticum aestivum
  Clone ID: PAT_TA_66122.pep
THGNLPSAAAAEDAADALLGHARLAARLVPHRFFITSSILDLTIGGVDSAENDSTLQAQQPHYLKTCCKPSLDHGSVVYLLGHTGKKELVIGDGKVVIGTDNLIKLSTDGVTWCPGSAGFDAQGNLAFMICDPMKLASSPTARSSSASSSSSHSSKKDQQMQFGI

SEQ ID NO: 171705 - protein, 102 aa, Triticum aestivum
  Clone ID: PAT_TA_66123.pep
MIHATKGRSKQALRDTRAVEPVTPKFNPWSACLITFDRRDNLTSIRHGGLAALVLDPIINGYHLTRVLMDGGSSLNLIYQDTVRKMGIDPTRISHSNTTLRE

SEQ ID NO: 171706 - protein, 138 aa, Triticum aestivum
  Clone ID: PAT_TA_66124.pep
VEEEPAAEKAEKAPAGKKPKAEKRLPAAGKTSAKDGDKKAKKKSKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 171707 - protein, 141 aa, Triticum aestivum
  Clone ID: PAT_TA_66125.pep
QAGPSDPLPSSSLPPVSHFLCARTRIHHWSAGPLSQKRKAPEPGELRRSGRVAGLPEQPNYLKGDYRGVYEACAASKTPTDEERAGAVAKAEELQRRIHRIRWPAFVKPMSHECATRSILMVKYCSKKACIGCDVKQCGSW

SEQ ID NO: 171708 - protein, 79 aa, Triticum aestivum
  Clone ID: PAT_TA_66126.pep
MSAPASFKFNVHAPEFVPMSPTATPMSAPAGGYYSPFLQMQPAPDWSFLHDHEPVGLMPDFAHAKFAAAAGAASNSAQA

SEQ ID NO: 171709 - protein, 148 aa, Triticum aestivum
  Clone ID: PAT_TA_66127.pep
HFTDTVTRTPCNGACRKLIGARFFNAGVQVPDFLDQPVEGKQLNQTDLNSPRDYDGHGSHTLSTAGGGFVQGAGAFGRGSGTAKGGSPRARVASYKACYTAGCSSLDILAAIFAAVEDGVHVLSLSVGAPAADYAADLMAIGTLYAVH

SEQ ID NO: 171710 - protein, 160 aa, Triticum aestivum
  unsure (1)..(160): unsure at all Xaa locations
  Clone ID: PAT_TA_66128.pep
PGWYVRASLAQSAGLRTVVFLPCKGGVLELGSAVAMRENPEVLRAIQSVFHVEAVAPDDRMRIFGKDVSRSRGIXPVQTTGSDASWALRLGGQAKQEAAAAKPKPQQEPPKTISFSNAVGAQXQAGGEDRRPRKRGRKPANGREEPLNHVEAERQRREKL

SEQ ID NO: 171711 - protein, 116 aa, Triticum aestivum
  unsure (1)..(116): unsure at all Xaa locations
  Clone ID: PAT_TA_66129.pep
MGDAEADQSNEPVSDLQMEPVRRCRRRAHTADKAAAVQRKAXCRLRLSARVPPWDAVVLTAASPEQLALYARQLTRARRLGRFPPSTAALAVPNPDGARICSGTATLHAVASLSRH

SEQ ID NO: 171712 - protein, 94 aa, Triticum aestivum
  unsure (1)..(94): unsure at all Xaa locations
  Clone ID: PAT_TA_66130.pep
GAPFMLNAYPFXSHVGDPANVPLAYALGASDEPVVRDGALAYSGLFDATVDAVVAALEREGFAGVPVAVTETGWPTAGHPAATPENAAAYNGRM

SEQ ID NO: 171713 - protein, 78 aa, Triticum aestivum
  Clone ID: PAT_TA_66131.pep
QLLLNYNPCPQPFLPLIHGAMALASLLEAIPSLLHSLVLRSLSALACGTYHTQTTLKVACTNVHFRANKGFVKSFGDF

SEQ ID NO: 171714 - protein, 128 aa, Triticum aestivum
  unsure (1)..(128): unsure at all Xaa locations
  Clone ID: PAT_TA_66132.pep
GLQQALYWHIEARVVLDLREVPDAVDGRELHFSMVDGDFKKFEGKWSVRAGPRSASAILLYEVNVIPRFNFPAIFLERIIRXSKPLNLRSATVENDVIPSSKFKEAPASSGFGGVLASPPPELNGKWG

SEQ ID NO: 171715 - protein, 103 aa, Triticum aestivum
  Clone ID: PAT_TA_66133.pep
SATSLNPGKYSVECPRNGKDRNFASLFFNVQIQVVCHMIFLMSASSNLLNSVCFDSRQVKYWRFFIWLDKYLDMVEEVWMINVLIMGNGAARSLSQEMQRRSN

SEQ ID NO: 171716 - protein, 114 aa, Triticum aestivum
  Clone ID: PAT_TA_66134.pep
PSLSPSVSHLRPRRLRALVVAASASPSARSLRLLEWGKVCRAVASFAGTAHGREATEKQLWGVESVSYERSRKLLRETEAAVRLLGSSGGALDFSGLDTVAVESAINCVSGGSV

SEQ ID NO: 171717 - protein, 116 aa, Triticum aestivum
  Clone ID: PAT_TA_66135.pep
AQKRNVVDTRSNRIFSEKSEYGLSIQIERGTHQHQKRLSGSRGGSSPEKKGGRDQEGRARWKGACRRVRRRGRADGQAGEPTGRAGRGGLPAGEVPGGRRSVSGVGEEGQERQAEG

SEQ ID NO: 171718 - protein, 57 aa, Triticum aestivum
  Clone ID: PAT_TA_66136.pep
MLPAAPLLGGSLARARATSCHPDDLHALRGFAGNLSRGAVLLRAAWSGAMCCGWDGV

SEQ ID NO: 171719 - protein, 130 aa, Triticum aestivum
  Clone ID: PAT_TA_66137.pep
DYRAGRGLKTGPFRDRAEPSFGRSSSVARLWPSPIPPSITIASALGHEQPQPESLVSPFLCSAPPHLSLATLQIWIDGDERRRASSPTRHRRRRAARPFLATPDIVGRASPGFSRNVTSRSRRLSSQQWT

SEQ ID NO: 171720 - protein, 186 aa, Triticum aestivum
  Clone ID: PAT_TA_66138.pep
AAGDEERPLLHHHPPPGLYQNGDSRLNTCDGTVDVNGQPAAKASTGNWRACFFILGIEFSECLAYFAISKNLVTYLTSVLDESNIDAARNVSTWIGTTFFTPLVGAFLADTYWGRYKTIVIFLSIYTVGMLVLTFSAILPSLMQSSNHHEIHRVAVYAGLYLTALGNGGIKPCTSAFGADQFDMAD

SEQ ID NO: 171721 - protein, 105 aa, Triticum aestivum
  Clone ID: PAT_TA_66139.pep
QDACILYGFSSSHGGGAAAAASHVGLDASRVWRSGPPAQSLGVLSAAWFASARRSAWRDRMITSGRPRASQWRPRAGCVCRPWQMRRLGRGRLRWRHTTIGRALA

SEQ ID NO: 171722 - protein, 112 aa, Triticum aestivum
  Clone ID: PAT_TA_66140.pep
FSLMSEIQMYLQLQNTRVFGSEVQMYLQLQNTRVFGSEVQMYLQLQKHSCFWSIVFSFTSRRSCAAPTPSQPTTPLPPGPQPSASHVPSGEAPCLACLVPLATGSVRRPFLS

SEQ ID NO: 171723 - protein, 62 aa, Triticum aestivum
  Clone ID: PAT_TA_66141.pep
RHPPSLLPQPNHNAFCSPPNSRLTTTHQIWGSLARIRAPDAAGTRRRSTSELGTPRAVPPPA

SEQ ID NO: 171724 - protein, 47 aa, Triticum aestivum
  unsure (1)..(47): unsure at all Xaa locations
  Clone ID: PAT_TA_66142.pep
ISGASMSKLGSGRGSATKPCSGRSXNGSTEKTPKKGSTHHSRSPNAT

SEQ ID NO: 171725 - protein, 152 aa, Triticum aestivum
  Clone ID: PAT_TA_66143.pep
QAYDYYLKELIVEWSEGVLSSDGGNRNFYHLDRKDERNESFDLFLEKVARFLQKDVDQNQTVDVRGLSKVEARIVVLSTLRKIKEKHLLGRAVQDDLVIITGHEKTSYTDVETTAIDVEYAITSVLKDELGLEVFVGPESRPPVSSKLRAPP

SEQ ID NO: 171726 - protein, 77 aa, Triticum aestivum
  Clone ID: PAT_TA_66144.pep
CHRRHSGSFLGSAPRAAFLDQEFRVSRGHLLLRVPFSSFRRNSHPAVMACLPRLLIPFRVGLASHVVHRLLQPTAGV

SEQ ID NO: 171727 - protein, 137 aa, Triticum aestivum
  Clone ID: PAT_TA_66145.pep
LEKSNEMLREELHKLQSEMQLLKNNKQPVIDVRSCDAEISKLLANMQIATANAALFKEKVLELIVACESSEISEIVQKEVLKEEISRRNSYVDALKDKLNAVEIENRRLKVDLNGDFTVLGALQTEVSALEKQTLSL

SEQ ID NO: 171728 - protein, 75 aa, Triticum aestivum
  Clone ID: PAT_TA_66146.pep
CSARLSSTAIGNLGSWLLGKNIPGIASKACSRSHAHPQLTAAPWRPEDTTTCLHPPSRITCGTLVSSTTASPEQG

SEQ ID NO: 171729 - protein, 148 aa, Triticum aestivum
  Clone ID: PAT_TA_66147.pep
TLLPNPCPMELARRAAHRADAGDIYGIPTPSADEQMTIQELHRELLHEKIRQRIIVDELAKQQELEAEFQRELLNSDVDARFRQITMPHHGTSPLPHDEPLDVPVSIARRPVKDRTVEWDRPPRCRPASEEDAPIVGAKQHKNALSGV

SEQ ID NO: 171730 - protein, 80 aa, Triticum aestivum
  unsure (1)..(80): unsure at all Xaa locations
  Clone ID: PAT_TA_66148.pep
STRQVVTALLRHCMYQVIPAEXGHQAWAYLQDMQSNIDLVLTEVFMHGGLSGIDLLGRIMNHEVCKDIPVIMMSSHDSMG

SEQ ID NO: 171731 - protein, 73 aa, Triticum aestivum
  Clone ID: PAT_TA_66149.pep
RHHLRGRLRGRRCRPLDLPVLARPGPGGRRGGGERGGGGEGRAAAGGRHVAERREQDGPGHRPQHAVVLQPQQ

SEQ ID NO: 171732 - protein, 102 aa, Triticum aestivum
  Clone ID: PAT_TA_66150.pep
GLWTALDYGALAYARWSLISRGRALIFRHAGSGLRTGRLPMPMAVSGADGAGSHRRCLLQGRRRSPLFTTSETLHVLPTEDVETSQSSHGGRRGNGFNVGVE

SEQ ID NO: 171733 - protein, 103 aa, Triticum aestivum
  Clone ID: PAT_TA_66151.pep
LLGPARLLAVPTGTTSCNRLVAVERAQWEPPSRPASPRSRSTTARHCSQHSSNTCRLPEFRFFFEKGGLPGLSIRTMHTAYKFRCSPRSLAAGCRRRPERRTS

SEQ ID NO: 171734 - protein, 152 aa, Triticum aestivum
  unsure (1)..(152): unsure at all Xaa locations
  Clone ID: PAT_TA_66152.pep
TSFHLPRKSPPSPPEPPHPPSSSPPXTTYAPSPSSPPGLPYSTRXAKPWTPPAPPYPPPXPRSVAPPAAHGTATRSSPSHSSWRTEQPRPLPASRDAPPHGPQPLSVWTALDPAXPRCTELPPPDPIPLLPSGLPQHPKPPPPASAGLPPTA

SEQ ID NO: 171735 - protein, 136 aa, Triticum aestivum
  Clone ID: PAT_TA_66153.pep
AAVLGPVPAATGGHSLELPPLHCLPSLGLFAATTWASSLARVPTDGGENIPFPLTPSLHAFPSAAAVDSPVRRGLHRPPLAEVQDSALLLLLSGKDLVSSKLDQAPTPPPKARCLERFLQSSSTRHQQQRSPSATT

SEQ ID NO: 171736 - protein, 111 aa, Triticum aestivum
  Clone ID: PAT_TA_66154.pep
MGGYEFRREELDALECFLRDGLSWGPMSLSLQLLRHITNDFSPEYEIDTDEFAVVYLGVLPSGFRMAVKKFHLRGCLDDESAFNNDFSIAMKAAHKDEVRLIGYCHHTQEQ

SEQ ID NO: 171737 - protein, 50 aa, Triticum aestivum
  Clone ID: PAT_TA_66155.pep
NFTFILKECLLLTNHLSKIVRQVLPNPSLRTSTGVKIGMCMGCAKSLLNM

SEQ ID NO: 171738 - protein, 98 aa, Triticum aestivum
  Clone ID: PAT_TA_66156.pep
MADPSFFVGIVGNIISILVFTSPIATFRRVVRNKSREEFRWLPYVTTLLCTSLWAFYGLLKPGGLLIITVNAAGAALQATYVALYLAYAPRDTKVKMA

SEQ ID NO: 171739 - protein, 119 aa, Triticum aestivum
  Clone ID: PAT_TA_66157.pep
QKDKGVEPSEFEDTVAQAFFDLENGNQELKSDLKDLYINTAIQMDVVGNRKAVVIHVPYRLRKRFRKIHVRLVRELEKKFSGKDVVFVATRRIVRPPKKGSAVQRPRTRTLTAVHDGIL

SEQ ID NO: 171740 - protein, 129 aa, Triticum aestivum
  unsure (1)..(129): unsure at all Xaa locations
  Clone ID: PAT_TA_66158.pep
AHEPTEGRHSGYGKRSGTREARLRTKILWMRRMCVLRRLLRKYREAKKIDKHMFHDMYLKVXGNMFKNKRVLMKSIHKSKAEKAREKTLSDQFEAKRAKSKASRERKIARREERXAQVRVLPVDGGLSI

SEQ ID NO: 171741 - protein, 88 aa, Triticum aestivum
  Clone ID: PAT_TA_66159.pep
MRLSMLNKFSFFLVLVVSLLILFQINSNKSKALEYLIASNHGHRSLACGTGGQGHLRRRRWALPARQLMRLSAVGGWGLGCCRERRGT

SEQ ID NO: 171742 - protein, 58 aa, Triticum aestivum
  Clone ID: PAT_TA_66160.pep
LFQDGNHIAVARKNSLRILSPDLKETCCMALLFQLWPDSDSEGTDIKVDSIGWVRDDS

SEQ ID NO: 171743 - protein, 159 aa, Triticum aestivum
  Clone ID: PAT_TA_66161.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSI

SEQ ID NO: 171744 - protein, 59 aa, Triticum aestivum
  Clone ID: PAT_TA_66162.pep
QCNVPPCFVPLGAQPHVVNISTYIYIILSYCFSSYKKHVASFKFLEAVLANPCIGFVMA

SEQ ID NO: 171745 - protein, 66 aa, Triticum aestivum
  Clone ID: PAT_TA_66163.pep
MGSVDYYEILNVDRSATDDDLRRAYRQLAMRWHPDKNPTGDKDSEAKFKDITQAYNVLSDASKRAV

SEQ ID NO: 171746 - protein, 49 aa, Triticum aestivum
  Clone ID: PAT_TA_66164.pep
NANHPPIAPNLTPRAWAATGERCRAPARGAAGPLPSPSLSATPVSSLTT

SEQ ID NO: 171747 - protein, 122 aa, Triticum aestivum
  Clone ID: PAT_TA_66165.pep
LHNQAVSRAPPPILNRGGQMRHVRARRRPDRARTRAEASRSGKDAHSSTQIQACGGAPRPCPPSLCLNRRGWRKRVRWRGDGEWSSSPGGAVWMRGWGSGGVHGDECGGWVGYRGRSRGSGR

SEQ ID NO: 171748 - protein, 171 aa, Triticum aestivum
  Clone ID: PAT_TA_66166.pep
APWSPTAVNANANGNGKTSPKLASPKHLPGERTVKKLRLSKALTIPEGTTVYDASRRMAARRVDAVLLTDAQGLLSGIVTDKDISTRVIAEGLRVEQTIMSKIMTRNPTYVTADSLAIEALQKMVQGKFRHLPVVENGEVMAMLDIAKCLYDAIARLEKAAEQGSAIAAAV

SEQ ID NO: 171749 - protein, 53 aa, Triticum aestivum
  Clone ID: PAT_TA_66167.pep
DANAFLYLSVDTPIMFEKIWNHILYAMMLMVSRYTFEYTGGKFLIIYSFSVCR

SEQ ID NO: 171750 - protein, 69 aa, Triticum aestivum
  Clone ID: PAT_TA_66168.pep
RTRLYFTSESHIHSLMNVLRYCYLDESLNGEESLICKNASDHLFKTKELDYMSYIVLRMFENTEVLKFP

SEQ ID NO: 171751 - protein, 149 aa, Triticum aestivum
  Clone ID: PAT_TA_66169.pep
HDVPAVVENPSSLGSRSGPNTAQYVQPFFAPESVQQQPGAPLVEIFPERASAGPMLSPLDGKVSVAAVPLADHLSRLDINTTKKLEGADDERHTQNVTETKPSHAASDPSTLVHNVGVDLQRGKPTEHDGGAVALQQCGDISENRLNIL

SEQ ID NO: 171752 - protein, 53 aa, Triticum aestivum
  Clone ID: PAT_TA_66170.pep
MKGGGAIRSGGGGGGGLMRTRLRLPTPSLIPYQILSWQPRALYFPQFATAEQC

SEQ ID NO: 171753 - protein, 53 aa, Triticum aestivum
  Clone ID: PAT_TA_66171.pep
MAMVAQAGFGLTRVVMLVGAGVAGSVVLRNGRLSEILTEIQEFLEKGEMGKGG

SEQ ID NO: 171754 - protein, 172 aa, Triticum aestivum
  Clone ID: PAT_TA_66172.pep
LFTEMFLPSIGWSSPSRIQPLVETVKCLQLPGFSDDLSWLKQGSYMGRQIQDQKLYLEECLTRYLTQSAQLLNGAQAVAEAKIMVQKGVDLELRDSNHYLVPNWVTIFRRIYNWRLARLSTGDFSEAYVLSQRLYQPPATQHGLTANSDTIGEAPILEDHDMMPAVPSGLSL

SEQ ID NO: 171755 - protein, 90 aa, Triticum aestivum
  Clone ID: PAT_TA_66173.pep
CVAVFERRPEAAAACFADIAARAGILDFLKFGRAVADAKKDPIKLLRLLDVFDSLSKLRLDFNRLFGGKACLEIQSRTRELVKRVVDGSV

SEQ ID NO: 171756 - protein, 37 aa, Triticum aestivum
  Clone ID: PAT_TA_66174.pep
CKTAPSLPPRKQTSCSGSTPRQSFGSYTGVVGGVQDG

SEQ ID NO: 171757 - protein, 67 aa, Triticum aestivum
  Clone ID: PAT_TA_66175.pep
SAFIGSSFVIKKIGLKKAGDSGARARAGSGGHSYLYEPLWWLGMVTMILGEIANFAAYAFAPAILVT

SEQ ID NO: 171758 - protein, 125 aa, Triticum aestivum
  Clone ID: PAT_TA_66176.pep
MQAAGATSEERSRGSPSAMEKGGDQSARKARLELVVANGPVKRQMVVHEAGEIVPAEQGPTMEVSVKMDVAVLHCPFCFLPFKPPVFQCSGGHLACGDCRGERPGSHWQCERCERGGPFHIRSTA

SEQ ID NO: 171759 - protein, 178 aa, Triticum aestivum
  unsure (1)..(178): unsure at all Xaa locations
  Clone ID: PAT_TA_66177.pep
ARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTXGLIFVVDSNDRERVVEARDELHRMLNEDELRDAVLLVFANKQDLPNAMNAAEITDKLGLHSLRQRHWYIQSTCATSG

SEQ ID NO: 171760 - protein, 199 aa, Triticum aestivum
  Clone ID: PAT_TA_66178.pep
AIPRPTEFSVSRNRLSGHVPNSLGNLSNQLQEIYLAENQLSGDFPSGIANLRNLFILTLGMNQFTGVVPEWIGSVKILQQFGLEANFFTGVIPSSLSNLSQLGELYLSSNQFIGHIPASFGNFSTLQNLDISNNNLHGRVPLEIFKIPTIFHINFSFNNLNGQLPTDIGNAKQLVHLVLSSNTLSRDIPKTLGDCESLE

SEQ ID NO: 171761 - protein, 133 aa, Triticum aestivum
  Clone ID: PAT_TA_66179.pep
GWERGGRLTGWSGWGVTTWVQKQWQRWRCAVAEEKDSDVVVRAWRVALSYIEVDSDEKRLNKLGYKEELRREMTLAITFSKMTIFTGITSLYGSILQFVRPASLVRGWVIVSFFTWFIGVVMLGISPSLSLNL

SEQ ID NO: 171762 - protein, 228 aa, Triticum aestivum
  Clone ID: PAT_TA_66180.pep
CKPKFGLPNSQVGSKMDHPAMAQHQQQSHQLQQQQQVQQSQQSSAVQQQQAQLLQQNAIHLQQQQEHLQRQQSLPQQQQEHLQRQQSQPQQQLKTAASMPSMEQHKLREQQPQGGQAVSQAQMLSQIFQPSSSQLQQLGLPKSPTQRPGFPGLPTASSLQQPALGQAPQVQQAAEYQQALLQSQQQQLQQLSQPEMQLQLLQKIQQQNMLSQLNPQHQSQLMQQLSQK

SEQ ID NO: 171763 - protein, 42 aa, Triticum aestivum
  Clone ID: PAT_TA_66181.pep
MYHYFPAATYPWLTCSSWFQLTFVSFSTLDYKCVVLILMMML

SEQ ID NO: 171764 - protein, 112 aa, Triticum aestivum
  unsure (1)..(112): unsure at all Xaa locations
  Clone ID: PAT_TA_66182.pep
DFYSTITRARFEELNMDLFRKCMEPVEKCLRDAKMDKSTIHDVVLVGGSTRIPRGQQLLQDFFNGKELCXSINPDEAVAYGAAVQAAILXGEGNEKVQDLLLLDVTPLSLGL

SEQ ID NO: 171765 - protein, 88 aa, Triticum aestivum
  Clone ID: PAT_TA_66183.pep
MSSHAGGENFPCASNGQYRSSLHINCGDKEAIVNGVKYEGDTTPKGASMLYLSPDSNWAFSSTGNFMDDNINDDNYIASNTSKLTMPN

SEQ ID NO: 171766 - protein, 59 aa, Triticum aestivum
  Clone ID: PAT_TA_66184.pep
WWRQRDLVGRHAPPRVVAAPVQVRRLLNYRRIAAVGRVRCLPCRVGTSLAPSCRGAGST

SEQ ID NO: 171767 - protein, 52 aa, Triticum aestivum
  Clone ID: PAT_TA_66185.pep
VLVRDDGHIMLSDFDLSLQQCAVSPALVRAPACDSRPQRAGGAFCARPSACM

SEQ ID NO: 171768 - protein, 83 aa, Triticum aestivum
  Clone ID: PAT_TA_66186.pep
ASHHTPSLLARLLSVSGEVLARHRRRGHSSHSTATSMGHLLPLPEIDLQRQRKFSRFAYNPCTLSKATFPRNETWRPIGQGQE

SEQ ID NO: 171769 - protein, 80 aa, Triticum aestivum
  unsure (1)..(80): unsure at all Xaa locations
  Clone ID: PAT_TA_66187.pep
GGHVRVRVAGRRWPGRLVRAVAAMXDLRMAVLHLAVTSVGHDAVVYCFNLKMEDGCEVSTADDVATVVHQIFAYAAGSCC

SEQ ID NO: 171770 - protein, 40 aa, Triticum aestivum
  Clone ID: PAT_TA_66188.pep
PQPPAALKIGTYRPIHSPRLYMYSTVYDMSAQVKDEARLQ

SEQ ID NO: 171771 - protein, 137 aa, Triticum aestivum
  Clone ID: PAT_TA_66189.pep
REGRGQCRRRSQGRRASRGSASPRDPSPVGGSRRHPLSARPPCISSCSPSPTAVARRVEQLAAARRPLHAPNAAAPLRLVRPLQPRRGDPRPTMREAEEGGRWHGEEEGLGVGAAARGELRESRGGGGVKGEKGLVR

SEQ ID NO: 171772 - protein, 69 aa, Triticum aestivum
  Clone ID: PAT_TA_66190.pep
SQVVHSVTGKCFYFVGQFYIHFFNNEMTMSSVSRSFINTNVMLRLVKEGLIAAYLNSTDALTAASLSLD

SEQ ID NO: 171773 - protein, 94 aa, Triticum aestivum
  Clone ID: PAT_TA_66191.pep
ARNRPLRLCHVDTNVVATYITGTLQAMHAKSKLCIKGNLSSRSFLCTPVAPPCMKSKTIKSAPPLIEKKKESDPLCLKHPNTYLIDDDLQCGCK

SEQ ID NO: 171774 - protein, 114 aa, Triticum aestivum
  Clone ID: PAT_TA_66192.pep
MPLDVLGRTRGGVMYSTSIKPEPKPMPKPEPKPEPKPEPMPKPEPKPEPKPEPMPKPEPKPEPKPEPMPKPEPKPEPKPYPMPKPEPKPEPKPEPMPKPEPKPEPKPEPMPKPE

SEQ ID NO: 171775 - protein, 57 aa, Triticum aestivum
  Clone ID: PAT_TA_66193.pep
KRSLSIMRDLVRWKHGSRTRFRRSSNSTPHGKLRTISSGSSRTTAQSRMVAVAPKGP

SEQ ID NO: 171776 - protein, 46 aa, Triticum aestivum
  Clone ID: PAT_TA_66194.pep
GEGEICFGKAASNARFCEGVKTRVGCWMCCPRFCLILYPVARNTVT

SEQ ID NO: 171777 - protein, 44 aa, Triticum aestivum
  Clone ID: PAT_TA_66195.pep
NQPKYHPTLRRSEWTFEAVVPLLNSYECTLAMSSPLGVGSLFYL

SEQ ID NO: 171778 - protein, 90 aa, Triticum aestivum
  Clone ID: PAT_TA_66196.pep
SSSYSSYLHTHAHNCDKTNDNPLSLAASWFSMCFFIPQLHLPMQLSLRWLDMNSYDASGCACNLVSGSSCKKDQCPDFHSNLRMPAAMRN

SEQ ID NO: 171779 - protein, 46 aa, Triticum aestivum
  unsure (1)..(46): unsure at all Xaa locations
  Clone ID: PAT_TA_66197.pep
PGAEDGRGRRGGRVXGPRSPAAAGAGGGPRSSEGGGRRRGEERAAG

SEQ ID NO: 171780 - protein, 67 aa, Triticum aestivum
  Clone ID: PAT_TA_66198.pep
GRREQAQSADLICLIMFEILLHMWKQLLRSGLKGQGVTTVTCWDFAVAAAVLLENFGVMYYFSIWYP

SEQ ID NO: 171781 - protein, 36 aa, Triticum aestivum
  Clone ID: PAT_TA_66199.pep
LNKFRTNTLDYWSPVHHYPLQIREPTQAIWELGAAG

SEQ ID NO: 171782 - protein, 177 aa, Triticum aestivum
  unsure (1)..(177): unsure at all Xaa locations
  Clone ID: PAT_TA_66200.pep
QHLAPTVMASSATSVAPFXGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 171783 - protein, 59 aa, Triticum aestivum
  Clone ID: PAT_TA_66201.pep
IPKLVLLPYAEICVWVWPRQIRIRTLCECQTSSTGSVDRTNGDIDSRMNLQNCSVVSVS

SEQ ID NO: 171784 - protein, 104 aa, Triticum aestivum
  Clone ID: PAT_TA_66202.pep
MWLFMLSLILCSGLQCRKRKLKVSVVAVPKTIDNDILFMDKTFGFDTAVEEAQRAINSAYIEARSAYHGVGLVKLMGRSTGFIAMHASLSSGQIDVCLIPEVCN

SEQ ID NO: 171785 - protein, 173 aa, Triticum aestivum
  unsure (1)..(173): unsure at all Xaa locations
  Clone ID: PAT_TA_66203.pep
SFGARRATVEARRELLVSALSACAHLGAYDVGRSVHCALLRNTVTLNTFMETSLVDMYSKCGCIXKAMAVFDRMDGKKNEWTYSAMVSGLALHGNGRKALQVFDAMIMEGHQPDEAVYVGVLNACSRSGLLEEGLRCFDWMRLERKVAPNAQHYGCMVDLMARAGRLDEARAL

SEQ ID NO: 171786 - protein, 75 aa, Triticum aestivum
  Clone ID: PAT_TA_66204.pep
QPLPHAGLQLIDLICLSAIVGRESEEGVVIPGAGTVVGRPPSRRRAADGRLKACTHRGHCLLPLPRHGAARCNLV

SEQ ID NO: 171787 - protein, 45 aa, Triticum aestivum
  unsure (1)..(45): unsure at all Xaa locations
  Clone ID: PAT_TA_66205.pep
GHLFHQSIASTWRIYYYSYGKEALICSXSEEEILEPXEENHVFTK

SEQ ID NO: 171788 - protein, 47 aa, Triticum aestivum
  Clone ID: PAT_TA_66206.pep
LFASTGDDPRRDVRILIVNCSLFNPTPSLASMIIHHYKMREDVKSFN

SEQ ID NO: 171789 - protein, 117 aa, Triticum aestivum
  Clone ID: PAT_TA_66207.pep
GLPRLSPQYHPVSSFSSFSSLKFCLVLFLIWFLIQNSSPILISWLCPALLLLIQIHRITSNEDGIIKVILFFYFTTYCDFFMVCAKYGAGSCAPANRHIFQVKEKVWAWTSNISLYI

SEQ ID NO: 171790 - protein, 128 aa, Triticum aestivum
  unsure (1)..(128): unsure at all Xaa locations
  Clone ID: PAT_TA_66208.pep
VLNAARQVWLDPXESTRLLANSRQNIRKLVKDGFIIRKPQKIHSRSRARRAHEAKQKGRHSGYGKRXGTREARLPTKILWMRRMRVLKRLLRKYREAKKIDKHMYHDMYLKVKGNMFKNKRVLMESIH

SEQ ID NO: 171791 - protein, 73 aa, Triticum aestivum
  Clone ID: PAT_TA_66209.pep
YHGLVQFGRSSMTACSIDRDVAALGKMLTPPFIAEKYVGLDSSWLVLQKNQCAFPVLFLHFNMHLCLFSSMSG

SEQ ID NO: 171792 - protein, 66 aa, Triticum aestivum
  Clone ID: PAT_TA_66210.pep
MNNTPRLRASRRGEQFQQRRAMIASFKESRAVSRRGGACHYLPRPHISCLDPDPAPPIAGIDRMHS

SEQ ID NO: 171793 - protein, 84 aa, Triticum aestivum
  Clone ID: PAT_TA_66211.pep
ATYASLHLPQTTDNPGKNTMAAPSPAVAAVSSAPSSGLLPARRAAPCSAVQVQLPSIRRAAPGGRMATVARAVGDVGAEGNTYL

SEQ ID NO: 171794 - protein, 45 aa, Triticum aestivum
  Clone ID: PAT_TA_66212.pep
AANRCIRESHAKKLSTGGELIPIVWLILEHLRYLKEAPHKEGSHV

SEQ ID NO: 171795 - protein, 154 aa, Triticum aestivum
  Clone ID: PAT_TA_66213.pep
IHMVSLPDGMGPDGDRTDIALLGSGLPAAMLGPLEEMIRSKKIKWVIADASMCWAMELAATAGVRVGLFSTFSAAVFALRLRVPKLIDDGVLDESGNVKRNETIQLSPKMPPIEAAELPWVCVSSLPERRRLMIQILLKTNPVIPLAAIVICNT

SEQ ID NO: 171796 - protein, 162 aa, Triticum aestivum
  Clone ID: PAT_TA_66214.pep
FASCVCIKKCAISVKPVCGSDGVTYDSQCDLDMVNCNENSDIRVASQGRCPSCDPKSCKNGAVCSGGLTCECVNKCGNEQNQMCGSDGVTYANPCRLKLATCISEGFITLLRTGVCATAPSPTPRVSTPYNSNSYSSASTPYASFATAPSSRGTSDSGGSVP

SEQ ID NO: 171797 - protein, 171 aa, Triticum aestivum
  unsure (1)..(171): unsure at all Xaa locations
  Clone ID: PAT_TA_66215.pep
CWWPQVEPGLSAYAGRPQEAAKSIVPLLEKAKSTVPRSLMKKTPVKLGATAGLRLIGDEKAEQILEAVRDAVHSQSKFQYNPSWINVLKGSQEGSYLWEEXYSKTVGVIDLGGGSVQMAYAISADAAATAPGVPQGDDPYVTKKYLKGRDYNVYVHSYLHYGAMASRVEIF

SEQ ID NO: 171798 - protein, 80 aa, Triticum aestivum
  Clone ID: PAT_TA_66216.pep
RWRRDMTMVRAASLRPCPPLCSVPPRRTLSIHGFRPTPSSLTMARPFLQLFWRGSRAVRSAGFGIGFQAALEVGRRGRDG

SEQ ID NO: 171799 - protein, 62 aa, Triticum aestivum
  Clone ID: PAT_TA_66217.pep
VTRKFCTEPSMASVKKRCRPAVNTTLAADNRPGVPASPTSATKPGNGQGVMSATGLGRPAAR

SEQ ID NO: 171800 - protein, 55 aa, Triticum aestivum
  Clone ID: PAT_TA_66218.pep
PPPLIISSQPPAPMAPTPPPPTNKAKDAFPHRSSGRLAAKPSRVLSAMDKAQLVL

SEQ ID NO: 171801 - protein, 44 aa, Triticum aestivum
  Clone ID: PAT_TA_66219.pep
VQHEPVSTGEDDAVDGDHATRLKVPLEGVDEGHPEEVAGKVLHG

SEQ ID NO: 171802 - protein, 30 aa, Triticum aestivum
  Clone ID: PAT_TA_66220.pep
GNGSWIYRPSSNSMVLTCMHSRGCFVLRKY

SEQ ID NO: 171803 - protein, 58 aa, Triticum aestivum
  Clone ID: PAT_TA_66221.pep
MAAATMSLSSSTFAGKAVKNVPSLALLGEARVTMRKTAAKAKQVSSGFPWYGADRVLY

SEQ ID NO: 171804 - protein, 53 aa, Triticum aestivum
  Clone ID: PAT_TA_66222.pep
GPPTDGRWRWHGAPAPGCRLGSPQSGDALSPPSQGRRRVKHAGASEQFSAELT

SEQ ID NO: 171805 - protein, 67 aa, Triticum aestivum
  Clone ID: PAT_TA_66223.pep
SSTAPSGSTATSCCGSPAGPAATRRPRRSTSPASPTPGRRPSRPTRPGTRAGAAGPGAPAATCTPPP

SEQ ID NO: 171806 - protein, 97 aa, Triticum aestivum
  Clone ID: PAT_TA_66224.pep
KEAAYISFFTNTQSLRIFSLIEEVEHHMAQPQDGANMMHGAERRGMLGPDRSYNTAQNYPPREKTRINVTISKTSTEHATSNQDDAFMKGNDAMTSS

SEQ ID NO: 171807 - protein, 73 aa, Triticum aestivum
  Clone ID: PAT_TA_66225.pep
GDLHHDEEEGGSPPAGGGAVDGAAAEVADAGERLFLILKKGSIDVHHCHLLTCFCLLVARLLYTVYIITGWLV

SEQ ID NO: 171808 - protein, 116 aa, Triticum aestivum
  Clone ID: PAT_TA_66226.pep
SCSSVGSFPSRRPQPPSSFSRPDSSPSHEELSRRRVVVGFVVYTTGSEPGGRLDDAPSPSTSTATATPSPDSPPSAPTRPPRAALPLRYVGAQEPDAIIDDYYYYSGGAYYYVQPA

SEQ ID NO: 171809 - protein, 41 aa, Triticum aestivum
  Clone ID: PAT_TA_66227.pep
ESVAMKVLDRSSILKHKMVDQIKREISIMKLVRHPNVVRLH

SEQ ID NO: 171810 - protein, 80 aa, Triticum aestivum
  Clone ID: PAT_TA_66228.pep
VTAPCAAASKESKSWWMPNSVSAFNSGLLFFRCHLIAATRISFGMLMILLIGWLIFQRSAMTGPNMPITFNLVLLGGVCG

SEQ ID NO: 171811 - protein, 117 aa, Triticum aestivum
  Clone ID: PAT_TA_66229.pep
MAAALSLRAPFSLRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEA

SEQ ID NO: 171812 - protein, 69 aa, Triticum aestivum
  Clone ID: PAT_TA_66230.pep
RKSGAIGKSGPMEEEEDDPFIDDDIPDDFKRGKLDALTILQWVGLVLIFGALVCSLAMKPLSRKKVWEL

SEQ ID NO: 171813 - protein, 83 aa, Triticum aestivum
  Clone ID: PAT_TA_66231.pep
PQRQLIWRRSRPSPSSDHRHRRRPSVLPRRALIPHHRRPPPTRHHSRPLIPLASSSPMAVSYKFDLELVWQQQIPCMLVLVLE

SEQ ID NO: 171814 - protein, 68 aa, Triticum aestivum
  Clone ID: PAT_TA_66232.pep
SPIRRHRFPRSRPPLCLALSPLPSFCGVGVGSGAVGTLLFSRCLPKCSLPCPCLASPQQPARPCAPGV

SEQ ID NO: 171815 - protein, 74 aa, Triticum aestivum
  Clone ID: PAT_TA_66233.pep
GLRRRTTRRKVTLSWTETVGNVTRGAAPVAFAERSSVVGSRGRRTASRTMAATAARRSRTSTAKLAQMMARRRR

SEQ ID NO: 171816 - protein, 98 aa, Triticum aestivum
  Clone ID: PAT_TA_66234.pep
AGVNTSVVGLKPAAAVPQSASPAAAKRVQVAPAKDRRSALLGLAAVFAVTAASAGSARASVFDEYLEKSKLNKELNDKKRAATSGANFARAYTVQFGI

SEQ ID NO: 171817 - protein, 100 aa, Triticum aestivum
  Clone ID: PAT_TA_66235.pep
MTLKLLAEVSPQELLQALAELQNHMLGYVKSMSLRCVVDLGIPEAIHRRGGTATIANIEADAKVHPGKVADLQRVMELLTTSGIFTATAGAGDGDTVVFG

SEQ ID NO: 171818 - protein, 103 aa, Triticum aestivum
  Clone ID: PAT_TA_66236.pep
LPLLRPRARPDNSLHTKTRHIDEGLSSALGVARPRQRPDMDDGDAQQHARVAAAPRRVIDKLTIAWSPISSPFSSPAGWSSPLHIHTHDICDGDEHPSIHGTS

SEQ ID NO: 171819 - protein, 99 aa, Triticum aestivum
  unsure (1)..(99): unsure at all Xaa locations
  Clone ID: PAT_TA_66237.pep
IIFENMYYIPVMPWTGSSCQILGRRALGASQVPRPHSGRXRPLAVTTPVMCATQGRVGGGCCGRQGGGRESVIPVPALAVSPRTPRCRGCDGWSAVSIT

SEQ ID NO: 171820 - protein, 56 aa, Triticum aestivum
  Clone ID: PAT_TA_66238.pep
HICMIFFQKLKVVDVALYEAIIRMENKLMGEYCLNFLRSVNGNTSYVCAMILFQFF

SEQ ID NO: 171821 - protein, 98 aa, Triticum aestivum
  Clone ID: PAT_TA_66239.pep
SLSPRAAESCKAWLVQSIPTDMPHLRRVPGVLATADVLQWLSGNTTESLDILAQYWQFIAHPKNPKSGEYGFSESDMAKFGAEEGRRVYNALEKAADR

SEQ ID NO: 171822 - protein, 40 aa, Triticum aestivum
  Clone ID: PAT_TA_66240.pep
MADDDYNEVDMGYEDEPPEADIEEGVEEDPENNEDAPDDV

SEQ ID NO: 171823 - protein, 150 aa, Triticum aestivum
  unsure (1)..(150): unsure at all Xaa locations
  Clone ID: PAT_TA_66241.pep
HLHPGVSNWTVDGIVKYVSSKMEEEKAQENESASLQRRQPVEVSPEAKKRSLEAKSRGDDAFRRKDFLVAVDAYTQAIEFDPNDPALLSNRSLCWLRXGKRFEEAANAFYEGVQLEPENKELVKAFREAVEDGRKFHSANKPTTNGTKSE

SEQ ID NO: 171824 - protein, 51 aa, Triticum aestivum
  Clone ID: PAT_TA_66242.pep
GRAWCPARLPLAAAASAAPPLTMHIACFAQRLAGSSQPRPRSHVIYLSTCS

SEQ ID NO: 171825 - protein, 104 aa, Triticum aestivum
  unsure (1)..(104): unsure at all Xaa locations
  Clone ID: PAT_TA_66243.pep
HGHCPLTPXEVGMFLSALGYPSSTPVYIAAGEIYGGESHMVDLQSRFPILMNKEKLASAEELRPFSQYASQMAALDYIVSVESDVFIPSYSGNMARAVAGHRRF

SEQ ID NO: 171826 - protein, 119 aa, Triticum aestivum
  Clone ID: PAT_TA_66244.pep
RASSSGVGCPPGVDPHSQRSYLPPPHVPDYHARNFSSNGAAPGPRFFVEQEIMFRMICGNDMVGGVIGKGGSTIRALQSETGASVKVIDPVADSDERIIVISARENSEMMHSPSQDALI

SEQ ID NO: 171827 - protein, 113 aa, Triticum aestivum
  Clone ID: PAT_TA_66245.pep
GHGMQFGVRKLNTKLGMCLYWVMAHQFADNQTNKNEKKKGVGGCCHLQWKRIQMPFAVRRRGGQARPAAAASPSEQRRAWIPCSLAAEEDAEDRHARHRVVRLLNPTVTMDGG

SEQ ID NO: 171828 - protein, 206 aa, Triticum aestivum
  Clone ID: PAT_TA_66246.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADM

SEQ ID NO: 171829 - protein, 98 aa, Triticum aestivum
  Clone ID: PAT_TA_66247.pep
WMDLGIAHKRKNAPAAPSTTCAVTADQGFPPVPPSALSKPPSPQTRRTKGRRRFEQMELAGPCAENLPSSDLTHEASGNGSHTEPPATAPHGPAAQDA

SEQ ID NO: 171830 - protein, 99 aa, Triticum aestivum
  unsure (1)..(99): unsure at all Xaa locations
  Clone ID: PAT_TA_66248.pep
MSSVSARAPVAALRPAASASSPRFLGDSGRVGLAKSTRRDVAVQXGSWLPGLPSPAYLDGSLAGDNGFDPLALAEDPEDLRWFVQAELVNGRWAMLGVA

SEQ ID NO: 171831 - protein, 141 aa, Triticum aestivum
  unsure (1)..(141): unsure at all Xaa locations
  Clone ID: PAT_TA_66249.pep
TGYWCTNRNARLGCVIVDFLRFPKRVYESPLLLVPEPEHRSNQAAGDPSCAVRPIDGGLSGSDLSWRPAIQDIARVPDETPFSNAHIGLVTPPATLXGANACAYSSDFNPDVRDDDSGNVIVVPGWKKRNVGANGPDTRTP

SEQ ID NO: 171832 - protein, 240 aa, Triticum aestivum
  Clone ID: PAT_TA_66250.pep
GPTPASIPESVQSNVLHPLGLPPAPPTDLINMTEAESADISHTSEKHGASDGLHKATNEVVLENLNADLKALKKYNSVEFLKRQHEEFRPAFVCRGLLLPFQVDDTETKFILKAYERAFKGQAPKLLNSFDATINLRNMPMDFWKHSLDDFMKQHIVVSNDWDDKAGRPAVYVQCLPYEIGPTYPEGIQYLRGECDASYDLHTHFGAIANAIWNKTDLLWYEICRGFRFNSILHAEAHAA

SEQ ID NO: 171833 - protein, 73 aa, Triticum aestivum
  unsure (1)..(73): unsure at all Xaa locations
  Clone ID: PAT_TA_66251.pep
RHQKLHARRSKDSRTLEELLLSPPRCPDRTRXRXERKEPAISPPTHFFIYSSPLTSLTGTDPWIRNWPRTRAT

SEQ ID NO: 171834 - protein, 63 aa, Triticum aestivum
  Clone ID: PAT_TA_66252.pep
GSPEEGRRRHRGSHRHLSSSDQHHRQRHPDRRHLIESNRTRSTSGEEGSSDWGFGVCVGLVAP

SEQ ID NO: 171835 - protein, 98 aa, Triticum aestivum
  Clone ID: PAT_TA_66253.pep
QDVWLAEFKTELKKSREELLAARKEMNSVSLLTIRFLFQCVPGYGLLTLSWDPGQLAVDSAATICDQGIRAICHQQLSVHNRLQIAWSFVSKFSCVGS

SEQ ID NO: 171836 - protein, 131 aa, Triticum aestivum
  Clone ID: PAT_TA_66254.pep
PWTSAACSRANKAHRCELNSLEHLQPLSPRGGIFCAAWRAAGGIFGLGVKKFSAVWGASRAHAVPAPRHGWPGLAVELEQSSMSASASRLSRGATASPAPSPSSPPSPTPSHPRRSPTSASSPGTPRQGGR

SEQ ID NO: 171837 - protein, 81 aa, Triticum aestivum
  Clone ID: PAT_TA_66255.pep
YTGEWHDLFSEHHFGQLWAKQRAPLSHPWLSTHYPDSPCYLPPACVPEVESRDQATVTCILQKRRSHMPTLVPDILGSKTA

SEQ ID NO: 171838 - protein, 208 aa, Triticum aestivum
  unsure (1)..(208): unsure at all Xaa locations
  Clone ID: PAT_TA_66256.pep
MKTFLILALLAIVATTATTAVRVSVPQLQPQNPSQQQPQEQVPLVQQQQFLGQQQPFPPQQPYPQLQPFPSQQPYLQLQPFPQPQLPYSQPQPFRPQQPYPQPQPQYSQPQQPISQQQQQQQXQQQQQQQQQQQGMHILLPLSQQQQLGQGTLVQGQGIIQPQQLAQLEAIRSLVLQTLPTMCNVYVPPECSIIRAPFASIVAGIGGQ

SEQ ID NO: 171839 - protein, 103 aa, Triticum aestivum
  unsure (1)..(103): unsure at all Xaa locations
  Clone ID: PAT_TA_66257.pep
MASSPVSYWCYHCSRFVRVSPATVVCPDCDGGFLEQFPQPPPPRGGGGSGRRGAMNPVIVLRGGSLSGFELYYEDGSGDGLRPLPGDVSHLLMGXSGFHRLLD

SEQ ID NO: 171840 - protein, 88 aa, Triticum aestivum
  Clone ID: PAT_TA_66258.pep
TSIMLSPPYVAVTPSTHTYHITTKSTLLHTYHEPIFKLQHSLNRHHLQPSTHQPDLQHPHHRQYSHRDGHLRALQLTASPRLVPLPPQ

SEQ ID NO: 171841 - protein, 123 aa, Triticum aestivum
  Clone ID: PAT_TA_66259.pep
SPPRSPADSGRSGELRRLPAHPLLLLGKLYQLRRIDLLFLPPVVVPNDFLARVPVVEAGLVADGPSVVAGFHPAPPAAHRDAVVPLGWRLRAVMPSGWRHRARRSPWSSWLCSGGLQTLSWMW

SEQ ID NO: 171842 - protein, 79 aa, Triticum aestivum
  Clone ID: PAT_TA_66260.pep
QQQPLSQVSFQQPQQQYPSGQGFFQPSQQNPQAQGSFQPQQLPQFEAIRNLALQTLPAMCNVYIPPYCTIAPFGIFGTN

SEQ ID NO: 171843 - protein, 45 aa, Triticum aestivum
  Clone ID: PAT_TA_66261.pep
NSGVLKDLPGCPREPQRDFAKELVTPGHCNVMTVHNTPYCLGLDI

SEQ ID NO: 171844 - protein, 43 aa, Triticum aestivum
  unsure (1)..(43): unsure at all Xaa locations
  Clone ID: PAT_TA_66262.pep
FEFFRLMLRQGXAADQFTLTSAVAACANAGMVEQGRQVHGCVL

SEQ ID NO: 171845 - protein, 36 aa, Triticum aestivum
  Clone ID: PAT_TA_66263.pep
LDMFRRRCRYSSIKYLLLVLDAISDSSLIYTIGLMQ

SEQ ID NO: 171846 - protein, 79 aa, Triticum aestivum
  Clone ID: PAT_TA_66264.pep
FQKALIHWCTPEHWKFFLYLPPTSCLCYPAASTRNDMLSDLCHWSPSPPRSSNLSRRSTACSFAHVAPCIHRWPILHHG

SEQ ID NO: 171847 - protein, 99 aa, Triticum aestivum
  Clone ID: PAT_TA_66265.pep
AGACPVHAHGDSDHEPSPPLPPPRPSISPTSHLVLLSPLSPGTQPPAYLPAVLLIAAGGSAAVREGRGVPALLSRRLPPRLLPGQDGGAVGGWVGFSKA

SEQ ID NO: 171848 - protein, 52 aa, Triticum aestivum
  Clone ID: PAT_TA_66266.pep
LDVSSHHQHHLTDSPSSSINRCISLQGNSLLKLLTTLQPAASKRWLYLLLLP

SEQ ID NO: 171849 - protein, 110 aa, Triticum aestivum
  Clone ID: PAT_TA_66267.pep
LQGCDILQNLPATLGHLQTLEHLRVSCRYDIGELADSLCNLHDLRFIDLWRGAELPQLPCSFGNLVRGEDLNLSSGFNLNQLPESFGNLYFLRSLNMSSCSELEQLPGSF

SEQ ID NO: 171850 - protein, 89 aa, Triticum aestivum
  Clone ID: PAT_TA_66268.pep
NCTYDKSYHHLVRNTDKTNDKHRCGRQKVQTQTESKFLSISQEPIITNRTHITIHKLQTVMGKQNTFTVVFNSPAAAGAIHKAMHLTMS

SEQ ID NO: 171851 - protein, 164 aa, Triticum aestivum
  unsure (1)..(164): unsure at all Xaa locations
  Clone ID: PAT_TA_66269.pep
VSLKLQKRLASSGLKCGKGKVWLDPNEVNEISMANSRQNIRKLVKDGFIIRKPQKIHSRSRAMRAXEAKQKGRHSGYGKRGGTRDARLPTKILWMRRMRVLRRLLRKYREAKKIDKHMYHDMYLKVKGXMFKNKRVLMESFHKSKAEKAREKTLSDQFEAQRAQ

SEQ ID NO: 171852 - protein, 85 aa, Triticum aestivum
  Clone ID: PAT_TA_66270.pep
IYHPPRQPRLLLVAALSPSASRRRALRRAAVPPRAWGLGARPPSGSQTASPTASSRAPCSLEFPRTRTGAGGAPPAARECRCGGV

SEQ ID NO: 171853 - protein, 130 aa, Triticum aestivum
  Clone ID: PAT_TA_66271.pep
VLFELWGCSVVCSEVMDNIGMKENTKRHIVKRRTKYPRDILPDHLKHYRLDQINNTSLTFRHNRMYIRALELVRLGDASVEAYQTLMGLLDQAMPVMDPFDKCRDRLLGRPWITTMWQIPTGSELGEVCE

SEQ ID NO: 171854 - protein, 79 aa, Triticum aestivum
  Clone ID: PAT_TA_66272.pep
GRGGVRGARPAAPARAPRHEAEAEDADQRAEQAGEDEDQVRVERVLLRAGGHRLLEEPSRRHVRAQERAHELRRWLASR

SEQ ID NO: 171855 - protein, 47 aa, Triticum aestivum
  Clone ID: PAT_TA_66273.pep
MEWIKKMSSSSFIHVLEMAQLIEDKLFWVASLVTKEILIAETRVFIK

SEQ ID NO: 171856 - protein, 86 aa, Triticum aestivum
  unsure (1)..(86): unsure at all Xaa locations
  Clone ID: PAT_TA_66274.pep
GINRSNHKELRAVVSGHGHLESLSIWLDKDTEGIDDPCLPINDDFRPAGGLLXLKLHGHIGNLGGGGSTLTMLDLVEVSKSLAQNP

SEQ ID NO: 171857 - protein, 125 aa, Triticum aestivum
  unsure (1)..(125): unsure at all Xaa locations
  Clone ID: PAT_TA_66275.pep
HAPRFLGSLLLLLLCFAWWESRVAKSRSEAPVNTRIXDLIGRMTLAEKIGQMTQIERSVASADVMKNYFIGSILSGGGSVPAPQATPAMWINMVNEFQKGALATRLGIPMIYGIDAVHGNNNVYN

SEQ ID NO: 171858 - protein, 71 aa, Triticum aestivum
  Clone ID: PAT_TA_66276.pep
RVKTSAHNRDMLTAEQWREQSGLSPVQDCEYMLWLIDMTSYDMKQNDVYHQVNYCCPETNTRKKATGSSIA

SEQ ID NO: 171859 - protein, 104 aa, Triticum aestivum
  Clone ID: PAT_TA_66277.pep
FDMALLSTEGATQDLVRKVPILYFWYAEMEISISTSRNNSDSAHRAIYILSCLGSNIKYSSFGGPISRPLVLRARQGFKEQIRNLRSAFASGCLKEESIALICC

SEQ ID NO: 171860 - protein, 45 aa, Triticum aestivum
  Clone ID: PAT_TA_66278.pep
IAGKSELKYSALGTTLSAIAPMNFLDAQCRLILTGRMLYKAGMQE

SEQ ID NO: 171861 - protein, 54 aa, Triticum aestivum
  unsure (1)..(54): unsure at all Xaa locations
  Clone ID: PAT_TA_66279.pep
AAPAASSASSAIDFLTLCYRLKTTKRAGWVXRGVPGPQSVADHMSRMGVMALVA

SEQ ID NO: 171862 - protein, 116 aa, Triticum aestivum
  unsure (1)..(116): unsure at all Xaa locations
  Clone ID: PAT_TA_66280.pep
SSNDVKSEAVKEKIPKEESSIDVKSEEKPKVAQSDSSNLASEXITDGIKFSDTVIDFDNVKDFSSFSIVVDGLVIDCEFPDHLRETYYELCCAQKSFLHKELLKGLNLTLVVGAIM

SEQ ID NO: 171863 - protein, 93 aa, Triticum aestivum
  Clone ID: PAT_TA_66281.pep
KDADPARLQTSPLLPAAGWSDLPPDLVRRVADSLLAANDLDCYMDFRAVCSGWRAATDDPRSDPFDPRFRPRRWVILDDGDDLLLLNAATGRF

SEQ ID NO: 171864 - protein, 135 aa, Triticum aestivum
  unsure (1)..(135): unsure at all Xaa locations
  Clone ID: PAT_TA_66282.pep
MADQLTDEQIAEFKEAFSLFDKDGDGCITTKELGTVMRSLGQNPTEAELQDMINEVDADGNGTIDFPEFLNLMARKMKDTDSEEELKEAFRVFDKDXNGFISAAELRHVMTNLGEKLTDEEVDEMIREADVDGDG

SEQ ID NO: 171865 - protein, 51 aa, Triticum aestivum
  Clone ID: PAT_TA_66283.pep
VLAVVLAAAAVTPATAEQCGSQAGGAKCADCLCCSQFGFCGTTSDYCGPRC

SEQ ID NO: 171866 - protein, 132 aa, Triticum aestivum
  Clone ID: PAT_TA_66284.pep
FSHLASTGTDGAPDVHGVSTSSSRQGGGRPRARGGGDIRGMEGAGHRRRRAAFSMVDTLEVVNKWAPGTDGISTGRLDRSIDVRCGRGGVAMGTPSMVDAIAAEFLGGCSGLLGEAVFLETALEVSVPAGEG

SEQ ID NO: 171867 - protein, 155 aa, Triticum aestivum
  Clone ID: PAT_TA_66285.pep
FLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPFGVGTGVGSY

SEQ ID NO: 171868 - protein, 115 aa, Triticum aestivum
  Clone ID: PAT_TA_66286.pep
ASCRDMHGCIYFLFSNSVIIVWSNIILVFDPQSYISATDSNHIIFLHIFPFGIRHYTNSLSVTEAGPILILVPPVSLSLRRRVLRKPRNLLQATRVLYMSFNFFTRYCFFFMSSD

SEQ ID NO: 171869 - protein, 175 aa, Triticum aestivum
  Clone ID: PAT_TA_66287.pep
AAGWLQCGEPAKAIGVLGPMMLEGIRPNNYTLATAANACATLAGPSEGRKVHGYAIKLGEGSDVAVNNALIDMYSKCGLVDTAHRVFQSMRQRPVISWTTMIMGFARNGQPQNAVKVFDDMLLEGVTPNHITFLCVLHACSQGGFMEEAWIYFKAMTDKFRIEPGEDHYACMVDL

SEQ ID NO: 171870 - protein, 77 aa, Triticum aestivum
  Clone ID: PAT_TA_66288.pep
LQADGGICMPGLDDAAMPEGDYMDFPFFSNSDEFDLLNGENFLNSPHDTNQEDLFDPDPKGVLGADSVMQNMLHPDE

SEQ ID NO: 171871 - protein, 62 aa, Triticum aestivum
  unsure (1)..(62): unsure at all Xaa locations
  Clone ID: PAT_TA_66289.pep
MEASVQQGNYVQVYVMLPLDAVSVNNRFEKGDELRPQLKKLVDAGVDGVMVXVWWGLVEGGA

SEQ ID NO: 171872 - protein, 191 aa, Triticum aestivum
  unsure (1)..(191): unsure at all Xaa locations
  Clone ID: PAT_TA_66290.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTSTQPQQQQQQGQQEHGQGSSQPQHQQQQXQLDQGWIVAIGTWVIXTVPAMCDVHVPPYCYTTIS

SEQ ID NO: 171873 - protein, 166 aa, Triticum aestivum
  Clone ID: PAT_TA_66291.pep
QKPTKDWSCALCLVSRQCEAALNAHLGGTKHKAKLAQCGVSKTIKDGKNCSQTTTGNENSTDPCDAPKKICMLVDSAMHEVVRKDNYLWCDHCRVSCDNYATMACHLQCKKQSKLTKVCSSIKAVRTNTNTKEGLPSFGSQVNTNGSTEIPAVIESDINMTTAVDE

SEQ ID NO: 171874 - protein, 108 aa, Triticum aestivum
  Clone ID: PAT_TA_66292.pep
RPIRPSSHIERGPPLLLKFLLLATRTQGGNVVSLYTVNGTNPATTSLSYRPLYEAGGSSREKRREKKKRRRAQLHDDNDSDNGKAGRRDQIWCYGKGGNQSISPPQVR

SEQ ID NO: 171875 - protein, 63 aa, Triticum aestivum
  Clone ID: PAT_TA_66293.pep
ASLLPLRRSPLHSSRFQPRAAMASDAASQFQKIQIQREDTTFDAYVVGKENAPGVVVLQEWWG

SEQ ID NO: 171876 - protein, 129 aa, Triticum aestivum
  unsure (1)..(129): unsure at all Xaa locations
  Clone ID: PAT_TA_66294.pep
THTQNANLRKHGAPAHAVEDASRCLPNPSGSLLHTAAXPSYASSPPSSRRSPPRPPRRWSLPSSRPPLLRRALEPAGRRGHGARRPGPRRGRTAHGGLGRCGGGGRGREGAGHGAGRTARRRRRGGAVA

SEQ ID NO: 171877 - protein, 134 aa, Triticum aestivum
  Clone ID: PAT_TA_66295.pep
SDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 171878 - protein, 133 aa, Triticum aestivum
  Clone ID: PAT_TA_66296.pep
SQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPFGVGT

SEQ ID NO: 171879 - protein, 96 aa, Triticum aestivum
  unsure (1)..(96): unsure at all Xaa locations
  Clone ID: PAT_TA_66297.pep
MASIAGSAVSFAKPVKAINTNSLSFSGARRGNAFLRLQPVPMRFAVCCSAKQDTVEKVCEIVKKQLAVPXSTEVCGTTKFSDLGADSLDTVEIVMG

SEQ ID NO: 171880 - protein, 79 aa, Triticum aestivum
  Clone ID: PAT_TA_66298.pep
LIASHHEDMFILALLAFTATSAVAQLYTTCSQGYGQCQQQPQPQPQMNTCAAFLQLCIQTPYVQSQMWQASSCQLMRQQ

SEQ ID NO: 171881 - protein, 70 aa, Triticum aestivum
  Clone ID: PAT_TA_66299.pep
PFPLLCSGHETAKDLEIQLNSPTIDMHQHGRVSHAQPDYLAILEPNLELRKINQESPGEAKSEDWRNWGE

SEQ ID NO: 171882 - protein, 175 aa, Triticum aestivum
  Clone ID: PAT_TA_66300.pep
ALRDAASADPLGAGGVHGSLYASLRTNLPRESMGFLDFPFVADEGSIDPRRFPGHQEVLRYLETFARRFDLLGLVRLQTEVVGVRRSRVDGVGAGAAGWTVSYCSRKLAGGELQEEEEQSEVFDAVVVCNGHFAEPLLADIAGIGGWPGKQLHSHSYRVPDPFHGQVVVVIGYHP

SEQ ID NO: 171883 - protein, 167 aa, Triticum aestivum
  Clone ID: PAT_TA_66301.pep
TPLLRNLPDEIVLWEILARLDPRSLIRCRAVRRAWRRATSTRRFLLAHHARQPAFPIAADNRYRNFLAFDHRSAATADAQFHTVARLGGSFSLELCCDGLLLVAKSGMLGNRARLAVCNPVTRQHASLPPLPDFNILGMYLHGPTDEYRLLLQWRGAMDWGDDSDFD

SEQ ID NO: 171884 - protein, 105 aa, Triticum aestivum
  Clone ID: PAT_TA_66302.pep
TPCSPPPSLDLSLSPPPYLPPSVLPWPVAPSTPDPGDAISCAPPQSTALPRRLFRAGFHELGCCLLPSRALSQLFSTKMMKGSGSMPPWNSTLFNFFLLIPSTLN

SEQ ID NO: 171885 - protein, 86 aa, Triticum aestivum
  Clone ID: PAT_TA_66303.pep
PPCAAAAAALFTPADAVFTILSCLAKSLSFLLECCSFPRTAPTQLPVYVAVRCCRPPSSVTHSHYSLGSCRSVTDQSPRQWPTAAR

SEQ ID NO: 171886 - protein, 82 aa, Triticum aestivum
  unsure (1)..(82): unsure at all Xaa locations
  Clone ID: PAT_TA_66304.pep
LQDEDVLVPTLISSTSXTFFSEPLRWRQRFKSKSITHSPYIILPNHLVYYLTIKSSNLKNEGFNFFFGLWLKSSMPIDRKNI

SEQ ID NO: 171887 - protein, 71 aa, Triticum aestivum
  Clone ID: PAT_TA_66305.pep
VAWARLMAAVLRRRGSAHGGVQVVVQRRLGSPVSARLRAALGDAVGLSRGCRLWPVRLLAPLSGWPVWARC

SEQ ID NO: 171888 - protein, 100 aa, Triticum aestivum
  Clone ID: PAT_TA_66306.pep
KVGVQLLSSSSPFSRSGAWFNLHGGRWNRDTAASPPQAAFLSTSSERRGRRPGQSLIYSKFQKINPLTSMFVNFVRSAYGLMFLVCIVRIWEHGDGQLTS

SEQ ID NO: 171889 - protein, 136 aa, Triticum aestivum
  Clone ID: PAT_TA_66307.pep
NQAACFPERILYGDVISDNEAGRYQPRHSRSSSKSHKSSSSSRKSSPKTAAGCTSHRVKVIEQDGQICFSLRPQPACNAHCQPTQKVEKKIDFHCVSDSSASRHWAQMIKKGANPDFSQKGANKSLKVNIPESCRA

SEQ ID NO: 171890 - protein, 90 aa, Triticum aestivum
  unsure (1)..(90): unsure at all Xaa locations
  Clone ID: PAT_TA_66308.pep
LFIREPSQRVLQIGNQINQERRDSNNLSRDLQSALVDRKRIKEGPTNDFIRPXGKIRHTSSHTETTHNRSDSKREEKEGRCACGARGGKA

SEQ ID NO: 171891 - protein, 90 aa, Triticum aestivum
  unsure (1)..(90): unsure at all Xaa locations
  Clone ID: PAT_TA_66309.pep
MRAEGGGLGFLFLSDYCVQVWKKKTDCDGVASWVLGRTVALXNLLSMNSXEGSQSPRILGFAEDNNVVLLWTFIGVFKVHFESLQSKKLL

SEQ ID NO: 171892 - protein, 159 aa, Triticum aestivum
  Clone ID: PAT_TA_66310.pep
PGLTQTSLDMSKIQYNKDVGKSILESYSRVMESLASNIIARIDDLLYVDELSKQADQKLPSGVADDGKIACKNKKAAAMAAVPASGTTYVTPSFSPAQLSSPSKIGRALLVDRRAHHGRAAKSPRWRTTAAARRSRGCWSPAPCSTPRWARSCEPASDP

SEQ ID NO: 171893 - protein, 153 aa, Triticum aestivum; identical to SEQ ID NO: 132616
  Clone ID: PAT_TA_66311.pep

SEQ ID NO: 171894 - protein, 146 aa, Triticum aestivum
  unsure (1)..(146): unsure at all Xaa locations
  Clone ID: PAT_TA_66312.pep
PGRLTRLRAPPPPPTPLPXPATPPPTPPDRPPPPGPCATQSSPGPAPQCRASPPPSRTPSRWCAASPGPSTAGSPTSSPSSSATRARGPSAPSRASPSPSSSRGSSCAPPRRPGPAGPPPPSGPRPPARPRSPPTARPSPPATLGR

SEQ ID NO: 171895 - protein, 79 aa, Triticum aestivum
  Clone ID: PAT_TA_66313.pep
TYIGRRTSPVLKKRQQPGRTTHLVTNTRSASFLANRNAAPTLPLHTNAFASRSHAWQQTGLTRTQPKLELHRGNEREHR

SEQ ID NO: 171896 - protein, 178 aa, Triticum aestivum
  Clone ID: PAT_TA_66314.pep
AAAAATSAAAHSSPPAKEEPAAAAEAKPASSGEAVSLNYEEARALLGRLEFQKGNVEDALCVFDGIDLQAAIERFQPSSSKKTTEATLVLEAIYLKALSLQKLGKSIEAAKQCKSVIDSVESMFKNGTPDIEQKLQETINKSVELLPEAWKKAGSLQETFASYRRALLSPWNLDEECI

SEQ ID NO: 171897 - protein, 68 aa, Triticum aestivum
  Clone ID: PAT_TA_66315.pep
FPPNPKPKEHIMHATTTKEHEVNNISSKHKKVMDVSRHAVAQESCTDHEEKDPPIEPDQPPPDDKIPH

SEQ ID NO: 171898 - protein, 207 aa, Triticum aestivum
  Clone ID: PAT_TA_66316.pep
MTSVRDPSLPSATEISKSSGPAPETEPVILILSARQANILLSSLWTQALSPENVPRNYEAISHTYSLMLLFSGDKNSHLEILVGSFQLSFSLRNMSLQAGFLPPSRRRSLFTLATSMIVFFSKAFSVPTLIPVVKDLLIESTVDPFLRLVDDLRLQALDSGIESVFRDYGSKEDNDFATKSLSNIKLNDQSKQIAVSLILDNLKLSD

SEQ ID NO: 171899 - protein, 69 aa, Triticum aestivum
  Clone ID: PAT_TA_66317.pep
RAHLPRLLNGRRRQDYILRPYEQCSRLGARARAQSGLTYVHTRRRPYERSVIMAGMLPGVECARRRRMW

SEQ ID NO: 171900 - protein, 87 aa, Triticum aestivum
  Clone ID: PAT_TA_66318.pep
ICPHHRQRKKKVPNKLRKATKHPTNLARYEHLLDRNKQKFTCKNLTEVANKPKRTTKNLLSWSPARRRHLLNPICRNLARHEYMSKS

SEQ ID NO: 171901 - protein, 187 aa, Triticum aestivum
  Clone ID: PAT_TA_66319.pep
CLRVLHISCNDVNLMEFPEYVCQLKHLRYLLLRGTSISKIPEGIGDLKFLQAIDLVGSINLCQLPESILKLQNLRCISLYGTKITSIPRGFGKLKNLVNLQGITTHSDYSGDGWCSLEELGSLLKLKYLYITCLDKAPSGSVAARAKLSSKQHLIWLQLIFTSDFTVNWGGSRPSTFHRIISVLHLP

SEQ ID NO: 171902 - protein, 210 aa, Triticum aestivum
  Clone ID: PAT_TA_66320.pep
TSTLFAAQSMDLNSRSAAEASLKLFQEQNLSAFLLSLSAELSSDAKPQASRVLAGIILKNTLDSKDSEKKELLIQQWVNLDTSVKMKIKKSLLTTLGSLVAVARHVTSQVIAKVASIEVPRGKCPDDLIGILLVNLKEQAASAPLKQATLEVFGYVFQDIHPENLDQDQASVILTAVVQVASEAHLSSEVRLTAVKVLYSALDFAYSSFA

SEQ ID NO: 171903 - protein, 63 aa, Triticum aestivum
  Clone ID: PAT_TA_66321.pep
MERPAPVRKSHTNTADLLAWPEGAQPELADGATPPPNRRPHQPSEAIHKVVFGGQVTEEEAES

SEQ ID NO: 171904 - protein, 48 aa, Triticum aestivum
  Clone ID: PAT_TA_66322.pep
RGHRRQELGGGEGRGRHLLCLDDLLPAVPCLVPLCLCAWRNAAEWGRR

SEQ ID NO: 171905 - protein, 166 aa, Triticum aestivum
  unsure (1)..(166): unsure at all Xaa locations
  Clone ID: PAT_TA_66323.pep
MATPDEHADAEGLMGEHAEKEHADFEARVKRTIYIDHLSPVVTRQVIRAALSQCANVVSVEFIENYTIPYDIPAAALVELDDESQAKSAVDLMRDFPFIIGGMPRPVRASLARPEMFADRPSLPGSKMEFLWLKQGDPEYXGMSKLKSLAKRQEAENMALIKSILE

SEQ ID NO: 171906 - protein, 206 aa, Triticum aestivum
  Clone ID: PAT_TA_66324.pep
RGYTPTPTQIAPVDLSPTQIERAELYQFKKHLDDLLKEARLRLKTPDDFETNISVTLLKPWQGVLLKSAIAFASMKRPGAIQMRWKLGVTAVDVAMENQSINSKYVRLLNEFTWNMKALVDHARENDEISAESASKLLNELRKFHTNVSMVLARDRSRFLEALQQLPENVSSLADKLLSFGSVFRVFNSFADVAYRVSQMGGDPAL

SEQ ID NO: 171907 - protein, 153 aa, Triticum aestivum
  Clone ID: PAT_TA_66325.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLL

SEQ ID NO: 171908 - protein, 180 aa, Triticum aestivum
  Clone ID: PAT_TA_66326.pep
AGRSGSPRGIFITVRLQKQVARFQSMYLGTCDALLPLMGSRFPELGVNRTHCREMTWIQSVPYIYLGATAAVEDILNRTTSSTPFSKATSDYVRQAIAEDVWAEIFARFAKPEAGLMIMDPYGAKMSSLPETATPFPHRGGVLYNIQYMNFWFAATDGSAQTRWLRDMYAFMEPYVSKNP

SEQ ID NO: 171909 - protein, 95 aa, Triticum aestivum
  Clone ID: PAT_TA_66327.pep
SRQQQPPAPRRRRAGPQPPPPGTAGAQQSSSREGLSRACSPAQRLPLTAAGRGGRRGTGGLGAETRNPDLGALISAARSSGRPLPQQRHRACVPH

SEQ ID NO: 171910 - protein, 104 aa, Triticum aestivum
  Clone ID: PAT_TA_66328.pep
WKALRIRPTLAPCAWPSTAPPRPRLRTPLIQRRWCSRRASPGSMPPWGRPSTRPPPPAPSRSRAAAAATAPGPCRSWKGRIRRPRRSTAASPASAPPKVRASPS

SEQ ID NO: 171911 - protein, 126 aa, Triticum aestivum
  unsure (1)..(126): unsure at all Xaa locations
  Clone ID: PAT_TA_66329.pep
PAPGSAFPPRWCAWPLCDLRGNAFSTSASAVTAGKPADDNEHKDAPKKDIDDQIADIQILHNLWKYLRLNNSRDFNIRIVLSLGLLVGAKXLGGAEASLAGFTDANATLLALFASPAAVLIGYGIA

SEQ ID NO: 171912 - protein, 103 aa, Triticum aestivum
  Clone ID: PAT_TA_66330.pep
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIER

SEQ ID NO: 171913 - protein, 176 aa, Triticum aestivum
  unsure (1)..(176): unsure at all Xaa locations
  Clone ID: PAT_TA_66331.pep
TSGIVVNIGFNVTTVVPIFQXRVMREIGIETVGQGALKLTGFLKELLQRRNISFESLYTVRTIKEKICYVAADYEAELCKNTQASYEVDGEXGGFXXLSXERFKMAEILFQPQIGGVRAMALHKAVSLCMDHCYNTEVLRDHSWFKTVVLAGGSSCLPGLPERLEKELHKLLPPYI

SEQ ID NO: 171914 - protein, 91 aa, Triticum aestivum
  Clone ID: PAT_TA_66332.pep
MELELGLAPPTNAGRPPLGSGKRGFGEAFGEDEEQRRTSTTTLPLFDDGSSSSSCDSGSGGGVGGSKKALVGWPPVSSARSRACGRHVKVW

SEQ ID NO: 171915 - protein, 116 aa, Triticum aestivum
  Clone ID: PAT_TA_66333.pep
QIKSVYLLLECRSCMVRLVVWTVKYGYSVLESVLRFVSLVVQPIKVGCFLISPAPPCFSRTLLVLLQVRQSPSSFSMSDAQEQHLIGNIWYDVRWNMYEENASDSCEIKKKKKKKK

SEQ ID NO: 171916 - protein, 106 aa, Triticum aestivum
  unsure (1)..(106): unsure at all Xaa locations
  Clone ID: PAT_TA_66334.pep
AFFEXRNRADSLVSDIYDWGASAITIHGRSRQQRYSKNADWDYINQCAQKAPDDLHVIGNGDIFSFTDWNRHVSGSSKISTCMIARGALVKVSMYSSLHDLSCYIL

SEQ ID NO: 171917 - protein, 98 aa, Triticum aestivum
  Clone ID: PAT_TA_66335.pep
LTEKTMLNHPTAAPVSPTPAAPPILLVWTQAARINLTDLAYMRAAGVPWVGRAMKSGPHSDDDGLKVEPNLKFLPGSLVSCGREDPDPCQIQPDVVYG

SEQ ID NO: 171918 - protein, 106 aa, Triticum aestivum
  unsure (1)..(106): unsure at all Xaa locations
  Clone ID: PAT_TA_66336.pep
MAASALHQTTSFLGTAPRRDDLVRSVGDFGGRITMRRTVKSAPQSIWYGPDRPKYLGPFSEQTPSYLTGEFPGDYGWDTAGLSADPXTFAKNRELEVIHSRWAMLG

SEQ ID NO: 171919 - protein, 67 aa, Triticum aestivum
  Clone ID: PAT_TA_66337.pep
SPSSDRASCANIILLPGFSALLSRLSGRQEPKQQQPAGVLSQWTIEVIYGRNIIVLSCPGRSAAESR

SEQ ID NO: 171920 - protein, 52 aa, Triticum aestivum
  Clone ID: PAT_TA_66338.pep
LARDLRKQMEADDDVDPKAQRKAMKDLGLTRARHFGWPNTYVFTKSMGGDDA

SEQ ID NO: 171921 - protein, 155 aa, Triticum aestivum
  Clone ID: PAT_TA_66339.pep
MSPPTMFTLQLLLVLVAATTTAAPAVLGGGKHHRGVLSTPVRRLKPDVRVSKIGGGGAGGGAVTVTSVGEALRLWNNLTGGHFVIYVTAGTYEEQIIVQQRRTNVVLIGDGVGRTIITGALSDRTGHNVMQSATISVFADGFMARDVTIQNTAGG

SEQ ID NO: 171922 - protein, 94 aa, Triticum aestivum
  Clone ID: PAT_TA_66340.pep
AASRRAHRTAAGASGAGRDGVSTRAGHSVIAIVCRPEAANLPVQLPCADEEDDDLDAAVVAAAALHQVLLPPQDPASTRPARGGEVAAVHVSGV

SEQ ID NO: 171923 - protein, 64 aa, Triticum aestivum
  Clone ID: PAT_TA_66341.pep
SSCYPVVLVWSETDSQVFMMIVCMVGRASNVLCIYTIQIFVRCFSLHISPENLYMCMQPFLNWL

SEQ ID NO: 171924 - protein, 49 aa, Triticum aestivum; identical to SEQ ID NO: 147490
  Clone ID: PAT_TA_66342.pep

SEQ ID NO: 171925 - protein, 100 aa, Triticum aestivum
  Clone ID: PAT_TA_66343.pep
EFAMAQHLLVAADKYRMERLKLICEDKLCKNIAAGTAASILALAEVHHCHELKGACFHFLSSPKNLTAAMAGDDFENLRSSFPSLVKELIATCSIDASAQ

SEQ ID NO: 171926 - protein, 58 aa, Triticum aestivum
  Clone ID: PAT_TA_66344.pep
FCLSIKTFFLHCEEVLMHNPTLDPRGDMSCLCDVNFASESGDQFFIIYCLLDFSVSKP

SEQ ID NO: 171927 - protein, 76 aa, Triticum aestivum
  Clone ID: PAT_TA_66345.pep
TVIFFLISTYNPKVQMWNHRQGKIIEKQKHNLFYHASWFPSCTQRFCLLPRPNRVPDDVDDGKNPWLNRRSRRRGR

SEQ ID NO: 171928 - protein, 171 aa, Triticum aestivum
  Clone ID: PAT_TA_66346.pep
ASTYDAAASGGMTVFCPSDDAVASFMPRYKNLTADGKASLLLFHAVPVYYSPGSLKSNNGVMNTLATDGSARNYNFTLQNEGNVVTIKTGASGGVARVKTTLLDTDPVAVYAVDKVFEPVELFKPAPSPTPAPAPAPAADAPIAGNGGAARHRSPPAVADAPGPEAEDTAP

SEQ ID NO: 171929 - protein, 91 aa, Triticum aestivum
  unsure (1)..(91): unsure at all Xaa locations
  Clone ID: PAT_TA_66347.pep
DVISVSKELWVGSLGKXCCRALVRSKFEEFGPLTNFLFYPSKEFALIEYGNIVHAVRACGYMRGSSIWGGDLQXRYLDRLIGSKGFVGGIA

SEQ ID NO: 171930 - protein, 138 aa, Triticum aestivum
  unsure (1)..(138): unsure at all Xaa locations
  Clone ID: PAT_TA_66348.pep
MGKISIGXNGFGRXGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAXKVVISAPSKDAPMFVVGVN

SEQ ID NO: 171931 - protein, 185 aa, Triticum aestivum
  Clone ID: PAT_TA_66349.pep
LLDIFLRLPNLPDLVRAALTCRPWLGAVRSSPSFRRLFRAIHPAPLLGIFLKVDDDTAPSFAPLRRSDPVVTAALRRGDFFLTSLPLDDAWTVTDCRDGYILLWNTFWAVAVVNPMTWAVDVISFPDDVADGSLRDFAFLGFHLLTSDENPRSFRVVCLCADVSRVRAAVFSSETSDWAVHPWVE

SEQ ID NO: 171932 - protein, 172 aa, Triticum aestivum
  unsure (1)..(172): unsure at all Xaa locations
  Clone ID: PAT_TA_66350.pep
MSCSESTIVNQSLDHLLRCYDRFVNGSVTVSTDSTSTLNKNKKSAEHEHQQHVTPEGSPAEGTINVIMLGTSILKFIVDSTTIKLVNESKVXVWGFASSYTKYAVSAMKRHSEGSSFNGDDLKDILILTRSSFTYAAKLLHLVLASSSESSSPPEEAFLLXNNLLDLVPAVE

SEQ ID NO: 171933 - protein, 186 aa, Triticum aestivum
  unsure (1)..(186): unsure at all Xaa locations
  Clone ID: PAT_TA_66351.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSXVNIVSNASCTTNCLAPLAKIINDNFGIIEGLMTTVHAITAT

SEQ ID NO: 171934 - protein, 48 aa, Triticum aestivum
  Clone ID: PAT_TA_66352.pep
RPAVLRHADAGPPLVFRVSSSWPRLSQADQRRQTSGSEGVRRGWRRWA

SEQ ID NO: 171935 - protein, 196 aa, Triticum aestivum
  unsure (1)..(196): unsure at all Xaa locations
  Clone ID: PAT_TA_66353.pep
LASWTDVGRNYGPAGDVPELQNRIRELIERDINLVSIMQVMLIRRMLPCKRRPLRMWEFNPEGPRTIKHFFGLNLEGMCKLFFGPQVKCPDATEDAGLSCNHLDAQVSNLKAGHFIYIYHNYYSENPSVARNGSTRRRESGVRRHFPNARLVQLFQRCSAGRSEKSPQGKAXERAVKTHYASKPAESLPLLWRIAG

SEQ ID NO: 171936 - protein, 166 aa, Triticum aestivum
  Clone ID: PAT_TA_66354.pep
MATVPAPAAETAASTARTVKDVNPHEFVKAYSAHLKRSGKMELPEWVDIVKTARFKELPPSDADWYYIRAGEYMFSAFLVAYSIYSHVVLMSLPLSDFYLPFQIMTASMARKIYLRQGIGIGGFQKIYGGRQRNGSRPPHFCKSSGAVSRNILQELQKMGIIDVDP

SEQ ID NO: 171937 - protein, 199 aa, Triticum aestivum
  unsure (1)..(199): unsure at all Xaa locations
  Clone ID: PAT_TA_66355.pep
MAVGKNKRISKGXKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEK

SEQ ID NO: 171938 - protein, 49 aa, Triticum aestivum
  Clone ID: PAT_TA_66356.pep
MSGALLECCITKTYGRPVKRKEQEYHMAKYIQSLTMTDHLYHQKSEGVI

SEQ ID NO: 171939 - protein, 203 aa, Triticum aestivum
  Clone ID: PAT_TA_66357.pep
FINTLLAGSSLHEEAGKKRNFVETIELQIGLKNYDPQRDKRFSGTVKLPNIPRPRMSICILADAADIDRAKQIELEYMSVDDLKKLNKNKKLVKKLAKKYNSFLASETLIKQIPRLLGPGLSKAGKFPTPVAHAEDLQNKVNEVKSTIKFQLKKVLCLGVAVAHCDMTEDQVLANVMLSINFLVSLLKKNWQNVGSLHLKSSM

SEQ ID NO: 171940 - protein, 209 aa, Triticum aestivum
  Clone ID: PAT_TA_66358.pep
LGVRCVGRKDPEVRLDTHVSVWSVFSSDMEGVAHDMFYISMNYFVNRTSKRLQSTLYRAELDHLKTDEGVNLAYKLAETQLSLIYDFLYTKFGSLDGVLHRLTILIINCTALALFVLHHKGGKRRSEAGPGGGPESSRLEWSGKLRQYNLIDGIIQEEKTKGQYGRLKRMMWRIGIKQYHHATKHVAISPELDRRKSDASSKTCILYQV

SEQ ID NO: 171941 - protein, 72 aa, Triticum aestivum
  Clone ID: PAT_TA_66359.pep
PTPPPTLPARRRSSASRQSPPRRRRSAGAPAAPASSSTRAAGVPPPRLLRVSSSPRRSRASPPSSQSRGSPS

SEQ ID NO: 171942 - protein, 85 aa, Triticum aestivum
  Clone ID: PAT_TA_66360.pep
SASSSSAAALALLIQPRRTRHAASPRLRSPLPLDRAVEPSRRLGDCGPRLHSGSLASGWASGEGGRSGVFEEEERGGGKEWGGEC

SEQ ID NO: 171943 - protein, 130 aa, Triticum aestivum
  Clone ID: PAT_TA_66361.pep
TAPSVEDLCITVWDHKCRKKSHESYSKKTEVKWEASDPDFKHKNLARLTIYGFQSDGNFTRYVRRVIQAAVNIRKVSLHDRKACKLCAEKFPHAEVRPSGYPRTSEEMDSLRKKMAAASAVACPDIHFCS

SEQ ID NO: 171944 - protein, 95 aa, Triticum aestivum
  Clone ID: PAT_TA_66362.pep
CRTRPRTRRQANRKAGPATPGPGPTAASPASPRLRQSRPPGRRRPSRTPPRAPLNRLSPSSIQRPTPSSSPQGSPSSDPDGLSSAQFSPAQRGVC

SEQ ID NO: 171945 - protein, 114 aa, Triticum aestivum; identical to SEQ ID NO: 149432
  Clone ID: PAT_TA_66363.pep

SEQ ID NO: 171946 - protein, 163 aa, Triticum aestivum
  Clone ID: PAT_TA_66364.pep
MSIDDKEVVTYIDIVCKAFEGRVNIRPALSVLFVFEVLAWTVALIILFADNTHSVWPSLSITSLKIMSFFLILPTTFLPLRLLSFSSLLGVLSSAWLVAIIFANGFTSHTTPGSILVPAATSLWPEFGPGQAGIAIGLLMSGFGGHSIMPTICYDMRDKTHWR

SEQ ID NO: 171947 - protein, 150 aa, Triticum aestivum
  unsure (1)..(150): unsure at all Xaa locations
  Clone ID: PAT_TA_66365.pep
FSHRGRGYWVDLLLGGMYCDCGDVFSSQRYMDAHSLDLPVGCERYLGCRDYIPEPRAFRAVGCVGDSIKFVSITGFLERVDLVDDRMVRVWRLKEDMSWDVDYELKLGSLREEGAFKGNHLPTSMAPMYPFLNLXEDRVIYFALGSFRLT

SEQ ID NO: 171948 - protein, 213 aa, Triticum aestivum
  Clone ID: PAT_TA_66366.pep
VRAGAVSTRWRHLPHQLSLVALGIRHFRRATLAETMDAFAAALLSVCPPAERHCECQRSYAIKDLRLCFYPSAPHLSSIGRTVEDVLSCGRTESLEFLISLLPGEYTPSQLAEFGQQLMSFSRAYQDAFRCLTRLSLKGLAFGDSDVNDLIRACDKLKCLTLISCRLVHRHSVLKIDTPFSGLQELEFIHFVCRRIELISVPKLSKVNCHWSL

SEQ ID NO: 171949 - protein, 162 aa, Triticum aestivum
  Clone ID: PAT_TA_66367.pep
SFLVRRWLLPLILPDNAHGRCITGAPTTGPHLHSAARPPFSPPSLQLHMFWTRPLLPARLSHSNHDATAGWSPYGVAAASQRQRHPSVPTSPIRCRLSAKIPVVELCHGMRGHPVSALRHMTRGTTTPSGVADRGHGPTGARYVGSTTFRRGSLRASCGARS

SEQ ID NO: 171950 - protein, 124 aa, Triticum aestivum
  Clone ID: PAT_TA_66368.pep
QVPFVPISGFEGDNMIERSTNLDWYKGPTLLEALDQINEPKKPSDKPLRLPLQDVYKIGGIGTVPVGRVETGVIKPGMVVTFGPTGLTTEVKSVEMHHESLLEALPGDNVGFNVKNVAVKDLKR

SEQ ID NO: 171951 - protein, 119 aa, Triticum aestivum
  Clone ID: PAT_TA_66369.pep
HCVPQPVHSHPTKIQSKWQATPSRSSTSTGTHLSAATITRHSSAATTTHDAAQDLGRRRTPRRANCPATTTTSRPRRRVARRPGSQPTDGFTQIQIAEHHAAVSCVLVTADTHKPSEAR

SEQ ID NO: 171952 - protein, 200 aa, Triticum aestivum
  unsure (1)..(200): unsure at all Xaa locations
  Clone ID: PAT_TA_66370.pep
LVSPRLPHXDACALLSVSPWCHRALAANPKLWEVLDLHEMKKAGERLISALTLARYRHLKVVNLEFAQDIEDRHFLHLKETGAILLEELELLNLNACQKISDTGIGSATSLCPNLRALSIYWIVGLTDASIEHAVKNCKQIIDLNLSGCKNISDRGIQLVADNYQGLQKLDITRCIKLTDDALQKVLEKCSALESLNMYA

SEQ ID NO: 171953 - protein, 84 aa, Triticum aestivum
  Clone ID: PAT_TA_66371.pep
FDCGELHQTSLIYYSLHPKIINFILKLVVQSYTKLPTLILGRREYDAKPLVYMSGRFLFQLWWVWLGCHSSLILASLKCRLVAR

SEQ ID NO: 171954 - protein, 161 aa, Triticum aestivum
  Clone ID: PAT_TA_66372.pep
PSRAGSVAFDAVVKQGENAKKIVYSKHSDIVPKIATADSEAVEDEEYDKEVEETKERTVAALQKIVNVRLSAAQPKNVPTHDSESKFIKYKPSQQSAAFNSGAKERIIRMSEMASDPLDPPKFKHKRVPRASGSPPVPVMHSPPRPVTVKDQQDWKIPPCI

SEQ ID NO: 171955 - protein, 161 aa, Triticum aestivum
  Clone ID: PAT_TA_66373.pep
RGVRRRPWGKWAAEIRDPQKAARVWLGTFATAEDAARAYDAAALRFRGSRAKLNFPEDAAAATARRARDAATAAAAASSKPAALLESQDGDVMDYLDYSKILAEPEPSNVMGRLMGGDGNGRFLGSWSIGTSPTSSASSASLVVSGPASAPLFQCGSGLKQ

SEQ ID NO: 171956 - protein, 77 aa, Triticum aestivum
  Clone ID: PAT_TA_66374.pep
GQILSAQHQERCSSIVNHISSDLSSVASAMYKEFMNRLAAAEKARLNTHAMHLNPSPLDCTATALVVTQGTYVLIPN

SEQ ID NO: 171957 - protein, 96 aa, Triticum aestivum
  Clone ID: PAT_TA_66375.pep
TTDAIWMLVGRVPDFIFVPPRPVFFWYLFWYLLPPTTSQRFSPGPSSDAPRGGSDASGSERGLHVEKNLRKKTYERKPTRKKPTSDGARQRTPSLR

SEQ ID NO: 171958 - protein, 93 aa, Triticum aestivum
  Clone ID: PAT_TA_66376.pep
GCDLLEVTRYSFSPFFPSFFFSIFYSFILSSLSFCYLTFFNPLNMQSVHLNIKPSNAFKSSLPVSHEKSATSYILKKLVPTLSTCKVSTSTSH

SEQ ID NO: 171959 - protein, 154 aa, Triticum aestivum
  Clone ID: PAT_TA_66377.pep
SLHRPAAGCAPNPSPSAAPPNPSPIPFSRSPPPPPNPSPLPSSCPPPPPDSLVSSPMTRCLRSVAGKASRGFRKRVVVNDPVAAVAQPPHPSLSGGLSNPGLDLGFASGFWEFLSQLGDSIFFTISASLWRWLCFVIEVLDAVPSVLTRILLLV

SEQ ID NO: 171960 - protein, 109 aa, Triticum aestivum
  Clone ID: PAT_TA_66378.pep
RAERYSRSLCLGRPRQGFPAKRFFVTYKWHWWVIFCNFGDNFNHVPLEAIAHLLSGVDCAVSRPKCFFSLCCFPTFSVMRFSSCVWAKLGCLASSFVHNPLVRLRWQRE

SEQ ID NO: 171961 - protein, 66 aa, Triticum aestivum
  Clone ID: PAT_TA_66379.pep
MDAAGGAGGAVVVDKAGGQAPPKTLVDWALKILDTADPDEKARLGDLAATKWLRGAIPLPYDPAQP

SEQ ID NO: 171962 - protein, 100 aa, Triticum aestivum
  Clone ID: PAT_TA_66380.pep
EFNFSVAGDAASGGEVVAVEPVAPASETENGVGIETEPAATAEAPAASFLRPATKFRVLLLKLRKPKVPAQPQRRDDSLLQLQDGIQGAIAHCKRSFNAS

SEQ ID NO: 171963 - protein, 190 aa, Triticum aestivum
  unsure (1)..(190): unsure at all Xaa locations
  Clone ID: PAT_TA_66381.pep
MAVGKNKRISKGXKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIP

SEQ ID NO: 171964 - protein, 54 aa, Triticum aestivum
  Clone ID: PAT_TA_66382.pep
LLILTRIMTLQMLGAKLQQYFHLRQQTLVELTHVSIRHEALEFAEKVLTLIGNL

SEQ ID NO: 171965 - protein, 102 aa, Triticum aestivum
  Clone ID: PAT_TA_66383.pep
LLRLDELIQRCPRLRVLEVGNGWGLGKIRVHSPTIEELVVDYPYDVCGIDIMAPVLRKFEVWTWMSLDFSVSFNAPMVENPWWDIYCNFEKMSGLMSGACAD

SEQ ID NO: 171966 - protein, 90 aa, Triticum aestivum
  Clone ID: PAT_TA_66384.pep
GSRVRACLPPALQRASVDTHARTIRARGDCRARARPRWRTRTEVPCRHGASRARSRGKLVVRTSFPCELAFSDCLKGKDRRRRRRCLVGD

SEQ ID NO: 171967 - protein, 127 aa, Triticum aestivum
  Clone ID: PAT_TA_66385.pep
MTIQYSSYVVTVTLLLLVVAAASSRQKLSMAAPTTLPGCPDKCGNVSIPYPFGTQDGCFLPGFQIICNHTFHPPRAFFPAEYFRSGPDMVYSKPLIRTEHVYYNNTQNGDDMPRGISSFSPVELMGV

SEQ ID NO: 171968 - protein, 131 aa, Triticum aestivum
  Clone ID: PAT_TA_66386.pep
WLGTIPWRRDALAWVGAVAWGQRIHGGCMGLWAVAWGQHVHARRDAQALGSSLGAARQWRRGADSSRERTPVSVARVSPCSAGERRIPPRAEPAAVLASHHGRLRVIQSMAERSSSEDVIGKKGTRSSCRI

SEQ ID NO: 171969 - protein, 50 aa, Triticum aestivum
  Clone ID: PAT_TA_66387.pep
TEAHIMTGCSIGWEEPVRVDFVADHPFLFLIREDESGIVLFAGQVVNPEL

SEQ ID NO: 171970 - protein, 152 aa, Triticum aestivum
  Clone ID: PAT_TA_66388.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHA

SEQ ID NO: 171971 - protein, 31 aa, Triticum aestivum
  Clone ID: PAT_TA_66389.pep
SCHSYLSRSIYIMHVKSFNLDQADITDKVVF

SEQ ID NO: 171972 - protein, 48 aa, Triticum aestivum
  Clone ID: PAT_TA_66390.pep
MIEQSRGPLASCAQCELIKHKVCSSEWMKRSCVICLRKHKSSSLVPNS

SEQ ID NO: 171973 - protein, 136 aa, Triticum aestivum; identical to SEQ ID NO: 116005
  Clone ID: PAT_TA_66391.pep

SEQ ID NO: 171974 - protein, 37 aa, Triticum aestivum
  Clone ID: PAT_TA_66392.pep
ITSLLTSYYLATKARLLLLQVNFFLLAAVPTCSHACI

SEQ ID NO: 171975 - protein, 173 aa, Triticum aestivum
  Clone ID: PAT_TA_66393.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPG

SEQ ID NO: 171976 - protein, 107 aa, Triticum aestivum
  Clone ID: PAT_TA_66394.pep
HHTSTVSLPKRSELRLLGHPPEGRLEKWCSPFSRPYGHQFRVPPPSSSEPHQNPSALNICFSAASSPQLLPHQPLLFTALSSPWPLRVYPPAGISSCSALRPAATTP

SEQ ID NO: 171977 - protein, 183 aa, Triticum aestivum
  Clone ID: PAT_TA_66395.pep
EFGTSFHAILPKIAVHWLINLYRAARKLRSNAFQYCRDSTSSTKPSTEAISSSERTMPSAADRTVVCDFHGGLLRSTGIFPYFMLVAFEGGSLLRALVLLCFFPLVWILGERSDAGVRVMTFVTFVGLRPRDTDLVARAILPKFYMERLHAQVYDHLWLPAKRKVALTSTPRVMAECFLKEYM

SEQ ID NO: 171978 - protein, 57 aa, Triticum aestivum
  Clone ID: PAT_TA_66396.pep
RLGSNAPGLVPVTSTSCSPGTTVWSPSKGLAHQLSVFLKYPRPANQNSPNISYSYVM

SEQ ID NO: 171979 - protein, 46 aa, Triticum aestivum
  Clone ID: PAT_TA_66397.pep
RITFAKILLSRIAEYERLMKLLCNNLLVSWVILNLIWLFVYHPEVE

SEQ ID NO: 171980 - protein, 48 aa, Triticum aestivum
  Clone ID: PAT_TA_66398.pep
NPAPFFINTNQTQGPGQVERQYYLVSRGGLVNEDPGGGELGGGAPSFF

SEQ ID NO: 171981 - protein, 189 aa, Triticum aestivum
  Clone ID: PAT_TA_66399.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPG

SEQ ID NO: 171982 - protein, 150 aa, Triticum aestivum
  Clone ID: PAT_TA_66400.pep
IRHEGEPSRIRPSNRAELPRTPSRLPCADLPPPPIQPTTGKANPSQSRRQAGHLRHGAGGAAPHLRPPPPPALRQAQAPRARRLLLRAASPVDLLVGVPFLLLLLVAGRVASNLAGAGRLCDFLIDAEGLRAASGDAGFAARINWRLLSR

SEQ ID NO: 171983 - protein, 78 aa, Triticum aestivum
  Clone ID: PAT_TA_66401.pep
PKLKGFLVSKGYPNLDRQRLTKAFGKSFNFLYLTPPPWPGQTFNPPIPDFKKLAPQPFFGFPFSMAKSFQKIGPLGLF

SEQ ID NO: 171984 - protein, 74 aa, Triticum aestivum
  Clone ID: PAT_TA_66402.pep
QTDVYGGPRAQPGGEQQPAGVDPPGGFRPHLVALHRLHLRPRQGQGVRRPLALNQSFFVVSSKPLASIPKIGVM

SEQ ID NO: 171985 - protein, 63 aa, Triticum aestivum
  Clone ID: PAT_TA_66403.pep
GAFLTAFALKTKILFYRDGHKIFFAHIEFTLPGIPTQTFVFWAAIKKLGGGQIIFWEYIEKNF

SEQ ID NO: 171986 - protein, 122 aa, Triticum aestivum
  Clone ID: PAT_TA_66404.pep
MLAVSSARCLAADADEQRAEVAPMETVGDAAVVVDLDIDFDFTVDDIDFGDFFLRLEDGDALPDLEVDPADIFTDLEAAAAGVEEFQDQQVPCAELLAAVEDVGSVSPAGGIIGVDNTAFAE

SEQ ID NO: 171987 - protein, 186 aa, Triticum aestivum
  Clone ID: PAT_TA_66405.pep
INAHKSGNYLQSKYLWPNSIHTRGEGRGRLYQRDVGMATRERQRLGSGVVDCLPVAPEKTPAWPCLLGWRHLGNKAAQVTKGSQEQIGEHPPRTNSTPPREQPGRCEEDGPGAPTGDGDGEPATPLRLLRPTGPWADDKQHPSALGVSREEGPSMGDVEELIWVGLLFPLLHRDEGSTLRGLVPNS

SEQ ID NO: 171988 - protein, 97 aa, Triticum aestivum
  Clone ID: PAT_TA_66406.pep
NKLPLVLNRKTVQKSRGVIVYDINKRIYKEYRFRHKFQVSLVLKYRKQDNMLLIKLYTIYLLSNSLRTVLFLFKYFLNSLYNSSSIFNLHACISSFF

SEQ ID NO: 171989 - protein, 113 aa, Triticum aestivum
  Clone ID: PAT_TA_66407.pep
FTFINMSNLLKFPLQFLTFIAMASFTFYLTFINMAGFTFFCHVKYIQINMILVMIVAILTICTMTNFSFFLQHHIFILHGTVANIVYASRKLWCMDHGILKCTFYCMDYPIRL

SEQ ID NO: 171990 - protein, 89 aa, Triticum aestivum
  Clone ID: PAT_TA_66408.pep
LHARALQRENINYVKHHSHPMVSIILNNVVDSFLPKRQIHSSFCPSSAIIRVCCCNFFLKLSNMSYNFHAPTQSLILYWRSAELEVENS

SEQ ID NO: 171991 - protein, 160 aa, Triticum aestivum
  Clone ID: PAT_TA_66409.pep
MQSTGELYTWMVRGHLHPMTQFAHHLTAHGVPVTVTVADVPSTGMSSETIVGLAASYTCVSLHLLPAAATRSAQTADPDADPFIDLVGDLRAINSDLLAFLRSLPSVKALVTDFFCAYGFDAGAELGVPVYLFFTYAESVLAAYLHINVMRSTVSFRDMG

SEQ ID NO: 171992 - protein, 187 aa, Triticum aestivum
  Clone ID: PAT_TA_66410.pep
NSARGCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGF

SEQ ID NO: 171993 - protein, 132 aa, Triticum aestivum
  Clone ID: PAT_TA_66411.pep
ALLAEAPFLPPGGSRGQGSGSRPPRMPSGRTGAPAPATGQREEDEEEKATCRAGREGEGQRRTAAQPLEEEWDEEDAAMLCISRPRLLRPVLGFSHGRRANGARLGNLLARRISSLSLCCRWKCGGKVSCRI

SEQ ID NO: 171994 - protein, 81 aa, Triticum aestivum
  Clone ID: PAT_TA_66412.pep
YITRTHCLNISIVHHSYEHFTPICGVISYKIPFASSTSRGNHLTNEKYHPVSSFFISSLCRHLPLQLTCEPSATKCITNSL

SEQ ID NO: 171995 - protein, 29 aa, Triticum aestivum
  Clone ID: PAT_TA_66413.pep
KLRMHAQEPMFVHTYSLHINIEVCAGWIV

SEQ ID NO: 171996 - protein, 98 aa, Triticum aestivum
  Clone ID: PAT_TA_66414.pep
SKRSLPIVRSGRRFLPQVRAKYVPTPHEQGPAGSAVPPRGIAAGDRELAGGAWDRGGDAAPRERRRRRRGGERRVEEPLGWGRDGLVVMAQSVLVPNS

SEQ ID NO: 171997 - protein, 186 aa, Triticum aestivum
  Clone ID: PAT_TA_66415.pep
NSARALSLVSSHPLLFPMPPPPLPPPPPSPPPPLPPYRTTRLDKEAIAWEAGKRKTGGIPSRAPRISSFPLRCRQPLSLPSHAAAAPPSTRGAPSSPTVVARTTTAVPCYCSSFSSSSSQRRVLPSSHARRLGVWRRRGSSQSLPCSGSSRSGQPCRIGGRGGPGEAARGSIASCSNLLSLCLHGV

SEQ ID NO: 171998 - protein, 93 aa, Triticum aestivum
  Clone ID: PAT_TA_66416.pep
ILAEMLQDGRQMLAGERLVSHANKGACPDNQMIHPSLTLFRCSNEPSLYYLSRQQEMIDLESVMPTEEPLCSHAYKAKYKLFWLLEFKADHML

SEQ ID NO: 171999 - protein, 83 aa, Triticum aestivum
  Clone ID: PAT_TA_66417.pep
TEAYRSGQITSTLALENITSTWQFGLDQPRWNCGNHWLIIDSCGRCGLGGGQSRKQSMQLHMPTSTRWYCLPVFSKWLGHFSP

SEQ ID NO: 172000 - protein, 136 aa, Triticum aestivum
  Clone ID: PAT_TA_66418.pep
NPPMFGGPHPPQGLHEVEEVKKGSPYAYVRVIGFYNLRPGQWGSFFAFRPPGFEEFGKALTTSLNHGLCMKVFFGLNFCPPLCWATPADFSFYMVWVWMFEHRFSGMPMLILEPGSHIPNRGGIFYIPTPGPLFFC

SEQ ID NO: 172001 - protein, 48 aa, Triticum aestivum
  Clone ID: PAT_TA_66419.pep
CRCERYSSYRFRVDKPTPNPSSAVAEMSHFAPMAEPKPMCVRQAEEAK

SEQ ID NO: 172002 - protein, 121 aa, Triticum aestivum
  Clone ID: PAT_TA_66420.pep
MGGMAAEQEAPAPTRSPPHTYTIGYAMQPDKLDTVIQPSLVALAAERGMRLVAVDPSRPLVDQGPFHLLIHKLYDEAWRAQLEAFSAAHPAVPVVDPPAAIGRLLDRGSMLDVVSELNATV

SEQ ID NO: 172003 - protein, 82 aa, Triticum aestivum
  Clone ID: PAT_TA_66421.pep
GFVEEVGHGMRRALGLQLFNFDMIRGRKARGQYFIIDINYFPGFNKLPGYEIALTDFFDEMICGAAAATRDEADGTPASNVV

SEQ ID NO: 172004 - protein, 67 aa, Triticum aestivum
  Clone ID: PAT_TA_66422.pep
MDDMEHGVIGVRAHGACVHGLFARAAQGQVPVMEQYNAGILRWRTRHQAPTPIQATSVPVSSSARMP

SEQ ID NO: 172005 - protein, 74 aa, Triticum aestivum
  Clone ID: PAT_TA_66423.pep
TWAANRPAGSKTLNPGFRLALQTEVQRWRNPTPPHGPIYYPGKAKGEKKPNDQTRGLNPQAGGKERPKGGGQKT

SEQ ID NO: 172006 - protein, 123 aa, Triticum aestivum
  Clone ID: PAT_TA_66424.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYI

SEQ ID NO: 172007 - protein, 110 aa, Triticum aestivum
  Clone ID: PAT_TA_66425.pep
TLSGGLQCPGDAGVSQEAILERVNSMSKSKSYQLGHRLSLKWSTGNGPRIGCVKDYPMELRIQALEMVQQSTTLTKGIDSSGLVDGTDRPLAHLANVAARASADLPALAK

SEQ ID NO: 172008 - protein, 42 aa, Triticum aestivum
  Clone ID: PAT_TA_66426.pep
EFGTRIYVDPPHPAMASSLTTVSLSTFARTDRGDVFPRPQVA

SEQ ID NO: 172009 - protein, 159 aa, Triticum aestivum
  Clone ID: PAT_TA_66427.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIW

SEQ ID NO: 172010 - protein, 58 aa, Triticum aestivum
  Clone ID: PAT_TA_66428.pep
PAQAMEVGSGGNDGGGVGRHSVGLRVERSEESRSVCESVDENKSVGPRCLHHKARAEF

SEQ ID NO: 172011 - protein, 93 aa, Triticum aestivum
  unsure (1)..(93): unsure at all Xaa locations
  Clone ID: PAT_TA_66429.pep
MATLISIDVCNFTGTYRVESTKCMHGTGCIKLFTDNDCRLEICSXKKTILSVHDILSLMVDHCHGVIDQITXDCAEVLLCALKRADGTDFSNM

SEQ ID NO: 172012 - protein, 95 aa, Triticum aestivum
  unsure (1)..(95): unsure at all Xaa locations
  Clone ID: PAT_TA_66430.pep
SRPPSRPRTRPPAPLRPAASPPSAPREPQEPSARVAPAVPAPAPGRAPASSPPXPASSPPSPWPPSPPRCPSCSPASSRLVPNSARASMAMTSSF

SEQ ID NO: 172013 - protein, 106 aa, Triticum aestivum
  Clone ID: PAT_TA_66431.pep
MGGRLVPNSARGPDRPKYLGPFSEQTPSYLTGEFPGDYGWDTAGLSADPETFAKNRELEVIHSRWAMLGALGCVFPEILSKNGIKFGEAVWFKAGAQIFSEGGLDY

SEQ ID NO: 172014 - protein, 76 aa, Triticum aestivum
  Clone ID: PAT_TA_66432.pep
SSLPFCPTSRKLSSTWPIFSSPFDETCFLACSCLSYIPPRGRLHFWMYPMFIRVCPSYLFLKKPYGGACIIALIIQ

SEQ ID NO: 172015 - protein, 123 aa, Triticum aestivum
  Clone ID: PAT_TA_66433.pep
DVNYYAKSSKANRFTVMAAENIHQKRNTDMRKALAYDISDDQQDITRGKDIVDSLFQAPTDDGTHEAVLSSYEYVSQGLKKYDFDNTMVGFYIAPAFMDKLVVHLSKNFMTLPNIKVCIMTID

SEQ ID NO: 172016 - protein, 90 aa, Triticum aestivum
  Clone ID: PAT_TA_66434.pep
GRGPPIASDSGPSFWSACPLDGGGSPEGQPGGFSLGPNLLQPLFFLPNVGPLGPFELGYIVECGVGAIRGPPLMVCPERPTYDGSSHFGP

SEQ ID NO: 172017 - protein, 198 aa, Triticum aestivum
  Clone ID: PAT_TA_66435.pep
EFGTRCAEAAGAKKSRHKDKKEKKSKRKETAEHLGGEPATAEEEAVHKKKKKKHAEEEEKADPKRRPTVSIAVAGSVIDNAQSLELATLLAGQIARAAAVFRIDEIVVFDSSPAAENGGGAEEEEESGARFLVRILEYLETPQYLRRRLFPMHKNFKYVGLLPPLDAPHHVRKHEWSEFREGVTLGGDRSKGTLVDVG

SEQ ID NO: 172018 - protein, 119 aa, Triticum aestivum
  Clone ID: PAT_TA_66436.pep
VHGARSEPARLPALAAGAAVKSQPSGLSLSSLFLGAAARARAPGHDAQLGAVRAPGRVGLKLGHGARRPSPCSWAYWLEPWPWRAVALSLLLRGSRRSRLAAALAPGRGASWRWSSCRI

SEQ ID NO: 172019 - protein, 106 aa, Triticum aestivum
  Clone ID: PAT_TA_66437.pep
LETAQTMASMTGLSQGVRLPGPVGRRASRFIVRALSAEAEAACRRAVLGLMGSGVAGSAFAQVVHAVTVTAIKVVPPSPLCGGLPGTDNFDEARDFDLPLKNRFYL

SEQ ID NO: 172020 - protein, 73 aa, Triticum aestivum
  Clone ID: PAT_TA_66438.pep
RTPSLCFFYMLLLMTRKYSVWGSRGRHPCVSFICSNYGVLYARGVIWHVGRSGGCTWWVTWCFGGGGGGAPQS

SEQ ID NO: 172021 - protein, 48 aa, Triticum aestivum
  Clone ID: PAT_TA_66439.pep
ILRAYTDNTNINGTEGTIHRLLAQELGTSEAFPTLHGRAYPRYDQLHR

SEQ ID NO: 172022 - protein, 70 aa, Triticum aestivum
  Clone ID: PAT_TA_66440.pep
GGPSPPGPGPELTWGGGPPIFGLGPGFVLQIFGCQVGKVFSFLGTGKGEFRCPFPGLGSLVNTVVRGPFG

SEQ ID NO: 172023 - protein, 115 aa, Triticum aestivum
  Clone ID: PAT_TA_66441.pep
EHHGQAELCGAQQCEAMKIRSSAAWERAIDVALSVGGLRTSWPGRWKKPKKLTSYIVRRECIGRLNPCDNRDIEHFGSMLKKSQQPKKDPRRALETISLLSHLDTREKLKRSLLS

SEQ ID NO: 172024 - protein, 132 aa, Triticum aestivum; identical to SEQ ID NO: 155960
  Clone ID: PAT_TA_66442.pep

SEQ ID NO: 172025 - protein, 174 aa, Triticum aestivum
  Clone ID: PAT_TA_66443.pep
MAPAVMASSATTVAPFQGLKSTASLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 172026 - protein, 82 aa, Triticum aestivum
  Clone ID: PAT_TA_66444.pep
ERWTLCNVFRFEICILRSPFYARRRPWVGVFKRTKCILRRLPCLIRFGLISRGLPVLLRDTFTERHHVASLLIGRLSVMILF

SEQ ID NO: 172027 - protein, 89 aa, Triticum aestivum
  Clone ID: PAT_TA_66445.pep
TPRVFIFYRCAPPQYCVSPRALFQRAPRYPLCSRALRVCLIGTKAGQSVPLAHSFRHMCLSACVCTPSVCVYTKMLCALRVSCARARAP

SEQ ID NO: 172028 - protein, 68 aa, Triticum aestivum
  Clone ID: PAT_TA_66446.pep
APPPPPRLVCSGTSPTVIQDSIRTNYAHIERGEVKTHPINPRILSALINLPILSANKNSLNRLIVTDS

SEQ ID NO: 172029 - protein, 43 aa, Triticum aestivum
  Clone ID: PAT_TA_66447.pep
KAVDSSSTWDSSCLKSQPPATRTSGDILALLKRLTNASSLVPN

SEQ ID NO: 172030 - protein, 130 aa, Triticum aestivum; identical to SEQ ID NO: 157660
  Clone ID: PAT_TA_66448.pep

SEQ ID NO: 172031 - protein, 102 aa, Triticum aestivum
  Clone ID: PAT_TA_66449.pep
QTGYKLQFFDPRCIAWRDFRKKKVQLSLTKLTAEARGKTVPLCRVERSRIFQLLHSHSTVCPSSSISFQNFRNSLLVTSDILLHELLLPQYQVASCRIRHEA

SEQ ID NO: 172032 - protein, 91 aa, Triticum aestivum
  Clone ID: PAT_TA_66450.pep
MEEESHCPLRWESTGDQWWYATPIDWAAASGHYDVVRELLHLDANLLIKLTSLRRIRRLESVWDDDMRFADAATNRASVARCLLLDCESRA

SEQ ID NO: 172033 - protein, 159 aa, Triticum aestivum
  Clone ID: PAT_TA_66451.pep
MAAALLLSSRLPKSTAITSAAAPSPTPRFLSFPLTTDKACRRRAGCSILASSATSPSPAAQPFRSLAPSETTVLVTGATGYIGRFVVRELLRRGHRVVAVARPRSGVRGKNSPEEVVSDLAPARVVFSDVTDPGALLADLSESGHGPLHAAVCCLASRG

SEQ ID NO: 172034 - protein, 103 aa, Triticum aestivum
  unsure (1)..(103): unsure at all Xaa locations
  Clone ID: PAT_TA_66452.pep
NTAHTPTGGSRGELSSKQSLTYLDGTLPGDFGFHPLALTDPQGTGASIQPTRLXYAEIFNGRTAMMGVVGMIAPEALGKVGLVPPETAIPWFQAGAIPPAGTY

SEQ ID NO: 172035 - protein, 75 aa, Triticum aestivum
  Clone ID: PAT_TA_66453.pep
QVPQPGRTPQPGRPAGSQSGCNPACYTKSTAASTRHRQDGYTTTIVADKAYTVRSLHAAPSTVYFVPRTLIYKMS

SEQ ID NO: 172036 - protein, 160 aa, Triticum aestivum
  Clone ID: PAT_TA_66454.pep
MAIAEASPFADLPFPDDLPEFPHGPVGDDDAFALDGFDLDDLDIDFDFDLDLDLLPTDDVQLPSPPPPLATSSSSAGSPGGAGDSSSGSGGGADGGLKNDESSETSSRSASDKAGDGGEGEDAKRRARLVRNRESAHLSRQRKKQYVEELEGKVKAMQAT

SEQ ID NO: 172037 - protein, 56 aa, Triticum aestivum
  Clone ID: PAT_TA_66455.pep
DGQCEDYSYSLSRTSLKGRVRCIQEQWYFIRIHDVQISEKNLAFMTEYCYGVLLIT

SEQ ID NO: 172038 - protein, 134 aa, Triticum aestivum
  Clone ID: PAT_TA_66456.pep
VFFPPKKKEKKKIPPTKGEKNPKGPTKKGGGGPPPFGKPRGAPNKGNPRPKPGGPKRAPRRAGDPKFWPPKGGENSGWGKPRAKRAPGGKGYPPQNPKKKTTGKKKGKPGGAQRGAQPQKIGGKGFGGSKNQPR

SEQ ID NO: 172039 - protein, 37 aa, Triticum aestivum
  Clone ID: PAT_TA_66457.pep
NSARADHQHRRTSTAPRKVEQAAQRRVRPSSSPAVPR

SEQ ID NO: 172040 - protein, 58 aa, Triticum aestivum
  Clone ID: PAT_TA_66458.pep
IRHERQSASAPRLTSQNREPCSAKRADHPRPHRSGKRSACLPNMMLAYMDRAAAGAAA

SEQ ID NO: 172041 - protein, 73 aa, Triticum aestivum
  Clone ID: PAT_TA_66459.pep
QNPDYSNPHLLLVHCNKKTNAVQGYSIMASRIFACRYTILQTPYSLSVLLNLACDQHMQTWPFSALGAAFPSP

SEQ ID NO: 172042 - protein, 138 aa, Triticum aestivum
  Clone ID: PAT_TA_66460.pep
GYSFINVFFFFFFFFFFFFFFFLKTGKKKNFHPRHVGGPPTNGLKTTGTPPSQPNPKKIAGATSPIDPGAPPPEPPLAAGLDGNPPHTAQGLGKPEGEAAPQTPPGCSRGTPAQPPASRRPPKAPGPTPTRGGRPPRP

SEQ ID NO: 172043 - protein, 119 aa, Triticum aestivum
  Clone ID: PAT_TA_66461.pep
MVAGFCCTVGAPDFTPTNFLGKKLKKQVTSSVNYHGRSSKANRFTVMAAENIDEKRNTDKWKGLAYDISDDQQDITRGKGIVDSLFQAPTDDGTHEAVLISYEYVSQGLKKYDFDITMG

SEQ ID NO: 172044 - protein, 113 aa, Triticum aestivum
  Clone ID: PAT_TA_66462.pep
NSARVSPKNDVYSLGIIIIEILVGRRGYLEFHEMDDVTPFNKLVIEKWQKWICAMTSPCPSAEIDQVETCIKIAIKCVDRERENRPTVAEILNTLRETEKRFHLLGQSLPTPT

SEQ ID NO: 172045 - protein, 121 aa, Triticum aestivum
  Clone ID: PAT_TA_66463.pep
SGKSSILKPAKPGNGGKGCLVPSFHYFLLPAVCRCGRDALVPCRPAAHARPLPLFSPSRPRRSISPVGPLVGHARGSPLPQCGWSFQLERLSPSAVDSRRLRWVEFRRLGIAGFYRPVWKA

SEQ ID NO: 172046 - protein, 141 aa, Triticum aestivum
  Clone ID: PAT_TA_66464.pep
HQCTCPNHLWTLLHSARALCERISRPALKKSVPIGPPPHVLKKASPISLACCHVSTTNHPFPHLLPRLDNQPSFPSRDPPLHPPLENPTPTSPDLLCNSFPSHRRMPWRTVGELSSFPPNLLVTKIAPCTKVFAEHDLDLV

SEQ ID NO: 172047 - protein, 76 aa, Triticum aestivum
  Clone ID: PAT_TA_66465.pep
KMHQSISDSKAVRCGISFISILVVRYVLMCSLGKRRSVTHFQIAVKMLSSSFLGCSTSSFFFGALLTIPLRNTYKQ

SEQ ID NO: 172048 - protein, 31 aa, Triticum aestivum
  Clone ID: PAT_TA_66466.pep
RATFVNIGCPNTFTEDMFVRELHVMNALQAV

SEQ ID NO: 172049 - protein, 44 aa, Triticum aestivum
  Clone ID: PAT_TA_66467.pep
VWISCFGTCGFVVCCMPHVAGDSCWLTLGYRFFGPGAAVPRTSP

SEQ ID NO: 172050 - protein, 120 aa, Triticum aestivum
  Clone ID: PAT_TA_66468.pep
PRPPFLRPWRAPFPRWAPPRGSFPGLAPFPGFPSPVFFPFSRKCLFRKTGPWPPLVIRGPALLGGFFFFPLAPNFWRFFFSQGGCPLGPKKIRWSPIVGLGPFPFFFLFGLPKVIKVPFP

SEQ ID NO: 172051 - protein, 139 aa, Triticum aestivum
  Clone ID: PAT_TA_66469.pep
IRHEHGGCLALAELARRGLLLPSSFPDVIPVITKALHYDVRRGPHSIGSHVRDAAAYVCWAFGRAYTNLDMKAVLEQLAPDLLTVACYDREVNCRRAASAAFQENVVRQGTYPHGIDIVNTTDYFALASRSNSYLSVAV

SEQ ID NO: 172052 - protein, 39 aa, Triticum aestivum
  Clone ID: PAT_TA_66470.pep
SRRGAVPRNLVVWCSGDAPISLVAGAACQLSAMNLVPNS

SEQ ID NO: 172053 - protein, 149 aa, Triticum aestivum
  unsure (1)..(149): unsure at all Xaa locations
  Clone ID: PAT_TA_66471.pep
EFGTRASTPTNFLGKKLKKQVTSAVNYHGKSSKANRFTVMAAENLDEKRNTDKWKGLAYDISDDQQDITRGKGIEDSLLQAPTVDGTHEADLSSYEYVSQGLKKYDFDSTMGGFYIAPAFMDKLVVHLSKNFMTLPIIXIPLILGIWGG

SEQ ID NO: 172054 - protein, 92 aa, Triticum aestivum
  Clone ID: PAT_TA_66472.pep
LKMPTTFTSGLQIGRLFFIGKFTSCTFQRNLIHLQIPFEYEDRGNTVLQNPSQNPNQKVLHHLHLGPWAFYDLGLVLGCLGTSLHPLAATYK

SEQ ID NO: 172055 - protein, 98 aa, Triticum aestivum
  Clone ID: PAT_TA_66473.pep
MFVLFYWSMCVVLKLFAVLAGWLFFCVFYPLGTVLSGDVVGAAALRNPRSSEESERGEKGTGDGIASHGTDDVDDTHTCLRIGITTGFYNIAYEGWTH

SEQ ID NO: 172056 - protein, 158 aa, Triticum aestivum
  unsure (1)..(158): unsure at all Xaa locations
  Clone ID: PAT_TA_66474.pep
EFGTSDTAHQHLPPRAAPHLPAHLLRCGAPLPCLPSQAAPXPPPPTASHGTTPGTDPTAVMAGSGRPPAPXPGTDSGGSSPPRYQATGSRSTPSPPSPVPIQDPSSHAASGCEPSPPTARAPPAIGPAITPMASPPSPPGPSINSGYAPAKKPPNPGD

SEQ ID NO: 172057 - protein, 168 aa, Triticum aestivum
  Clone ID: PAT_TA_66475.pep
NSARGRLEIFTGARRSYPVLGGRLHFVKFETGKLNECLDFISSKQLHRGGVDSPSWRSGAQPDNIVIKATGGGAFKYADLFKERLGVSLEKEDEMDCLVAGANFLLKAIRHEAFTHMDGQKEYVQIDQNDLFPYLLVNVGSGVSIIKVDGHGKFQRVRGTNVGGGTYW

SEQ ID NO: 172058 - protein, 203 aa, Triticum aestivum
  Clone ID: PAT_TA_66476.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDT

SEQ ID NO: 172059 - protein, 132 aa, Triticum aestivum; identical to SEQ ID NO: 155960
  Clone ID: PAT_TA_66477.pep

SEQ ID NO: 172060 - protein, 77 aa, Triticum aestivum
  Clone ID: PAT_TA_66478.pep
KTLNSNSETTAQFKPLKFKMESPGEGGPTISLKLKSTMDPNMPYWIGYHPGASDPKVHQTFSPGDLIGTQDWIKWGI

SEQ ID NO: 172061 - protein, 50 aa, Triticum aestivum
  Clone ID: PAT_TA_66479.pep
AGVSVDADGLPLALGRRHGSSCLEQMRRDLVASVRVCVRAQQLLLVSCRI

SEQ ID NO: 172062 - protein, 142 aa, Triticum aestivum
  unsure (1)..(142): unsure at all Xaa locations
  Clone ID: PAT_TA_66480.pep
MRCPALLLLPLLAAVLLHAAAAAGGGNGSCVRSCGRMTLPYPFGFSSGCTVRLGCHVGADGVGAAWLGGAPELGLLVRNVTPRALTLNLQPDCDRSFNASVAALFSDSYAPSSRNGLVVRSCSXREADRIRNCSSDYINRTT

SEQ ID NO: 172063 - protein, 130 aa, Triticum aestivum
  Clone ID: PAT_TA_66481.pep
TLTSIHKVAELAFRCLAFHSEIRPSMAEVADELDQIQVSGWAPSADDAAFMSTTSSLCSSAPSRGTDKSLGPDKGRGEALPTSAPATTVAERETEKGAAGSSPVSVQERWFSDRSSPSSNSLLGNSSSLH

SEQ ID NO: 172064 - protein, 46 aa, Triticum aestivum
  Clone ID: PAT_TA_66482.pep
VTSWITLAEKTASKWTILKCAYTVTCSSNLNQSACKLANRRFLLND

SEQ ID NO: 172065 - protein, 83 aa, Triticum aestivum
  Clone ID: PAT_TA_66483.pep
SQPPRIFWWLLTSTLLQLCNNSCNLQFLPSQQNHLLSMSAASDMDFSRRKFRRSVPDIPSQILMVKWTVCESVYSVPTEAVMG

SEQ ID NO: 172066 - protein, 51 aa, Triticum aestivum
  Clone ID: PAT_TA_66484.pep
KTILPFIMKWFDQISPINESGGMHRTRRHRPRRNYVRMPKNLCPYIHTQTI

SEQ ID NO: 172067 - protein, 51 aa, Triticum aestivum
  Clone ID: PAT_TA_66485.pep
AEEGAPGAGQHIGGELRDGGGGGGGEQRHGVRCIALGLCWRCRVWLLVPNS

SEQ ID NO: 172068 - protein, 103 aa, Triticum aestivum
  Clone ID: PAT_TA_66486.pep
FGVDPLLPLQMDAAVERLKTGFEKFKTEVYDKKPDFFEPLKAGQAPKYMVFACADSRVCPSITLGLEPGEAFTIRNIANMVPSYCKNKYAGVGSAIEYAVCAL

SEQ ID NO: 172069 - protein, 47 aa, Triticum aestivum
  Clone ID: PAT_TA_66487.pep
RMASSAPPSLSSSSKVQPSQLIFQVEPSGSGQVCLALSGRMRARAEF

SEQ ID NO: 172070 - protein, 101 aa, Triticum aestivum
  Clone ID: PAT_TA_66488.pep
MARAAAAEAFSRRLGAAVRGLSGAWYNRHMAAADRAIRARLPLVDLVLEVRDARVPATSAFELLHRRSPEEPDVRRLVALNKADLADKSETEKWVALMKQR

SEQ ID NO: 172071 - protein, 64 aa, Triticum aestivum
  Clone ID: PAT_TA_66489.pep
LQMQAYLIKIHDLQLPKNLKKDIKTINMDSYRLICSHLMPQYILTISSETYKISNVLAHVFFMV

SEQ ID NO: 172072 - protein, 87 aa, Triticum aestivum; identical to SEQ ID NO: 115757
  Clone ID: PAT_TA_66490.pep

SEQ ID NO: 172073 - protein, 159 aa, Triticum aestivum
  unsure (1)..(159): unsure at all Xaa locations
  Clone ID: PAT_TA_66491.pep
CDTVGGSFSNYNRAIVETVSTRYGXADVTYAVLSNGVEGRVTVKLACLDGEGPAGVLGRIVARSKLFNAGCVLFCNEHGDGNNMRVGSGELVPLARHVLAVPLHMPLTVELDLRRDSGDEIVRGAVAFHPATDGQHMELVMGAGGAVIEVSISWSDYPW

SEQ ID NO: 172074 - protein, 196 aa, Triticum aestivum
  Clone ID: PAT_TA_66492.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQ

SEQ ID NO: 172075 - protein, 78 aa, Triticum aestivum
  Clone ID: PAT_TA_66493.pep
QRRAERINQASSLARPQNQEQERQRFVERGRGRDRIKARGRVPWMDGGVLECRKGEGSRKGGGYGVRRCMFSLLVPNS

SEQ ID NO: 172076 - protein, 120 aa, Triticum aestivum
  Clone ID: PAT_TA_66494.pep
MLTQNPLLSATVVGTDQEMYWTYNLVKEDIITRNIIDSSGKVKMFFWSKQARDWQVVYAQPRALCDVYAICGPFTICIDNELPYCNCMEGFTITSPVDWELEDRTDGSDCPKSRSCYKRE

SEQ ID NO: 172077 - protein, 194 aa, Triticum aestivum
  Clone ID: PAT_TA_66495.pep
NSARVEVEGICDRAARKYVARKMGLGGGGLGMPPVVMRVDLMSAYAQHLRDIIKERVAHPTHYDTPLEGFKVIVNAGNGCGGFFAWDVLEKLGADTTGSLHLEPDGMFPNHMPNPEDATAMSLTRGAVLARGADLGVVFDTDVDRSGVVDGAGAAINGDRLIALISAIVLAEHPGTTVVTDARAGDGLTRFIEA

SEQ ID NO: 172078 - protein, 154 aa, Triticum aestivum
  Clone ID: PAT_TA_66496.pep
IRHEPSSIVPPSPPSSGEMLLSELPNPPRPWRPRVREAHSARPRHLPLPGSPTTPLPRRRHLLLSPSATPSDDPALPPSRRPSHPKRASGEGEGWTKKAVPPGTLGLSSPVPEEPLSPPRWTAARQARTAWRKATSIVPRRARSVMLLNLLVLI

SEQ ID NO: 172079 - protein, 136 aa, Triticum aestivum
  unsure (1)..(136): unsure at all Xaa locations
  Clone ID: PAT_TA_66497.pep
MAPASPFMTWSPPTASASPSTPTTSTTPSSPPAPRPVLPPAASHQMVTRLKNNVIKTLKPSDGTVRYDPRRRAFLPVPTSSRQALSDERWRAAMLEEFRALQANNTWSLVPRPPRQNVIGXKWVIKVKEHPDGTIP

SEQ ID NO: 172080 - protein, 133 aa, Triticum aestivum
  Clone ID: PAT_TA_66498.pep
MSCFPCSGSSGKAGEDAAALSPSPRPSAAKPAPDRYNSRSSSSVRRGGSAPHGPAKIFTFRELAIATKNFRKDCLLGEGGFGRVYKGHMENGQVIAVKQLDRNGFQGNREFLVEVLMLSLLHHPNLVRLIGYC

SEQ ID NO: 172081 - protein, 70 aa, Triticum aestivum
  Clone ID: PAT_TA_66499.pep
RGASWLQACCAFVQFMKLSSKLFWKAVFRSSHIPVNVEVHENAEMDTHALHSPACVSSVLGLCYVALLPY

SEQ ID NO: 172082 - protein, 67 aa, Triticum aestivum
  Clone ID: PAT_TA_66500.pep
PPISNGNYNNIKDRPGGRPSAPNAALCIKPQTEPKKKTVRSTILTAHPNNNRPLPTISGGKFCRGPW

SEQ ID NO: 172083 - protein, 127 aa, Triticum aestivum
  Clone ID: PAT_TA_66501.pep
TQALVPNSARDRRWACRIVSPADLSLVDLLRSVRRSSSFVFRLNPFDLHSSSAAVAVLVCWFYGALARRLPDCLLQQSLPGSGEGGAMTAARLRLASVLIVVTRWSTDLDVIFSISSFRCTTMIEDE

SEQ ID NO: 172084 - protein, 204 aa, Triticum aestivum
  Clone ID: PAT_TA_66502.pep
NSARASESRAWSPVTSCEHPDLPLHVISSRPNALVGDAVYFLCHQETFILQYDLLNQELSMIYWPPLPKCKCDEYIVMATEDGELGCATLKESKLELWSMEADAGGAVKWVTRRVVDLQNLLPSPPRFLVCCANGVHVFFARTDLGTFTVELNSGRVKKVSSSSEVIPYMRFYTPDLAPSTMASSSENIETAQDEHHDQLLPHS

SEQ ID NO: 172085 - protein, 244 aa, Triticum aestivum
  Clone ID: PAT_TA_66503.pep
NSARAFSDQDDQNKVPHFPPPFFRMVAPRESPKYFISAFGTRILAMHPRDPAGDLLEGYFPMLDVRSRCVTTGPGQRDLFYPIYHLPVGNKLFTMSSYSFEMLCLESFEMLCLEELSAKVSHRDSSKEWSWKELEQQPFNVWDVTSYSLHPEERTFLISTKEDTTEATYSFDTERHSWKLLGNWVLPFDGQGHFDQHLKAFVGLSKEPDTLGQIYCCDVPIYGTPEGRCPVPSMNLCKENLFIS

SEQ ID NO: 172086 - protein, 68 aa, Triticum aestivum
  Clone ID: PAT_TA_66504.pep
KTKDSTLTETQECRLYKNILYKATGLQRSENKIKLIMRTLPLQHSTSKRPQDLERVTTWGLFWTLCKT

SEQ ID NO: 172087 - protein, 89 aa, Triticum aestivum
  Clone ID: PAT_TA_66505.pep
LIPGGLFFMGGKKPLFFRGFRPRNFKNFGLGGLRPIFFENLIWGVLNFLYKNRPLGWFGKTVIFFIWTGLYPGVFLGKRRGWGYIPFGF

SEQ ID NO: 172088 - protein, 99 aa, Triticum aestivum
  Clone ID: PAT_TA_66506.pep
RRAATSRPDLRGLAVSSLAKPYVKAGLAARNEAGARQGIEAAASSWEQRERRLQLRDSPLSTRLGSDIFSMPRRRVKLTPMVLLQHVIFIAVALSVFSR

SEQ ID NO: 172089 - protein, 213 aa, Triticum aestivum
  Clone ID: PAT_TA_66507.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELK

SEQ ID NO: 172090 - protein, 168 aa, Triticum aestivum
  Clone ID: PAT_TA_66508.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQD

SEQ ID NO: 172091 - protein, 133 aa, Triticum aestivum
  Clone ID: PAT_TA_66509.pep
LKRSNWGGGGQTVGPSLINPPLVPAGPQDQDFFNGNNWPNGPRGFQQTQIKKGGPKKLLTQPGNLGWQKQPGKKGFQGIRKGGGLNFKRPAENPNQGGKSKKPQMDFPGSNWGAENLSWNNPGKTWGPKMGGP

SEQ ID NO: 172092 - protein, 69 aa, Triticum aestivum
  unsure (1)..(69): unsure at all Xaa locations
  Clone ID: PAT_TA_66510.pep
MAAPAIHPFAQXITGPPGSPDHSMIAFCPNTTEVHIYKFFTDKWEKLHVLAKHDQIVSGIDWSRSSNKM

SEQ ID NO: 172093 - protein, 74 aa, Triticum aestivum
  Clone ID: PAT_TA_66511.pep
MANDIDAAPIDGEYGAKDYSDRPPAPMFNTQELTKWSLYPADVSEFVATLLLVYITAAIVIRYNHQTDPTGPIA

SEQ ID NO: 172094 - protein, 56 aa, Triticum aestivum
  Clone ID: PAT_TA_66512.pep
PPSAGGISTNLSMDDRKRGQYIYQCNTVQITYSARVCILLHAFGCVLNFPSIAPNF

SEQ ID NO: 172095 - protein, 145 aa, Triticum aestivum
  Clone ID: PAT_TA_66513.pep
NSARAPPCPPPSRATSSYGCCCHRPLLASTSAPARSRGARLTLTLRSPSLPPPAGPLIRSGSRRVACRADDEPEPAASNGHEAVADAPSPPPDSVVQEDAAAETDSAADSTAQTKDESPNAEPVSASDTVQNIDGDATAAADSAA

SEQ ID NO: 172096 - protein, 86 aa, Triticum aestivum
  Clone ID: PAT_TA_66514.pep
VFRVGPLGPPNEVQLLGCPGGVEMGLKALGDPVKLGNGVAAPPGDPLNFPPLIPPRVLANPPPQNQGVPRKKPNLLPGPALGAKPG

SEQ ID NO: 172097 - protein, 101 aa, Triticum aestivum
  Clone ID: PAT_TA_66515.pep
IRHERPSPLCRPQGAPGSGPPSPAAATSCWRSSPSRSSSFSPLGTSARKGGHHSPWRTAASSLPHSLTSSLPPQYLSTHDHGDSTGGAASRCCCVKDRRRG

SEQ ID NO: 172098 - protein, 61 aa, Triticum aestivum
  Clone ID: PAT_TA_66516.pep
SLSHTVLQLLHAIPCSLMFYALGPCRIPSMCLGSHTGRILTCFEHTLGYHQLTCMREGRFD

SEQ ID NO: 172099 - protein, 88 aa, Triticum aestivum
  Clone ID: PAT_TA_66517.pep
RRAGGKKRPDRLWNYLGGCFRVPLRFFFSPGKVSPGGGGGGPLQTILGFCLALSAWEIFLGPPVFDYLEGGGGGLTKLVPPPCLGFVR

SEQ ID NO: 172100 - protein, 227 aa, Triticum aestivum
  Clone ID: PAT_TA_66518.pep
NSARGNAMMEYANVTVPKPKVAPESNDEPNGRLNGFAEVDDFSDQTGSGHDFRPSSFSSAKHYEDQIVDRGFPVSKRGEVNNTVKARDVNLNSCLDTISFPIASANNQTSTAVDEANQSSIAGKCFIGSFNNNDGASTTSSCSGSNNKVSGSLGGSNGSSNAARCIGGSYGNDAAANIFGNKNNTMVYQPSLNTCPISHVATNVDSLVSRSTHAKNSDKERAYYTKE

SEQ ID NO: 172101 - protein, 122 aa, Triticum aestivum
  Clone ID: PAT_TA_66519.pep
CRRCQNDIFLFSFLILGRCSNEVQFLQPTFSGVSSSQVQFEVRSALRWGQSIVQAEKWTRRDEPGGSCSFYWVRCDSHRVGRGMRFRVDVGEVVFVCVCFSHVYIISFSLLLCGCLLVQTYI

SEQ ID NO: 172102 - protein, 213 aa, Triticum aestivum
  Clone ID: PAT_TA_66520.pep
IRHERRRRRCLPVPKAGAFPPRRAAAPLSASNLPASEQTPPPTSTPTSTSPARPSPAFAAGGYRAAGPGEDPLVSKLRTQLGVIHPLPAPPPLPSLPRSVLGLFALFFFVGAAFDKLLTLRRRRRAEREVRVNGSWPQVPTSGFSLFLEEKDLQRKESVEWVNMVLGKLWKVYRPGIEGWIVGLLQPVIDNLQKPDYVNRVEIRQFHLGEEPL

SEQ ID NO: 172103 - protein, 60 aa, Triticum aestivum
  Clone ID: PAT_TA_66521.pep
RWKFGFRGHVCISDHGGGLGDFNRWVISIFGAYCLREIGREIRFFPVKGLWFGLSLWEKQ

SEQ ID NO: 172104 - protein, 63 aa, Triticum aestivum
  Clone ID: PAT_TA_66522.pep
RATVGRHNVCVCQSAEEFVFGCSQMFHVRVLHLLVVVYDIISLLRYTGLSREIFCLLKKKKYP

SEQ ID NO: 172105 - protein, 126 aa, Triticum aestivum
  Clone ID: PAT_TA_66523.pep
ELKEASHSKMSNCTSSKEATLDSVPISVGKIVGCVLAFLPCRALRFCSTFVNLAICSIAFYLFFIHWKILMAPKYFICDPFLNQIISRQLCRSKLVTWHRIVIRKISTNCMFSFSLASLTIKHDVS

SEQ ID NO: 172106 - protein, 189 aa, Triticum aestivum; identical to SEQ ID NO: 171981
  Clone ID: PAT_TA_66524.pep

SEQ ID NO: 172107 - protein, 211 aa, Triticum aestivum
  Clone ID: PAT_TA_66525.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKE

SEQ ID NO: 172108 - protein, 130 aa, Triticum aestivum
  Clone ID: PAT_TA_66526.pep
AFVTHCGWNSVLETVMAGVPVLTWPMVFEQFITERLVTEVLGIGERLWPCGAGLRSTRHEEHEVVPAGDVARAVTAFMLPGGAGDAARSRVMDLAAKCRAAVAEGGSSHRDLRRLVDDLMEARAKKNCLA

SEQ ID NO: 172109 - protein, 226 aa, Triticum aestivum
  Clone ID: PAT_TA_66527.pep
EFGTSTELRAIRQDKYGWILHGESEWQSQIQQLVHERGIFPICQVSTEPAWQLCAVEGPYRMRKKLENSKFKIDTIQNVLTSSLGFDDVTRAKEEDGDMMTSGSDTMSGLNLLTYDTEQRELDAADFASFKEDDDIFKGGSTASPPIGWTDDKSSINEQSLHSANDFGAKSSSFSYHMSESVQGRSELYSPRQPPSVKGTDTRTSEDKSDKELLDNGEYLIRPYME

SEQ ID NO: 172110 - protein, 57 aa, Triticum aestivum
  Clone ID: PAT_TA_66528.pep
PGKPYQLIYLPKWREKSTTSLWDQQTQNESREKEKEAANMTGSPSGAESGKTIQFGK

SEQ ID NO: 172111 - protein, 193 aa, Triticum aestivum
  Clone ID: PAT_TA_66529.pep
KLTDRSAILYRLRTESLGGNTETESRRPAIQHACPDLADAENHGLFSYLPRIVLFLAKRRCVGSWTVAERGGRCCFRCWFSRSPRFSVTKSALSGLIPAFLHVDKDRTFGLGQRGVRCDRRLVRMKSFGRRGLPARTLSFPSSLRAFFLDAPPDQGLLELIQHAPPDDAADGCTLSRMMYCTSVLPLALARSS

SEQ ID NO: 172112 - protein, 122 aa, Triticum aestivum
  Clone ID: PAT_TA_66530.pep
KVNRLRNGETLGEQSRVVAPQEDRIRHKKEKGTRIVACSLRLRVVGTQIKEANRERGVSRRQEHRAGSAQVPGGRLGGQDHEGSSTRRSFLCSDSTLLPPASVLGVPPCASIIAIDGLPLEG

SEQ ID NO: 172113 - protein, 163 aa, Triticum aestivum
  Clone ID: PAT_TA_66531.pep
MGVDNPPPITGSGSDDGAFAFISKGWREVRDSATADLQLMRTRTDRELGRLLASASALAGPGPAPPVAAGAPFAELEFVRKRIQPKIAELRKQYSSTVLDGWPPKSGASLRVDLSGITAIRNAIVSSGKADGGDEGNKEWEVVKMIRNGLKEFERRSLSSEMS

SEQ ID NO: 172114 - protein, 84 aa, Triticum aestivum
  unsure (1)..(84): unsure at all Xaa locations
  Clone ID: PAT_TA_66532.pep
KVFKNKNGQCGKGVKRKGVRKLRLLPQFSDILDGGLAFAHYWATGNXILRMATGATPGTRGYDKPPGLDLNFLPPQIQPPGYGL

SEQ ID NO: 172115 - protein, 63 aa, Triticum aestivum
  Clone ID: PAT_TA_66533.pep
VPGFNFQVEQVLSKEFLFRENRVAGNGTPSLGPYVIRPGGPADAFWAAGQGNRGTSEEKTRRK

SEQ ID NO: 172116 - protein, 115 aa, Triticum aestivum
  Clone ID: PAT_TA_66534.pep
MCLERPCQRPRTAGTCGPREQRSISYQNRLMKSQVWLRCHSQTCSKVNLHGITRNNNHDKSITHNTRTGSSARTYLSTRATSAAKDQFCRRIKLCAAPGEGLLNKKHKRITQQET

SEQ ID NO: 172117 - protein, 52 aa, Triticum aestivum
  Clone ID: PAT_TA_66535.pep
FWNQKAPGQFQKKVFVFPQPPYEKVPAPPFGKVGARFSQLPQFPFWFLSLPL

SEQ ID NO: 172118 - protein, 111 aa, Triticum aestivum
  Clone ID: PAT_TA_66536.pep
MDESEPRDENKILLQNSCGGSLSKYLLVACGRMSVFILLARAEKLLKAWDHAVGVICVEEAGGQTCDWSGKPLDFGADLTGRRIIYPSGGVLATNGALHDKLVEMVSANYK

SEQ ID NO: 172119 - protein, 123 aa, Triticum aestivum
  Clone ID: PAT_TA_66537.pep
MRVAAGEWWSQNVVDVEKDAVMAGQLPSHSDAFTINGLTGQLYQCANETFTAVVQPNTTVLLRVINAALNTHLFFKVAGHNFTVVAVDACYTVNYTTDTLVLAPGNTVDALVYTVAAPGSYYM

SEQ ID NO: 172120 - protein, 79 aa, Triticum aestivum
  Clone ID: PAT_TA_66538.pep
PVITTGPHHTGLCLTPQNWRSKKRKRKGEISAAGAVFDGGGGLEIRQVAHELREGSWRRHGGRGKEVAGARDEGVGVVG

SEQ ID NO: 172121 - protein, 45 aa, Triticum aestivum
  Clone ID: PAT_TA_66539.pep
RRRHRSLHLHVYCLPSTANGGGLLDWRRAGDGRALSRGGGLVPNS

SEQ ID NO: 172122 - protein, 96 aa, Triticum aestivum
  Clone ID: PAT_TA_66540.pep
EFGTRIHPPAGAPAPFSPRPGNLLSSATEREAPPPSENSIAAGLLAGARMRASMHGASSSWPDRAHESRAWNPWGRHREKRRRSASCRAATRSWRT

SEQ ID NO: 172123 - protein, 156 aa, Triticum aestivum
  Clone ID: PAT_TA_66541.pep
GFTPLHLASRLHTSKKLGLELMCTCEATYSGSSTTLATITYPSPSATLLLPRSQWKQRSRPLPPLPHEQDMAFGWARPYSSASSSKRPPSPTAASRAASLVTSSCKKYTMNRQTVSEVHFHSNRSLKLIEIHTSNEVTKILKSTTCPSSRSHMLCR

SEQ ID NO: 172124 - protein, 197 aa, Triticum aestivum
  Clone ID: PAT_TA_66542.pep
IRHEANWCYAAVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQT

SEQ ID NO: 172125 - protein, 216 aa, Triticum aestivum
  Clone ID: PAT_TA_66543.pep
PDLMASRSRALKFLHEIGWLLQRSHTRATSSKAPQQHHAVGFSAARFRWLLSFAVDQEWCGVVKMLLDTLFQGNIDVASPVDFVLGESLVFAAVNKRSKPLVACLLRYTTKSAPVGSGAVATPARFLFTPDMTGSSDITPLHVAATITNAAAVLDALTDDPQQLGIKTWKNARDATGYTPEDYARRRGHTSYIKMVENKINSRLPAAHVSVAMTTT

SEQ ID NO: 172126 - protein, 136 aa, Triticum aestivum
  unsure (1)..(136): unsure at all Xaa locations
  Clone ID: PAT_TA_66544.pep
MARAAVXTAPLSRLHSPTPSIPCHSVSSQLRIHQQRKPLTVASALPEVADLPGLSLPAAAAAVAALAAAVSLSDPERRRMAQAEALGGGDKEAVRAYFNSTGFERWRRIYHPATDDVNRVQLDIREGHAHTVAGTL

SEQ ID NO: 172127 - protein, 72 aa, Triticum aestivum
  Clone ID: PAT_TA_66545.pep
VAAAAAARRRRPFKGSPNPEAAVRRTARLHPYPSPGTHQGDQADGTATRHSGASSACRSALTEGSDRRPWRR

SEQ ID NO: 172128 - protein, 90 aa, Triticum aestivum
  Clone ID: PAT_TA_66546.pep
FFFKTNIKCYKSLIALHSIQSKNYSNSYTILFTYSLHLHLYLLSTLTVHSIQFAHCHNSSNQSPYLTLEQPINRCIKLLQATFKVHLAPT

SEQ ID NO: 172129 - protein, 31 aa, Triticum aestivum
  Clone ID: PAT_TA_66547.pep
KCEWNAFSICLSLIHDKNWISDSMYAQLHRD

SEQ ID NO: 172130 - protein, 69 aa, Triticum aestivum
  Clone ID: PAT_TA_66548.pep
PMLLVICHAIRKHCTNNDLGGFVQLVDLECFQQSEQESMTSVNLSCKSKPGMHHQQICYGNVWNDAGPP

SEQ ID NO: 172131 - protein, 57 aa, Triticum aestivum
  Clone ID: PAT_TA_66549.pep
KINPSCSITLGFIVQEKKLVCLSSREVQHSLQQKSRKFKRVEVLVDLLIKENPHSFS

SEQ ID NO: 172132 - protein, 157 aa, Triticum aestivum
  Clone ID: PAT_TA_66550.pep
SSASLLHPSTRAPASSPRLPRRVPAPALLGLRSSPRRPHGLSLTVAAAASPDVEKAPSSSPPPPPEESSDLSAVAESVKVLKDAAKTRKVPAAEVLAALATIKKAKLDTFSFLETLGGTESPSRTWMLIFTAQGSKLEKGSYFPETVVQRFDAEGQR

SEQ ID NO: 172133 - protein, 85 aa, Triticum aestivum
  Clone ID: PAT_TA_66551.pep
IGRRARPKAQGVTRRAPSRRPATRRRRRSARRRGDGGGWSGGRAAAGQARDAAGAASRLERAWKRGARMRTRPSSPSSCSGSCRI

SEQ ID NO: 172134 - protein, 146 aa, Triticum aestivum
  Clone ID: PAT_TA_66552.pep
EFGTSRRPPPDRICLSATSTTPTLLPIAGSAIRSPRLGGRAPRPRLARARQGRGCRSNLRSRGLCAMAAMASMADKRGPSASAMAACFGHGLVLHLFGGRRKEWRRRAIWEKTVPCLTTDSNFYWIRLTVRWLRTLRCQIRWRQGT

SEQ ID NO: 172135 - protein, 49 aa, Triticum aestivum
  Clone ID: PAT_TA_66553.pep
KIRWLYNLFKSRTNLTMIETYLPLLQFKAHTFPLRMNWTETMNINSVPT

SEQ ID NO: 172136 - protein, 84 aa, Triticum aestivum
  Clone ID: PAT_TA_66554.pep
NRHEEEFCWGEKQVQRGWGLYNNQLQGVYGCMPSCLMPTKFYLILLLTVSEASPRLMPQRLGSEAPPQRLASPYRLKNIGTYKL

SEQ ID NO: 172137 - protein, 97 aa, Triticum aestivum
  Clone ID: PAT_TA_66555.pep
KHPTITEFSKTMRAMKGTTDNKFLTGWLAIGFNTFLAPTTSLSLSPHCYGAVLEPDVLLKSNVSLFVVEHINKAFRNMGEDKQTVCCYLYHLMVSCN

SEQ ID NO: 172138 - protein, 92 aa, Triticum aestivum
  unsure (1)..(92): unsure at all Xaa locations
  Clone ID: PAT_TA_66556.pep
MAEYLQAVVTLMPAKIGGRASSARPWXHVARSFGDHAGARITCSLQSDIREVASKCADAAKMAGFALVNCALLVCVASAEGAPKRLTFDEIQ

SEQ ID NO: 172139 - protein, 84 aa, Triticum aestivum
  Clone ID: PAT_TA_66557.pep
IFFTACLVVGHPFTKRKVAYLWVVAAQIIILFTSSFLFYCMFCSRTSVYEREGSILVAAQTIIFFTEVNTSEVPKLVPHGHFSV

SEQ ID NO: 172140 - protein, 142 aa, Triticum aestivum
  unsure (1)..(142): unsure at all Xaa locations
  Clone ID: PAT_TA_66558.pep
LSEYLFYSNNAGLFDGLFTVEIHHKGFFCGSGSNMKYIDHEVDWFDYCQSDTWSNLWIDDFFLQLGHDRANSKMDVYWCQPGKSFCDGLHLMSCDADIVLMIGATGKXRTWVLLVDHDADIVLLNASQPPSSQLLPATACSS

SEQ ID NO: 172141 - protein, 76 aa, Triticum aestivum
  Clone ID: PAT_TA_66559.pep
SAMKTVCTALGFLAIAVGDYLSSFLLTVVEWATSTGGTPGWIPDDLNEGHLDRFFWMMAVLGCVNLMAFVSCIARR

SEQ ID NO: 172142 - protein, 46 aa, Triticum aestivum
  unsure (1)..(46): unsure at all Xaa locations
  Clone ID: PAT_TA_66560.pep
MLLKRILKELKDLQKDPDHXCSARPAGEDMFHXQATIMAPPDSTYA

SEQ ID NO: 172143 - protein, 161 aa, Triticum aestivum
  Clone ID: PAT_TA_66561.pep
MDAMEVEEGPLLAIDAKLHAGMCRAFHPAVSKLLAIFPFIEASRPRSKSGIQALCSLHVALDKSKGLLQHCADCSRLYLAITAETVHLKFEKSRSQLQESLRRVESIVTEDIGHKIVEIIGELEEVVFTLDQSEKEAGDEVINLLQRNNKMNSSSDSGELE

SEQ ID NO: 172144 - protein, 214 aa, Triticum aestivum
  Clone ID: PAT_TA_66562.pep
AATPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRR

SEQ ID NO: 172145 - protein, 61 aa, Triticum aestivum
  Clone ID: PAT_TA_66563.pep
KKKTLERGSYMDKHCQQASNILLSCQAVDAVMAGPFSAKKKKNPYGDDPQRGTWARKSPRR

SEQ ID NO: 172146 - protein, 113 aa, Triticum aestivum
  Clone ID: PAT_TA_66564.pep
TPTTPRRRRRRAGQPTNQPMERGRGLTAISAGEGRRRARPCRPPGWLDDGIQRRSNRRVIQRDEEEIGPANRRAAAGRGGRRRRRTGLARLGEGEKVVAGRGEERRGRRVVVG

SEQ ID NO: 172147 - protein, 101 aa, Triticum aestivum
  Clone ID: PAT_TA_66565.pep
EFGTSRSTRGGGFFIIWDKGPHIITKQTQWSMSESTYDHNFIGVCTALLPRGTYMYISIFVPVYIRIFIAVFLIPWTNLYSPAVEGTKYDIPLPYAVATTG

SEQ ID NO: 172148 - protein, 122 aa, Triticum aestivum
  unsure (1)..(122): unsure at all Xaa locations
  Clone ID: PAT_TA_66566.pep
MAASALDQTTSFLGTAPRRDDLVRSVGDFGGRITMRRTVKSAPQSIWYGPDRTKYLGPFSEQTPSYLTGEFPGXDYGWDTAGLSADPETFAKNRELEVIHSRGAMLGALGGVFPEILSKNGI

SEQ ID NO: 172149 - protein, 124 aa, Triticum aestivum
  unsure (1)..(124): unsure at all Xaa locations
  Clone ID: PAT_TA_66567.pep
STSSLLVASDPEGKGPLLWGITADGCVAFSDDIDLLKGSCGKSLVPFPQGCFCWNARGGLKSYXNPKSKVTAVPANEEEICGAXPSCWKDLPFCDDFSSPRLLRAARKKKPSVWVWWSVEELSQ

SEQ ID NO: 172150 - protein, 65 aa, Triticum aestivum
  Clone ID: PAT_TA_66568.pep
WVWECDVLAQFVQTLQGVIIQELAEAIAALTKGLHFAVSEGYRRVMILASDCLMVVNKLQATASC

SEQ ID NO: 172151 - protein, 160 aa, Triticum aestivum
  Clone ID: PAT_TA_66569.pep
QVPDRFDGLHPTSGSACGAPPGHPTPEMNEIRQRTHVASRPGSIFRVFCPENCSKCIRTRNGKKFLRACPARAQYHVEKNWARLTDAKRRGATEGPLRPYQNHPLPQQVPDRFDGLHPTSGTACGAPPGHPTPEMNEIPQRTHVASRPGSIFRVKKICLF

SEQ ID NO: 172152 - protein, 77 aa, Triticum aestivum
  Clone ID: PAT_TA_66570.pep
MSHIGMASWGTFHSLFKGLKNTGVLPVRRSCSVASLVSVHSDERIMGMQVCPIMSIKNMKNMSYLQTVNTQGMLKHI

SEQ ID NO: 172153 - protein, 47 aa, Triticum aestivum
  Clone ID: PAT_TA_66571.pep
SSIMHAPRVQHRSYRSTTTIPCNRYLIEGLIYAPDLHQQSGAMPCLL

SEQ ID NO: 172154 - protein, 127 aa, Triticum aestivum
  Clone ID: PAT_TA_66572.pep
VGALDLYAIDVRIVGLNTASLALSSRRLLTLSMLATKRSMRTIFSARSSVPVACITRASHFSAICKIAEVVLNIYKQLTASPASTHHRPCSSPCCIRATPPRPLVSRIYRRSCLVGYDFDVTYVVAK

SEQ ID NO: 172155 - protein, 93 aa, Triticum aestivum
  Clone ID: PAT_TA_66573.pep
IKIGNSTTRHIQKKKDLPESKKSSHLLPPTTQLGRYTSQNNLLCVETCLLPCTSYTMFTSVVLIIIASDIVIRCMHVDDCLDAESTFYICNIM

SEQ ID NO: 172156 - protein, 185 aa, Triticum aestivum
  Clone ID: PAT_TA_66574.pep
MAQTMASMTGLSQGVRLPGPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATLDGLDH

SEQ ID NO: 172157 - protein, 74 aa, Triticum aestivum
  Clone ID: PAT_TA_66575.pep
IIFYFFIIYILTPNSIPEAYTQSSHGYAQSATSMAKNHQKLQSRTPLSIQYKLCGNTHCLRPTPAKDAHDKLLL

SEQ ID NO: 172158 - protein, 213 aa, Triticum aestivum
  Clone ID: PAT_TA_66576.pep
EFGTRKPSTVGYNTFMNGLCKKGMAKEVLEQLDVMLGEGLDPTDFTLSILLNCLCHDKRIHDAVCLLERSTSLKCYAGVVAYNTVMSCLCEMGHWMSALKLLTDMIKRGVMPNTRTFNIVIRSLCFRRKFSIAKSLASNQGFAANVVTYNTLIYFVFYYSRKLSEVKDLIFDMTAERIAPDEVTYTIIVDGLCRDGFFDTATSYFLESLEIGL

SEQ ID NO: 172159 - protein, 78 aa, Triticum aestivum
  Clone ID: PAT_TA_66577.pep
GSVRQWALTSKAVANLDLSSSQTTRIHVHGGAYSEGCGYFYQCIKSQSFCVFSVKDHNIVLCGQSSRHASIAARFCFK

SEQ ID NO: 172160 - protein, 63 aa, Triticum aestivum
  Clone ID: PAT_TA_66578.pep
DELLKALQIKEKIPRRKALSALEEKVIMILSEQGYVSKDELSGPIGNLADIVEEEDEDEVIED

SEQ ID NO: 172161 - protein, 96 aa, Triticum aestivum
  Clone ID: PAT_TA_66579.pep
KIRHEVRVFLVFFWTRGTAFTVVMRIHCIIRSNISEYMMCLLHAREEEEVAYNRWPCKKCRRRGDGWGCKTRSTIAHIGTIPHRIEGRSAAAAVTK

SEQ ID NO: 172162 - protein, 121 aa, Triticum aestivum
  Clone ID: PAT_TA_66580.pep
MAAASARALAAAVSALLAAAVLLASPSPVAAEEGCTQRPVVFAFGDSNTDTGGTAAALGSYLPLPEGRTHFRRSTGRLCDGRLVIDYLCESLNMSYLSPYMEALGSDFGDGANFTIAGSGT

SEQ ID NO: 172163 - protein, 96 aa, Triticum aestivum
  Clone ID: PAT_TA_66581.pep
IRHEAAPIGGLSLLSPRTGGGEVGIRGVRPPVLSPPPPITGLAPPPARQSSVAEIMSGSAWDIVNSFAPTEENTELRMAYGHVETSLMSDTDEDNP

SEQ ID NO: 172164 - protein, 102 aa, Triticum aestivum
  Clone ID: PAT_TA_66582.pep
MEGTSVPIEIDGDAICLENVGDDEHEAQESGQVQIIYATENGAQVAFDSQEQGTEEHSVRSEEDQENNSVIPSREEFTEELRTKVAYSEEQAYRLYCEYGHR

SEQ ID NO: 172165 - protein, 64 aa, Triticum aestivum
  Clone ID: PAT_TA_66583.pep
VAQQYQIGTCTLLGMKNRSCARAIEGQSTPWSRQRSRVILSVYGHKQTAITGLCSMLLDTFFSI

SEQ ID NO: 172166 - protein, 195 aa, Triticum aestivum
  Clone ID: PAT_TA_66584.pep
MEGKEEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVAPGYTKGSGLGAEIIGTFVLVYTVF

SEQ ID NO: 172167 - protein, 114 aa, Triticum aestivum
  Clone ID: PAT_TA_66585.pep
IRHEEKLRVGHQRAPRLHPSPPPRPHYATLPSPSLVHNTSSLRTAPAQIPSRPSTPLPANPNPSPPPPSRRPNPRRTGGRSPTRVNRGLVPEIGAFRDAWARKLCPERLTSADE

SEQ ID NO: 172168 - protein, 213 aa, Triticum aestivum
  Clone ID: PAT_TA_66586.pep
IRHELQREWGVGHPLRVVPLFEKLADLEAAPAAVARLFSIDWYMDRIGGKQEVMIGYSDSGKDAGRLSAAWQLYKAQEELVKVAKQYGVKLTMFHGRGGTVGRGGGPTHLAILSQPPETVNGSLRVTVQGEVIEHSFGEEHLCFRTLQRFTAATLEHGMHPPVSPKPEWRALMDEMAVVATEEYRAMVFKEPRFVEYFRSATPETEYGRMNIG

SEQ ID NO: 172169 - protein, 203 aa, Triticum aestivum
  unsure (1)..(203): unsure at all Xaa locations
  Clone ID: PAT_TA_66587.pep
IRHEVAWSKGPPLAIASAVPFASFRAERWIVVSVSSPPTAALAALTRVKGWQLLAVGNSHTPSGWDLKGAIFLSLDLQAQLGYRSVDFLPYASHVRKTAGYLFAIQHGAKLIFDADDRAEMPGNDLGKHFDVDLGSGIANHPVLLQYSHADPNRTVVNPYVHFGQRSVWPRGLPLDKVXEVAHEAFYTEIFSGRQFIQQGLSD

SEQ ID NO: 172170 - protein, 52 aa, Triticum aestivum
  unsure (1)..(52): unsure at all Xaa locations
  Clone ID: PAT_TA_66588.pep
EFGTSYCRSPRTPSEEFAAYIKQRGYDLHDVKTYGKMLEDAXFHDVVAEDRT

SEQ ID NO: 172171 - protein, 96 aa, Triticum aestivum
  Clone ID: PAT_TA_66589.pep
WSKSTMLPIMWKVYCLKQELLQLAKSNSGSRILNPARKMLILKCSISATQPLARLSPSGSTRPSFDTPPTACECQLKPRLGGSFSTLRALESKIYL

SEQ ID NO: 172172 - protein, 129 aa, Triticum aestivum
  unsure (1)..(129): unsure at all Xaa locations
  Clone ID: PAT_TA_66590.pep
EFGTRRMNATSERLSYMRVIKFQAWEEHFNARIGRLRRLEFGWLTRFMYSIXRNIGVLWSAPTVVSELVFGTCVAAGVXIDAGLVFTAXTCLFKILQEPMRXTFPQAMIQAWQAMISLQRLDSYMTSPE

SEQ ID NO: 172173 - protein, 62 aa, Triticum aestivum
  Clone ID: PAT_TA_66591.pep
SECVFDAKYGCMCGLYCYWALLKNLAVGFFFFYGGGGHMYTDVVPSKPPGCLDKGVYGPGCM

SEQ ID NO: 172174 - protein, 215 aa, Triticum aestivum
  Clone ID: PAT_TA_66592.pep
NSARDDVHVPEEPMEYDELVIKAHMFFHTFRRLFVDLILSFQDRTDSLTFFRRLKRDQAYKVVEIELQLMYESLHSKSPVIHCPSGRYLRVFTLAAPILSLLVFSKAGKGRYKEADVAVTYVLLVGAIFLEIYGIILMAISSWSYADLRKLRKCLPAASRVVFQAVKYFMPEARPRWSNQMAQYNLLSYCLKDKSTWLTRVLESLEWDYNIRVKT

SEQ ID NO: 172175 - protein, 189 aa, Triticum aestivum; identical to SEQ ID NO: 171222
  Clone ID: PAT_TA_66593.pep

SEQ ID NO: 172176 - protein, 57 aa, Triticum aestivum
  Clone ID: PAT_TA_66594.pep
RKHGHTHILILGTYNTDMRNRKTQSNVRADKTAMALYMWPAGSELFRPCRTPRSPVA

SEQ ID NO: 172177 - protein, 68 aa, Triticum aestivum
  Clone ID: PAT_TA_66595.pep
NSARVAVKMLKDFKTDGEDFINELASISRTSHVNVVTLLGFCLQGSKRALIYDYMPNGSLERYAFKDG

SEQ ID NO: 172178 - protein, 91 aa, Triticum aestivum
  Clone ID: PAT_TA_66596.pep
MPAGHGLRSRTRDLFARPFRTKGYMPLTTYLRTYKVGEHVDVKVNGAVHKGMPHTFYHGRTGRVWNVTKRAIGVDINKQVAIRIINKRIHV

SEQ ID NO: 172179 - protein, 140 aa, Triticum aestivum
  unsure (1)..(140): unsure at all Xaa locations
  Clone ID: PAT_TA_66597.pep
MASSELTYRVQQAVTAADVAAAESKPRTMQQLPQPIRYVLGEQRLVFYLVGMALATLLFVLLSPSTTTTTRSTSVEHLTAVGLVSRQYQSSAGAGRMAFEEAGAGGVRHGRVPLRLKRKGLRVVVTGGXAGFVGSHLVDR

SEQ ID NO: 172180 - protein, 101 aa, Triticum aestivum
  Clone ID: PAT_TA_66598.pep
VMKGMDRWSSYGFWEKKWDGVHPWLLRREGEGVPPWLLEREGDGVHPWLLRKEGEGVYPWLLQRDKGKEIIHGRSSAARIDSGAAPPAGAGISRTWRQGTN

SEQ ID NO: 172181 - protein, 113 aa, Triticum aestivum
  Clone ID: PAT_TA_66599.pep
LLGRSTTHRQISMRVTVRSKSTHPVSPQSSPPACLCHIAAPSASLHVLVHPSCRSSCPNPPSQLPRHRHGRPLTRCCRHASPIPAPPIKVVVAFSLAGSSTLEYGRNFFHGQL

SEQ ID NO: 172182 - protein, 110 aa, Triticum aestivum
  Clone ID: PAT_TA_66600.pep
SFNKEVEQKGVRQKQQPKERWSRPPPEILKINTYNAFLKERKILEVGAMPSEKHDCGMAMAGGAGDLEQVSDALRSEDLGMFYAIRTSIQMCCNQEMVETDSVTEGCGMH

SEQ ID NO: 172183 - protein, 97 aa, Triticum aestivum
  Clone ID: PAT_TA_66601.pep
SGAERSSYFRSCYSVTPSSSAERSGVARAMRCRTGTKSLSLLRNHHPEHVIVETSTHGSLKQRLFLSNQSSTATCYSCGPKDRPINRRLFRKLGDSS

SEQ ID NO: 172184 - protein, 183 aa, Triticum aestivum
  Clone ID: PAT_TA_66602.pep
IRHEAQGAKPGEGGELPGHKVIGDIAVTRHSTAGVGLISPPPHHDIYSIEDLAQLIHDLKNSNPQARISVKLVSEAGVGVVASGVVKGHADHVLISGHDGGTGASRWTGIKNAGLPWELGLAETHQTLVANGLRGRAVLQTDGQLKTGRDVAVACLLGAEEFGFSTAPLITLGCIMMRKCHTN

SEQ ID NO: 172185 - protein, 91 aa, Triticum aestivum
  Clone ID: PAT_TA_66603.pep
YHNKPIITLLQLALQNSITAITEGMGAQSQIIKSLKRPKYEPRYSIDGGRMHAVNRSNSICTPFVGPNPQESLLYYVHKALLGARWFRMGP

SEQ ID NO: 172186 - protein, 114 aa, Triticum aestivum
  Clone ID: PAT_TA_66604.pep
TSSKSSGMPLASMDSSFSPTSSTHSILMFLSSASPSSSSSSQSAPLLLLSSFGVSKLLVTPLISPGSPFTSLSSSLPSASFKYSKFLSVSVFSASWCSSLTLFSALSASPAAAA

SEQ ID NO: 172187 - protein, 103 aa, Triticum aestivum
  Clone ID: PAT_TA_66605.pep
KPHLMVSAASAREMFAPLWVLNFMPKSGHGPPLGTMVGLPTPVGQVVINWTLWEAPVWTGYLGTGGPLVEIPFFSRYFAKGVNFRWAPGGPIFFYPAGGLIYL

SEQ ID NO: 172188 - protein, 104 aa, Triticum aestivum
  Clone ID: PAT_TA_66606.pep
MLASVPSTRSDGCPKPFHSAVGYLGNPSLVHAQSILAIWACQVVLMGAVEGYRVAGGPLGEIVDPLYPGGSFDPLGLAEDPEAFAELKVKEIKNGRLAMISMFV

SEQ ID NO: 172189 - protein, 47 aa, Triticum aestivum; identical to SEQ ID NO: 172153
  Clone ID: PAT_TA_66607.pep

SEQ ID NO: 172190 - protein, 68 aa, Triticum aestivum
  Clone ID: PAT_TA_66608.pep
KEVGVAYLPQSLSPSICFEFNSAASLLPAQHAFHHNTAEHVTTAMTETYLCFHANSYPIARCHATHQA

SEQ ID NO: 172191 - protein, 79 aa, Triticum aestivum
  Clone ID: PAT_TA_66609.pep
SFLGFFLQQNMWLILEAYTVSLWVQNFWIYLHFDQASMATAYNTINGRPRVSLSHRLRKLPRSSACVFQQNRSVVVPHK

SEQ ID NO: 172192 - protein, 151 aa, Triticum aestivum
  Clone ID: PAT_TA_66610.pep
MSSSSAAPMERHHSIDAQLRLLAPGKVSEDDKLVEYDALLVDRFLDILQDLHGPHLREFVQDCYEVAAEYEGDRDAARLDELGGRLTGLAPADSIVMASSFSHMLNLANLAEEVQIANRRRNKLKRGDFADEASATTESDIEETLKRLVSD

SEQ ID NO: 172193 - protein, 55 aa, Triticum aestivum
  Clone ID: PAT_TA_66611.pep
KTTKEEKKDLKDLTGKLFATLDGLDHAAKIKSPTEAEKYYGETKTVLGDVLAKLG

SEQ ID NO: 172194 - protein, 89 aa, Triticum aestivum
  Clone ID: PAT_TA_66612.pep
MTNTAMALSTLSFSSKAMKDLPAKAFLAEAFVNMRMTMRKTKPMPNVTPCNSSYRVFYLVLFFGQLSSYLTSYLTGEYRGDYGWLTADL

SEQ ID NO: 172195 - protein, 54 aa, Triticum aestivum
  Clone ID: PAT_TA_66613.pep
TNNQIRGLCGHLPADRTFKLQLKHHHLAITRVLIVQTLHQNFHVHYFDPSNNKG

SEQ ID NO: 172196 - protein, 102 aa, Triticum aestivum
  Clone ID: PAT_TA_66614.pep
IRGRYQSGLGLGSMKNLRTEISGGYLFLFVALREEPGKDGPTACWPCCLPDVHVLLQLGLGPDGAVGEGRAAGNGAVAWVRVRDRGTEEEASCRIRHEYSWA

SEQ ID NO: 172197 - protein, 58 aa, Triticum aestivum
  Clone ID: PAT_TA_66615.pep
GNALIFIARYKYYKHARSTRTNLHFTPTLACIPLARSRFPRRRVPCTGRRCSDRIGSI

SEQ ID NO: 172198 - protein, 82 aa, Triticum aestivum
  unsure (1)..(82): unsure at all Xaa locations
  Clone ID: PAT_TA_66616.pep
MEMGGDEMMMTSGATGRIVPVFRSELSRRALLRLAVALHSLFLXLLLLVGRRRRPDAASPAEPGRLWKASSRRRAAEEEDVR

SEQ ID NO: 172199 - protein, 210 aa, Triticum aestivum
  Clone ID: PAT_TA_66617.pep
NSARELLVLVSGLLPNPKLETSVLPICLNTGALMFTVPSGLCAAISTRVSNELGAGRPQVARLATRVVICMAMFAGSVISITMILLRKSWGYMYSNEEEVVTYIARMIPVLGVSFFIDGIHTSLSGVLYGCGEQKIGARVNLAAFYLAGIPLAVLLAFVLHLNGMGLWLGIVCGSLTKLVLLVWIRVSINWENESIKAKDMVLGTSLLVA

SEQ ID NO: 172200 - protein, 172 aa, Triticum aestivum
  Clone ID: PAT_TA_66618.pep
MAPTKGEGPAIGIDLGTTYSCVGVWQHDRVEIIANDQGNRTTPSYVAFTDSERLIGDAAKNQVAMNPITNDKGRLSKDDIEKMVQDEKIASKLPADDKKKIEDAVDAAIQWLDANQLGEVDEFEDKMKELEGLCNPIIAKMYQGAGADMPGGMDEDAPAASGGAGPKIEEVD

SEQ ID NO: 172201 - protein, 66 aa, Triticum aestivum
  Clone ID: PAT_TA_66619.pep
LVPNIHECHHHINQYQHNVSDGRRSAVRSFPWRVILIRFDGEEDEAEKLFRQAWQPSWRFGLVPNS

SEQ ID NO: 172202 - protein, 112 aa, Triticum aestivum
  Clone ID: PAT_TA_66620.pep
FTPQFFLNYLFLMQGAGAQSAVVYRRYLEDEERRDIKGGRIHPRRHAGDRAARRRRGEVQSEGRWQEPSRRDQQGSVRDPRTGDRLRRRSRCQPRPVSSDRPGEECGLVPNS

SEQ ID NO: 172203 - protein, 77 aa, Triticum aestivum
  Clone ID: PAT_TA_66621.pep
LTCMQRQTNIDPRITSLLVVHAFSARIACTIIHPDAHMVFGIPVFVLYALDLWFLIQMETQTDLSSVGRAEDCSRCR

SEQ ID NO: 172204 - protein, 155 aa, Triticum aestivum
  unsure (1)..(155): unsure at all Xaa locations
  Clone ID: PAT_TA_66622.pep
MHVLLQLSLLGLILLGTQHASGAAGPSSNCRRRCGDVKIPYPFGIDPNIPNCSLAEVFDLSCEVRDGSLKPKPFKAIFEVLDISLTHSTARVLNYIEAFCYNNSTRSMEHLGYHESQNGGPSSVYRLSDVENRFTVIGCNALXIMSDFAGTGYQG

SEQ ID NO: 172205 - protein, 119 aa, Triticum aestivum
  unsure (1)..(119): unsure at all Xaa locations
  Clone ID: PAT_TA_66623.pep
ACLSSNSVCVDSVNDYGYMCNCSQGYKGNAYLPGGCPNVPTCSHXDPCPSGGPYHNTIAGCRCSCRVGRTMEVNTCSPDIGLILGVALGLFGAIITAMITVFWGQMIIQKRKLEKVKRE

SEQ ID NO: 172206 - protein, 60 aa, Triticum aestivum
  Clone ID: PAT_TA_66624.pep
KNTQILHNHHFVGHTHQLLIWTRPHMQHLSARTTQSKNGKNQKSTTTHMQHHPSPMKLPA

SEQ ID NO: 172207 - protein, 175 aa, Triticum aestivum
  Clone ID: PAT_TA_66625.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPCCEESGKA

SEQ ID NO: 172208 - protein, 145 aa, Triticum aestivum
  Clone ID: PAT_TA_66626.pep
RVSPIYIGGRTKHLLQRAIWNDTSFLTSVNVMDYSLLVGVDEQNHEFVLGIIDYLRQYTWDKQLETWAKTSLVVPKNESPTVISPREYKKRFRKFMAKYFLTVPDDWTTAKKSSGTCKYCTRGNCNLSKIDSQKPQLRAESCSIQ

SEQ ID NO: 172209 - protein, 79 aa, Triticum aestivum
  Clone ID: PAT_TA_66627.pep
SAGGAGTPPPRVSTPRPPRWSRCRGSARARAPSPAPSTTPPRTASGPAGSGSRAPTRRKRSPPPPAMTPPPPPAGAAWS

SEQ ID NO: 172210 - protein, 158 aa, Triticum aestivum
  Clone ID: PAT_TA_66628.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAI

SEQ ID NO: 172211 - protein, 172 aa, Triticum aestivum
  Clone ID: PAT_TA_66629.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGY

SEQ ID NO: 172212 - protein, 88 aa, Triticum aestivum
  Clone ID: PAT_TA_66630.pep
PLLAGPSGGFFGLKLGNPLRMAWFFRNPVSLNYAAFALFVLKLDRGPWLVFPFGVPVGPFHWVGWGGDFGGGGPGFNFFGGMGPGMVL

SEQ ID NO: 172213 - protein, 57 aa, Triticum aestivum
  Clone ID: PAT_TA_66631.pep
QEPYALSQNILNVLCPSVLFRVWFCVIRPPSSHVKRSSQLLWPGAQAPKKFWPVYPW

SEQ ID NO: 172214 - protein, 180 aa, Triticum aestivum
  Clone ID: PAT_TA_66632.pep
MAASALHQTTSFLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPG

SEQ ID NO: 172215 - protein, 71 aa, Triticum aestivum
  Clone ID: PAT_TA_66633.pep
EEHQIYHGHRSDSSCSTCIPPSSDVHTLEIVLTLVRRRPSPADSSSTRPLTAAPSSPPGRDPGCCGLVPNS

SEQ ID NO: 172216 - protein, 52 aa, Triticum aestivum
  Clone ID: PAT_TA_66634.pep
FSKQKFVISLFKFSVVQPNSFFIPCKLNYTEQVIFFCTTCMLLFFIHNPVVW

SEQ ID NO: 172217 - protein, 84 aa, Triticum aestivum
  Clone ID: PAT_TA_66635.pep
KYLGGSYGSLIVISTLPSRFSMMIEMTVTTLQAFGSCDRRHGNHDKSKHINLKIMQLIISYCHWNEIVYSKVFYTQAIICTSFI

SEQ ID NO: 172218 - protein, 78 aa, Triticum aestivum
  Clone ID: PAT_TA_66636.pep
RRGSTCPTPAAGGREFDHHTILYAWKSSSPSRDSWTTVIFIEGHSSGDHVVSRCAWSSRPARRRSSPHKLLNKIIQWK

SEQ ID NO: 172219 - protein, 152 aa, Triticum aestivum
  Clone ID: PAT_TA_66637.pep
MLARSPALPSPFLTATETAAASSAFFQPCHLSTSPSVTFSKKTHGTRLTVQPNARHGNTKAASRIQGKWRTLSSDPAQAAAVVDAAGNSKTWVECKQILTTLNFSTEDAEKMLKKAFGWLHSPYWTEERKKEVPSTEVVSGVLDYVRGLGLS

SEQ ID NO: 172220 - protein, 204 aa, Triticum aestivum
  Clone ID: PAT_TA_66638.pep
PSRHRLRCQAAASCFSSSSSSGGGRAGSSWATDYDLYELLGVEPSSPQADIKAAYRALQKRCHPDVAAGNGDASAGPSSHDMAVVLNEVYALLSDPAQRRAYDREHARRSEFQGYTGRPLYSSWRGGDAETRAVFVDEVACVGCLKCALHAGQTFAIESVHGRARVVAQWADPEDRIADAVQTCPVDCISYVERSDLAALEFLM

SEQ ID NO: 172221 - protein, 76 aa, Triticum aestivum
  Clone ID: PAT_TA_66639.pep
PGGRFDPLGLAEDPEAFAELKVKEIKNGRLAMFSMFGLFVQAIVTGKGPLENLADHIADPVNNNAWAFATNLVPGK

SEQ ID NO: 172222 - protein, 216 aa, Triticum aestivum
  Clone ID: PAT_TA_66640.pep
IRHENSLTWVEILRQVLVASGFGSDHHMLNRNFFNKEKNQMVKYGLRPRTLKGELFALLSKKGSGGLKVAELAKSPQIIGLNLSGASEVEQLIFSTLSSDITLFEKIAPSAYRLRVDPRIKGKEDSRSDTEDSGTVDDDGDASSSGDESDGPQESYPEHESRIIRWRQKNVHKNMNKCSEIDESYSGERWLLGLMEGEYSDLSIDEKLDCLVALID

SEQ ID NO: 172223 - protein, 77 aa, Triticum aestivum
  Clone ID: PAT_TA_66641.pep
PSRPPFSRKHQPVKHTLKGHQMHMLKNLPPPFFEAPFLGSTKALILLNPFAVEPTVRLNRACLLHAPIKGYQAFSPR

SEQ ID NO: 172224 - protein, 68 aa, Triticum aestivum
  Clone ID: PAT_TA_66642.pep
GGVKTLGRGGTQKHPNKTKAGAAIIQLTPHPKRQTREPRKRPKNLKQGPVIHNRWQRESFHRVLLLHA

SEQ ID NO: 172225 - protein, 174 aa, Triticum aestivum; identical to SEQ ID NO: 172025
  Clone ID: PAT_TA_66643.pep

SEQ ID NO: 172226 - protein, 80 aa, Triticum aestivum
  unsure (1)..(80): unsure at all Xaa locations
  Clone ID: PAT_TA_66644.pep
NVAHLDKVLNLLRQSDLNQEXKNMAXLGKGCSVCTTVSVLSKTSVNGSSERFVNVVPDNSVVSDPLSMLXVASEGSTVQA

SEQ ID NO: 172227 - protein, 199 aa, Triticum aestivum
  Clone ID: PAT_TA_66645.pep
KFGTRWGGGWAGSSSHRSGLLSTLPFPMFHVRIGGCRVVVFHFVHALLFRPSDSFVQIEISLVKMAQMEDVDAASPLPAMALDPDLHAAIRAPVTVMLGPSALLLRELDSSGQSLLGAEELRLLRDALREVCIPLKSMSEDDGASFMARWWMKIVRELCYDTQDYLNFVQSARDRPEFSELPDRAKAVYSGLLARAIDA

SEQ ID NO: 172228 - protein, 83 aa, Triticum aestivum
  Clone ID: PAT_TA_66646.pep
QVYHFSSLCDIRRYSGVSVSPQPLSPTHKLSVSRSPQLYSGLEQQNFFCLSYFVGVVSVVMDLMSCSSRCFIILPVSVYDGMI

SEQ ID NO: 172229 - protein, 47 aa, Triticum aestivum
  Clone ID: PAT_TA_66647.pep
RALTELHTPSPAYQTRPWTIHAQYAPIKSTFFYTYVTPAKLMQHRHK

SEQ ID NO: 172230 - protein, 222 aa, Triticum aestivum
  Clone ID: PAT_TA_66648.pep
NSARAQRRGKQKQSRRRLRTPHRRISVPIHPAAAAPRRASLGPVDRGSGPESPLRSALRGLGLVRPCVGGLSWGFGGGWHALRRPGAVNPMLRLLSVGERLLTTGTNRRAARLSQLSHASGYYATVRDNGLSTRRNIPPVFSRMFSHYKDIVRKKVEDHNYRKRFSRGYGSLSGAVSNSSARQQAQLTLKRPSHIYSYSGPRFPLLSRAACALTLSLTRSHI

SEQ ID NO: 172231 - protein, 103 aa, Triticum aestivum
  Clone ID: PAT_TA_66649.pep
QNSARALLLPKLAPNTSMLRSTRRPSSGASKTVRGRRAAAWEEAAHAMDKDDLQNSDPTMDEEESSDGSFSTRFSAPRLREVADNELNDKKRALLEKSSFGSL

SEQ ID NO: 172232 - protein, 201 aa, Triticum aestivum
  Clone ID: PAT_TA_66650.pep
EFGTRSRDPPGPLAAPASNHLSLQSSAFLDSTIPSIKSSSTRNGGSRALDTMTTQLATKERSRSPYLSNLSSESMTGLSLPYVRRSSERLQDGGHMDESNDLRSTRRFPQMHTEKNYVDMPYRDAAAHRDSHNNNVPNFQRPLLRKQVMSRPSASSRDRFDDSQVPSNDVSRYTDTLATLHDALSEGLNPSSDWVARVSAF

SEQ ID NO: 172233 - protein, 39 aa, Triticum aestivum
  Clone ID: PAT_TA_66651.pep
YLSLNMEDHDMEHSIWHESSLKSLNAPLARTKETCFHTF

SEQ ID NO: 172234 - protein, 108 aa, Triticum aestivum
  Clone ID: PAT_TA_66652.pep
LEGCLRTDTFSSHLFQMYIYLRINGNQDGLTFHFQSRFTLTRYHARCSPIEQEPAGELAGTEQNQQAKGETEEQMPGNLLSLFLRLLRDDGRCRRFVVCRSHHGVGGL

SEQ ID NO: 172235 - protein, 57 aa, Triticum aestivum
  Clone ID: PAT_TA_66653.pep
SKKFATSSDPIDASSSPVRFFHAVFRVFSVLLPPAPADGPWTPTMVGDRARLSLPCR

SEQ ID NO: 172236 - protein, 64 aa, Triticum aestivum
  Clone ID: PAT_TA_66654.pep
KNTQILHKHHLVLYTHQLLISNLPNMQHLSVRTTQSQNGNNQRSTTTHMQQHPSTMKFSAYRLS

SEQ ID NO: 172237 - protein, 230 aa, Triticum aestivum
  Clone ID: PAT_TA_66655.pep
NSARGGAAGGQVPLERMAAGVVEIFSQDRRARAQDVFLPFRRLFGSKTVETVVLEGDSVAEALARYAAESGVRNLVLGSATLSWFRRILWLQDLPNTVLKAMPCSCNVFIVSRHGLTIKLANQTQTDNSNTCSKIQSVSHRAFALQLRSQLQDKQSLHDLPDVNTPKSSGVSSSDSCSQARSSLSNSTSAASSESHRRRLFGSLCRKTPGRTGDTDFDAIGQLKEFPHVP

SEQ ID NO: 172238 - protein, 60 aa, Triticum aestivum
  Clone ID: PAT_TA_66656.pep
PPLPKGKVKEGACVVFLQLPARIVVSHLHKNAQKSFSEMIKDMDLPYNGRFGLVFCGFQP

SEQ ID NO: 172239 - protein, 170 aa, Triticum aestivum
  Clone ID: PAT_TA_66657.pep
IGVGSNTAIGSIRDAMLRTEDEATPLKKKLDEFGTFLAKVIAGICLLVWVVNIGHFRDPSHGGFLRGAIHYFKVAVALAVAAIPEGLPAVVTTCLALGTKRMARLNAIVRSLPSVETLGCTTVICSDKTGTLTTNMMSVSKVCVVRSVHQRPITDEYSISGTTFVRDGFI

SEQ ID NO: 172240 - protein, 99 aa, Triticum aestivum
  Clone ID: PAT_TA_66658.pep
LLAGDKGPNIAPVHREKSLGPISFFNFNTKGLQRRSKPGRKSYLRGSAPNVGWGEQNRRELVKQIDGKTYTIASWYIPANHLGWGGGPGGIPSHLGRRG

SEQ ID NO: 172241 - protein, 88 aa, Triticum aestivum
  Clone ID: PAT_TA_66659.pep
YLRLRAYRDIFSAHSGCCSTLFLFTPERLFSSLSCKTVFSSVPSMCCLMEVEPQAVCITGTAPTFVRDLVAGNLARHSGLWNISLSIS

SEQ ID NO: 172242 - protein, 125 aa, Triticum aestivum
  Clone ID: PAT_TA_66660.pep
ADIADWILNIGDGLVGNKEEEAWVNILEDLLLQKGENQLETIINSTYPNLWTNYMNRIYLEERAILCPRNEMVDEVNSYIMGRIEGEEVTYRSSDTVCKAMSNSEDGDHLYPTEFLNSLKCPSIY

SEQ ID NO: 172243 - protein, 101 aa, Triticum aestivum
  unsure (1)..(101): unsure at all Xaa locations
  Clone ID: PAT_TA_66661.pep
MAVAKSKAGKHAAPLLGKYELCRLLGRCTFSKVYHARSLVGGXAVAIKVLDKPELAATAGMDARVLGEVSAMRRLRHPNVLRLHEVLAKRSMVYLVMDLVP

SEQ ID NO: 172244 - protein, 83 aa, Triticum aestivum
  Clone ID: PAT_TA_66662.pep
PDDLVQKLYLLRVNITILRTIKSAPQTIWYGPDRPKYLSPFSEQTPSYLTGEFPGDYGWDTAGLSADPETFAKNRELEVIHSR

SEQ ID NO: 172245 - protein, 178 aa, Triticum aestivum
  Clone ID: PAT_TA_66663.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAG

SEQ ID NO: 172246 - protein, 169 aa, Triticum aestivum
  Clone ID: PAT_TA_66664.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFI

SEQ ID NO: 172247 - protein, 63 aa, Triticum aestivum
  Clone ID: PAT_TA_66665.pep
PKVVVFSGLLVGISPLEPLKARPRGGPFLPGKGFYKPHKGLPRVRSLQPCNCRSRFPPGLIKG

SEQ ID NO: 172248 - protein, 183 aa, Triticum aestivum
  Clone ID: PAT_TA_66666.pep
MEAAAGLLAPLPRSTAGGGTTFPVLSSSNPYHHYPQPHHHPIFSGLLSLSLRGCGTRLPAPPCRAAVKEDDATPQWQLDFLGPDPHPRSGDDEDDDPLPAASTDWCVRARRSALRSIEARGLTPALQRMVTPPKKKKKKKQKKRVLGRKPRKHDADEEPLDGDEFDSDEEASLDDLDLRVAQF

SEQ ID NO: 172249 - protein, 150 aa, Triticum aestivum
  Clone ID: PAT_TA_66667.pep
MAEQQQKGGDDEVLEVECALDMPEVVQRQDSLYRDASRAGGASHHGHERWGKTLRLAFQCVGVLYGDIGTSPLYVYSSTFTAGVRHTDDLLGVLSLIIYSFILFTMVKYVYIALRANDDGDGGTFALYSLISRHAKVSLVPNQQAEDELH

SEQ ID NO: 172250 - protein, 36 aa, Triticum aestivum
  Clone ID: PAT_TA_66668.pep
ILSYISTYSYNISQAINLQAVANHLLVERMRSSKNA

SEQ ID NO: 172251 - protein, 49 aa, Triticum aestivum
  Clone ID: PAT_TA_66669.pep
GFFYSLKAPPFSKQWGFMGPLVQKGVGSFSLLPPTKKYVPPFQGPWRVW

SEQ ID NO: 172252 - protein, 41 aa, Triticum aestivum
  Clone ID: PAT_TA_66670.pep
VFNKFGEHVNLQRDRNRSDAALRTVRSTYSTCRAPGDRGKR

SEQ ID NO: 172253 - protein, 78 aa, Triticum aestivum
  Clone ID: PAT_TA_66671.pep
RALFPHFNSAATSKLKFQRFPPMWGNIRNHFPPLGLRRGPLSARIKNFFVFPAREPPKSPVLGPVLLTIDPRLGAPLC

SEQ ID NO: 172254 - protein, 203 aa, Triticum aestivum
  Clone ID: PAT_TA_66672.pep
SSRESGPAGLFPQTRAAQFVENTASGRQRAVGSERLDPDVTTPPTGLWRAAARGDGRAWRASFSASRRAWSATSSSTRSYPRHRPVSSEPRLMETAAHGGPLVLRFQARAIGGERLDPVIPMRPPGLRRATTHGDGRAVRLRALVCLCGDPAIYHHPGLSYRASSAGFSPGVAGIRGPHRIRGGRGRIGEEWGKRVRQLVPNS

SEQ ID NO: 172255 - protein, 80 aa, Triticum aestivum
  Clone ID: PAT_TA_66673.pep
ETENEALHGRPSPRAAARQRPVGGVVTSGLRRSLPTACCRPLAVFFSNCAARVCGKRPAGPPFLLDRGFLCNDKLIVRGG

SEQ ID NO: 172256 - protein, 154 aa, Triticum aestivum
  Clone ID: PAT_TA_66674.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQS

SEQ ID NO: 172257 - protein, 98 aa, Triticum aestivum
  Clone ID: PAT_TA_66675.pep
GTGFAKSVVDALNDRADSPNVRAIRHPQTHTWWSRHGWSVPSHNLPPNEQEETDAASNTYSYGAEQIRLDPYVIFECCEIPILTSRTCLICAVGCHIG

SEQ ID NO: 172258 - protein, 112 aa, Triticum aestivum
  Clone ID: PAT_TA_66676.pep
EDHIFASCWPDAQQIFKNAFCRVQSSLVCVTQSERTLQDSRKDHLSAVPEQTGRPPVGAPEGIRVCQAVRPTNTGRFPTSSAGTTARPGPSAELLRPGHGRPRPCLSERARW

SEQ ID NO: 172259 - protein, 85 aa, Triticum aestivum
  Clone ID: PAT_TA_66677.pep
KTKAFQRPFLRALFENLTRAPTGGFVTVFLARGYSFRQNGGQHIQQPTLVLTPSKNRGGEAALPKNISPSPTGGGVATLGLKARP

SEQ ID NO: 172260 - protein, 130 aa, Triticum aestivum
  Clone ID: PAT_TA_66678.pep
MEEGEQQVRRQIQTTPTMERDGEQPVDKGEAAAPSGSTSRSTKHTSRIAIQKVTEVVAALSDYKRFLVEEIGFEGVLHIPMIQKINLKFSKFLMTKVDVKEHCIILRHGGTPITFYPEDFHKVFGIPCGQ

SEQ ID NO: 172261 - protein, 105 aa, Triticum aestivum
  unsure (1)..(105): unsure at all Xaa locations
  Clone ID: PAT_TA_66679.pep
FGMGPDGPIAFFFPGHPFVKKNPKWVPPLLGFPKPPPQRIPFPFPGVHLSAYVPLVVTGAGKTGPVPKAILGKKTFYLLPVXMAILDDGEFPWFPYKEAGLILPN

SEQ ID NO: 172262 - protein, 53 aa, Triticum aestivum
  Clone ID: PAT_TA_66680.pep
TAGNLISEHVFPGYRLYICSKSQTAKKKRPTRNPAKKTITCHKILKSPPLGEQ

SEQ ID NO: 172263 - protein, 41 aa, Triticum aestivum
  Clone ID: PAT_TA_66681.pep
ASVRPSMVIGSCDDIRPWHSTTMSLDPASCKAPMSFLVPNS

SEQ ID NO: 172264 - protein, 187 aa, Triticum aestivum
  Clone ID: PAT_TA_66682.pep
IRHEGQGGSRRYGLTWRWLRYFKNDRDRRDLVTIGAGAGVSAAFRAPVGGVLFALESLSSWWRSALIWRSFFTTAVVAVVLRLFVELCGSGRCGLFGKGGLIMYDVSTLFEDLMTYHLKDIPIVVLIGVIGAVLGAFYNFLMMQVLRVYSVVNERGRAHKLLLAAAVSVLTSCCVFGMPWFAPCRPC

SEQ ID NO: 172265 - protein, 173 aa, Triticum aestivum
  Clone ID: PAT_TA_66683.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYR

SEQ ID NO: 172266 - protein, 127 aa, Triticum aestivum
  Clone ID: PAT_TA_66684.pep
MAQTMASMTGLSQGVRLPGPAGRRASRFTVRASSAEAEAAGRRADLGLMASGVGRSAFPHVVHAGTVPAIKVGPPPPLSGGLPGTDNLDEAGDLDLPLNNRLYLHPLPPPEAAVRPKDSAQDILNLK

SEQ ID NO: 172267 - protein, 77 aa, Triticum aestivum
  unsure (1)..(77): unsure at all Xaa locations
  Clone ID: PAT_TA_66685.pep
YPGGRFDPLGLAYDPQGFSELQVKEIKNGPPPMFSMFGFFGQAIVPGKGPFXNLADPPADPVNNKAWAFAPHFVPGK

SEQ ID NO: 172268 - protein, 156 aa, Triticum aestivum
  Clone ID: PAT_TA_66686.pep
MAAAAAAADTSAASTTGLALSEASINWERLDKTKFHVIGAILFTAQQGVLHPTAVVKTRMQVAEGGLSHMSGFVVFRKILRSDGIPGVFRGFGTSAVGALPGRILALTSLEISKEMAFKYSEHFDMSEASRIAVANGVAGLVSSTFSSSYSVPLDV

SEQ ID NO: 172269 - protein, 45 aa, Triticum aestivum
  Clone ID: PAT_TA_66687.pep
MFSMLGFFGQAIVPGKGPFENLADPLADPVNNNAWAFAPNFGPGK

SEQ ID NO: 172270 - protein, 97 aa, Triticum aestivum
  Clone ID: PAT_TA_66688.pep
MCNTGASPTPSPPHLTPPLACFKNSSHLLHPVGDHHDDDDSHHRARALALSKVAGEARAIGRLSVPMAVTGLVMYSRSFISMLFLGQLGELALAGGS

SEQ ID NO: 172271 - protein, 197 aa, Triticum aestivum
  Clone ID: PAT_TA_66689.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGL

SEQ ID NO: 172272 - protein, 188 aa, Triticum aestivum
  unsure (1)..(188): unsure at all Xaa locations
  Clone ID: PAT_TA_66690.pep
MAAAAGSEHAAEEGTLSIYKAARRIKRRESTLYNALRSVADDAAFVAEIAALWPALPLVANLRCGLWYAQPRSLAATCYFKSTDGHAGNWGFSTARLNLHLALLAGERGGCIIVDSTRKGKRFPDSMAKTIPIWCCVLNRAIQRHRLRAINXSAVVPNGDAEEYSGSSNWDSSVHLPVWVLETEKNAI

SEQ ID NO: 172273 - protein, 72 aa, Triticum aestivum
  Clone ID: PAT_TA_66691.pep
SICVALAIITRLFSDTGCFDCGESFMRRDVTKLEMRKRLVFICKYAVNARPSRGNLRQVYGFLCNEKEQLPC

SEQ ID NO: 172274 - protein, 147 aa, Triticum aestivum
  Clone ID: PAT_TA_66692.pep
YYPACPEPHRTLGNARHSDPSFLTVLLQDAVGGLQVLVDVDERRPAWVDVPAEACALVVNVGDYLQILSNDRFRSVEHRVVANTAGPRVSVACFFRADASTRVLAPIVAGGDGDGRARYRSTTVPEMLRHYGAKGLDGVSALQRVRI

SEQ ID NO: 172275 - protein, 77 aa, Triticum aestivum
  Clone ID: PAT_TA_66693.pep
EREREPRAEFGTRDDLDVFKKNVESATKYLLSKLKDLQFFVGESMHDDGGVVFAYYKEGAADPTFLYFAHGLKEVKC

SEQ ID NO: 172276 - protein, 148 aa, Triticum aestivum
  Clone ID: PAT_TA_66694.pep
NSARAQVLRRDPRVTRRVMETSTSGVSPSRPRQGRRGLPSADSKRASVRWPPSPSGWLAAGHPPHPDSLRRDGLRVRAGGRQVSHGLAVVVRRWDALRLLLPTRREPLLRHPVHPVRRGGLQHCRCGQKQSRCFIIYLLKQGVRVDII

SEQ ID NO: 172277 - protein, 132 aa, Triticum aestivum
  Clone ID: PAT_TA_66695.pep
MTMMIYRDSADGGVLLLESPLDPPKKGSPSTELTLFFMLAQCSFAGASSCRYWSLASSTVLLKYDDAGACAASFSGTVAAAPLFSIRSRKLRSVDRKLACVKKLSLPVLLWWPGGRGVVPTYMGSVMSRRLS

SEQ ID NO: 172278 - protein, 145 aa, Triticum aestivum
  Clone ID: PAT_TA_66696.pep
HAPALRNTRRRYPCEAQMAVAAVLLCNAFCWCSGAMMQRSLALQSGLGSDAAGRTRAKVLRSPVLSSRSQNGFCRGAAMQRSRRAELQLSVAGVVEAAMGMEWTPSELQWSAAGVVEAAMAMEWTPSELQWSAAGAAMKLPPELQ

SEQ ID NO: 172279 - protein, 94 aa, Triticum aestivum
  Clone ID: PAT_TA_66697.pep
RRCSRRFSLCIIVVAEVGVAAGGCNTREEKDDGGLGCFNQTGHMHLIERPASRMIFIRVIRSCPLLFYCSRRSICAWNGKNIFGMLVSLSYNYF

SEQ ID NO: 172280 - protein, 91 aa, Triticum aestivum
  Clone ID: PAT_TA_66698.pep
VGFFFFFFFFFKAHKILSFAFDLGYKGYNPIGPGVCCFWHYRFSSVWRDIKASTFYWGARQPLDAPQNNRFWRQQKRPNKNCLSSRVNRSI

SEQ ID NO: 172281 - protein, 66 aa, Triticum aestivum
  Clone ID: PAT_TA_66699.pep
PDDRHPRRGPAGPDHRQGPERRGLLEPGDGQGRRDGRQGRGGGHGVRTAWVRSGVSSSWAGLVPNS

SEQ ID NO: 172282 - protein, 192 aa, Triticum aestivum
  Clone ID: PAT_TA_66700.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEP

SEQ ID NO: 172283 - protein, 204 aa, Triticum aestivum
  Clone ID: PAT_TA_66701.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGGERVP

SEQ ID NO: 172284 - protein, 128 aa, Triticum aestivum
  unsure (1)..(128): unsure at all Xaa locations
  Clone ID: PAT_TA_66702.pep
NRFTVMAAENMDEKRNTDKWKGLAYDISDDQHDITRGKGIVDSLLQAPTGDGTHEAVLSXYEYVSQGLKKYDFDNTMGGFYIDPAFMDKLVVHLSKNFMTLPNIKITLILGIWXGKGQGKSLQCELDF

SEQ ID NO: 172285 - protein, 81 aa, Triticum aestivum
  Clone ID: PAT_TA_66703.pep
IPPFYFLTPTSTYTFRPKKKKTSAYRVGPADVFNPPLEGWSFPEGGIFFFCEFFMLEYYLCLKIKIKNRGRVGFNPFFLFL

SEQ ID NO: 172286 - protein, 73 aa, Triticum aestivum
  Clone ID: PAT_TA_66704.pep
WDSKDSTKMAGWSEGGRLIVAPCQDYLLCWHQIIKCSSKCVSFSSCHVILGISFYLLIRACTRLYIELQVHDK

SEQ ID NO: 172287 - protein, 65 aa, Triticum aestivum
  Clone ID: PAT_TA_66705.pep
CVILSFSFPGVFSLNINALMDSTLTLMILSSLFENMILYMYCRLDYKIVVVVLMICSSLGMVLWL

SEQ ID NO: 172288 - protein, 73 aa, Triticum aestivum
  Clone ID: PAT_TA_66706.pep
EFGTRRDEARAPFQKSRRASRLPPHPPTDRSRPTVRPRNPRAQISPPPRRAPRRPHGPRRPALRPDGSRRIGR

SEQ ID NO: 172289 - protein, 127 aa, Triticum aestivum
  Clone ID: PAT_TA_66707.pep
LISTEFSSSQENEPSIAHSSEAGPTGKTVSEEHAARWRSLFLQMERTLQEEGRHLEIRLKEVQGMLQNCDKGLQQVTCEAPLLGPMAELWKLKNPEISESEWAVQAAAASIYSTCNLVMKTENVPCF

SEQ ID NO: 172290 - protein, 63 aa, Triticum aestivum
  Clone ID: PAT_TA_66708.pep
LFVIRIISIELPTASFFSLRSWTGIFLSMIFQVRCREFKMFCNNVISGDWILYVSACSSGVYL

SEQ ID NO: 172291 - protein, 103 aa, Triticum aestivum
  Clone ID: PAT_TA_66709.pep
LFINGRNKGGGPIKQPHGLGRGYTRGGTGNSPKRARAYMGEKNICPPRGGAGAKHKPPTEITPPGNFILFFRTPTREGPPINGKIKPHPRASMLARRKDYLWN

SEQ ID NO: 172292 - protein, 86 aa, Triticum aestivum
  Clone ID: PAT_TA_66710.pep
PKFSPSWFKVSKPVQFTYGLSFLQDPSLGFVLKYKLFCPFFVAIPRLLFPNVIVFPLHIYRLHLEPKPQIVFAYHRMQRIPICFNC

SEQ ID NO: 172293 - protein, 82 aa, Triticum aestivum
  Clone ID: PAT_TA_66711.pep
ADIDRGLLELRARAKDMTASQLKAATAIDQVWLVGAARCVSSQLQDARSGRKRRLTLSSEPILGRAITTYLSLRRLEVVVMF

SEQ ID NO: 172294 - protein, 145 aa, Triticum aestivum
  Clone ID: PAT_TA_66712.pep
DVFCDYRQYFLLHPFNVVFLLVVVDRAIPAASVDDGRRRRCYIHGASMAGVATDLRRSCNQVEGELHEGGCEAPGASRRGVVGRRVRAASGRRPASGALAELRTEVKAHGQRGGGAWGRWAKARGAEVEDDSGREEMPDRTAFLS

SEQ ID NO: 172295 - protein, 207 aa, Triticum aestivum
  Clone ID: PAT_TA_66713.pep
MSRVALVLSFVGPLVLSKFLLESFSDNPTFFDRLVVFCLSWPIAREVRLRLEQRDLRARASSRGAVLAPLVSSRLPFGLSVLLTRLRMIHSGSPGDVLDLFKTGVAQPLNPDRPTKVFRSRVMGVETIWTMDHDDAKYFLSTGFGNFGKSPLFKAGFRRLLGDGVFASDQRGLWAWHRSLTRPHFVRERIADVVAMEEHSQRVATWL

SEQ ID NO: 172296 - protein, 87 aa, Triticum aestivum
  Clone ID: PAT_TA_66714.pep
EEFDPDRWIDSRKALQVKDPFSFQPFSAGPRICLGQQFALTEASILMIRILEQFDGVDLDLSEGPVGAEAPAVILTFRGGLKVRFKR

SEQ ID NO: 172297 - protein, 103 aa, Triticum aestivum
  Clone ID: PAT_TA_66715.pep
MVIFFFFLGGPRLISKREPQRPPWGGRKPQRGGIPPNAGNARGNPPPATPEGGPPRRGTRRAPFWARQGSPPQTWGAWGPPPGGAQTGTPRPGGPLRAFPWGT

SEQ ID NO: 172298 - protein, 97 aa, Triticum aestivum
  unsure (1)..(97): unsure at all Xaa locations
  Clone ID: PAT_TA_66716.pep
MDPGQNGDVIIRIMARNSMLEKLGVDIDSAVKQLLDKAYXIALQQVRGNRVAMGKIVEVFLGKETLNGYEFRAILFEFPQIPVENRGAPTPQAPVPV

SEQ ID NO: 172299 - protein, 237 aa, Triticum aestivum
  Clone ID: PAT_TA_66717.pep
IRHEGKWLCAVIHGPSGYLDGYTTQSTGEGLRVKENMSDKKGSRGIYIERSELLPWDGGYMYAAKCRVGHLGLINSFSSIYKTVQGIGPELKDQTVISHGETLILHISEAGRSDILFSFIDSNFISGCLLGNDLLYSARHWRSKSEKPLRKMEEVYSPELADKSKGRMINQGAPRSEGRRIAKFADKKKGNMADEGAKLVDKKGRIADEEKEYGVELEEELSVLEDIRLLHRPNYTR

SEQ ID NO: 172300 - protein, 99 aa, Triticum aestivum
  Clone ID: PAT_TA_66718.pep
MYKDGPSLTGMYDLIAVVRHNGDTPDSGHYIAWVKQEGELWIQYDDAMATMHISHEVLNLCGGELVSFKVLNLCGGGQIAYLCLYRARVVQGCLESARA

SEQ ID NO: 172301 - protein, 96 aa, Triticum aestivum
  Clone ID: PAT_TA_66719.pep
AFGRGTAFPLQRRRVREGRGATAPPPRASIKSPGEPPRGRRRRRRMRRRAAAGRDGLRAPALPSAAGRWQRELGHLLLELRLDHLHLPDLLSCRIL

SEQ ID NO: 172302 - protein, 205 aa, Triticum aestivum
  Clone ID: PAT_TA_66720.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDEN

SEQ ID NO: 172303 - protein, 218 aa, Triticum aestivum
  Clone ID: PAT_TA_66721.pep
EFGTSRSVDRGPKPKAGERRRRRRRSQQPTSPSPSPRSAMADGGGGGGEYSNLNNPITSPTRTAAADGGGEDIEEGRPWLVSPPPFKIRRKLSDPGAFAAAANGGGEGVVEARPPPVKIRTAVADGGGEDVMEARPPLVKIHKLGAPGTSSIRPEDQIEVMPASDYEMNSMRPEHLGNDDMDFINLMHPVIPCGEVQKDQMGLGKHSIISEQQIENKT

SEQ ID NO: 172304 - protein, 77 aa, Triticum aestivum
  Clone ID: PAT_TA_66722.pep
QCFPPKGFFVRGICLMVVQFLLSYVRCGLIAVSVCYVMCLAVCIDSVLLAQFRWCIFTFRGGITCQSCCREFFWFVR

SEQ ID NO: 172305 - protein, 172 aa, Triticum aestivum
  unsure (1)..(172): unsure at all Xaa locations
  Clone ID: PAT_TA_66723.pep
DPEFNYTVQVDDESRIKTLMWVNGRSVDQYRCFGDVVTFDTTYRTNLYDMPFGLFVGVNNHFQSIIFGGVMLRDEKEDTFKWVFREFIRMVGGKXPVNNINRXRSMELAIETEMPNTTHRWCKWHVLKKAKESMGVLWSKKTDFTSEFHKLVHHMVTEQEFEDGWSAMLIVS

SEQ ID NO: 172306 - protein, 102 aa, Triticum aestivum
  Clone ID: PAT_TA_66724.pep
LKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 172307 - protein, 221 aa, Triticum aestivum
  unsure (1)..(221): unsure at all Xaa locations
  Clone ID: PAT_TA_66725.pep
MGSFANAGSAPAPSAARPHVVLLASPGAGHLIPLAELVRRLVEHHGFAATIVTFSGLSDSEALPSGILDSASTVALPAVKIDDLPADALRGSLLVELIQRSLPSLGTLLRSMGSTTPLAALVPDFFCSAALPLAVELGVPCYVFVPSSLTMIYLMRRIVELHDDAAPGEYRNLPEPLEIPXGLSLRRAELPVPYRDCNGLAYAQLLRGGRRYRRADGLLMN

SEQ ID NO: 172308 - protein, 144 aa, Triticum aestivum
  Clone ID: PAT_TA_66726.pep
TPLPTEALAPHGCYSSPMDSTTSSSSRYPTAGWAAQTVPAPVVSQCIWPVSLVVPNLSYALVAPDCVCLLRVESYVWSWSAMVSNQGSVFTSSVARVAPTSCIHVPVAPDTEPLYVRVAPWAPTICKHVSVVPDHVFVLLFHLV

SEQ ID NO: 172309 - protein, 114 aa, Triticum aestivum
  Clone ID: PAT_TA_66727.pep
SNVRCLDYFTHGGKQYLFTGSDDGTAKIWDVQKKICVKTLVGHANRVSTVYAHPQLPILMTGSRDGTVRLWNTSTFRLERILNFGLRKVHALGCMKGSRRVVIGHSYGLATMEI

SEQ ID NO: 172310 - protein, 110 aa, Triticum aestivum
  Clone ID: PAT_TA_66728.pep
KRKGKAPPPRGGTGATFQLNRGNNIANIFRRGQGNTRYKKGGDRNYMGPLTSYGLQKTIWGKSPNYPFLQGGEENIYLKLGGLTTRTLGGGETKPKRGIIGGTWATKKPG

SEQ ID NO: 172311 - protein, 101 aa, Triticum aestivum
  Clone ID: PAT_TA_66729.pep
MAAQGLLSGRQLLGRPLQSSISRSSSSRKSAFVVRASSSPPAKQNDNRQLRFASKQSLTYLDGTLPGDFGFDPLGLADPEGTGGFIEPRRLAYGETFNGRT

SEQ ID NO: 172312 - protein, 76 aa, Triticum aestivum
  Clone ID: PAT_TA_66730.pep
PGAPGGPEEKKGEIGFGIFWRAVFSFPCGSFPGLVFPRECVSLRDYFGSFPSFWVLVAFHGPPGVGLFGGRRGGVN

SEQ ID NO: 172313 - protein, 109 aa, Triticum aestivum
  Clone ID: PAT_TA_66731.pep
PNPKPLHPPLELRRPISLPPLLLPRNSHRGLRRRREVEDLGRGWRRREAELLDPGGRGLEVEEGGGIQIEGVTWSFSRFSPGRRISPATDCILMLPGLYQQPAFTIRFS

SEQ ID NO: 172314 - protein, 135 aa, Triticum aestivum
  Clone ID: PAT_TA_66732.pep
MAKKGKDAAEPDAKAAAVRSLFSADNPFRRKESAPPPTPASAPAVPAPARKPRRRPEAEAEAEPAVPSRRKRSEEDGEGPARRKRKRDEVEAGYERRTLGRAPADDEERPRPVVGAKRKAPHDVEAAASGGEEED

SEQ ID NO: 172315 - protein, 85 aa, Triticum aestivum
  Clone ID: PAT_TA_66733.pep
PLYPGGSFDPLGLAYDPEAFPELKVKEVKNGRLAMFSMFGFFVQAIVPGKGPLENLAGPLSGPVNNNAWGFAPNFVPGKLGVGAP

SEQ ID NO: 172316 - protein, 166 aa, Triticum aestivum
  unsure (1)..(166): unsure at all Xaa locations
  Clone ID: PAT_TA_66734.pep
HPLPPPRPRPKPKPPKPKPKPGRMKPEPVRDQTDSVFPFPADPLACAAHCSEPCAHYGLCRPPPPSRTATVXPPLLLSPTHPAHRPIGVRPRRVRSPPPRPARLPRRAPAPAPCRQRRAAAAAPPARPRRASGRHGGPGAGGQRLRRRGAPRVVHTHRGTRRARHR

SEQ ID NO: 172317 - protein, 134 aa, Triticum aestivum
  Clone ID: PAT_TA_66735.pep
SVQSAHAEQLHPGLQAVQLRRTLVHRGHERRRRRVGHREVVGEAQARIVRHPPELHATKRSTQLDGTTEANYTTNPISRARANETKGQEHQSKEMSSLCAKQLVARDTCSSDDQIFPENNNRRARELISHSYRH

SEQ ID NO: 172318 - protein, 110 aa, Triticum aestivum
  Clone ID: PAT_TA_66736.pep
HPLDFDAYGGQGQGFGGGVSLTLGLQQHDTHGGDGVNIAFGAPSSAQHGAGGFLFPGEQMDGVGLHPSGGHGQNIQFGMDGAAEGSSHGVQDQHYRGMSAGFHLLRDLAG

SEQ ID NO: 172319 - protein, 70 aa, Triticum aestivum
  Clone ID: PAT_TA_66737.pep
GNWREILKTPKRVLENADAGTIHHPNSVTLIYLLAGLPIIHTGVGRSSSCRRRQTSRAWWRWPLGHTGGR

SEQ ID NO: 172320 - protein, 37 aa, Triticum aestivum
  Clone ID: PAT_TA_66738.pep
ARLVRVLERLSASAEGEGCGRVSKLAVAMAQAVMPAM

SEQ ID NO: 172321 - protein, 67 aa, Triticum aestivum
  Clone ID: PAT_TA_66739.pep
LNTPCPQKNTAYFAIITLVVIVKFTQRDPLKNGWVLLPTLDVGVKPLQLLLGLANHHANHVADGNHP

SEQ ID NO: 172322 - protein, 159 aa, Triticum aestivum
  Clone ID: PAT_TA_66740.pep
PILRAVMFGGRVRYFACFHEWGILASTLHTLPRPESVPLPRLLDLPHCVAGLPFLLLLPGLRRRLQSCSARISPPRPPSPHPPPWSDHHGRIGPLSDLSIQVWCRSRPWPLAGMAKAPWAGRCQIDGSKGKRPSGRRRGGRPLDRADGDGLVRWTSCRI

SEQ ID NO: 172323 - protein, 82 aa, Triticum aestivum
  Clone ID: PAT_TA_66741.pep
GCTTEFQGRSSKGEVECGECRHRQDVALRLPATHASLPPVKFGRLAFRKNMQKIMLGHATTPHALTPSKTYIGCQGGITVKK

SEQ ID NO: 172324 - protein, 126 aa, Triticum aestivum
  Clone ID: PAT_TA_66742.pep
MAASALDHTTSFLGTAPWRDDLVRIVCYFGGRITMRRTVKSAPQSIWYGPDRTKYLGPFSEHTASYLTGEFPGDYRWDTVGLSADPETFAKNRELEVIHSRWAMLSTLWCVFTEILCKNGIKFCEA

SEQ ID NO: 172325 - protein, 78 aa, Triticum aestivum; identical to SEQ ID NO: 106952
  Clone ID: PAT_TA_66743.pep

SEQ ID NO: 172326 - protein, 74 aa, Triticum aestivum
  Clone ID: PAT_TA_66744.pep
GINLHCTQLAIGPLARSIVVLINTRSTFHYTTIHDVQVHMHISADGRTDGRTGNLIYLPGAKLVAKAQPLLLTG

SEQ ID NO: 172327 - protein, 105 aa, Triticum aestivum
  Clone ID: PAT_TA_66745.pep
GQVAGGRDRGQRGPVGGLLQDRPQPRGGQGVLRVNQKLGGCRWLDRSGLIRKRNEATPLLSSKFKVYKMAQRDGVSFVSRLLPELGGWGFKNQTGLGQNKLPLFM

SEQ ID NO: 172328 - protein, 204 aa, Triticum aestivum
  Clone ID: PAT_TA_66746.pep
PPGDYSGESFRRLERQRVARECGGEDAGGLRPCDRATHAGHHAAPAGGGGGEDASGGRELLLHVQGAVRHHECAQAASGSASSVALPVAPATDILPRRRGRRGPVHGVALSGRTSTAARMWMAASGGYVAGRYGGGRGTREEGAASDWAKVWVLPSSHTVAEESRRLWRTSSGGGSRSRFCSECINGVVSRRPLHLGLARGIRP

SEQ ID NO: 172329 - protein, 34 aa, Triticum aestivum
  Clone ID: PAT_TA_66747.pep
SRHTIIYWWMIMSLFTNKLTSLLFAIHPMSQSLK

SEQ ID NO: 172330 - protein, 62 aa, Triticum aestivum
  Clone ID: PAT_TA_66748.pep
EFGTRTLQAVSRDSRRTAPSSERLPCYGTVDAHEEDGLVGLHTSLLQAARPSLNKAEARDKI

SEQ ID NO: 172331 - protein, 113 aa, Triticum aestivum
  Clone ID: PAT_TA_66749.pep
VAASGGAGMGTVNDDATSANESGNRLSGQLAPKKRKEMGRPSTSREKASYEGLSKRPRFCTICRGQGDKRTTCPDRGDAPEPVRKPSRCKYCGIEGHRRNNCHKVGDLRLAGM

SEQ ID NO: 172332 - protein, 81 aa, Triticum aestivum
  Clone ID: PAT_TA_66750.pep
RQSLDSTEFEFANLLVEDQNNDAMSYVDYLCFVHKQIQNDLSGAGSSSKASYQQDDHQAAAAGGGNAASFIDPGSLWRAAW

SEQ ID NO: 172333 - protein, 169 aa, Triticum aestivum
  Clone ID: PAT_TA_66751.pep
EFGTSVDVTSRGNTPFYCTPEYWDSFKGDMDDPVQVPEVSDEKAATSLETDEIASHASVGSQGVQEEVEEVTGRRKRRGSQHVKSSYVVPKPNKHAKRSAKGKLFQNGDVNKSGDEYDVVKASIKYVRAHEHSQKHAKTEIFNDGMEEGLTVRRACQIINHEWLSGDIS

SEQ ID NO: 172334 - protein, 137 aa, Triticum aestivum
  Clone ID: PAT_TA_66752.pep
FNPQRDCFKVHSKLHKVLTTDTAASVTMRIRCSNGLRISEHFGSFLQRNVTDLEFGNLNADKAIAALLKIEGKLKDNGSVEAQLQCALLYTSAAGERRVRCHNLTLPVTRVIGNIFRSADMDATMALLTKQYIAHIV

SEQ ID NO: 172335 - protein, 111 aa, Triticum aestivum
  Clone ID: PAT_TA_66753.pep
MVPHTMLRPFGVNPCAAGGHLRRHHARLCLRRASSVDATTGTLPGGSSNTRRRKKQAAEESRLEVLYDDGFGSATMKDYWEAVRAMPKDDGGPPRWFCPMECGRPEVDRAP

SEQ ID NO: 172336 - protein, 199 aa, Triticum aestivum
  Clone ID: PAT_TA_66754.pep
EFGTRADAEHTGRACTHEGRRVIESQLHACARREVIKATSSRSWKNREAATSWTPSLNWTAGRRRRSRSAVARELRWWTTCWARQRRCLRVGRTARCPWTSSASPTCYSLPTSAPGSRSTSRLPTRTTPVTTMRRTVTSSGSSPSSPARTTPIPAEAQVSTTRRSTRAARRGTDQEARTITAAASPRAPRWCSSPTAAP

SEQ ID NO: 172337 - protein, 55 aa, Triticum aestivum
  Clone ID: PAT_TA_66755.pep
FWDFFFIFFFFLFFLDQKTYFVYNKTFKKLKKLHQNYLDHDKQSKKFKMQKKTKI

SEQ ID NO: 172338 - protein, 121 aa, Triticum aestivum
  Clone ID: PAT_TA_66756.pep
RPTVRPATTFTVRASSAEAEAAGRRAVLGLMASGVVGIAFAHVVHAGTVAAIKVGPPPPLSGGLPVTDNSDEARDFDLPLKNRFYLQPLPPAEAAVRAKEFAHDILNLKPFIYKKQWPYFM

SEQ ID NO: 172339 - protein, 220 aa, Triticum aestivum
  Clone ID: PAT_TA_66757.pep
EFGTRPLQGGVLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLEAGAKKVLITAPGKGDIPTYVCGVNADLYTHADTIISNASCTTNCLAPF

SEQ ID NO: 172340 - protein, 166 aa, Triticum aestivum
  Clone ID: PAT_TA_66758.pep
HIHSFPKSSFPNLSDSNPLSPQPLLAGHGQPDHGNLPQRAVLLWCSRSSSLTHACRRVVWWTGGAVLQMESAGGYGTGGVARRCWNSHGGGVAVVTTGSVGTSHQGCWKRPAKKLQPLDGDGSAAARAADEDERGAAGAGEHGRRRGKRGIVAGQRGEEAGDLAEL

SEQ ID NO: 172341 - protein, 65 aa, Triticum aestivum
  Clone ID: PAT_TA_66759.pep
VERCIRKVMHGEGKDEYRRNETKWMEMAKKPMQEGGSSDKNIAECQLFIDINLGLIIHSHPMVIL

SEQ ID NO: 172342 - protein, 68 aa, Triticum aestivum
  Clone ID: PAT_TA_66760.pep
NLGWEIGKYRKHNGEFVFATIMERVLCFEYMHGGSLDKHIEDEACGLEWPTCYKIIKGTCEGINYLHN

SEQ ID NO: 172343 - protein, 133 aa, Triticum aestivum
  Clone ID: PAT_TA_66761.pep
TQQVEEGKKRWNWPLRSTYIIINSRHAHSTPKTTILEKLWQALLKVRKRCSVWEAISNNSWISKIKRLSDHSCQKFGSIGSRNGVAGRGSRRLKSRVEEGYSSSGRYFGSRYATPLKLGRKIRVDLVVPSGKY

SEQ ID NO: 172344 - protein, 53 aa, Triticum aestivum
  Clone ID: PAT_TA_66762.pep
LSRRLQALEADRSFLEHSVNSVRNGRDGEAVIHDIARSLRELRKTLGEDTMAS

SEQ ID NO: 172345 - protein, 72 aa, Triticum aestivum
  Clone ID: PAT_TA_66763.pep
PPHELKKPPGLKGSLDPFLGGAALPKNGGISLFEFPKFLQTAGMSTPPGPSGVSNPPGFLKLTRRVYRGKWL

SEQ ID NO: 172346 - protein, 58 aa, Triticum aestivum
  Clone ID: PAT_TA_66764.pep
TPLKKKTTGGKNFAQGKPPRIPWANGGGAFPLKTLVSPPYPLQVQTPGKKPFPPGAPK

SEQ ID NO: 172347 - protein, 216 aa, Triticum aestivum
  Clone ID: PAT_TA_66765.pep
NSARASVLLGACNVLKKIIVPKEGTTHSAYRSSLAVAFLFTFLYPMTKRNVKPARSARLNGHAASDTNGNPNCPPSADIDLSLKETNSVESGLHSNDHILESCKQIVEISKDYLPVGIPAKKVGAELQASGEAVYVDDIPSPEGCLYGAFVYSTKPLAHVNSIELDPSLEQVKTVAVITVKDIPEGGGNFGANTIFGPEPLFGDPLTQCAGEPLGI

SEQ ID NO: 172348 - protein, 98 aa, Triticum aestivum
  Clone ID: PAT_TA_66766.pep
AKSVQCFGPKLNRCGEGNCVHVKGCFSLRALLGLAFDLKGGNGVFYGKNKFVWNSLYKNCGECYDFQPKKALEVEKISPLAWMLSQDLFFRGMLRQSL

SEQ ID NO: 172349 - protein, 189 aa, Triticum aestivum; identical to SEQ ID NO: 171222
  Clone ID: PAT_TA_66767.pep

SEQ ID NO: 172350 - protein, 105 aa, Triticum aestivum
  Clone ID: PAT_TA_66768.pep
RRHCCPPMEVNPGRGHCPVKLLLSKFSPPLVPDDRFFVMGIQGIELPPAFFFSLLFLFFFFLFLIFQGPDPDYNRLPAKEVLTLGICKIYYCLPGFDVEFNSFLG

SEQ ID NO: 172351 - protein, 89 aa, Triticum aestivum
  Clone ID: PAT_TA_66769.pep
MANAAEHRVQMQAAPPAGKVVPAAPEKRLNRLAHSIASMERVGNALGTLDFTWATVVVLSGYPTVLHVLDFWFATAIIFLEGLRYVCNF

SEQ ID NO: 172352 - protein, 126 aa, Triticum aestivum
  Clone ID: PAT_TA_66770.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEA

SEQ ID NO: 172353 - protein, 132 aa, Triticum aestivum
  Clone ID: PAT_TA_66771.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINE

SEQ ID NO: 172354 - protein, 175 aa, Triticum aestivum
  unsure (1)..(175): unsure at all Xaa locations
  Clone ID: PAT_TA_66772.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEXIHCRWAMLGALGCVFPELLARNGVKFGEAVWFKAGSQIFSEGGLDYLGNPSLVHAQSILAIWACQVVLMGAVEGYR

SEQ ID NO: 172355 - protein, 95 aa, Triticum aestivum
  unsure (1)..(95): unsure at all Xaa locations
  Clone ID: PAT_TA_66773.pep
MSGPLDRLARPSFEGFTHNDGKKESRSDADNSQGEKKTKIASFKKKAINARNKFRHFLWRRSXKKNEYQISIDDITDVQDLQAVEAFRQCLHDED

SEQ ID NO: 172356 - protein, 201 aa, Triticum aestivum
  Clone ID: PAT_TA_66774.pep
IRHEVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLAGDPDTAAELKVKELKNGRLAMFSMFGFFVQAIVTGKG

SEQ ID NO: 172357 - protein, 135 aa, Triticum aestivum
  Clone ID: PAT_TA_66775.pep
IRHELARLLRSRSESRGLHPAGALTRPCEEEEKVVFGRSGPTSQQSARISGATHSGCAGAPHGRLQTREKFCPTASSRQKRKRRKKALQDASPPGRSSLTGREARRLHPAGAPARSASAESRQLSSTTATTQKSM

SEQ ID NO: 172358 - protein, 57 aa, Triticum aestivum
  Clone ID: PAT_TA_66776.pep
MTAGSMALSCPAMADTPVNVWRETPFGEGRVTMHKTVDKPRVAECSEPGHGSDRVLY

SEQ ID NO: 172359 - protein, 40 aa, Triticum aestivum
  Clone ID: PAT_TA_66777.pep
IRHELTCPHAADPDARTNPRQGGLDTIEGDHLANGAHSTA

SEQ ID NO: 172360 - protein, 91 aa, Triticum aestivum
  unsure (1)..(91): unsure at all Xaa locations
  Clone ID: PAT_TA_66778.pep
AGITAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 172361 - protein, 38 aa, Triticum aestivum
  Clone ID: PAT_TA_66779.pep
GLSPEKSEKSTFCMKATLLCRRGLVGMSAAARVSSCRI

SEQ ID NO: 172362 - protein, 36 aa, Triticum aestivum
  Clone ID: PAT_TA_66780.pep
DVTVRQDVSCLLMNSTDSLKGMTYLGISGYMVIVNS

SEQ ID NO: 172363 - protein, 60 aa, Triticum aestivum
  Clone ID: PAT_TA_66781.pep
SNNQFMHWRKSPHVKTTPVSEAAYAEGTNILRCHCQSPLSTLIQQQVRSDPKKGATAIAN

SEQ ID NO: 172364 - protein, 118 aa, Triticum aestivum
  Clone ID: PAT_TA_66782.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSK

SEQ ID NO: 172365 - protein, 120 aa, Triticum aestivum
  Clone ID: PAT_TA_66783.pep
NSAREEAGEANCSSYMEEMAWVKEVYGVSTAEAMELLEHFLAMNPDSDGRVKAQDFWAPFGLDCSPLCKKIFHYFDFENKESITFRQFLVGCAHLRKQPMFEGVCETAFEKCKAPGTSDI

SEQ ID NO: 172366 - protein, 166 aa, Triticum aestivum
  Clone ID: PAT_TA_66784.pep
NSARGKFEALDLSGNQIEGQLPRSLASCKYLEVLDIGHNQISDSFPCWMTALPRLEVLVLKSNKLFGQVSPSIDDEKSTFEFPRLRILDLASNNLSGTLTEGWFIRLKSMMVEVVNEMSVMEYNSYQNQVYQVNTVLTYKGYAGSFTKILRTLVFIDVSNNAIHGS

SEQ ID NO: 172367 - protein, 159 aa, Triticum aestivum; identical to SEQ ID NO: 172009
  Clone ID: PAT_TA_66785.pep

SEQ ID NO: 172368 - protein, 59 aa, Triticum aestivum
  Clone ID: PAT_TA_66786.pep
IRHELGRVTRALLTRRDVRITTLRRARPKTQENHPYADQPDYESGVQDFLERLTHYEKV

SEQ ID NO: 172369 - protein, 154 aa, Triticum aestivum; identical to SEQ ID NO: 172256
  Clone ID: PAT_TA_66787.pep

SEQ ID NO: 172370 - protein, 153 aa, Triticum aestivum
  Clone ID: PAT_TA_66788.pep
CRCSGVRSQVGMLKESYPSQLLMSLASSPSCAQQLLQSCPSIPSLEIRRWLARGGLRRNRKTGGNRCCCLRALPRSGYCHCSLARGGPEATDKRGIVAAAAMHSLAPATAVALSCEAASKLQVNRGTLPPPSLAPSLRLPPTPAHGRRILVPN

SEQ ID NO: 172371 - protein, 103 aa, Triticum aestivum
  Clone ID: PAT_TA_66789.pep
EFGTRDEHRVHDEVPIRGSPDERVRRRAGLLLEPAAHRQRHPREPHHQRGQGPQVEDGALPARLGRLLPRALLPRPPLRLQEQEEVAQPEGPGSLYRHIMLVC

SEQ ID NO: 172372 - protein, 93 aa, Triticum aestivum
  Clone ID: PAT_TA_66790.pep
RRQARLPCSGTISSSQSRWIQACCGRRDPRSHRLADNKGTVKVDKLASRSFSSSHTNPPSSLTDLRDRGGIQGAKQASSSVRVGQVTCRVACR

SEQ ID NO: 172373 - protein, 135 aa, Triticum aestivum
  Clone ID: PAT_TA_66791.pep
PTRSVPGADHSRRHHLPEPLLELQPPPTPRARHLGPYLAGSCQGTTCTPSPKSTSLQPQRQRPVAASHRAAVAARASDPLARFYDEGPRASPKRLLEQLSYASMRRAESTRAPLPPTLAGLCPAAPRGGSEGGGP

SEQ ID NO: 172374 - protein, 207 aa, Triticum aestivum
  Clone ID: PAT_TA_66792.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENVN

SEQ ID NO: 172375 - protein, 139 aa, Triticum aestivum
  unsure (1)..(139): unsure at all Xaa locations
  Clone ID: PAT_TA_66793.pep
MVKCRMEHCLIILAKHHHGITANTASHLPLLPARRSAVRFPVRAGAAEPPAPAAKPGSPKKRCKTEVNESLLTPRFYTTDLHEMEQLFNAXINKQLNQDEFYALLQDFKTDYNQTHFIRNPXLKEAADKMHGPLRQIFI

SEQ ID NO: 172376 - protein, 174 aa, Triticum aestivum; identical to SEQ ID NO: 172025
  Clone ID: PAT_TA_66794.pep

SEQ ID NO: 172377 - protein, 97 aa, Triticum aestivum
  unsure (1)..(97): unsure at all Xaa locations
  Clone ID: PAT_TA_66795.pep
IRHEGTSTAPRLKEKMPGLKENTSSHEIDLPGAKVGEVCVRFAPEPIGYFHIGHAKAALLNKYFVERFIGRLILXFDDTNPSKASTEFVEXLLKDIE

SEQ ID NO: 172378 - protein, 191 aa, Triticum aestivum
  Clone ID: PAT_TA_66796.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYE

SEQ ID NO: 172379 - protein, 140 aa, Triticum aestivum
  Clone ID: PAT_TA_66797.pep
MADETMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSE

SEQ ID NO: 172380 - protein, 65 aa, Triticum aestivum
  Clone ID: PAT_TA_66798.pep
FHGVFTPPRAVGLPLQLPSSSVIVALFFPSSPAPTPNPQPPPPQRRTTPIWSSSTPSPAPPSPYL

SEQ ID NO: 172381 - protein, 72 aa, Triticum aestivum
  Clone ID: PAT_TA_66799.pep
MVAAAAILPELATQLVVPVAAAVGIAFAVLQWVLVSKVKVAPEPRGEGGSAAGGGAGAGGKDGASEYLIEDE

SEQ ID NO: 172382 - protein, 82 aa, Triticum aestivum
  Clone ID: PAT_TA_66800.pep
ETTVVVDAYLHIYIDYSFMAHACIALFGALRRFKERRKKAPEKRERSREINLHGASGGGAWDGNILIRDKSSSSFSSSSDDS

SEQ ID NO: 172383 - protein, 85 aa, Triticum aestivum
  Clone ID: PAT_TA_66801.pep
LFIVLFTFMLISTPSDSKYKPFWRFQYGLHTDAYRHILECRFTHFAPYIIHVGISKKAYIWERREQYLISLLNSHYYIHLSQVEY

SEQ ID NO: 172384 - protein, 74 aa, Triticum aestivum
  Clone ID: PAT_TA_66802.pep
QLCTLLCPDVPILEGCCLTHDSSCTAYERCSLPTTPLCASSLLALSWQNHASIGHGGVMCIAVLILKYLCCAFC

SEQ ID NO: 172385 - protein, 61 aa, Triticum aestivum
  Clone ID: PAT_TA_66803.pep
AFPLIHNAFGKLYPLLSQPCSAFELELITSEDLVYDSKMPRWVEPMPSLVCVNPKVFTSHT

SEQ ID NO: 172386 - protein, 166 aa, Triticum aestivum
  Clone ID: PAT_TA_66804.pep
MAQTMASMTGLSQGVRLPGPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEK

SEQ ID NO: 172387 - protein, 84 aa, Triticum aestivum
  Clone ID: PAT_TA_66805.pep
GKVRRDAASWGPGADGPTRQPTVRVGARVERPLTGGPAAGLAEGQGRIWELLNGAGEPGSNPLSPARLVCDNQPLCTCAINSFV

SEQ ID NO: 172388 - protein, 65 aa, Triticum aestivum
  Clone ID: PAT_TA_66806.pep
NKRCIREKVPKPRPALGLKATKDERRTRELRSNDEDLSALEMAREVGILPSKEGERGERRSSRRR

SEQ ID NO: 172389 - protein, 49 aa, Triticum aestivum
  Clone ID: PAT_TA_66807.pep
NSARASCLLTPHWHTAPSSTPTPTIADAARLPSSVQLHIISMLDVRIML

SEQ ID NO: 172390 - protein, 61 aa, Triticum aestivum
  Clone ID: PAT_TA_66808.pep
MDATAMAMALTSISAFEWLKVINNLLVSRRCTLASVGCVGAGETITRMQVGPIEGIKKMET

SEQ ID NO: 172391 - protein, 103 aa, Triticum aestivum
  Clone ID: PAT_TA_66809.pep
MADAKSQGRAATTALSSTPTPTWAERTEALTHILTHPSHSPSLHSQLFLASRVPCPPRGSSYPTFLCPGASLLRWALTSVFLPRADRLGLPTSTWRSRCPFQL

SEQ ID NO: 172392 - protein, 66 aa, Triticum aestivum
  Clone ID: PAT_TA_66810.pep
SQALKDALKSKPQNKMHLYPLYATCIKLPFFPSNISQASKDALNFRSHKKDLYPFCYSKKFLFSSR

SEQ ID NO: 172393 - protein, 131 aa, Triticum aestivum
  Clone ID: PAT_TA_66811.pep
MAAAFSSTVGAPASTPTNFLGKKLKKQVTSAVNYHGKSSKANRFTVMAAENIDEKRNTDKWMGLAYDISDDQQDITRGKGIVDSLFQAPTGDGTHEAVLSSYEYVSQGLKKYDFDNTMLGLYIAPAFMDKL

SEQ ID NO: 172394 - protein, 49 aa, Triticum aestivum; identical to SEQ ID NO: 147490
  Clone ID: PAT_TA_66812.pep

SEQ ID NO: 172395 - protein, 119 aa, Triticum aestivum
  Clone ID: PAT_TA_66813.pep
MAAQGLLSGRQLLGRPLQSSISRSSSSRKSAFVVRASSSPPAKQNDNRQLWFASKQSLTYLDGTLPGDFGFDPLGLSDPEGTGGFIEPRWLAYGEIFNGRTAMMGVGGMIAPEALGKGG

SEQ ID NO: 172396 - protein, 118 aa, Triticum aestivum
  Clone ID: PAT_TA_66814.pep
FGTRKYTSTFRGKTSIVAALAITKATYGCTPSRYMHAHHMHTQHTRSTQHASTHAHHTYASTRRCSACNITHAHLQAGGCVLEKGKSSFQALSHGTLVSYFAELIQKNCRKSFRKYSE

SEQ ID NO: 172397 - protein, 101 aa, Triticum aestivum
  Clone ID: PAT_TA_66815.pep
MAQGRILPLVLSVLATVAEAVASCSFTDSNPIRPVTERADSTLESTVLAALGRTRHALRFARFAVRYGKSYQSAAEVRRRHQIFYESLKEVRSTNRKGLSY

SEQ ID NO: 172398 - protein, 39 aa, Triticum aestivum
  Clone ID: PAT_TA_66816.pep
SGSITPISQPIILDDIVHRRAVVAQCVCRVRWISARAEF

SEQ ID NO: 172399 - protein, 81 aa, Triticum aestivum
  Clone ID: PAT_TA_66817.pep
VCHVFCFVRFRSMGRLRKVSHKDVSVVSSIMSADSWNDPFVPNDFAEDGSNAMSLVVISVLFSTFIFVFILSFSLLFFFVC

SEQ ID NO: 172400 - protein, 50 aa, Triticum aestivum
  Clone ID: PAT_TA_66818.pep
EFGTRFFFVLLFNITHSFFLVWESSTYYLVKLFSWVVIIHGQPHTAGQIN

SEQ ID NO: 172401 - protein, 81 aa, Triticum aestivum
  Clone ID: PAT_TA_66819.pep
TLAKTFEILHRYRGKYPFSCLRLLVVALMASSPFLFLGEILLNPAQLGGMLARWTMLQLVLIVICPITTKQNIHCILVPNS

SEQ ID NO: 172402 - protein, 94 aa, Triticum aestivum
  Clone ID: PAT_TA_66820.pep
EFGTRAHTTQSWRPTPCAVGPNKMQPDSPILLRRRGRRREVSGLRVGACNRGASPTTAAPAASPDPASPSRAPKQKPHRHLRAHTFLTTNTHQS

SEQ ID NO: 172403 - protein, 77 aa, Triticum aestivum
  Clone ID: PAT_TA_66821.pep
ASPPPPRPSRPTPASAAPRSRPPPPPSRPSCCSSLAALLAASARSRAGSGSGRAANSRSPAALGRPRPAPCTRRPCE

SEQ ID NO: 172404 - protein, 60 aa, Triticum aestivum
  Clone ID: PAT_TA_66822.pep
MRASRTEETACQSRKVPILSVNNCGFFKSVVTMNMCSKCHKEMAMKQEQAKLAAYSFDSI

SEQ ID NO: 172405 - protein, 207 aa, Triticum aestivum; identical to SEQ ID NO: 171251
  Clone ID: PAT_TA_66823.pep

SEQ ID NO: 172406 - protein, 232 aa, Triticum aestivum
  unsure (1)..(232): unsure at all Xaa locations
  Clone ID: PAT_TA_66824.pep
NSARGRLPPXTSPRGAAERWSPGTPAGFAGSGSHFTPPLSAGFCSYRVTPPASGGGCSRPPRAPPALDSPYVRAKQAQLVEKDPNKAVSLFWAAINSGERTESALKDMATVLKQANRTEEAIEAIRSFRDRCPNEAQESLDNILLDLYKKCGRTKEQIEMLTVKLRMIDEDLASGRWKTKLSKSHGRVFYLSLRDEKARLLGNLAWAYMQSENYEEAEMLYRQALAIETDYN

SEQ ID NO: 172407 - protein, 78 aa, Triticum aestivum
  Clone ID: PAT_TA_66825.pep
GDEDINKMISELRRRLHDQLKEKKYGLHKLDKAIQDTKSIEERSLEQHALNKLVESAYSKLQGVEAVEGTRAGSCQKA

SEQ ID NO: 172408 - protein, 221 aa, Triticum aestivum
  Clone ID: PAT_TA_66826.pep
IRHEVNCCCGKEKLLALGSSGILAEHQLQAQLQEQHLKGQSKLTISDVARKAFLHSHFMEGHAKSGPISRLPLVTISDPSNLLRDIPVCQPFHLELNFFNQENRVVQYPVRAFYLDGFNLMAHNLSSGADNLYKKLYSTIPSNMECHPKYISYSPKQHMFLVVFELSGPSGVVHEVVLYWEQTDLQTVNSKGSSIKGRDATFLGPDDNQYAILEEDRTSLN

SEQ ID NO: 172409 - protein, 83 aa, Triticum aestivum
  Clone ID: PAT_TA_66827.pep
PLSSSSSSAPRKIPFDLPQQPETSSSATTAQGIRKRKKRTQQRKRLRIQNHRIKRTSNKTKKDLNLFPKLHSSNRSNYARAEF

SEQ ID NO: 172410 - protein, 67 aa, Triticum aestivum
  Clone ID: PAT_TA_66828.pep
LVSNPGRYGPFGDEVGTYFSSPATAEGKVVGFPGRSGQPLDALGVPMQPWQGGPRAGPKYVLSKYLF

SEQ ID NO: 172411 - protein, 157 aa, Triticum aestivum
  Clone ID: PAT_TA_66829.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPT

SEQ ID NO: 172412 - protein, 54 aa, Triticum aestivum
  Clone ID: PAT_TA_66830.pep
TLIIQVLPFCTKLKNCGLSICNLDNCFGFKLYEPKCFFQFIISVHFDFIHTPLN

SEQ ID NO: 172413 - protein, 153 aa, Triticum aestivum
  Clone ID: PAT_TA_66831.pep
QQVCGAVSGKLADTSLTTLALICLWPCSAGSRYLAMVVAATEARGGSYALPWRPEEEEALLWSDQWLPCRRQRPPSSTDQLTPKATAPDLEHELGNLAPTYAAAGQISPYFGLEIFGRNSCLIAQNHLSNGNIQRSFSVYELYWKQQRIWNSQ

SEQ ID NO: 172414 - protein, 118 aa, Triticum aestivum
  Clone ID: PAT_TA_66832.pep
EKRRVICNTRFELLTMIPPVISVIMFLTELVGTFQVSIGCWFSRDTSPGINVLAGMWVHIYCACGSIYITHPSSPDKNRGLLGNTHDCSYHINWSLMGKANGSSINLDETGRREYAID

SEQ ID NO: 172415 - protein, 61 aa, Triticum aestivum
  Clone ID: PAT_TA_66833.pep
KPQHHQQPTSRQPHNTQASPGTEPRAPVSISGTSSRSGVLRWSKVEKRCWGMQVEELEREE

SEQ ID NO: 172416 - protein, 87 aa, Triticum aestivum
  Clone ID: PAT_TA_66834.pep
AAPSSSLHAQVVHEAAPALSNKGYPKWSNSQVKHFIWWTLMQETASIIKLFVDFSFAKTCLVAFIISITFRSYTNMKLQTKFTSYNK

SEQ ID NO: 172417 - protein, 87 aa, Triticum aestivum
  Clone ID: PAT_TA_66835.pep
PHLRNSSSLDPPFSSALDEDRPRHGSMEQRLLVLEFLFDSSSSRSGPPIPYSSCSSLPVLQALSTKLAGGTTFANDDTRGMNNFIIL

SEQ ID NO: 172418 - protein, 89 aa, Triticum aestivum
  Clone ID: PAT_TA_66836.pep
ECSAFIERVTRTCVELVGELGGSSLCDIAAAVPDSTTIAAEQGSEGQRDTEDELNNSMVPDQENESGPVREKRTRFQVDHTQVNSRVHS

SEQ ID NO: 172419 - protein, 124 aa, Triticum aestivum
  Clone ID: PAT_TA_66837.pep
SCTTPATVGTEAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAA

SEQ ID NO: 172420 - protein, 188 aa, Triticum aestivum
  Clone ID: PAT_TA_66838.pep
AYHRANGLLATVADDMVLVLFDTVSMKMVRRFEGHTDRITDLCFSEDGKWLISSSMDGTLRIWDISLARQIDAMRVDVSITSVSMSPNMDVLATTHVDQNGVYLWVNQALFSPSTNVDSYASGKHVRNVLLPTVSSAERSEEEEPIKKSQDSNQSNIKPFVIMDHQIPDMITLSLLPKSQWQSLTNLD

SEQ ID NO: 172421 - protein, 157 aa, Triticum aestivum
  unsure (1)..(157): unsure at all Xaa locations
  Clone ID: PAT_TA_66839.pep
SFNVLRGKYCNNLPSFTESHIMQNLQSIASAMRRRLLGEAGNLPALSGNNNAXNSTGIQRPADVLSLGTGSFPAFPKSDGQILMPSVPESIENVDAATPKQVPAEVTQSPDKESSGAKYDIWTYVLIFLAALLLISLIIAPILVCRKRGDGSIAPWK

SEQ ID NO: 172422 - protein, 155 aa, Triticum aestivum
  Clone ID: PAT_TA_66840.pep
DSNRCRYVSPYMDMYPLFFPMSWPTQLSLSMQWPSRLQGRLRRLIPNLGPRLRRLLLNGCCPAVATPSSFHYKTPRAAPPLPYPLLPRFVRIRSEKMANGKLIFFLPGRPGAPADPLPSMHCQGGDLRFTSFITWLQSKPICANCPYSVEFITPI

SEQ ID NO: 172423 - protein, 121 aa, Triticum aestivum
  Clone ID: PAT_TA_66841.pep
GWIAFEVHFKSTDGYQSNRWRVAWVIPAVWQLISFALLCAVCLVWAPSHDSARLACSDEGGDGGDGDDGDDVEDGARPLMLRTGPLSYVENWACYVTQDAKIILRTDSGVYAKAGEEDKRV

SEQ ID NO: 172424 - protein, 50 aa, Triticum aestivum
  Clone ID: PAT_TA_66842.pep
ILPESCKNSFAGGTFPLNCHLLLLHNDRFLNFTEPRMLLVAFDASETLNR

SEQ ID NO: 172425 - protein, 179 aa, Triticum aestivum
  unsure (1)..(179): unsure at all Xaa locations
  Clone ID: PAT_TA_66843.pep
QVLRLATQPSILVAATTTTTTTTIQSVKARQIFDSRGNPTVEVDIGLSDGSFXRGAVPSGASTGIYEALELRDGGSDYLGKGVLXAVNNVNAIIGPALIGKDPTEQTDIDNFMVQQLDGTSNEWGWCKQKLGANAILAVSLAVCKAGAMVKKIPLYQHIANLAGNKTLVLPVPAFNVIN

SEQ ID NO: 172426 - protein, 108 aa, Triticum aestivum
  Clone ID: PAT_TA_66844.pep
SGKNKTATGGVAKPKRAPTPFFAFLAEFRPQYMEKHPEAKGVAAVTKAAGEKWRSMSDEEKAKYGGKKADAPASKAVNKKESTSSKKAKTDADEEGSDVEDDGEEDEE

SEQ ID NO: 172427 - protein, 84 aa, Triticum aestivum
  Clone ID: PAT_TA_66845.pep
RFEQLNRGNLRGRDWEDVAAAVTDGQGKSSGGKSVEQCKNKIDNLKKRYKVECQRIAGSASASLWPWYKQMEQIMGNSPSPGTP

SEQ ID NO: 172428 - protein, 58 aa, Triticum aestivum
  Clone ID: PAT_TA_66846.pep
WPPLPGAEPSAASLRPRRRRLRQDDGSREVEASGRCASVAVCVLPGLPNDGRCAARLI

SEQ ID NO: 172429 - protein, 161 aa, Triticum aestivum
  Clone ID: PAT_TA_66847.pep
RRGCCLLRRPKRKSQPPPSSSSSPSAALPPLRRRVHMPEPSTAAASGLQRRTEVSPLTALPRGVLPPSGGRRQRKPRRRVDVLPTYLARLNILQDRRDPSSRARVRPSAPSAARRSPTRPRRRQPLLHPLLQATEDAARPCCIDCSQRPWPSFSGRVGHQQ

SEQ ID NO: 172430 - protein, 127 aa, Triticum aestivum
  Clone ID: PAT_TA_66848.pep
MARPSLLLLLLVSACAALAVADDDPMVRRFEQWMGKHGRAYTDAGEKQRRLEVYMKNVELIEEFNSGGHSYTLTDNKFADLTNEEFRAKVLGLCAPGRTGRRAPRTENFAPVTMPEKEADNDNSTLP

SEQ ID NO: 172431 - protein, 55 aa, Triticum aestivum
  Clone ID: PAT_TA_66849.pep
HCLKILTSAPVARFHHTVLPMFIQIAYSKNNYTSEPHRLNRACTRTQKINLTSPF

SEQ ID NO: 172432 - protein, 155 aa, Triticum aestivum
  Clone ID: PAT_TA_66850.pep
MERYSALGMRLDGGGGDLPPGFRFHPTDEELITYYLLRKVVDCGFSGARAIAEIDLNKCEPWELPDKACKTTTEKEWYFYSLRDRKYPTGLRTNRATGAGYWKATGKDREIRSARNGALVGMKKTLVFYRGRAPKGQKTQWVMHEFRLEGVYAYH

SEQ ID NO: 172433 - protein, 113 aa, Triticum aestivum
  Clone ID: PAT_TA_66851.pep
PRRPEGNRGGEGGGGRVGSGDRRATRRRCGAEPERPHSRGLGASRRLVLARVSIHQPGPQSRPWSCRRSSSTSPEARRTGSAHFPTSSSSGSSSGSACAGRSAPGRSPSGGGT

SEQ ID NO: 172434 - protein, 59 aa, Triticum aestivum
  Clone ID: PAT_TA_66852.pep
YIQTEPKHGYSCLSIDAGTIQIVSVKIKTYVCMYRCKCHLDFGVEGGGQRRSPCPHCKC

SEQ ID NO: 172435 - protein, 108 aa, Triticum aestivum
  Clone ID: PAT_TA_66853.pep
EKEHISLQLCTPSSIQASGAGAGESVSARLLTSTAGARADSSMDSAAGPSAAGASAGAGASAALSALASGATATAARRSAARTSAVRAMTAPVRACVTWVDAQAGLTN

SEQ ID NO: 172436 - protein, 177 aa, Triticum aestivum
  unsure (1)..(177): unsure at all Xaa locations
  Clone ID: PAT_TA_66854.pep
QPRGCGGAPRRCSNAPLPYRQLPLAYEPARYCSCTPAAKAPLWISWSDLNPGRRYLACAKGRGAGCGFFEWADPEPNAFMNQLLLDLRNAVWALEAQNRLLNRSVHGARTQVLEGMVVQEATSAQVQQRGGENMMIHSQDSEMLRKAVADLEAQRKFMVGCALSLVMLFAFXLVIPR

SEQ ID NO: 172437 - protein, 53 aa, Triticum aestivum
  Clone ID: PAT_TA_66855.pep
PGVDDQKKGAVLLERGLGQQRNQGSYYSAPSMQRLITYSREQGTYKKSPGSFA

SEQ ID NO: 172438 - protein, 134 aa, Triticum aestivum
  Clone ID: PAT_TA_66856.pep
PPTLTAFHRQRHSTLRPLPAPPTPATTAPLGILPATCWNRPPGSRCEHHRHLSVDSHPSGWSPHLRSHPQTLTKNKPGSDSAPQFAGVSSAGSTLQVCGQGGLKSWSLFSGNLQFVGDKLIFVAMVAKSYEGLQ

SEQ ID NO: 172439 - protein, 124 aa, Triticum aestivum
  Clone ID: PAT_TA_66857.pep
YISSYKSSSPQMPKPPDSPQPSLDLPAVTAVCLKVVASVRWRWSTEVTTTLTKRIWRLFISDWCRCPWQPQEAGGGYHSTANSGVSCKHRQRTTPMLATPVQADGGVELLVLTMQLIEGLDRCA

SEQ ID NO: 172440 - protein, 122 aa, Triticum aestivum
  unsure (1)..(122): unsure at all Xaa locations
  Clone ID: PAT_TA_66858.pep
MARLNSKAVAAAVVLAAVVLMMAGREASAALSCGQVDSKLAPCVAYVTGRASSISKECCSGVQGLNGLARSSPDRKIACRCLKSLATSIKSINMGKVSGVPGKCGVSVPXPISMSTNCNNVN

SEQ ID NO: 172441 - protein, 68 aa, Triticum aestivum
  Clone ID: PAT_TA_66859.pep
MVEKAGGFGMIVFTPEVFGPVIIPRPHVIPTVQVPNKVGQKLKAYLQSEKEATANFILKGTSFDTPRS

SEQ ID NO: 172442 - protein, 156 aa, Triticum aestivum
  Clone ID: PAT_TA_66860.pep
MAPSAGDSAAAATVPRYPAWVLLEKKGYDDDREDATSASCKTTTGRDVRVAFYLVPLPEISYFHVHLSKLEGEDDFDFMPLNLVEYFIYKAGRGGGPSLEPIPPTPLGSSRDSVSVGIVPCPDDAEGSYVLADLSVGSEIGHYDLHLYSSKTCKWS

SEQ ID NO: 172443 - protein, 153 aa, Triticum aestivum
  Clone ID: PAT_TA_66861.pep
SVTIKHMIEDGCADDGIPLPNVPAKILSMVIEYCNKHAADAAADDTNKHVADPADADEDDDNNNNNASAGEKEDLKSFDASLVAVDQAMLFDIILAANFLSIKGLLDLACQKVADDIKDKSVEEVREIFKIENDFTKEEEEAVRKENAWAFNE

SEQ ID NO: 172444 - protein, 174 aa, Triticum aestivum
  Clone ID: PAT_TA_66862.pep
MACNALLASAWETASLTPEERAAEVDGVPIYNYISSTDNPLTWDLFMQHTSYYGDRMPVNQAVWIYCLSLVPGRWAYLFLTGLLHFLPALLVDIVCIAIGNKFRAIPVYKKIYKFSEVIAYFGLREWYFKNHHTKNLWRRLSPKDQELFAFDITQIDWFKYLGDYTKGMRMFMF

SEQ ID NO: 172445 - protein, 82 aa, Triticum aestivum
  unsure (1)..(82): unsure at all Xaa locations
  Clone ID: PAT_TA_66863.pep
RIRINVLRSVFVLGLSGGLYGVQNDKFRCFRVYLSSILHILHLGRVLVHRLQKVMHGYEKLQFTFWRQVYTEIYLFFQXSLY

SEQ ID NO: 172446 - protein, 120 aa, Triticum aestivum
  Clone ID: PAT_TA_66864.pep
IGLGGIFHTAIQVYGNEEWSFGYCENGSGVFSCPPAKNPMYTFRESIVLGKTSCSPRTVNQIARELSREWPGASYELLSRNCNHFCNEFCDKLGVPKLPGWVNRFANAGDAALEAAETTA

SEQ ID NO: 172447 - protein, 129 aa, Triticum aestivum
  Clone ID: PAT_TA_66865.pep
TLLRITAFVQKRGQATTNRWRRRQRQHARCMRSGKMGSASPHAFRMACQMARNARARLTRGMLQSTAAATCTARSRSSPARAPLYWRNPASPSSPPLTGNPIPLRALSFLYFDFTGFVPADEREREGRK

SEQ ID NO: 172448 - protein, 164 aa, Triticum aestivum
  Clone ID: PAT_TA_66866.pep
MFGFGHHGHHGQNPPANAPAAGGGNQPTFKIFCKADEGYCLSVRDGNVVLAPSNPRDEHQHWFKDMRFSTQIKDEEGNPAFAIVNKATGLAVKHSLGQSHPVKLVPFNPEYLDESVMWTESGDVGKGFRCIRMVNNIRLNFDALNGDKDHGGVHDGTTVVLWEW

SEQ ID NO: 172449 - protein, 108 aa, Triticum aestivum
  Clone ID: PAT_TA_66867.pep
FFLVIIREHLLPKFFDTRHLWELDASEYEECEGVHRDPSIPEGDGESITRGIEDPSEYTAEVMEEFTTHRGELKHRAPSFRDERLIRLNSVQMTRQFSRISSFAPTRP

SEQ ID NO: 172450 - protein, 212 aa, Triticum aestivum
  Clone ID: PAT_TA_66868.pep
PPHHALRRRGRLQVVVAAAGRVAFERAMVGRTIVAARRRGKNLWLRLDAPPFPSFQFGMAGAIYIKGVAVTKYKRSAVNSEDEWPSKYSKFFVELDDGLEFSFTDKRRFARVRLFDDPETVPPISELGPDALFEPMSVDNFVDSLSRKKIGIKALLLDQSFISGIGNWIADEVLYQSKIHPLQIASSLTRESCEALHQSIQEVVKYAVDVDA

SEQ ID NO: 172451 - protein, 90 aa, Triticum aestivum
  unsure (1)..(90): unsure at all Xaa locations
  Clone ID: PAT_TA_66869.pep
RLAWSHSADTTGSVRGTAWTAPDAAPPASDTAERMALKRAAIPNRVIDGDSDAPQPTSAARAHPTXPWGGAGRRRGGRRRPRRRARGARP

SEQ ID NO: 172452 - protein, 166 aa, Triticum aestivum
  Clone ID: PAT_TA_66870.pep
LGSSVLRCGVPVQWWWMPDVGSGSSVLADRRRGRRWLWRGGGVFAASEVCGPPECFAWECCSCCSRRKPSRCLIETAVWTTTCLHDSETTGNPAVNYGLMLCMDDLISAVVHKSSVNIVCIAALMLDGRRRQRPWVSLSSLEAPSRSFCTSSTLGSRSTGESHDPV

SEQ ID NO: 172453 - protein, 87 aa, Triticum aestivum
  Clone ID: PAT_TA_66871.pep
SWLACKIITAPISKWFQVGTSHGGHLQTEERNATRKSRKRGKQIIVFCIGLCHVGHVLQAWATRPGAAAVGRIRRGVGWAGVLVLIH

SEQ ID NO: 172454 - protein, 197 aa, Triticum aestivum
  Clone ID: PAT_TA_66872.pep
GFHQPQNRLNLHTSLSLTSLPKNYKTALLDPNWAAAMQEEYNALLQNNTRQLVPRPPNTNIVSGKWIFRQKFHSDGSLSRYKARWVFRGFSQQQGIDYEETFSPVVKPSTIRTVLSVAVSSSWPIHQLDVKNAFLHGSLQETVYCQQPLGFENPSFPTHVCLLQKSLYGLKQAPRAWFQRFSSFIQTIGFTPSLSDT

SEQ ID NO: 172455 - protein, 142 aa, Triticum aestivum
  unsure (1)..(142): unsure at all Xaa locations
  Clone ID: PAT_TA_66873.pep
GNEVAGSDTQYLVPAMXNVHGALAAAGLGDAVKVTTAISQATIAVHVPPSAGEFADESKPFLLPVLQFLERTGAPLLANLYPYFVYTYKAAGDMDVGFMLFTAPGTVVQDGEYGYQNMFDASVDAVHAAVERLGVSGVDVVV

SEQ ID NO: 172456 - protein, 212 aa, Triticum aestivum
  Clone ID: PAT_TA_66874.pep
VGTPRRHSPHPDVPARRRGTGARRGAYRSQPASPASEQPPPSRRPEGVAELRRLGKSYSEAVDSAQLLAPARYNLGPPCPPPHIQILPDDLLVEILMRLPPEPIYLFRASHVCKHWRSLIHDARFLCRFHEFHRGTPPVLGFFSNQPSFPFFVSITNTFAGSAVGKIDHDYLSVLDCRHGRALLKCCVYSSETGVWGEITSIHMPDSFVVPL

SEQ ID NO: 172457 - protein, 88 aa, Triticum aestivum
  Clone ID: PAT_TA_66875.pep
SSPPPRPPLPYPRPASTAGRSPPPRPSAPRPDEAGAAAPPRRPGPTRCRPRSPRRRRGPRPPPPSSRTSPTRRPGRRRAGRSPADLWR

SEQ ID NO: 172458 - protein, 117 aa, Triticum aestivum
  unsure (1)..(117): unsure at all Xaa locations
  Clone ID: PAT_TA_66876.pep
AGDQAARKSAPATGGVKKPHRFRPGTVALREIRKYQKSTELLIRKLPFQRLVREIAQDFKTDLRFQSSAVSALQXKAAEAYLVGLFEDTNLCAIHAKRVTIMPKDIQLARRIRGERA

SEQ ID NO: 172459 - protein, 71 aa, Triticum aestivum
  Clone ID: PAT_TA_66877.pep
MAAAAGEAPRALSQKEQDIQMMLAADVHLGTKNCDFQMERYAYKRRSDGIYIINLGKTWEKLQLAARVIVA

SEQ ID NO: 172460 - protein, 69 aa, Triticum aestivum
  Clone ID: PAT_TA_66878.pep
SEDSFLALKNMRCYHGIFDTSLCSFRDDRSSLLKVEDSAVLELRVEAALIARNSLLNQVRSDLAIYKPW

SEQ ID NO: 172461 - protein, 71 aa, Triticum aestivum
  Clone ID: PAT_TA_66879.pep
GRTSACTYALANVDRLISPCTETHIRSTLVSGRGDGNQTPARAYHEKSTTTLVHETSNSINQSGKELEHTH

SEQ ID NO: 172462 - protein, 127 aa, Triticum aestivum
  Clone ID: PAT_TA_66880.pep
LGFTSRASTLALSAAGAITYSVAVGVATVVCNLAVVVAAMEERCAGHAAVLRACILIRGRVPTALALALPTNLGMAAAEALFQLRVVSQRRKAGRLAPGVAGEAFSIAYIHALCVVLEIIVSCMFYR

SEQ ID NO: 172463 - protein, 70 aa, Triticum aestivum
  Clone ID: PAT_TA_66881.pep
HHHGTGTPPRPPCTDEHAASGPVHRRARRHHPSCCSKHAGAASRLASHRGREEESIAWLVLVDREEKDEL

SEQ ID NO: 172464 - protein, 43 aa, Triticum aestivum
  Clone ID: PAT_TA_66882.pep
VRRLCSPRRGGRGGPSAIAHADMMFPAMLWIAPAVSSAAASSA

SEQ ID NO: 172465 - protein, 42 aa, Triticum aestivum
  Clone ID: PAT_TA_66883.pep
IDADNNNQIIELTSRKTSERSRAAAEARSITRCRSWSPLPIG

SEQ ID NO: 172466 - protein, 121 aa, Triticum aestivum
  Clone ID: PAT_TA_66884.pep
FTVASLEQCTNNFSDENFLRETRFGKIYLPERPECKFVVLKLCHTATKMATDEFLENVRTIADLRHPNIEELVGCCVEHGQRLLVYKHFSEHTLDDMIHRGSSDAADPGNKFLWEARIAVA

SEQ ID NO: 172467 - protein, 102 aa, Triticum aestivum
  Clone ID: PAT_TA_66885.pep
MPAGHGLRSRTRDLFARPFRKKGYIPLTTYLRTYKVGEYVDVKVNGAVHKGMPHKFYHGRTGRVWNVTKRAIGVEINKQVGNRIIRKRIHVRVEHVQPSRCA

SEQ ID NO: 172468 - protein, 54 aa, Triticum aestivum
  Clone ID: PAT_TA_66886.pep
TGGTASTPPAAGLTAGCGKAPEPPGATAVGSSGMGTGTNASDVLPSSPYSLRGR

SEQ ID NO: 172469 - protein, 122 aa, Triticum aestivum
  unsure (1)..(122): unsure at all Xaa locations
  Clone ID: PAT_TA_66887.pep
GHRGTSRQHVDFLGVGSDLPTTXVENPRNRAKNSTSNGLKEVVGSDVFSASGPREERREAINIQGTAXLSSTPCDVPQRQVVRRKLVRNGCISPSNVVKRSVIADEKREMCSTSGVLRYRNP

SEQ ID NO: 172470 - protein, 79 aa, Triticum aestivum
  Clone ID: PAT_TA_66888.pep
MGLCMSSGGATVAAVRSEGLATSTAMVLLPTGELREYPRPATAAQALQDSVEAGDGSAGWFLCDADAMGFEGPVAAVGG

SEQ ID NO: 172471 - protein, 108 aa, Triticum aestivum
  Clone ID: PAT_TA_66889.pep
PFRLLEFVAIGPRFSYLISQTLMVLLKRVPPKGKNLLVIGTTSETTFLDSIGMSGVFSVTYEVPKLTKEDAAKVLRHLNVFDEADVETAAEALDDMPIKKLYTLVEMA

SEQ ID NO: 172472 - protein, 107 aa, Triticum aestivum
  Clone ID: PAT_TA_66890.pep
AAPRLRRGQSSPPRRRRATSQYWVPEEILPAAARLISAAPRLQRGQRSPPRRRRLVASRPCPAARRLGGAAGACLHARAPAGEELLNAAAWPPAGRRPGRRQRATAA

SEQ ID NO: 172473 - protein, 51 aa, Triticum aestivum
  Clone ID: PAT_TA_66891.pep
KLSNFTGHMIDGCCVLFVTSILSVVLLEKCLPIHLKPSSKIVVWKCVCVCV

SEQ ID NO: 172474 - protein, 161 aa, Triticum aestivum
  Clone ID: PAT_TA_66892.pep
PHRNHGRRRREVGAAVLSAGAAFAASSQRVNAEGGSGFRFPGFSSPAPAPAPAPASCSPPPAAPAAEEAPPKPRNDNPRTTAAGFDPDALERAVELLREFEKRDDADVKKSFAHANKREETRQAEFAARKADYLKEAAQIELERTRVEYEEKKKLAQSQAE

SEQ ID NO: 172475 - protein, 83 aa, Triticum aestivum
  unsure (1)..(83): unsure at all Xaa locations
  Clone ID: PAT_TA_66893.pep
VLTRWWMAPFTALSMRKNVIKINTATMDFSSLDLPSRVIDYGQADFIVGDTXDGELCMLYASDDFYLHAWIRGVDGDGIGIWV

SEQ ID NO: 172476 - protein, 113 aa, Triticum aestivum
  Clone ID: PAT_TA_66894.pep
GGWLGTTHLNPNLSLRLQIRRFIWLKDRHIIAINSYFYRSRDGSRKDQYLDLDACEMVCFLKSKKKKKTGYASAKHSLSYPKRERQDVLFEKEKSTTDAFMSSIVVLSENGKT

SEQ ID NO: 172477 - protein, 65 aa, Triticum aestivum
  unsure (1)..(65): unsure at all Xaa locations
  Clone ID: PAT_TA_66895.pep
GWNTIPIAHKSSTGTCLPIVPIRWIYSQYSPFQASQSTQASSQEQLVKKXTARKLWQQVPSHGSG

SEQ ID NO: 172478 - protein, 144 aa, Triticum aestivum
  unsure (1)..(144): unsure at all Xaa locations
  Clone ID: PAT_TA_66896.pep
LVMWATSRLRDSRLVVAELPDPALXGAFPPEEMQIMAHLARECLQWDPEARPTMTEVVQILSTIAPLADKRRRHHLPAAAAAFAPGFRAEKPQECSVWQDGDDGRRRDHLHGGNGSNAKGTVLSGEVAVNVGTPAAMGRSWRSA

SEQ ID NO: 172479 - protein, 111 aa, Triticum aestivum
  Clone ID: PAT_TA_66897.pep
MASLWVVVAAALLVLGCASSGATARPLVGAAAANHPLQTSRPYNIAHRGSNGELPEETAAAYMRAVDEGADFIEADIVATKDGHLVCFHDVTLDDTTDVADHKEFAARRRT

SEQ ID NO: 172480 - protein, 115 aa, Triticum aestivum
  unsure (1)..(115): unsure at all Xaa locations
  Clone ID: PAT_TA_66898.pep
LDPPPPPARPAPPRAVPPWEAPASXSRSPASCSACACPCSAPPPAPPYPQPVPPAPPYLPTPHSTVPHAPTPPVPGAGRQTRSPTPTGCSFNMDPNMKHLRRTLIDIETDAEQLL

SEQ ID NO: 172481 - protein, 201 aa, Triticum aestivum
  Clone ID: PAT_TA_66899.pep
PANFEEVSNEILKKCGGLPLAIITIASLLASRRERSRNDWENIQNSLGAQFAINPTLKGMRSILNLSYMNLPLHLRTCFLYLAMYPEDYVIERDDLVRKWIAEGFISNLHGPNLEDVGISYFNELVNRSMIQRVMTYKGVYCKVHDMMLDLILSKCAEDNFNSVAYTSEDMTRLRDCTYKIHRLSLISRVDRTTNETISWT

SEQ ID NO: 172482 - protein, 139 aa, Triticum aestivum
  Clone ID: PAT_TA_66900.pep
PARTVPTCPELRLAPLLRLHQMARAGSLYIAGIECFFLFGRRCATAQLLCSDHSGLPSPRQAIQELPHRRLLCPRIRARAGRPSTVTIAVVFAHGRRISSSRSSCPATPALPDHIHKLRDLETDAAPVIDYVDDDPFLP

SEQ ID NO: 172483 - protein, 72 aa, Triticum aestivum
  Clone ID: PAT_TA_66901.pep
SIPSDIYSYQYIYLLFAVMCNAYYMVWYPLIQDSSEVRNLYYQKYYLSDIFRDWCTSALGRRSLTRTLFYKR

SEQ ID NO: 172484 - protein, 130 aa, Triticum aestivum
  Clone ID: PAT_TA_66902.pep
MVKFAPTVKLNNGQAFPVIGLGTWKSKPGEVEQAVKDAIDAGYRHIDGAFIYGNEVEVGNGIRAKIAEGVIKREDIFVTSKLWNTFHRPDLVVGAVKKSLQNFGLDYLGLYLIHWPVGYHDEGELFPRGA

SEQ ID NO: 172485 - protein, 99 aa, Triticum aestivum
  Clone ID: PAT_TA_66903.pep
MATTSPTDAKRKYSWWWDSHICPKNSKWLQENLEDMDSKIKLMIKIIEEDAESSAKKAEMYYRRRPELMALLEELYRAYRALAERYDHAAGDLRQAHKK

SEQ ID NO: 172486 - protein, 60 aa, Triticum aestivum
  Clone ID: PAT_TA_66904.pep
SIISQALIFVTRSRHWSFVERPGALLVIAFFVAQLLATCIAVYANWEFCKMQGIGWGVGA

SEQ ID NO: 172487 - protein, 196 aa, Triticum aestivum
  unsure (1)..(196): unsure at all Xaa locations
  Clone ID: PAT_TA_66905.pep
MSSATGPVVDAEYVAEIERARRDLRALIASKSCAPIMLRLAWHDAGTFDKNTITGGPDGSIRFPEELRHAANAGLKIAVDLLEPIKQKHPKITYADLYQLAGVVAVEVTGGPTIDFVPGRRDSSVAIEEGRLPDAKQGASHLRXEVFYRMGLTDKDIVALSGGHTLGKARPDRSGFDGAWTKDPLKFDNSYFVELL

SEQ ID NO: 172488 - protein, 64 aa, Triticum aestivum
  Clone ID: PAT_TA_66906.pep
KLCLCTTYILYEKELDGASSTCLKLLKYMLSSLDLPSGVNKNWVQNYCMRNATLLLCTTSMREC

SEQ ID NO: 172489 - protein, 114 aa, Triticum aestivum
  Clone ID: PAT_TA_66907.pep
IRSQAFDFAGHSFFLIVQRTVNAQLGIHCFGLYLAVEKGVSVPITIEFEFAARTKAVGDFVSNFRHIKTFTSESNQLGSRDLFNMSWGQVFSEASQFLLDDMLYLRAELTVRQP

SEQ ID NO: 172490 - protein, 139 aa, Triticum aestivum
  Clone ID: PAT_TA_66908.pep
YSWLLAIGRLDCSRQLILATVVNIIIIIACCTPSNMISCTPSVRKYLSSKWIKEDVSRREYACIHPSCSGHVQWWHMYYTRPRPTKPPARTTHQTITLRFPARATTESKPMEWRWPAAPWRWGTDAAPAGTTGQRCGNE

SEQ ID NO: 172491 - protein, 86 aa, Triticum aestivum
  Clone ID: PAT_TA_66909.pep
DSFFTDNICFSARSLIYARRLRRHLQHPGIFLMYTHVSVQQQPPPISTRVPFIMPSTFIQLPPLDSPPSSPIIHGWLLPQFHHHSR

SEQ ID NO: 172492 - protein, 159 aa, Triticum aestivum
  Clone ID: PAT_TA_66910.pep
QQQQPWPPRQARSRPPESKVEKAAEKTPAGKKPKTEKRFPAGKTAAKEGAGGEGKTRGRKKGGKAKKGVETYKIYIFKVLKQVHPDIGISSKAMSIMNSFINDIFEKLAGESAKLARYNKKPTVTSREIQTSVRLVLPGELAKHAVSEGTKAVTKFTSS

SEQ ID NO: 172493 - protein, 114 aa, Triticum aestivum
  Clone ID: PAT_TA_66911.pep
GRSEAFGSSGSVRMATMDRAAASGPKPKVPFHIPTIPRPQDVHRIVVDNTSKPFDHAFLERSDDGARAIHPLEKLPMEQLFDRRVPESEPLKPPALNDTPFTFVEDPKTLEVLV

SEQ ID NO: 172494 - protein, 127 aa, Triticum aestivum
  Clone ID: PAT_TA_66912.pep
KRPAKARATSDGSGSDWKPTMTATAPRRTSSRSSIAMAAARSANAGRASGELPGASIFLSSTGRAVERRGGAGGETCLPTTRWTRARPTVQQPPQDAGGVPAVHHRAQRTHTASTLQDCSTQRPGEP

SEQ ID NO: 172495 - protein, 126 aa, Triticum aestivum
  unsure (1)..(126): unsure at all Xaa locations
  Clone ID: PAT_TA_66913.pep
KMTPFTPLDFTESDVLNNISEENIIGSGGSEKEYHVHLPGRHGLLRITTAEXVAVKKVCNMRNLDHKQSDSKVKTLGSINHKNMIKLLCSISSQDAKLLVYEHMEKGSFDDRLHCRDSKGAPAPLD

SEQ ID NO: 172496 - protein, 67 aa, Triticum aestivum
  Clone ID: PAT_TA_66914.pep
YYTSVDIGNPARPYFLDIDTGSALRWIQCDAPCTNCTKGPHSLYKPTKENIVPPGIHIVRNCKATKI

SEQ ID NO: 172497 - protein, 183 aa, Triticum aestivum
  Clone ID: PAT_TA_66915.pep
MLRMESVDSPSPRCYAQHQQNDGEPKDHKSTSKRQSHSTEIPCSLVQEVQHLEKRLNDQFAMRRALEKALGHKPCAINLSRDCYIPKPAEKLIKEIAVLELEVICLEQHLLTLYRQAFDQQLCSTVSACDMERRNRQSTRSFSGTLSETSAHDFSTPKKQQLVQSSRMVQARKSTTAALNTEP

SEQ ID NO: 172498 - protein, 134 aa, Triticum aestivum
  Clone ID: PAT_TA_66916.pep
LVRLPVAVPDAVPFRRRHHKLLSILPGRQRRLLRRAGVPAHHRFGASADKLRDTEARLARFADGCPNLRFEFEGVVNNGPEEGRHERITTDPAATVVVNLVFPAAQNVRQSSWDPRSASAHIRSLNPSLVFLID

SEQ ID NO: 172499 - protein, 69 aa, Triticum aestivum
  Clone ID: PAT_TA_66917.pep
IHSANELTAKHSRFLLVGAKLSADPLDKEIPSPDGSSDEHEDCSASAAEEAPAVHDASHAGSGGGGGGG

SEQ ID NO: 172500 - protein, 83 aa, Triticum aestivum
  Clone ID: PAT_TA_66918.pep
LASRKMTVIGTVDPVDVVSKLRKGWAAYIESVGPAKEPEKKEQKKEEAKKEGGDAKKEGGDGGDGKKDGDGKKDGDGKKDGEK

SEQ ID NO: 172501 - protein, 116 aa, Triticum aestivum
  unsure (1)..(116): unsure at all Xaa locations
  Clone ID: PAT_TA_66919.pep
MATTAAGGGRGXAEGSKSVSRSVKAGLQFPVGRVARHLKVXRYAKRVGAGAPVYLCAVLEYLAAEALELAGNAARDNKKTRISPRHIQLAVRNDEELSRLLGGVTIAAGGVLPNIH

SEQ ID NO: 172502 - protein, 116 aa, Triticum aestivum
  Clone ID: PAT_TA_66920.pep
AQTRRTRSCRRCRRRRAQPVQICQAPRGRREPAGWSGTAAGERPHGRCWCMPRGRRWRTPRLHGAYTPVEAAARCSTPRWRLLCPGCSRLHRRTKRCGSHRPMLAPQRGGAMQLPL

SEQ ID NO: 172503 - protein, 92 aa, Triticum aestivum
  unsure (1)..(92): unsure at all Xaa locations
  Clone ID: PAT_TA_66921.pep
RSRRRGAATRTRVRRPTARPPTPRSGXPTAAAAARGALPSMLLRRSELLRRGGKNGNMQSLNVSCASEASDDSFCSRASTGRIGRPAGAAAR

SEQ ID NO: 172504 - protein, 40 aa, Triticum aestivum
  Clone ID: PAT_TA_66922.pep
SGRLPKESFGKCIGMGDLQEFAGELFVTLSRRRSIEPEQG

SEQ ID NO: 172505 - protein, 99 aa, Triticum aestivum
  Clone ID: PAT_TA_66923.pep
MVSSKNARCTALLLLAVLLLSCAAMGRAARGLEETAPEDNYPAEAPESSPEDNYPAEASESSPFPDFRSFPKVELPPMPEMPTIPGFSSPEPEPEADEP

SEQ ID NO: 172506 - protein, 77 aa, Triticum aestivum
  Clone ID: PAT_TA_66924.pep
TILQIAARRSTAEIPTYTLVDGASTVHEFCAARRRCKWRDKLASGPRSVDRCGRSGHGGRGRQRGGADHQGGVAGER

SEQ ID NO: 172507 - protein, 119 aa, Triticum aestivum
  unsure (1)..(119): unsure at all Xaa locations
  Clone ID: PAT_TA_66925.pep
LRVRDLIRIDGSDVDALCGFISRVADAARASASGVVLNSFDAIEAPELARIEKELSCPAXAVGPLHRMCPGPAPAEHGLHAPDRGCLAWLDAHPARSVLYVSLGSVARVDRGVFEEMAW

SEQ ID NO: 172508 - protein, 107 aa, Triticum aestivum
  Clone ID: PAT_TA_66926.pep
RASRTHLRCHSILATTESSGKRAAHTSMERSRSYSEKSSSTTTTPAGAVTELRCYSASYATPKKAAGTTSWPPCTTASSSTSAAAAGSKARSWSGSFRSAPAELRRK

SEQ ID NO: 172509 - protein, 57 aa, Triticum aestivum
  Clone ID: PAT_TA_66927.pep
ERPVRSSSVGEGLCYRLLQPFFSSSFFNWRSQKMDFTGRQKRLMYIYKPPSMDNYTQ

SEQ ID NO: 172510 - protein, 118 aa, Triticum aestivum
  unsure (1)..(118): unsure at all Xaa locations
  Clone ID: PAT_TA_66928.pep
LACLGGYSSXSAAXVXXILHSVXAEAXEETLXFLLAELLXXXLHRXDCLXQGXXCPLXLQVGGXIAVGAPAAASGVXXAXAAXSXXEEKVXEKEDSDEXMGXXLFLSGFSSSPLPLCP

SEQ ID NO: 172511 - protein, 74 aa, Triticum aestivum
  unsure (1)..(74): unsure at all Xaa locations
  Clone ID: PAT_TA_66929.pep
QPHRRXLTDTTXNRSPPRXVXKSHRHEEPEQXRXXFRXPAXXXGRPXXXNXPXYTDEXHGGAGXXHQQGGAYLP

SEQ ID NO: 172512 - protein, 99 aa, Triticum aestivum
  unsure (1)..(99): unsure at all Xaa locations
  Clone ID: PAT_TA_66930.pep
TLADYXIXKESTLHLVLRLRGXMQIXVKTXTGXTLTLEVESSXTLXNVKAKIQDKXXIPPDQXRLIFVGKQLEDGXTLADYNIQKESTLXLVXRLRGGQ

SEQ ID NO: 172513 - protein, 130 aa, Triticum aestivum
  unsure (1)..(130): unsure at all Xaa locations
  Clone ID: PAT_TA_66931.pep
GXSXTXCXTLGXRTXXXXLXNCPXERELXSPXXXRSEXPXAQXFKPXPXLXSNRERAXRALCXSERTXXXXXSRALRPSXXPLSHXHXQRRXLSAPAPXAXRXRVARAHSXARARACAPHARVSRLATRA

SEQ ID NO: 172514 - protein, 173 aa, Triticum aestivum
  unsure (1)..(173): unsure at all Xaa locations
  Clone ID: PAT_TA_66932.pep
EWFQGLLVDLSLEKEAPPCYLXWLKLXGDXICXXPPFVTMLRGLTKLXLSSPXXQLXGEILAALSRVCGLEXLKXIXARLVNLIIRPGXLGXLRCLCVVVEAMMELKIEEKXLPRLDWLXLLCKDLSDFRHATTIWSLXRLNEVXLHDGLXNETKKEWEKAAKNHPRRPXLSF

SEQ ID NO: 172515 - protein, 128 aa, Triticum aestivum
  Clone ID: PAT_TA_66933.pep
SVKAKFFDETGIPPGRQRLFFAGKQLEDGRTLADYDVQNESTLHVAFRGITRRSGQMRISVRTVTRKKVIERAMKRRQAVDNIKAWIYSELCILPEEQQLSGEDGAPLAEVIRRSCIVVLQIRPPGGW

SEQ ID NO: 172516 - protein, 58 aa, Triticum aestivum
  unsure (1)..(58): unsure at all Xaa locations
  Clone ID: PAT_TA_66934.pep
QQNPQREVTPAASAXTTAPRPKXKPPTXXAHXDXLDGGSSXSRXPXRWSCPXCXEXXC

SEQ ID NO: 172517 - protein, 61 aa, Triticum aestivum
  unsure (1)..(61): unsure at all Xaa locations
  Clone ID: PAT_TA_66935.pep
XFHYFMMKRLNLXTWKXKKXGAGERSRXKXXXQETXXLPPXIKTNQWGKNPXWRRHHTNVY

SEQ ID NO: 172518 - protein, 115 aa, Triticum aestivum
  unsure (1)..(115): unsure at all Xaa locations
  Clone ID: PAT_TA_66936.pep
KYTXXGDRXVGQXXKRQAXVNXENTXFSXKRXIGRXMNXXXXESKQXSYLXFPXDNXNXKLXFXXICXQFAAEEXSSQVXXKLGXDAXKFLNXKXTKAVITVPAYXNYSQRTXTK

SEQ ID NO: 172519 - protein, 135 aa, Triticum aestivum
  unsure (1)..(135): unsure at all Xaa locations
  Clone ID: PAT_TA_66937.pep
DTVHGHXKHSXIKLKDDKTLLFGEKPVTVLXXXXXGXIPLGEAGADYXVEXTRVFTXKDKAAXHIKGGAKKVIISXPSKDAPMFXXXVNXKEYKSXXDIVSNXSXTTNCLXPLXKVINDRVGIVEGLMTTVHAXT

SEQ ID NO: 172520 - protein, 217 aa, Triticum aestivum
  unsure (1)..(217): unsure at all Xaa locations
  Clone ID: PAT_TA_66938.pep
IPGDLSTXVSADAXRNVVGIMGNCISXXXXLSPAQTFDRICKNKDXEQFTPDXYLATLMNCLLWFFYGLPIVHPNSLLVITINSIGIIIETIYXSIFFLYSPPKKRLKXLLVVGFEGAFXASVVVGVLLSAHTYEDRSRIVGIICIVFGTIIYXAPLTVMGKVXRTKSVEYIPXTVSXVNTINGCXXLAYWLIGNDPYXTIPNAIGTSARDHANRIP

SEQ ID NO: 172521 - protein, 238 aa, Triticum aestivum
  unsure (1)..(238): unsure at all Xaa locations
  Clone ID: PAT_TA_66939.pep
GVSXXYYEDEXAHKXXCXXCVVGGERXLIEXLXEGNCXKXENXKKKEKWEXVEKEKXSKVXGFFFRVXLEXIEFVXENVAESKKVFLMNXSATFICEFFGDXKEKVFXYGDYIFGNEIEERXFFKVGGWEIENVEXMVLXFXXIVXXYGKKKRIVVIIXGVDXVVVXEDGKVKXFLVILLTKEKFVXXNGVGDGFVGXXXFKLVKGKXXEXXVKAGCRXXXVXIQKXXXIYLEKPDLN

SEQ ID NO: 172522 - protein, 101 aa, Triticum aestivum
  unsure (1)..(101): unsure at all Xaa locations
  Clone ID: PAT_TA_66940.pep
HXFQXHLGDEELRXXLQLLLGXRQHSWSLRNXXXYXSIRPAEXVLQVVHPGCXLXLAEKCNSVQPWPEHPRGTGHTYXFSAXHHRLDTLQVGGDNXWLXAA

SEQ ID NO: 172523 - protein, 160 aa, Triticum aestivum
  unsure (1)..(160): unsure at all Xaa locations
  Clone ID: PAT_TA_66941.pep
FSSALPVXTXGGXGPIFXXGPGFESXLXLFPGXDGIVPLXGXXSVPXXNXSXXTXVXPXPAPPFNPLAARXAPISLXEFGPXGFHFXRXGGXXQNKKPHXLAXQNKKPRKXDQNXMKQXGGNXXSXEXXSDXWLEXGXCQXVGSYRAXSGVLPLVAXVPG

SEQ ID NO: 172524 - protein, 110 aa, Triticum aestivum
  unsure (1)..(110): unsure at all Xaa locations
  Clone ID: PAT_TA_66942.pep
SRMGEDICRCCSLPGKGLRGMEXTSHXADDMVRGTGXALYQNARSSGEGDQLAWEXTYEDHRRVMGEXLXAVLGTWXKKAGLVFCWGYEXTLISQLEFFKSTRDDHQELX

SEQ ID NO: 172525 - protein, 77 aa, Triticum aestivum
  unsure (1)..(77): unsure at all Xaa locations
  Clone ID: PAT_TA_66943.pep
GTLADYNIQKESTLXLVXRLRGXMXIFVKTXTGKTITLEVESSDTXDNXKAKIQDKEGIPPDQQRLIFAGKQLEXWP

SEQ ID NO: 172526 - protein, 66 aa, Triticum aestivum
  unsure (1)..(66): unsure at all Xaa locations
  Clone ID: PAT_TA_66944.pep
WTHEXDTCIIDHVTCTAXXSYGRNFFLQQFSXRGIHKMYICSXXQXRFLLCSLXNPPCPSXFCRMG

SEQ ID NO: 172527 - protein, 162 aa, Triticum aestivum
  unsure (1)..(162): unsure at all Xaa locations
  Clone ID: PAT_TA_66945.pep
LYGCXHSLPDGLMXATXVIIXGKVXVVCXYCDVXKGCXAALKQAGXRXNXTHNXPICXPQALMEGXQILTLEDVVSXADIFVXTTGNKDIIMVXHMMKMKNNAILXNICXXDNXIXMNGLXEXXWCQRXNIKRQTERXVFPETXKTXINXLCEGRLMXLDVH

SEQ ID NO: 172528 - protein, 91 aa, Triticum aestivum
  unsure (1)..(91): unsure at all Xaa locations
  Clone ID: PAT_TA_66946.pep
YNTXKLSAXQAXGXXWEPNLLGRYPEXLCXCXGXRXKSIPEPMGXNXHVXPIXYNNLXXHCRLLHVLLENLLPLSLHTPFHXIQATSLHXH

SEQ ID NO: 172529 - protein, 120 aa, Triticum aestivum
  unsure (1)..(120): unsure at all Xaa locations
  Clone ID: PAT_TA_66947.pep
MAPIKXGINGXGXIGRLXARVALQSPDVELVAVNDPFITTDYMTYMFKYDTXHGQXKHHEVKVKDSKXLLFXEKEVAVFGCRXPEEIXWAAAGAEYXAATTLIEFRPWGEHATSGPNSPL

SEQ ID NO: 172530 - protein, 168 aa, Triticum aestivum
  unsure (1)..(168): unsure at all Xaa locations
  Clone ID: PAT_TA_66948.pep
CXPLTNXPLXKGMCYRRXVGXTGVYXSXRIXXRPXIIIRITMXXXARRTCSXAMRXGYXFXAPXXXHXXKXENXRAGPCALXAPXXPFXADPVSXXKXXXCXXWRXENLIRPGLTHLXERXIXQKTRGFXIXIQXKDKLSCSWXMFVCIVRDVXYIPADLGRDHANHX

SEQ ID NO: 172531 - protein, 139 aa, Triticum aestivum
  unsure (1)..(139): unsure at all Xaa locations
  Clone ID: PAT_TA_66949.pep
PSPQVSTSVVEPYNSVLSTHSLLEHTXVSMLLDNEXIYDICRRSLDIERPTYTNLNRLXSQVISSLTXSLRFDGALNVDVXEFQTNLVXYXRIHFMLSSYXPVISAEKAYHEQLSVAEITNSAFEPSSMMAXCYXRHGK

SEQ ID NO: 172532 - protein, 131 aa, Triticum aestivum
  unsure (1)..(131): unsure at all Xaa locations
  Clone ID: PAT_TA_66950.pep
AQXAPSSRPPAGMHGLSFSSSANTGYNQTSIAAFRPPRPATGXFTFRPHAPPSADHPASAGQMGAQANSPFGLXQAPPXRPANHSPISPXQGFQRPPDGSXMGPARMHVPXPHFHGXFPGDHLXMILWFDI

SEQ ID NO: 172533 - protein, 97 aa, Triticum aestivum
  unsure (1)..(97): unsure at all Xaa locations
  Clone ID: PAT_TA_66951.pep
KSNMLAQDRSYYDRAEEXNSXFSGSXLESPTSCNSXDYVYRFXNPYFGSSLSHASCSXKXHVAREGKXNXSXRWPSXSSNEXIREXVPMRRXLRNAW

SEQ ID NO: 172534 - protein, 143 aa, Triticum aestivum
  unsure (1)..(143): unsure at all Xaa locations
  Clone ID: PAT_TA_66952.pep
CIXXLDKKKASXFFKTQXDSHVSXAKEKTKLSXXXDIIXEXEGCYFDFEXXXYXMNAXNGSXVSTIHVXXEDGFSYXXXEGMGXDASPXAYGDNXKRVLRCXGXTEFSXAVTISCGAXTATWGXKLDAXAYXFXNVVEQELPS

SEQ ID NO: 172535 - protein, 59 aa, Triticum aestivum
  unsure (1)..(59): unsure at all Xaa locations
  Clone ID: PAT_TA_66953.pep
TSSWPLIDPLPSYGRGRELPGKRYISLIHGNGLQDVFITGENGXIDGQGSVWWDMWKKX

SEQ ID NO: 172536 - protein, 99 aa, Triticum aestivum
  unsure (1)..(99): unsure at all Xaa locations
  Clone ID: PAT_TA_66954.pep
QVQRAHGXXXPHGSSXXXLXXXYLPXFPEVXXAIXASXXXPPXLILXXPATASLPXXLXHPIVGXXXTPXTRSSSSRRSILXXXAXPXAXRXPPHRCXC

SEQ ID NO: 172537 - protein, 63 aa, Triticum aestivum
  unsure (1)..(63): unsure at all Xaa locations
  Clone ID: PAT_TA_66955.pep
HTXTITXTSTNYTLINLNFPLEHYTXSLLGESWXLLLVVKPTIMSXSSSSGLIPSGRLQSXVV

SEQ ID NO: 172538 - protein, 86 aa, Triticum aestivum
  unsure (1)..(86): unsure at all Xaa locations
  Clone ID: PAT_TA_66956.pep
PLGRTVLLFFWWGXRLXLEXXGRKGRQRHDLVEXRCQVXRGTGPGSXISFFLRQXLIXHHGGRAXRRXPXXRRRHFFGKPGAFFIF

SEQ ID NO: 172539 - protein, 103 aa, Triticum aestivum
  unsure (1)..(103): unsure at all Xaa locations
  Clone ID: PAT_TA_66957.pep
LIRLTIGLEXXRPGQVLHLXQHNTXTSTRHARNLHTKITRKVSTRCTNHXLFRRWPWXNHTRSHARTTRXXRVHXTXQPGAQQKSKHKRSKLLTKSEHFFIHK

SEQ ID NO: 172540 - protein, 169 aa, Triticum aestivum
  unsure (1)..(169): unsure at all Xaa locations
  Clone ID: PAT_TA_66958.pep
XXLSLXMKMNPLVSLLHLYDVVNTPGVTADVSHXDTSXXVRRFICQQQXXAALTGIDLVIIPAGLPRKPGITRDDLFNKNXGIXRSXCEGVXKSCPNAIXNXISNPVNATVPIXXEVFKXTGTYCXKRXLXVTTLXVARANTFVAEXFELIQXKXIFQXVGGHSGVTIL

SEQ ID NO: 172541 - protein, 66 aa, Triticum aestivum
  unsure (1)..(66): unsure at all Xaa locations
  Clone ID: PAT_TA_66959.pep
LIXYKXTXXLSXHIFXYSFYXLKFKPKXXYLPXHPLKITTQFPPXSTSTISXLPTLSIILHILYSP

SEQ ID NO: 172542 - protein, 88 aa, Triticum aestivum
  unsure (1)..(88): unsure at all Xaa locations
  Clone ID: PAT_TA_66960.pep
ENKNXXLFLEXHKGVWMASLGTIQXPXVXFPYKMSIKXINQIGXNGEXFKLKQKIDXNYIKFSSXKASKLFCXTPPGTFRXSRTKKRH

SEQ ID NO: 172543 - protein, 48 aa, Triticum aestivum
  unsure (1)..(48): unsure at all Xaa locations
  Clone ID: PAT_TA_66961.pep
PLTSKAACKCIKSAAGGLNAGKAAGIPSKCGVXVPYAISANVDCSKIR

SEQ ID NO: 172544 - protein, 91 aa, Triticum aestivum
  unsure (1)..(91): unsure at all Xaa locations
  Clone ID: PAT_TA_66962.pep
SFCSLRLLSLXASASAMIALCLSXRHEXLQLXLFCTHVSHTCKFSIYLRFSVGCKXSLSTFSTLVGSFFISSSSSILELRPSKKDELGAIL

SEQ ID NO: 172545 - protein, 208 aa, Triticum aestivum
  Clone ID: PAT_TA_66963.pep
TRLGRNSTHSAKNAASAEPDKCSRFPEHQQNSYSTSVKKDKGKGKLRVKDSGCSMRSPLLDCSLCGATVRIWDFRSVPRPSHLNLGNIDAPDAGTKPMLARGISATSGINGWVAEGTDRNNAEGRDEACTVEGKSLSNAQVDLNLTMAGGLPPTHSGMLSMPENFKNGGMGIDLMIGQPTGSEIGGYAASFESRGPSSRKRNLEEGGS

SEQ ID NO: 172546 - protein, 124 aa, Triticum aestivum
  Clone ID: PAT_TA_66964.pep
RPLMGQAAKGWKEQDMFDYSVILLLGYFEFKICFQLKICPSPLDCLPRSATAIQRCSSSSTSISHKVACVTPPPAPSYQRMALLHPHPRRNARAPATLMKPHRELRLPSSSLTVARVKLPPCAP

SEQ ID NO: 172547 - protein, 163 aa, Triticum aestivum
  unsure (1)..(163): unsure at all Xaa locations
  Clone ID: PAT_TA_66965.pep
IPLPASRVPLADEDGVADIAAEHLCDVSSCGDLIKFVQIDFDEPDYGSSGIAWKATTWNRKLSWDDWRNRRTVDVAEISVDTSYSALLPELLDDXNKQLELKNLIFINPTLSIQDDHLLYIRAMVKAQDDTTWIVALDMKHASLSALVPVSTQPFCGVTMRPK

SEQ ID NO: 172548 - protein, 55 aa, Triticum aestivum
  Clone ID: PAT_TA_66966.pep
WREENLIRPGLTHHLERPIHQMTRGFEIAIRPKDKLSCSWLMFVCLVRDVLYIPA

SEQ ID NO: 172549 - protein, 77 aa, Triticum aestivum
  unsure (1)..(77): unsure at all Xaa locations
  Clone ID: PAT_TA_66967.pep
QTHSRSRTLXXTRXGPGXXXXTLKLGLSXARSSPRPLXRXRAHTXXLTXALKPXAXXHXLSLSRXXXXKGTRANSHT

SEQ ID NO: 172550 - protein, 82 aa, Triticum aestivum
  unsure (1)..(82): unsure at all Xaa locations
  Clone ID: PAT_TA_66968.pep
DKNHIFKAHFFLSCPGQNTPALLXKCSXXXCXXXXKXRKANXKDYWRXKXTVXNXNXLMNYSKWNLVAXNPNFXNLTTIFXL

SEQ ID NO: 172551 - protein, 48 aa, Triticum aestivum
  Clone ID: PAT_TA_66969.pep
RTAAAAAPSASAAPAAAAPAAAARSLIIDHACTARAASIISIYYYHTM

SEQ ID NO: 172552 - protein, 78 aa, Triticum aestivum
  Clone ID: PAT_TA_66970.pep
TVKGLVSPGRLEFINRGMCMHDEATVCYIDMIDQTTLGHRFINEEFSQIPRIGWQIDPFGHSTVQAYPLGAETAGARF

SEQ ID NO: 172553 - protein, 84 aa, Triticum aestivum
  Clone ID: PAT_TA_66971.pep
STEESWLTYPVAHLLAAATTTPNAHASSDFKSKTTPRCQVRAQRLNHCPIGVQKWFLAKLERTCPFIVGDVGHEFLHKHGHLYM

SEQ ID NO: 172554 - protein, 72 aa, Triticum aestivum
  unsure (1)..(72): unsure at all Xaa locations
  Clone ID: PAT_TA_66972.pep
KQSSPPLQQHGLHRRPSFFWPGTKIAGIPLPPPCPAHAGTKHQXELNGGDTIRFAPAGPKHQPELFPCLQRP

SEQ ID NO: 172555 - protein, 176 aa, Triticum aestivum
  unsure (1)..(176): unsure at all Xaa locations
  Clone ID: PAT_TA_66973.pep
SXRRXVQXXCERRRGXVRTGSGSSRTHGYEXXWHNXSFXSXVXXKSTVAHFFXXTAMGKDXRXNXSQQXTIXNSSXXRSXGQXLRAYXYXXTXKARRREITSEXRXXGXXADXNDPRAWGXXERPXLNXVYIMRVXAXWKXGYNYAXXPXAXXXKXXXFXMXXWXEXXGXXGXXGT

SEQ ID NO: 172556 - protein, 90 aa, Triticum aestivum
  unsure (1)..(90): unsure at all Xaa locations
  Clone ID: PAT_TA_66974.pep
AGIRLAWSRPRYXLQRXVKDDIXXLERELEXMHAAXSKXGDVPRDQLDEXVXLXANEVRDLXXIIEDXIDXXXLHVEGXXPEHDASRQDG

SEQ ID NO: 172557 - protein, 230 aa, Triticum aestivum
  unsure (1)..(230): unsure at all Xaa locations
  Clone ID: PAT_TA_66975.pep
LDADFNVAEEEVEDQEEDERAGDRDARVSQVSPQWQESEXEDEFDADFNGAEEEVEDQEDDEELETETLQPRNLSEARGKGRKVKPTGSSRQRHEDDDDYEEEIEDEDEDFDPEVDEDEEDEEEDVEEEDDDLGDYAPTRATNVRPRNHLAKRKPAAGRQHRKRKSSSKGKTRNGTSARRRRSKRRVADDYEDDEEEXDDDDFVVKDDVEEEVNYRPRKKAKVGRKTREG

SEQ ID NO: 172558 - protein, 89 aa, Triticum aestivum
  unsure (1)..(89): unsure at all Xaa locations
  Clone ID: PAT_TA_66976.pep
GYSVDPFXGXGVGTXFHSEPIXWHTYDYEPGFMVAGQILTIEPTLSMGXTRCEVWDDGWTAITVDGSLNAQFXHTVLVTVNGAEILTKC

SEQ ID NO: 172559 - protein, 173 aa, Triticum aestivum
  unsure (1)..(173): unsure at all Xaa locations
  Clone ID: PAT_TA_66977.pep
GSPSSVCRRLRKCXFXFKRXGXRXXGTGXXXSXXXXGXXSXCXPPXFXLIMAEPPLNXMQILGKKLMGRLDLLVVIRILXXAAFLSTXYKKTKKSKSDKFCSHQERXGLSTKAFXIPHRRXSPCPRKKRSPXXHQCSLFXADGXPSPPLVHGXGLXXTPLGPGERGREAGREX

SEQ ID NO: 172560 - protein, 116 aa, Triticum aestivum
  unsure (1)..(116): unsure at all Xaa locations
  Clone ID: PAT_TA_66978.pep
RYRELENXVFWEVNGNWVVQGXVDVKIXANPSAXGGGDDXGVDDQAVKVVXIVNXFRLKEXPAFNKKQFXYNXKSYXKNXSXAXLXGDDLDVFKKXVXSAXTXYXXRXIXDLKFFS

SEQ ID NO: 172561 - protein, 77 aa, Triticum aestivum
  unsure (1)..(77): unsure at all Xaa locations
  Clone ID: PAT_TA_66979.pep
TXCXAATGVAXGXCAFSLLXNXTGNPEVRVNKMGRAAGVLENHEEGRXYAEHGLRAFVQDKTPXIMPGINKFFTSPK

SEQ ID NO: 172562 - protein, 96 aa, Triticum aestivum
  unsure (1)..(96): unsure at all Xaa locations
  Clone ID: PAT_TA_66980.pep
KDMQIAGVRPDKXTYSIVMEVLGXCGHLDEAEAVFLEMRRDWAPDEPVYGLLVDLWGKAXNVDKALGWSALVLSLATHDRRSMVVGILCVLFGTGM

SEQ ID NO: 172563 - protein, 85 aa, Triticum aestivum
  unsure (1)..(85): unsure at all Xaa locations
  Clone ID: PAT_TA_66981.pep
LQFMIWFLRLVVHGLGRXSSLSAVRPGLLXPXXLXGHSGNTAMLRVFDKIMPSTSDLVRAXMEEARSWAAXGATGVNALMRXNLN

SEQ ID NO: 172564 - protein, 113 aa, Triticum aestivum
  Clone ID: PAT_TA_66982.pep
PQCCPLALRCAAQSPRDILHSFHTLVQEAQSPYPPDGSLVRPWKLAARCHKHATKLTCQHSWSLRRVLLDTIHGFYLQALARLPRGYHRSLLDAGHCYGPFDPVSNIIINTIW

SEQ ID NO: 172565 - protein, 93 aa, Triticum aestivum
  unsure (1)..(93): unsure at all Xaa locations
  Clone ID: PAT_TA_66983.pep
SPVPAAATVGKSCVRSPCASXKQNMXLRKSRTCXSSSVNLGFASXXCMSCVLPVTIMQSTXADVRCLXANSIFLLEIICSELSKKENRTXIFI

SEQ ID NO: 172566 - protein, 57 aa, Triticum aestivum
  unsure (1)..(57): unsure at all Xaa locations
  Clone ID: PAT_TA_66984.pep
STPKAQAMHQSFWXXXXXHVQPLRXXXXDRPNVRQKTIKKNXHWHKLTXHHVHFKXC

SEQ ID NO: 172567 - protein, 115 aa, Triticum aestivum
  unsure (1)..(115): unsure at all Xaa locations
  Clone ID: PAT_TA_66985.pep
HTSXHHXXXXNSILIQLTIKQHNXNQNTSXNTSLHXXLFFPXYLTLLYPLLNXQXXXKPLXTXXXXQXXHXXSIHHKKKKYSYQQXIXFXPIIQXFXTSXXSPSPXQHISQPWQR

SEQ ID NO: 172568 - protein, 154 aa, Triticum aestivum
  unsure (1)..(154): unsure at all Xaa locations
  Clone ID: PAT_TA_66986.pep
LIRDISSKEYXYRXXXTARKFNSIYFNEGSXESAFLXAGSVIEVAEXVAEGELSXXXSCKPPGHHAEHNEPMGFCLFNNVAIAANYLLNEXPDLXINKXLIVDWDVPHXTXTQXMFYXXSRVLXFSVNRFDYGXFYPCEXDXSNCFIGEGAGEG

SEQ ID NO: 172569 - protein, 71 aa, Triticum aestivum
  unsure (1)..(71): unsure at all Xaa locations
  Clone ID: PAT_TA_66987.pep
TPQNTLPVARTHAASLLQXHPCYXNAWXHTXCXHAXGAIXXIGXYTTIGGRXMHXMHXYXVAVXVVDGHPV

SEQ ID NO: 172570 - protein, 75 aa, Triticum aestivum
  unsure (1)..(75): unsure at all Xaa locations
  Clone ID: PAT_TA_66988.pep
TGCPXXXATATXXXCMXCIQRXPIVVXTPXRSIAPXACXHACGRXGXLXHGCXCNKXAACVRATGNVLCGVTCXW

SEQ ID NO: 172571 - protein, 60 aa, Triticum aestivum
  unsure (1)..(60): unsure at all Xaa locations
  Clone ID: PAT_TA_66989.pep
QRDRRNSFXXTXKGAPDXRCTRTQXSNLQPXTLDTXRXSRXXXQNRKXCXLEHYRQALGS

SEQ ID NO: 172572 - protein, 101 aa, Triticum aestivum
  unsure (1)..(101): unsure at all Xaa locations
  Clone ID: PAT_TA_66990.pep
HRFXAXLGDEEVRPGLQQLLGPRQHKWSXRNSHAXLXIRPPEGVLKXVXPVCDLVLTEKCNXVXXMPEHPXGTGXTYVFGAFHHRLXTLQVGSEKPWLTEA

SEQ ID NO: 172573 - protein, 103 aa, Triticum aestivum
  unsure (1)..(103): unsure at all Xaa locations
  Clone ID: PAT_TA_66991.pep
AXLMAQRGRPHFAVARTYLVSDXTXGGIHDXYFGWXKPVYXGPXRNGGVVELPGVGSFFISVRNAXYEEGXAIPXCXPRPXXXXFVNXKGKLXXPAFADTCPK

SEQ ID NO: 172574 - protein, 67 aa, Triticum aestivum
  unsure (1)..(67): unsure at all Xaa locations
  Clone ID: PAT_TA_66992.pep
TTSIPILLATLLGPLXTCFLPPPXSXALCXXXRTNDLVKERXQWVCSICKRRRRXRMRRRRCGCGDG

SEQ ID NO: 172575 - protein, 101 aa, Triticum aestivum
  unsure (1)..(101): unsure at all Xaa locations
  Clone ID: PAT_TA_66993.pep
LGRRCXXTSFLAGLXXTYFLVXXRTEXLXRXASAXXXXIFGRSSPPACXPXNXHCLIVXXKXDCRRALXAPRPLGGHFXXXIXXXGXPFTXXXPPPGXVYL

SEQ ID NO: 172576 - protein, 57 aa, Triticum aestivum
  unsure (1)..(57): unsure at all Xaa locations
  Clone ID: PAT_TA_66994.pep
XAIVXXVXKKXKKGAXXXRCTRTQFSNLQPRTLXTERTSXLXXQXXKXXYWXTTXKP

SEQ ID NO: 172577 - protein, 115 aa, Triticum aestivum
  unsure (1)..(115): unsure at all Xaa locations
  Clone ID: PAT_TA_66995.pep
MSYLDVTLPXAFDPFAXANXXXAGAGPGAKKYXHXXIQQXNGRKSLTTVQGLKKECSXNKILKDLKKEFCXNGTVVQDPEXGQXIQXQGDQRKNXXTFLVQAGIXKKEXIKIHGF

SEQ ID NO: 172578 - protein, 74 aa, Triticum aestivum
  unsure (1)..(74): unsure at all Xaa locations
  Clone ID: PAT_TA_66996.pep
YPPPXRDANHWTIQXEQMFLMFKRAVPVTNVARRQEVSXXSYVXXXKLVCXMSCIDPPIRSTSTGSWYCKGXRS

SEQ ID NO: 172579 - protein, 167 aa, Triticum aestivum
  unsure (1)..(167): unsure at all Xaa locations
  Clone ID: PAT_TA_66997.pep
FPMAFSVQLLNLXVLSYXNXXGNQHTWFCLXRPRXMPSVAAPPPPTPPRSQXCWHVXKKGPKLKVDQXVKIQLEEFLCXQXTPWRPLPLFLLYYFVFPFXDFSCCXTRTRIAKKKLKENTEQRXNAGEHYXYNFPPKYXGQLCXFXHXSHXGQHFTTXLTATXLSKP

SEQ ID NO: 172580 - protein, 187 aa, Triticum aestivum
  unsure (1)..(187): unsure at all Xaa locations
  Clone ID: PAT_TA_66998.pep
MHPTRWELSHXVXXHAAANSLXISXXARXXGXGXAXXGLISXQXXXLPXRXLWCGGSXXRXXASLXXXSXXXXPGVXFGGXPGGLCGXRSCGFSXFSGGGALXLRPSAAGXGALVLSAAGAGGRXAPPXLXRXXLVLXXCXGGSGSXGGXSSXAAXXXVXPAPPXGXXPFAPPXXXVCSPPRSXXRA

SEQ ID NO: 172581 - protein, 130 aa, Triticum aestivum
  unsure (1)..(130): unsure at all Xaa locations
  Clone ID: PAT_TA_66999.pep
XSXPXLVTPKSPTXXTKVLQXXFSXXALXFNIXGIIXLHLCKLCXXKFEKPIAGKGRLMTAQGGGLRFIXIVDXTNLTXLSGEAGPKGXMVWTKXTVIDLKKXPXPGALMTQTVEYXINGXAEGHPSXFC

SEQ ID NO: 172582 - protein, 114 aa, Triticum aestivum
  unsure (1)..(114): unsure at all Xaa locations
  Clone ID: PAT_TA_67000.pep
XLRGLGGNPVTXAIXXIIQFSSGVATIKPQSXNIHVNNPKKANYYGLKNYNTPXCSPSLMSTESAPRRLXIAPPKIAGRXGFDXQRPGPIAQQXGPPVLNSXTCSXRLLLRNRF

SEQ ID NO: 172583 - protein, 80 aa, Triticum aestivum
  unsure (1)..(80): unsure at all Xaa locations
  Clone ID: PAT_TA_67001.pep
LDGQTHNSTQPDDGAAPPPFSSPGTXTXRRRTWVNRXXXSLRSNSNPRARTKLXTFSXMQGAHIYIFIFLFFVFAIXGHQ

SEQ ID NO: 172584 - protein, 85 aa, Triticum aestivum
  unsure (1)..(85): unsure at all Xaa locations
  Clone ID: PAT_TA_67002.pep
VGGXPVPXALXXLXCXAEXXXALXVPTAXTVXXXQGAXXXNCXRCSXCALXXXAPRARTRTXSRSHSHGTGDALRHTRVAPGTAL

SEQ ID NO: 172585 - protein, 165 aa, Triticum aestivum
  unsure (1)..(165): unsure at all Xaa locations
  Clone ID: PAT_TA_67003.pep
XAXAGQGPRGSXGGAXIKEKFSEDXTXLEXNKXQRTXXLXQXGXXLKRERVGXLXXQKHXXXSLNXXXPXXXLXXNXKNTTXHRXXLXHXNXRLXVRXXSGXXDXSXXSNCMRGXGGIQXXXIKXVSXXSVEHXANKXXXXGGAXXNXIRVCVXYVXXTKPSEGE

SEQ ID NO: 172586 - protein, 120 aa, Triticum aestivum
  unsure (1)..(120): unsure at all Xaa locations
  Clone ID: PAT_TA_67004.pep
WNISVNSRMXVRAHXKHIHTEGSPRLTRXGKSCXRTPQRARPILPPLRLPGCSSTPPSLATPHPPSPNRFRQQPPVAAAIDEVTFTAATTAPCLTIISMPHWSRPHTKYLDLQTGYTLKN

SEQ ID NO: 172587 - protein, 93 aa, Triticum aestivum
  unsure (1)..(93): unsure at all Xaa locations
  Clone ID: PAT_TA_67005.pep
TFDDIRSAPFGREIMRAYSKHLKLRDAKHEVIFPGVCLKIPGRFYYRFGKPIPMRERQDVLTDRRAATDLYTHIKSEVQGIIXHLLDKREEDE

SEQ ID NO: 172588 - protein, 77 aa, Triticum aestivum
  unsure (1)..(77): unsure at all Xaa locations
  Clone ID: PAT_TA_67006.pep
DFQEKVKKTEQTRCVTLRAPSTVTDTVIDYKSRDRSRXHPXNRSXIRIVNLAKQKLTRXIYEKHDAVVSFKRLXYKK

SEQ ID NO: 172589 - protein, 57 aa, Triticum aestivum
  unsure (1)..(57): unsure at all Xaa locations
  Clone ID: PAT_TA_67007.pep
TDQRRRXVRSKXXAGEXLFRVLQLDXXXXTXXXXLTSYGPTEXTXXGTRXSLXXXLV

SEQ ID NO: 172590 - protein, 103 aa, Triticum aestivum
  unsure (1)..(103): unsure at all Xaa locations
  Clone ID: PAT_TA_67008.pep
QAHRVLEPCPWYKKXQLXIAXXPRIIGEXXRLKPHXIHXXSXXXXVLXALIXEKLLCLPLVMSYQTPVPIYIXPRYTFRWLVKXPMWLVIKFLXHRAADINTG

SEQ ID NO: 172591 - protein, 56 aa, Triticum aestivum
  unsure (1)..(56): unsure at all Xaa locations
  Clone ID: PAT_TA_67009.pep
RASSXPLHHEXRSLILPGAGPAQMASSAHHASPPIXLHVKHQTDTTASAGGASVDV

SEQ ID NO: 172592 - protein, 132 aa, Triticum aestivum
  unsure (1)..(132): unsure at all Xaa locations
  Clone ID: PAT_TA_67010.pep
ENMGSLRXQAILVVRCVCFMRFRALDRXVGGXGRRMGLVPLEQXIVTPREKISCXRVXIRCPTEGIFVFQHTPGHMASSHSXFHPQSGDKLGFRFVVSPTHLSCSRRSRSSPSLRPERRCSSXPPSSSMRXN

SEQ ID NO: 172593 - protein, 63 aa, Triticum aestivum
  unsure (1)..(63): unsure at all Xaa locations
  Clone ID: PAT_TA_67011.pep
VRRRADRRQVYRLGGADPAPDXXKXNRQRFSFQKLIQGTPXVFFXSDELATXXXESIKKXNPX

SEQ ID NO: 172594 - protein, 79 aa, Triticum aestivum
  unsure (1)..(79): unsure at all Xaa locations
  Clone ID: PAT_TA_67012.pep
GGLPVLXWTRLLXKKXPVSGAXXPGLKVNNXAXEXFXGAXVLXXXLLPXCXAXIIKXFPTXEXSVPXLPLXXKKXPTKX

SEQ ID NO: 172595 - protein, 115 aa, Triticum aestivum
  unsure (1)..(115): unsure at all Xaa locations
  Clone ID: PAT_TA_67013.pep
MVKAXAVLTGSXGVKGTIFFTQEGDGPTTVTGSVTGLKEGXHGFHVHALGDTTNGCMSTGPHXQPRWSCAWGTXDEIRHAGDLGNVTAGADGXANIMLTIPLLDKFNCGRAVVVM

SEQ ID NO: 172596 - protein, 53 aa, Triticum aestivum
  unsure (1)..(53): unsure at all Xaa locations
  Clone ID: PAT_TA_67014.pep
XFTPHPWGPNNLSVAVLFSQXXSWXCXNCIPFPCIFHLTDHGYITFQLEIQEI

SEQ ID NO: 172597 - protein, 119 aa, Triticum aestivum
  unsure (1)..(119): unsure at all Xaa locations
  Clone ID: PAT_TA_67015.pep
MAPRNSISAAGEGTTICVRLPGYVSXVASGWISMLXVINKIIPQHWKDEXVARILELCILHIAMXEMTSKGTPXKVAINEAVXLAKRFCDGGAPRVINGCLTYVKDNMNNGPSAAESKP

SEQ ID NO: 172598 - protein, 60 aa, Triticum aestivum
  unsure (1)..(60): unsure at all Xaa locations
  Clone ID: PAT_TA_67016.pep
TDLFRVLLQITSPVSARTLELAVAPHRIAAXRXXLHLRVCIHFTPLTDSPLSTPFLCSAV

SEQ ID NO: 172599 - protein, 48 aa, Triticum aestivum
  unsure (1)..(48): unsure at all Xaa locations
  Clone ID: PAT_TA_67017.pep
KRKYXMFRRSSRGGRSLEDRALPHNIYVRVYAXFXLQXLRYYMTSIKT

SEQ ID NO: 172600 - protein, 75 aa, Triticum aestivum
  unsure (1)..(75): unsure at all Xaa locations
  Clone ID: PAT_TA_67018.pep
AATVCVFLVGXRLXHKKXNQHHPXKKIXLKFLGADKRIQKVVQXTXRLNXAXSSMMGEGAXXRANXSXGGFYNGF

SEQ ID NO: 172601 - protein, 188 aa, Triticum aestivum
  unsure (1)..(188): unsure at all Xaa locations
  Clone ID: PAT_TA_67019.pep
AEAGDVGALTAAFQEIPATHPSIVPDLYSYNALIRTLCQKSNLSAALYAVHLMKKHGVSPDIITFNSLLDGFXNSGRNDEAEAVWEMIKERNLEPDAKCYNAKLRGLVAQGRIDDAAAVLERLEKDGPKPNIVSYNQLILGYCKAGRFQEAKKVYDNLMKNECVPNKGTYXTLVPHLVQAGELDCALR

SEQ ID NO: 172602 - protein, 163 aa, Triticum aestivum
  unsure (1)..(163): unsure at all Xaa locations
  Clone ID: PAT_TA_67020.pep
MVKAVAVLTGSXGVKGTIFFTQEGDGPTTXTGSVTGLKEGLHGFHVHALGDTTNGCMSTGPHFNPAGHVHGAPEDEIRHAGDLGNVTTGADGVANINVTDCHIPFTGPNSIVGRXVVVHGDADDLGKGGHXELSKSTRNAXTRIACGIIXLQGRCHLHRPTYL

SEQ ID NO: 172603 - protein, 216 aa, Triticum aestivum
  unsure (1)..(216): unsure at all Xaa locations
  Clone ID: PAT_TA_67021.pep
VAAEYRYLSARDLAVCDPVHRGYILLPXVPGHLKXLVSEPDLLHLETFLAPGDDEEDPLSFRVMCLVQCRTNMVLLVFSSLDGXWXSLAFDLWSAQAPLEDPRDGLSDRQFVXGCFCWHFPLLNKLVLLXTRTMEXSAVNLPPELGWSSDFVIVEAAEGMLGMLAEVYDKDNIYDPCWLNYSILRNNWLEKVDPLPGLHHVVLLGVGGGYLLIGAM

SEQ ID NO: 172604 - protein, 126 aa, Triticum aestivum
  unsure (1)..(126): unsure at all Xaa locations
  Clone ID: PAT_TA_67022.pep
XAQWAVGPGXXSXXTLDXXDIYSEXXGLXVXXEXXEXRPRXKXIYXNTLGGXGGEXNPARNSRXAXRXSAXSLAQTNPHXPXSXXLXKXALXXXFXXXXXXXLAIXXFXLXXXXXXKRKRXRXXXR

SEQ ID NO: 172605 - protein, 138 aa, Triticum aestivum
  unsure (1)..(138): unsure at all Xaa locations
  Clone ID: PAT_TA_67023.pep
NXXNSXMLKFSPHPSPYTXSRXSKTXICSLXNFXHQPNXIXNKSSSPVNXXKKNXPLLFXHXYIPIQSKYSLYSXXLXLXXSXSTITIXYTFLLSXPSISPXLHLPXHIILPPXXPPQNHXXIPPHLQINHIKXLPXH

SEQ ID NO: 172606 - protein, 135 aa, Triticum aestivum
  unsure (1)..(135): unsure at all Xaa locations
  Clone ID: PAT_TA_67024.pep
EHQXSXXTLXSPHKAXNRLTRWQYLTDPFEWSPRWLVWSLVLLVXLSSXRDILXHDHHEHVXHPNLFLDQXHNPWCLVHDPXGETSWIGSGHPPTCPWGGRHCHLPDSSTRWTRHNLENHRFXXRNITSNHTSWS

SEQ ID NO: 172607 - protein, 93 aa, Triticum aestivum
  unsure (1)..(93): unsure at all Xaa locations
  Clone ID: PAT_TA_67025.pep
APRGGGGGGAPPDRHVRLTWVRIRIRVGTSYTLATSLXSSRPLPPSPSHPPLXRLNSTSCCIQRLNTSTTLQXMFXNDXKYMNELEIAEDYXE

SEQ ID NO: 172608 - protein, 106 aa, Triticum aestivum
  unsure (1)..(106): unsure at all Xaa locations
  Clone ID: PAT_TA_67026.pep
RRQXRNGLYRSTKRSKSGXQKPRRSWXXXXGEDGGXQKRTRRXLLTKRXXXRRXXGXXPRNKXLRLARHXXXRPXTXTKXYLEXKXKPXCXPXXETKSXGKKKKRK

SEQ ID NO: 172609 - protein, 102 aa, Triticum aestivum
  unsure (1)..(102): unsure at all Xaa locations
  Clone ID: PAT_TA_67027.pep
HPRPDTRXXEPRAXRRRRDXSXPAXGXRKAXNHXSERPGGARTTTSPXXXXGAKTATTTPTRXRXPGRARXGXXARGRKPPXRGRHXRAQAHEEDSXRRGGA

SEQ ID NO: 172610 - protein, 119 aa, Triticum aestivum
  unsure (1)..(119): unsure at all Xaa locations
  Clone ID: PAT_TA_67028.pep
TPGTGGQQVVKXCPAAMGFXFXXGTKDGXGVFDFKQGDDKGKIFWKLVGGILKKQGKEKXKCKXQKKILLENGEIKEXYDWXXKILXIXMIRIGQLVILFVPGEXTXMAGRXLGDXVKN

SEQ ID NO: 172611 - protein, 237 aa, Triticum aestivum
  unsure (1)..(237): unsure at all Xaa locations
  Clone ID: PAT_TA_67029.pep
KSRDPRTTDEGEMLXNLFDCLXCVLMPLGNKERFVKAEGVELMIIIMKQKKSAYSSAIRTLDFAMTRFPPACXXFVDVLGLKTAFAAFMGKIPXNKKNNXESYQEELEERIXSLVASLFGGITKGSRRIRLLGKFVENXCXKIDRLXEXYIRYSDRVKAETERFESLDLDDLEMDDDERXGLSKGGNEVLLVIAYKTLRDRAPYPASFMLSQLTGSAFVLFDKSTSSLLVASDPERY

SEQ ID NO: 172612 - protein, 59 aa, Triticum aestivum
  unsure (1)..(59): unsure at all Xaa locations
  Clone ID: PAT_TA_67030.pep
LAHVMLREKLHIFGILGCVLCVVGSXTMXFHXPQXRXIESVTEVWDLATEPAFMCYVAV

SEQ ID NO: 172613 - protein, 37 aa, Triticum aestivum
  Clone ID: PAT_TA_67031.pep
YYYCTLLITSVMANLVNARFISSLYVWLVRTLLPGMP

SEQ ID NO: 172614 - protein, 63 aa, Triticum aestivum
  unsure (1)..(63): unsure at all Xaa locations
  Clone ID: PAT_TA_67032.pep
ATGGKNLVWSXKNLSKVAFXXGGGGQWXGXQFGNLGXNXXRXVXXDFNXXXLNSLFXPNWIVX

SEQ ID NO: 172615 - protein, 144 aa, Triticum aestivum
  unsure (1)..(144): unsure at all Xaa locations
  Clone ID: PAT_TA_67033.pep
KRTGPEWNLLIRTXTCWGRKFGPRTVSYCLXRRXMGGRAGEIRNXXVGXRARXVPXMKKXVXXGSERXFGGANLNKKKKWQYXTLXAXRKKWVNAWGAGXWXSNGGXVXGCFXEXNRXTKXARQRXXCINSLGDWFTRFEXNKS

SEQ ID NO: 172616 - protein, 64 aa, Triticum aestivum
  unsure (1)..(64): unsure at all Xaa locations
  Clone ID: PAT_TA_67034.pep
SCPRPLPPLPPATEPSQQSPPPHAPPLPXGTLPLPPLPPATEPPPEPPQQSPPPDAPPPPPMAP

SEQ ID NO: 172617 - protein, 67 aa, Triticum aestivum
  unsure (1)..(67): unsure at all Xaa locations
  Clone ID: PAT_TA_67035.pep
TXDRRLGQSSAANWXXXXXXXILSRSTXDXXIXXHXVGLAXTYTXTXSXHMXPGXXXVGXXPEGVGV

SEQ ID NO: 172618 - protein, 152 aa, Triticum aestivum
  unsure (1)..(152): unsure at all Xaa locations
  Clone ID: PAT_TA_67036.pep
VQNFLXYXTSKHYDYRKXSVLXKPRSTDLPLQLSXNNILPLQIKLNSTRKIPRDQRKSKRREQPSIGKKTRIYIREAWSGITSNTTLGAGQNLNXVSXSPAXQAXSXGGALHPHRPLXPRAPKGTGRGTSTPPLRNSSXRPTSVAPXGXRSL

SEQ ID NO: 172619 - protein, 116 aa, Triticum aestivum
  unsure (1)..(116): unsure at all Xaa locations
  Clone ID: PAT_TA_67037.pep
INMWAINRCREXGXDGDTXRXTXXMPGEGDXVGRDXXGGSFEFXPXGSGRRSCPAQXLXGHHAVQLXLPXXAHGXXRELPXGMXPTXLXMGXMPGIXGPRATRXYVVPTSRLNXTL

SEQ ID NO: 172620 - protein, 63 aa, Triticum aestivum
  unsure (1)..(63): unsure at all Xaa locations
  Clone ID: PAT_TA_67038.pep
AATGQLTVKSDIYSFGVVFLELITGRRALDSNRPREXQDCXVHGARPLFKDQRKFPKMADPLV

SEQ ID NO: 172621 - protein, 115 aa, Triticum aestivum
  unsure (1)..(115): unsure at all Xaa locations
  Clone ID: PAT_TA_67039.pep
INSPFNXKXNXIGQXTTKGKCLGCEGXVVLQVLQKPSIGSXPXXYKGSSQVLLTXWKPKKCXXKXGCXXFXNXPNLXKKPEVXASQLVLWRSSLRDPXXLXLVLGRXLEKKTHLS

SEQ ID NO: 172622 - protein, 78 aa, Triticum aestivum
  unsure (1)..(78): unsure at all Xaa locations
  Clone ID: PAT_TA_67040.pep
MXSGVQTPNCIWRTIYDVXALDYEKXTVFIXATXVARPNIHLASIRXMRTIVVERPTLEEWRRCARGVFHSWHRSIHA

SEQ ID NO: 172623 - protein, 60 aa, Triticum aestivum
  unsure (1)..(60): unsure at all Xaa locations
  Clone ID: PAT_TA_67041.pep
GLRNYNLLLGXDLPAMXXXXDNXXXXMTXXXFLPXXXDWXTVGXXXRGRXFFXXVXXXXX

SEQ ID NO: 172624 - protein, 123 aa, Triticum aestivum
  unsure (1)..(123): unsure at all Xaa locations
  Clone ID: PAT_TA_67042.pep
MXXLDXIXAIXGRKAYATXAXFFLXXGGXXKPXAIXLXIXPAQLGEXXXSKVLXPACDGXXNWIWMXGKXDXSXNEXGVHXLXNXWLRTHAIMEXXXXGGDWRMRAMDXIXKXLHXYMRXHAN

SEQ ID NO: 172625 - protein, 49 aa, Triticum aestivum
  unsure (1)..(49): unsure at all Xaa locations
  Clone ID: PAT_TA_67043.pep
VRXSRYWDIGXXXXYPQERXXXRXLLXXRWXPXRRFCSLIDRQXRPATK

SEQ ID NO: 172626 - protein, 142 aa, Triticum aestivum
  unsure (1)..(142): unsure at all Xaa locations
  Clone ID: PAT_TA_67044.pep
KQHQLVLVAKXLVRIGAPLXNXXSSRNRXXRXKSPRTXHGRVXXXXXLXFXLXXRTRACXXKQLDXYTKSSXXEGXXLXXVKLSXARPPIPXXRIXLFCPQXLXHRMSSSRPRKLRHYXXXRAVXXIXXXKVQWQMKLIXFW

SEQ ID NO: 172627 - protein, 80 aa, Triticum aestivum
  unsure (1)..(80): unsure at all Xaa locations
  Clone ID: PAT_TA_67045.pep
QLRXYTSXVFKKTRQAFSFPSPPPSYPNGNTYHQGAMQGIHGXKVAQSCLLXLIXPTCWXPVCHRXPXXRLXQNWXSSWX

SEQ ID NO: 172628 - protein, 115 aa, Triticum aestivum
  unsure (1)..(115): unsure at all Xaa locations
  Clone ID: PAT_TA_67046.pep
DRDPXTSXXSGXVXEXRFNWXXTIXGPSESXNAGGXXLFIIXSLXSXHTNXXLCGIKNKGFHPYINMHXGSICLDXMXEQWSXSXTXSXXXXXXGXLXTXXNLDDPXXPEXXXMY

SEQ ID NO: 172629 - protein, 45 aa, Triticum aestivum
  unsure (1)..(45): unsure at all Xaa locations
  Clone ID: PAT_TA_67047.pep
PWAGAAPSNDGGXKRNVIXGRGWRGWXXAALHRGGKPGXWIQXXX

SEQ ID NO: 172630 - protein, 61 aa, Triticum aestivum
  unsure (1)..(61): unsure at all Xaa locations
  Clone ID: PAT_TA_67048.pep
NLSXXGXFIIXPIXPAVIPLXPHLKFCFPGXXXPIPVSFADXDIGKTCVGXRAVDDXFRXG

SEQ ID NO: 172631 - protein, 85 aa, Triticum aestivum
  unsure (1)..(85): unsure at all Xaa locations
  Clone ID: PAT_TA_67049.pep
RQMLVQXIHACXVEYPEVAGSVVHLLXDFLGDTNVAAAVDVVLFVRXXTETNPKLCVSMIQRLSXTFYQIRASRVXSIALWILGE

SEQ ID NO: 172632 - protein, 154 aa, Triticum aestivum
  unsure (1)..(154): unsure at all Xaa locations
  Clone ID: PAT_TA_67050.pep
XAXQXXSXXANSVSFSAXGXANVSXRLXPXPXXFSVRCAANXXTXXXVCXIVMXQXALXXXXVXSGSSXFADLGADSLGTVXIVXGLEXAFGXCVXXSXXPTXXTVEXAAPLLDRXVASFLAMCYPLPLLEAPIRAFFCGSVVFLPDLRYFSLI

SEQ ID NO: 172633 - protein, 139 aa, Triticum aestivum
  unsure (1)..(139): unsure at all Xaa locations
  Clone ID: PAT_TA_67051.pep
RXLENGVFWXVXGHWVVXXAVDVDIGANPSAEGGGXDEGVDDQAVKVVDIXTXRLQEQPAFDKXQFFXYMKXYIKXXXAKLEGDDLDVFKKNVEXSATXYLLXXXXXDXXFFVAXTXMHDDGGVVFAYYKEGAAXXTXL

SEQ ID NO: 172634 - protein, 114 aa, Triticum aestivum
  unsure (1)..(114): unsure at all Xaa locations
  Clone ID: PAT_TA_67052.pep
SRNKELHELGXIXLDVGRXKGNVXSLLAGKSSKAPXXIXPLMKRXNXXXLQGMXXVCFSSLXSXMVGLLIPLXLADSGHAQLYSPXGAXVXEXXALGXSIVCXLLXCXVXXFGX

SEQ ID NO: 172635 - protein, 104 aa, Triticum aestivum
  unsure (1)..(104): unsure at all Xaa locations
  Clone ID: PAT_TA_67053.pep
HTXXXPXXRRXQXFCQLNLPXXTCGRHRDXTXTEYXERXTQDXEDEDEVXXAKXHLALXPRXRGRXXWPAXXXSLXMPSPSXXSIXVXHGQSXXPCPGSVSLSL

SEQ ID NO: 172636 - protein, 137 aa, Triticum aestivum
  unsure (1)..(137): unsure at all Xaa locations
  Clone ID: PAT_TA_67054.pep
LPFTXVLRXRGXXXIFXMXXXGXXLXLXVECSVTIDNXKXXIXXXVGLPXIMXXLLXTGXXMVVGRXLADLXIQXXSXLPLXVLRLXGGMXIFVVXLTGXAFSLAXXNXDXLDXDXAXLLXPVGXPPXQPSLLFXGL

SEQ ID NO: 172637 - protein, 88 aa, Triticum aestivum
  unsure (1)..(88): unsure at all Xaa locations
  Clone ID: PAT_TA_67055.pep
XQQRNSXTRRRSEQRSIPDEVGVQQSERSIHASEKNQRLTRRPWAGHGVVWTSWCLRVQGRGREHRTCKKMAFQIVXDREXNXLIVAA

SEQ ID NO: 172638 - protein, 129 aa, Triticum aestivum
  unsure (1)..(129): unsure at all Xaa locations
  Clone ID: PAT_TA_67056.pep
VVCXLFXGGXFLWXCFGXXYGXRALNCXXCLGTXDFGSGGVXXXYQGXVXAXXXXLXGWXCCARVXSLVLLAXSXCFFSXXTYDXIVGLXNXVAVXGMXLLEDDXLFQFXRVWLVNNSRDXDGXXNSVG

SEQ ID NO: 172639 - protein, 58 aa, Triticum aestivum
  unsure (1)..(58): unsure at all Xaa locations
  Clone ID: PAT_TA_67057.pep
GVRHQVXHVVLAPWLHGGKNSSFTRALFWRVTLLIASSCLVECRRPPATSLPPWSWGT

SEQ ID NO: 172640 - protein, 218 aa, Triticum aestivum
  unsure (1)..(218): unsure at all Xaa locations
  Clone ID: PAT_TA_67058.pep
LGPAPRGHTLSSHARSRSRPRRRSLAGTLWRALATSLTRARAALSPSXTRALALTPXXSRXRTLAPPPXLAXSLPPPRTXXRTRSHTHSLTHSXSHPPPXWXTXXTGSXPXPXPXPXPXPTPSPSGSHSHSGTRALPPPRTXXPXHPXPXXRTHSLTRSHSHSHAHTHSRPLTLPXSXXSXARXLAHSTPPARPRAHSRTXSLSXXLTLSHTHALSHA

SEQ ID NO: 172641 - protein, 159 aa, Triticum aestivum
  unsure (1)..(159): unsure at all Xaa locations
  Clone ID: PAT_TA_67059.pep
PQASILTPACSVESRKRPSXPQGFFGHPGXRTLPVRSRPESXXSXGXTPSRXDEAXRQGTIVTXGLNADKCHPXTQGLMPPARPTRPXPKAPFVLGGKGWPXXGRQAAVARRLFSSXXXXGXVXXQXXQMIPTXILPNPGASHPPVGQARWPVMAAXLQ

SEQ ID NO: 172642 - protein, 69 aa, Triticum aestivum
  unsure (1)..(69): unsure at all Xaa locations
  Clone ID: PAT_TA_67060.pep
TYIPIIKXLIKHXKTSFXHPHYFSSILPIHTHIHFSQXTPXNKNRIPSXTPPQNQIPXATMTHSAYYIP

SEQ ID NO: 172643 - protein, 205 aa, Triticum aestivum
  unsure (1)..(205): unsure at all Xaa locations
  Clone ID: PAT_TA_67061.pep
LXVSQECXXXSKEKPMKLQVXFXPPLXXXXTXTXFESXPXPXSPPXXRPHQXSLAXFLFFFPTPPGFRTHXFSHSXFXTXIGXSHXLSPXXSLPLAXSRSLXFRXFSHPRIHFRSGYSXTXPLPXTLXGRLSGTRTRSHVSXCFCXLXGGRARQXXWAXFLSRXIXLTLSXXSLSXFSPXLPSSPXKKXXLXXXPRASXXXFPRA

SEQ ID NO: 172644 - protein, 137 aa, Triticum aestivum
  unsure (1)..(137): unsure at all Xaa locations
  Clone ID: PAT_TA_67062.pep
LXCXPALSPSXXLGLSXXXGRDSQXXPHSPPQSHSPLSVGGXPXHXSHSVGXGGPXAEXSXCGTVWGXSGGRVGXLSGEGGXSHLSPVXGAXAXQXXALXPXXRXRTHXWXXXRXTPRVWGKXIFXSWERRHGXQSG

SEQ ID NO: 172645 - protein, 61 aa, Triticum aestivum
  unsure (1)..(61): unsure at all Xaa locations
  Clone ID: PAT_TA_67063.pep
KKKKKKKKKKNRXLIPXRYLRXRMCXDNDLXQGGEEGADHPMRKAGSLDXXARGLWPHGXG

SEQ ID NO: 172646 - protein, 261 aa, Triticum aestivum
  Clone ID: PAT_TA_67064.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYLEYNLLAYTSIHPYLPLEFFRSVLFYTPRRRKELKQKITSRHCRTSALLDEEARCRAMRDSHHYFIIVTTNSYCAGNRKEGFGCVRLPG

SEQ ID NO: 172647 - protein, 201 aa, Triticum aestivum
  unsure (1)..(201): unsure at all Xaa locations
  Clone ID: PAT_TA_67065.pep
SPCHPGLALLWSGRGPGEDERRRKERVEEIGREDAWFKRSDGEAMPKVSVVPGGRWNRFKTYSTIQRTLEIWGSVFAFIFKVWLNNQKFTYRGGMTEEKRVMRRKVLAKWLKESILRLGPTFIKIGQQFSTRVDILPKEYVDQLSELQDQVPPFPSETAVSTXEEELGASVNEIFERFDVEPLAAASLGQVHRACLNGQEV

SEQ ID NO: 172648 - protein, 107 aa, Triticum aestivum
  unsure (1)..(107): unsure at all Xaa locations
  Clone ID: PAT_TA_67066.pep
IGVVVCSTHGLHQQLQSYFFSLYRSLPRTLMSCRHAARGASRGAYPGCKNAGHHRLGCCVLLEHVINGCWXMXSTWNTLFATLKMASSPYTEXXSLAVLPFSLEQRC

SEQ ID NO: 172649 - protein, 125 aa, Triticum aestivum
  unsure (1)..(125): unsure at all Xaa locations
  Clone ID: PAT_TA_67067.pep
MKPTEATVTLLGYDDTLEHVFTELPKTXSHVETLSVNTCINTEVVGFSNCLMKFTHLIKLEVTVSILGDSRIRNGILRLVSLLEVAPLLQRLELNASAPLALMQVSCLSFETNDVCLVLVAFDPP

SEQ ID NO: 172650 - protein, 109 aa, Triticum aestivum
  Clone ID: PAT_TA_67068.pep
TCFLQKNNRRLPRLLEPPVGVEALCINHDDAFFILVTDRCPAVDSPISEPPQSHPGLVELATGPPHDYETDVAAAQFDYGVDDPSFLPEQPGMVNSRGKTGFKDIWKHK

SEQ ID NO: 172651 - protein, 112 aa, Triticum aestivum
  Clone ID: PAT_TA_67069.pep
RTRRRCRTLSYPLLPLPSPPRSGEAPDVVVAVAAPIPRPPDSPRRCNKFRSSVVFVYAIYNHPFEFGASTSCGSSFFFPGRRRLSSPNSSNPALLSSHRAYLCLHDPETDAG

SEQ ID NO: 172652 - protein, 63 aa, Triticum aestivum
  unsure (1)..(63): unsure at all Xaa locations
  Clone ID: PAT_TA_67070.pep
QPGSSGSDPFKNKNLXEALRMQMEVQKXLHEQLEVQRQLXXXIEEHAKYLQRILEEQQKAGSG

SEQ ID NO: 172653 - protein, 108 aa, Triticum aestivum
  unsure (1)..(108): unsure at all Xaa locations
  Clone ID: PAT_TA_67071.pep
RPARRQGHXSAXXLVPQRHCXTXWLXGHPXXDXNXTXLPRXXXDXGXPTLXSXXXGIKPTEPXPRWXVPKVGGPFAXXVPRRACXXIDSSQXPTQVVXPRAFLPGIWT

SEQ ID NO: 172654 - protein, 94 aa, Triticum aestivum
  unsure (1)..(94): unsure at all Xaa locations
  Clone ID: PAT_TA_67072.pep
HSPREMAGPXPXAARKEAXFMDIXEAMTEFYDGTDDVAXSRRPCPXXMTKSRHXHGNCWXQGRVEHGXTLSPMMXTTLPXPLKLSLXGCSSSAN

SEQ ID NO: 172655 - protein, 80 aa, Triticum aestivum
  unsure (1)..(80): unsure at all Xaa locations
  Clone ID: PAT_TA_67073.pep
TGCGEPSTLHAEDGDYVVGGGGLRETELKRFLDLYSVRWAVSXDFGVAAAHSATLLHVLTADCTQSASTVSCAASASHYS

SEQ ID NO: 172656 - protein, 98 aa, Triticum aestivum
  unsure (1)..(98): unsure at all Xaa locations
  Clone ID: PAT_TA_67074.pep
MGTGATANMFAHPGNLASXTPVTIDRRIIVGDGSTLPITHAGHTSFPSNSIPITLSNILVSPHLIKNLVSVRCLTRENPVXVEFDELCFCVKDARTRM

SEQ ID NO: 172657 - protein, 89 aa, Triticum aestivum
  unsure (1)..(89): unsure at all Xaa locations
  Clone ID: PAT_TA_67075.pep
YNSLXXKLTPTXHPAPPIXPAKIQLAXSHPXYLXXYPNYFHTPXNPXNPXXXYIXXXFKEQXKSXHXHFXPVSXPSKFXKQKLPKTLMH

SEQ ID NO: 172658 - protein, 85 aa, Triticum aestivum
  unsure (1)..(85): unsure at all Xaa locations
  Clone ID: PAT_TA_67076.pep
PQINFXGVGHLVTANRXSISXDXXHLWTPHXPXINXXXXDXNQXHPMGDNGXGVXXXWSSSGXAGHXLVYWWXXIHXQRSXVLVX

SEQ ID NO: 172659 - protein, 119 aa, Triticum aestivum
  unsure (1)..(119): unsure at all Xaa locations
  Clone ID: PAT_TA_67077.pep
LLSWXAKVLLGVVLFCFVVVFCFFLTYSEXXSVLRVCSQCCFFFXAHSXSERAXSAXWGRRXLREXVXAXAHXQSAXCXQGSXGQXFXXSXRRXXERXRDSLFCXTLRAGVFETPFCVG

SEQ ID NO: 172660 - protein, 83 aa, Triticum aestivum
  unsure (1)..(83): unsure at all Xaa locations
  Clone ID: PAT_TA_67078.pep
ENQKEDKNKRXTTVVPATRXAREINGGXNGDGAXRSAKSRKISGKMELRXRASRGESLTSVARAFHQTPHXHRRGARAPKXXP

SEQ ID NO: 172661 - protein, 96 aa, Triticum aestivum
  unsure (1)..(96): unsure at all Xaa locations
  Clone ID: PAT_TA_67079.pep
CXHRLLVCNVARRRXCFRQVHQHQLLKPKKAWLPLKLTKXKKAWLLLNLTKXKNRKGVLLQTATTIRXPGQAVGPRRSDRPLASSHKYAGKDWFTS

SEQ ID NO: 172662 - protein, 81 aa, Triticum aestivum
  unsure (1)..(81): unsure at all Xaa locations
  Clone ID: PAT_TA_67080.pep
ASVASXPSGGSPXVLDYCFPLEKKTXLAPNXLEQXLAXGKXXXDLALGKMGEMGIRXRXRLAXELADWRTSTLXGNLRXSL

SEQ ID NO: 172663 - protein, 94 aa, Triticum aestivum
  unsure (1)..(94): unsure at all Xaa locations
  Clone ID: PAT_TA_67081.pep
CVTESRRAGVGGTWPPNERAXRELDRGQLEAMVLDNALDKXKPVGRNNDPEVLRHGSRSAVAWPTRYVSVTGLHDYLRHPSKSWTXWHQXXGPP

SEQ ID NO: 172664 - protein, 79 aa, Triticum aestivum
  unsure (1)..(79): unsure at all Xaa locations
  Clone ID: PAT_TA_67082.pep
LGASDEDDLGDDGEDQVDGDAVAEVVEGVAVKEKGASLEXDGLGTXVCAGLVXRLGXXXXAAAPGVAXLXWGGXXKAXC

SEQ ID NO: 172665 - protein, 96 aa, Triticum aestivum
  unsure (1)..(96): unsure at all Xaa locations
  Clone ID: PAT_TA_67083.pep
GFGEHTKRTFRLQPNDTFTLWNEDLERSDLLDRNLYGSHPFYMDVRPGGNAHGVLLLNRNXMDILYGGSYITYKVXGGVLDFYFFAGPSPLAVVDQ

SEQ ID NO: 172666 - protein, 62 aa, Triticum aestivum
  unsure (1)..(62): unsure at all Xaa locations
  Clone ID: PAT_TA_67084.pep
TLWTPRVYALIAEADAALSGXDAXLTGRNPTGSSGVTRAPTSFPVWALEGDGSHRFSVWLLH

SEQ ID NO: 172667 - protein, 41 aa, Triticum aestivum
  Clone ID: PAT_TA_67085.pep
GAFVDMDIEAHGGIISLRTLVDYSVVESFGGGGRACITARV

SEQ ID NO: 172668 - protein, 82 aa, Triticum aestivum
  unsure (1)..(82): unsure at all Xaa locations
  Clone ID: PAT_TA_67086.pep
FLERFFPAVFRRKNLVTLNNYXKYDNXALSAXTSILYLSGQVSXXAAAXVTRNYGRXASIICGXISFLIGAALNAAAAXLTT

SEQ ID NO: 172669 - protein, 66 aa, Triticum aestivum
  unsure (1)..(66): unsure at all Xaa locations
  Clone ID: PAT_TA_67087.pep
TKNRVLSSKASGEPAVVLAASVHCAVREAIRAARKEFGSSQLTFQLDVPSPMTHXKEMCGLDIVDK

SEQ ID NO: 172670 - protein, 206 aa, Triticum aestivum
  unsure (1)..(206): unsure at all Xaa locations
  Clone ID: PAT_TA_67088.pep
CAAESISVLRRSYLDPVLFVRPPVLRETTSQPVSFLVTPQIYLEPNPSGLFSTNIRFYLWSLQQDDMSRSSSSAKLLYGXQFXTGEFGLVSQLAHCDGLVLLXTNTXTYVFNPATRDVVALPRCHRNMLQHPXCLPIGLGLDVSTGTYKVARSFYXSGDYSSVAMXMXVFTINGEEGXWRETLLDPPYPIVCPQTAIHCKGSLFYS

SEQ ID NO: 172671 - protein, 179 aa, Triticum aestivum
  unsure (1)..(179): unsure at all Xaa locations
  Clone ID: PAT_TA_67089.pep
KTDDVHLPGFLKAAMVQGVGSYSKDPXSXHSTTXGSSVYFLDVDWSGSLKSLFVETPTKNYXWTGHVVKPFKPFDLDAMHRCXAGLIINAFPVXVEEFLEGYQVEPGMXRPFKRCXESEGTPSRHSPPYRSSRTEAPCKDTGGWLIRLTXHFPWELWGLWLXAIGYCLSGAEFLKRNPS

SEQ ID NO: 172672 - protein, 121 aa, Triticum aestivum
  unsure (1)..(121): unsure at all Xaa locations
  Clone ID: PAT_TA_67090.pep
SDXXMAGDIDDRKXTSGGVFFLGDSPVSWLSQKQKVVALSSCEAEFIAAITAACQGVWVARLLAEITGEELQVPLLLVDNKSAIALCKNPVLHDRSKHIDVRYHFIRECVEDGRMTVDYIR

SEQ ID NO: 172673 - protein, 64 aa, Triticum aestivum
  unsure (1)..(64): unsure at all Xaa locations
  Clone ID: PAT_TA_67091.pep
AADDGVDDELRRYREFGPEDAIRVSVQSQIGTQELKQRVHHLLTSQRARIKAXTGDDEAVNEVR

SEQ ID NO: 172674 - protein, 53 aa, Triticum aestivum
  unsure (1)..(53): unsure at all Xaa locations
  Clone ID: PAT_TA_67092.pep
PPDRXVXXIXGVXDPXGXACXPPILXCRRXXGVPXSAXXXVGXLXXGXRRXKS

SEQ ID NO: 172675 - protein, 119 aa, Triticum aestivum
  unsure (1)..(119): unsure at all Xaa locations
  Clone ID: PAT_TA_67093.pep
QHXIQASGTCIDGKEDGLLSSCXXDPRIXSFXXYXXXFSXALSKAPALVADMRRLRXLSPRALCXLDAKMGXLXXYXRASSXYXGKVEDSVDFDITYYXSYTEARXXXIXDVIXELQQL

SEQ ID NO: 172676 - protein, 73 aa, Triticum aestivum
  unsure (1)..(73): unsure at all Xaa locations
  Clone ID: PAT_TA_67094.pep
AVGPIGGEINLTLTAYTDHIFNTRFDHFDRXEIDPLLFEIWKRLTKRKITFRQALEQIQQENMFPRQEKCIQF

SEQ ID NO: 172677 - protein, 136 aa, Triticum aestivum
  unsure (1)..(136): unsure at all Xaa locations
  Clone ID: PAT_TA_67095.pep
EARXXXXACDREFDEKARQVQXFKAEXLXKNQKVXEFERIVXLKXXEXEMFQXXXXXXXKEAERFXRIXLAPFERAXQDYXSLSXKXRLEEAEEEKQFFFEKXKFEXXHXPPKESXSVPADSSQPDAVQSGPSQTF

SEQ ID NO: 172678 - protein, 99 aa, Triticum aestivum
  unsure (1)..(99): unsure at all Xaa locations
  Clone ID: PAT_TA_67096.pep
FSLPLXXKKSTXTDNLNKIXXFFLXLTXSAAXFNASXRCLRRXVTGSXKXXGRSLRRXXXXNQXKXPLXXLSNGMKXPFQAPFVFLQIGGRXLXHGQVA

SEQ ID NO: 172679 - protein, 123 aa, Triticum aestivum
  unsure (1)..(123): unsure at all Xaa locations
  Clone ID: PAT_TA_67097.pep
IEXIKKFETLSYLXXLSTEALLKQVDYLIRSKWVPCLEFSKVGFIFREHNASPGYYDGXYWTMWXLPMXPXTDATQVINEVEEVKKAYPDAYVRIIGFDNMRQVQCVSFXAFKPPGCEESGKA

SEQ ID NO: 172680 - protein, 100 aa, Triticum aestivum
  unsure (1)..(100): unsure at all Xaa locations
  Clone ID: PAT_TA_67098.pep
XWVCXXXRLPASXGAXXSXXSLLVXFVXRXRLLAKAXXAXXSAXXXGGGXVLPDSXRGEVLGXXXTLXCGFFEEXRNVXXXKXDGDXDVGGXTXPGFGAG

SEQ ID NO: 172681 - protein, 90 aa, Triticum aestivum
  unsure (1)..(90): unsure at all Xaa locations
  Clone ID: PAT_TA_67099.pep
XFALGCNLTADGNRTVGRTLPVMGISVEESRVRVRFLISTGCYNPANGNTSYSRAWVXHDTVALLVLGQGQQALRHRMQINGLCEGCXRK

SEQ ID NO: 172682 - protein, 113 aa, Triticum aestivum
  unsure (1)..(113): unsure at all Xaa locations
  Clone ID: PAT_TA_67100.pep
GXXXXMRXRXMAAXXIRXXXXAXXGTHGFFXXXPGLDXTRRGGAHXCCEXFLDLASCRXRXLHLGTDLAFPTXESSSEKIRTXQDXLXHTXWILYLCAFRDSSXWEVYXHXXD

SEQ ID NO: 172683 - protein, 121 aa, Triticum aestivum
  unsure (1)..(121): unsure at all Xaa locations
  Clone ID: PAT_TA_67101.pep
TLNRGGTPLSFYMVAAPLDPLHRLRRRRARVLTRRRAVMALWRKKVLFLESRYQPPPPLAAKDRSQCSLANVRVWMLLVAAVVHVCLVCPCCFVFPPPHRRQIQFLSFLRKVQVRYVXVEV

SEQ ID NO: 172684 - protein, 59 aa, Triticum aestivum
  Clone ID: PAT_TA_67102.pep
HGLGKYHKALLKPKIKLQAVTSFFCSGHAGGLHTCSCRTAPMHARNCNRRRSELPEQSA

SEQ ID NO: 172685 - protein, 70 aa, Triticum aestivum
  unsure (1)..(70): unsure at all Xaa locations
  Clone ID: PAT_TA_67103.pep
LVLQLRGRQMWIXPTXIPVRLNHLNKLFIANVPMNWDTIWILXXXXPRLPWSRSMFILTXXQRRRVXQDH

SEQ ID NO: 172686 - protein, 99 aa, Triticum aestivum
  unsure (1)..(99): unsure at all Xaa locations
  Clone ID: PAT_TA_67104.pep
ITAHGHGCWXXVPRQAGLXXCGKSCRLRWINYLRPDLKRGSFSQEEEAPIVDLHRVLGXRWAQIXKXCXXXTDNEVKNFWNSTIKKXLIWQAVGSLLRF

SEQ ID NO: 172687 - protein, 99 aa, Triticum aestivum
  unsure (1)..(99): unsure at all Xaa locations
  Clone ID: PAT_TA_67105.pep
LFGGFGVXXRLVAGXSAGTVSSFXLXSGGGAXPDXFAFEFLGXSGGAPSVLXPXVWAXGAGLXXPRFXLWFAXSAXFRSXXFXWAPXPFFFGVXGVPVR

SEQ ID NO: 172688 - protein, 135 aa, Triticum aestivum
  unsure (1)..(135): unsure at all Xaa locations
  Clone ID: PAT_TA_67106.pep
MAAPVVAPVAAPPPVLGAPMXLMTXALRLVMXXSSAHDGLVGGLRXAAXSIGAHAAXLCVLAEDCAPPDSVTLVXALCAAPXVPLAPVPGAHTLGAWAGLCXXDSGGKAGXVVGCSCVVVPAYGXGSGGLXLVPA

SEQ ID NO: 172689 - protein, 141 aa, Triticum aestivum
  unsure (1)..(141): unsure at all Xaa locations
  Clone ID: PAT_TA_67107.pep
PPSPDTLADKDSNDTTKTSTSKDAPTFLEXISPXGEIFKXATXIESGQLQXQDDXVNLGCXCKNELALAHYACAXKXFISHGSTVCXSCGNVATNVRPEDFNMVXXSXKDYXALRERTSTGDLSXLHXRADAFVDPVALAA

SEQ ID NO: 172690 - protein, 75 aa, Triticum aestivum
  unsure (1)..(75): unsure at all Xaa locations
  Clone ID: PAT_TA_67108.pep
EHVCVCGRVCVXVWGVRMRRVAMXIACXARXRVXACXXVEXXXXXXXXSVXGESXALAXVGLNXRRXGSARRXFA

SEQ ID NO: 172691 - protein, 151 aa, Triticum aestivum
  unsure (1)..(151): unsure at all Xaa locations
  Clone ID: PAT_TA_67109.pep
PXPQVXXSVVXXXNSLXSTHSLXLEHTDVXHILLDNXXIYXXCRXSLDIXXAPXYTNLNRLXSXXVISSLTXSXRXDGALQWSXSMNXRXQXWCPXPXRIHXMRTSYAPVIXAEKAYHEQLSXAXITNSAFEPSSIXXKCDPRXGKHXGRS

SEQ ID NO: 172692 - protein, 95 aa, Triticum aestivum
  unsure (1)..(95): unsure at all Xaa locations
  Clone ID: PAT_TA_67110.pep
KPQPRLRISCICLCICSRIAVWGSICLCLCICSRIAVWRSICLCICSRIAVWGSICLCPCICSRIAVWXSICLCICSRIAVWRSICLCSMGGTSV

SEQ ID NO: 172693 - protein, 105 aa, Triticum aestivum
  unsure (1)..(105): unsure at all Xaa locations
  Clone ID: PAT_TA_67111.pep
EEGSXTSIINSPEXHRPSDQICGSLVGIEKLGVEEFGGGDIRREGKXXNXVXXXMFGMYIVRLISEYPKQRLXERKKTEFDGKGIGEVLNILPPVLFTLYIRFXX

SEQ ID NO: 172694 - protein, 84 aa, Triticum aestivum
  unsure (1)..(84): unsure at all Xaa locations
  Clone ID: PAT_TA_67112.pep
XXLXAHXCQVXHARRRRIXXSXKSRLQTXSSAIXXDPXXIXGSMSERTITXSKAXSLXXXRXKXPXXTDPXRRQXRTSSXKETX

SEQ ID NO: 172695 - protein, 45 aa, Triticum aestivum
  unsure (1)..(45): unsure at all Xaa locations
  Clone ID: PAT_TA_67113.pep
LGAQRRVRQLXQLRXHXGHPRQARHPHPRGDGRRREVXQXRXLKS

SEQ ID NO: 172696 - protein, 112 aa, Triticum aestivum
  unsure (1)..(112): unsure at all Xaa locations
  Clone ID: PAT_TA_67114.pep
ALGMVILELLTAKSPIGLPELVERAVEDGQITDVLDKSAGDWPVKEAHELAQLGLKCLEMRXKDRPDLKSVVAVDLERLKHGTAVXLAGPPSHFMCPILKKVXQNPCLAADG

SEQ ID NO: 172697 - protein, 140 aa, Triticum aestivum
  unsure (1)..(140): unsure at all Xaa locations
  Clone ID: PAT_TA_67115.pep
PVAWWCFLCCAPXGGXXVCXAXXXPXXGGVRLPGRPXAAGXARXPPRXGXPAPAXPSXPCPWFSSXPMSGSXGPASRXPXPTPRSPGPPSLSXXFXAXPRPXXPXSASPRPRSPXRLPXPAPFXLXXXXLPFXSPPFTPS

SEQ ID NO: 172698 - protein, 104 aa, Triticum aestivum
  unsure (1)..(104): unsure at all Xaa locations
  Clone ID: PAT_TA_67116.pep
TPTSXNXXSXPPPXQDKPXTXPPWPXSPPPXPRPXFXXXQXSXVXGAXHVXPYRVEPQTLXNXXDQHPHSIXXNRRQQXXPCXVPFQPPPPXTSGCXGHPNQMH

SEQ ID NO: 172699 - protein, 83 aa, Triticum aestivum
  unsure (1)..(83): unsure at all Xaa locations
  Clone ID: PAT_TA_67117.pep
LGXSGDPAYPGGPXFNPLGFGTKSEKEMKEXKLKEIKNGRLAMLAFLGMSLQAIFTGXGXFQNLLDHXSXPVNNNILTSLKFH

SEQ ID NO: 172700 - protein, 145 aa, Triticum aestivum
  unsure (1)..(145): unsure at all Xaa locations
  Clone ID: PAT_TA_67118.pep
MAFSLDGQMPXDKTVGGGDDAFNTFFSETGAGKHVPRAVFVDLEPTVIDEVRTGTYRXLFHPEQLISGKEDAANNFARGHYTIGKEIVDLCLDXXIRKLADNCTGLQGFLVFNAVGGGTGSGLGSPLLERLSVDYGKKSKLGFTV

SEQ ID NO: 172701 - protein, 71 aa, Triticum aestivum
  unsure (1)..(71): unsure at all Xaa locations
  Clone ID: PAT_TA_67119.pep
QRDNSVNLSFTCRHSTLYPKAMEVVRMRDASAAAFDXXFAGLDALLLSGAXFAEKRDGYGFEDXMAGLXPV

SEQ ID NO: 172702 - protein, 123 aa, Triticum aestivum
  unsure (1)..(123): unsure at all Xaa locations
  Clone ID: PAT_TA_67120.pep
IEGIKKFETLSYLPPLSTEALXKQVDYLIRSKWVPCLEFSKVGFIFREHNASPGYYDGRYWTMWKLPMXKXTDXXQVINEVEEVKKAYPDAYVRIIGFDXMRQVQCVSFIAFKPPGCEESGKA

SEQ ID NO: 172703 - protein, 85 aa, Triticum aestivum
  unsure (1)..(85): unsure at all Xaa locations
  Clone ID: PAT_TA_67121.pep
ARQTPEGSXQXXKRXRXXXXAASHMYLHVRLLRAGHRHRXRXLSKTSPTTLPTPSTTXPGPLXPTXXPASKXLGVVLCLETDRTR

SEQ ID NO: 172704 - protein, 167 aa, Triticum aestivum
  unsure (1)..(167): unsure at all Xaa locations
  Clone ID: PAT_TA_67122.pep
SSNNSPQATASDSKISQTLDRILGRSASTSAPNNQSDNGGVNAETPRKLTGHLGDIDPVPFVPLSADLFTKPQNAKSNEQADRDCQINRETGSSTPGITQASTERKDVDRSLDTAEKWSKKVAELDSVNDLSSAISDEDFPDIMPMRKGENRFVISKKXXRSLTSPQ

SEQ ID NO: 172705 - protein, 114 aa, Triticum aestivum
  unsure (1)..(114): unsure at all Xaa locations
  Clone ID: PAT_TA_67123.pep
AEVPXFVLTGLADMFTMVGLQEFFYXQVXXXLRSLGLALYLSIFGIGSFISXFLVYAIDRVTSDGGDRWFSNNLNRGHLDYFYWLLAALSVVGLAAYLHFSQVYVPKKKGISAE

SEQ ID NO: 172706 - protein, 244 aa, Triticum aestivum
  unsure (1)..(244): unsure at all Xaa locations
  Clone ID: PAT_TA_67124.pep
PGLVSGLPAVFLEXNPGLCGPXLPSDCDAPLRKHXGLXLAATVASFVTGLALLAVXVFAVCRRIRGNRPSSPWXXGAFHPIKITGEDLFAAFHDKNVIGRGAFGKVYLIVLQDGQKVAVXRLFSSAXLTFREVKNEMKALAKIRHKNIAKIAGFCYSEGXVSVIYEYFQRGSLQDMICAPKFAVGWNDRLKVALGVAQGLAYLHHDYTPXMLHRDLKXSNVLLADEFEPRVAGFGIHRVVGEKA

SEQ ID NO: 172707 - protein, 70 aa, Triticum aestivum
  unsure (1)..(70): unsure at all Xaa locations
  Clone ID: PAT_TA_67125.pep
XSGQYNDEVCLRYKTLCLPKVHTNTNHVRQCILHVTKNTKNXIXTLNCSWCSQSILPQQSLEWPPIHLPT

SEQ ID NO: 172708 - protein, 76 aa, Triticum aestivum
  unsure (1)..(76): unsure at all Xaa locations
  Clone ID: PAT_TA_67126.pep
WAPCXIDENWSXXXPCXSLRXITXFXXXAXADRRRCXIXXCCNNNXLIFDLCXRMVWXGXGVCXXXSXXXXGVXRG

SEQ ID NO: 172709 - protein, 98 aa, Triticum aestivum
  unsure (1)..(98): unsure at all Xaa locations
  Clone ID: PAT_TA_67127.pep
WFTPMLTDFGWLQXCSKXLDARALXDSLGXALLTLPLRXQXXLFEEWFPVFASRGAXCPNLSRASXMVXKGHSLXRLXVXPLQQKPMILLGPHELYYL

SEQ ID NO: 172710 - protein, 55 aa, Triticum aestivum
  unsure (1)..(55): unsure at all Xaa locations
  Clone ID: PAT_TA_67128.pep
TNRARGSRCAAVSLGXARGSREGRARGXGFEISRPGTDCREDDAERNGSGKSGSS

SEQ ID NO: 172711 - protein, 120 aa, Triticum aestivum
  unsure (1)..(120): unsure at all Xaa locations
  Clone ID: PAT_TA_67129.pep
HDARXIRREQWRDRVLQLLGKKXPSWISDEAMXEFYDGTDDVASFASSMXHRHDDKVXRPRALLVARKSRTWEDAEXHDXHYXSPPVETKLXGLFXIGQLXAAIXXXPXKPWXXGXXTIX

SEQ ID NO: 172712 - protein, 114 aa, Triticum aestivum
  unsure (1)..(114): unsure at all Xaa locations
  Clone ID: PAT_TA_67130.pep
NGDSSGXVYIQLGCRITTTPTITCPAKWTKSKNSLPXQNQQRPXTVLLQPPTNFIXILIRQRDHKTLLILGTTAPRSGPSRDGRXGAXGGARXSAIRFHPLLPQRQLELQQXVV

SEQ ID NO: 172713 - protein, 107 aa, Triticum aestivum
  unsure (1)..(107): unsure at all Xaa locations
  Clone ID: PAT_TA_67131.pep
TXXATSFPNLKALDFSGTAQAYVTFVKGSAPKLEQILHMPFSVPKLDDKDATPSESKAAAAAIRKEAGANPNHPTVTFEGKPEGEDNEETGASDEEKSKEDGIADED

SEQ ID NO: 172714 - protein, 127 aa, Triticum aestivum
  unsure (1)..(127): unsure at all Xaa locations
  Clone ID: PAT_TA_67132.pep
GWQXNAPPPPPDHVVKMNSHPSTKXPPPXVNVNSSXSXSHFSGGGENRXLQXPFGNALSFSXCTFTYEELAXATNEFADANLLGXGGXGFVHKGVLPXGTEVAVKQXREGSWQGERXXQAEVEXISR

SEQ ID NO: 172715 - protein, 71 aa, Triticum aestivum
  unsure (1)..(71): unsure at all Xaa locations
  Clone ID: PAT_TA_67133.pep
LVAEPLLKAKLNHYLSQNCCKTEPACFQTECHQSGTLLASKYPVVSKNAPEPMLKKEYHQIMRXVLNSTPW

SEQ ID NO: 172716 - protein, 120 aa, Triticum aestivum
  unsure (1)..(120): unsure at all Xaa locations
  Clone ID: PAT_TA_67134.pep
GIAXVTAPVYIAEAAPSEIRGGLVSTNVLMITGGQFFSYLVNLGFTEVPGTWRWMLGVAAVPAIIQFVLMLFLPESPXWLYRKDEKAKAIXXLEQIYDSGRLEEEVELLASASMHEFQSC

SEQ ID NO: 172717 - protein, 62 aa, Triticum aestivum
  Clone ID: PAT_TA_67135.pep
RPPAAAVLRPRVSPPAGTRPLRSRLFSSLEEDGESAMRLYQENLATLDRVKKHQECMISQVK

SEQ ID NO: 172718 - protein, 139 aa, Triticum aestivum
  Clone ID: PAT_TA_67136.pep
CRTPARGITATSTPKSRSPWKSTAACGPSRRPLASATTTTPRSRSRRALGRRPAAARRRRTRRRRRGSPTTSLSPAAPCSSPRPPASPGPRSPECRTRRRPRGALPGDQEVPTPTEATPQAQERRPAPPQVHTRRRSRR

SEQ ID NO: 172719 - protein, 62 aa, Triticum aestivum
  Clone ID: PAT_TA_67137.pep
SLYSPQLQVNHVLATRGCSFVVALVGSSPSTRNSRECGFVFTPVASPPPTHNSRDVVCNRPS

SEQ ID NO: 172720 - protein, 184 aa, Triticum aestivum
  Clone ID: PAT_TA_67138.pep
MRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHS

SEQ ID NO: 172721 - protein, 77 aa, Triticum aestivum
  Clone ID: PAT_TA_67139.pep
SAPGTSSGSPRRRAWRSPPTSSRPWRRRLSILPSSSFERLLITSTLLAAARLRGRSPICPNQSESLISSSYIRRTAC

SEQ ID NO: 172722 - protein, 65 aa, Triticum aestivum
  unsure (1)..(65): unsure at all Xaa locations
  Clone ID: PAT_TA_67140.pep
LCSYSAIKSILPWRKRXKLPKKGEPLLKNKNGEEGGDDIDYDRRLLTSSGESVSGGSSGSVSTME

SEQ ID NO: 172723 - protein, 111 aa, Triticum aestivum
  Clone ID: PAT_TA_67141.pep
PSCGDTVLQANSSFEFDGNSLAKASERQCWSGQEPRISILDSFPSDVSAFLCFPYSLTPSRLYWSLQHVAAIFAVRASPARTFPPSICPRAELRGRASTTCCSSLPPLQHK

SEQ ID NO: 172724 - protein, 175 aa, Triticum aestivum
  Clone ID: PAT_TA_67142.pep
AGRGRIPVSDRSAEAQPEAAPSSQRGASTTQDEVSGSRSRAGRRRRRRITVSDESAEAQPEGAPSSQRGKRKASPEPSSAASQGRRRQKRTAKKRKRTDEKKAASSKGEEAAATTSASPGASHASSSSEASSAASSPLRCPLPPAPAMGAGRNYDPAMEPACEAYMELSSKYHAK

SEQ ID NO: 172725 - protein, 129 aa, Triticum aestivum
  Clone ID: PAT_TA_67143.pep
RPYGLMAAVVFKSYHASWVGSRNQKPLPPEAEVLSATSSSNSANCKRAFTTSPSRNSSNTGLCWHVGWDSPSACTPQDTAHYWQQWADIAGVSVGRAGIACVTEFKPLKPKTWKEIPRLVRERRQACRS

SEQ ID NO: 172726 - protein, 155 aa, Triticum aestivum
  unsure (1)..(155): unsure at all Xaa locations
  Clone ID: PAT_TA_67144.pep
SPPAPPXPPPAAVHHAPPPQIHPHPTPPXLPPLPPSPLSTASSPPSRPPFSPTLASPSRTTSSPPAASPDHRPPRPPPGSPTSNPPLSPTPSSPSSPVSASPPPMSQPSSPRTPSSSAPKWRKPWPPTSRSSVAAASAVDPSSPSCTTTCLSSTP

SEQ ID NO: 172727 - protein, 83 aa, Triticum aestivum
  Clone ID: PAT_TA_67145.pep
GAAMLLYFVLSRRLANHEEAAGSSGGGGGGKRRRGRAARQPSQPPATWMEAVGTLAETLRFTYSETLGKWPIGDLAFGIKYLM

SEQ ID NO: 172728 - protein, 123 aa, Triticum aestivum
  Clone ID: PAT_TA_67146.pep
GNASRWRRVEHRATRAPFPFPFPLFLYIHLPPPAAEIEGRSCALLCSPALDSACLAAPSLALLSACASTVGERAAANRLSGLPFAPFGVCSSRPLGLPMRVEIKRNGAVQQRRYFFGEPKALP

SEQ ID NO: 172729 - protein, 140 aa, Triticum aestivum
  Clone ID: PAT_TA_67147.pep
PSASTTTDTLTSASSSSLLWEDAVAEFECGDDGQFKMESSAATQSFSGLLRELNELEQSVVSWGRKSHRSRDDKKASSPPLEHKQATMKSGVKGGDVTTGGAKDRHVGDSVEPGTVGACVEVGLDGSVAVVKQSEDPLSD

SEQ ID NO: 172730 - protein, 89 aa, Triticum aestivum
  Clone ID: PAT_TA_67148.pep
PPQQPGHQRQRLPIGRLNPRRGRRRRPLAATASTCVRTVAANPTSNRSANEQELKRYTAVRGRVLGVLGLDDVDAGGGAAGGEGDDDEA

SEQ ID NO: 172731 - protein, 51 aa, Triticum aestivum
  Clone ID: PAT_TA_67149.pep
GQNPRLATAAGLAGVKPPVGLTHFDHGGTPRVSMTGGAGLLIRLGLVLTKN

SEQ ID NO: 172732 - protein, 143 aa, Triticum aestivum
  Clone ID: PAT_TA_67150.pep
LSNDSAQQAAAMASTAMPQAQVQVHAQAQARQSPVAAAAMMAQARKSPYQQVAVPRTTSRTSQRNQSRTPVTEQARGYQPPPPVDMGQQQSARPGAHYDTSSSHMPSGSGYNDYGRYCGANTAANHQAAMSAASATPSTMGTS

SEQ ID NO: 172733 - protein, 63 aa, Triticum aestivum
  Clone ID: PAT_TA_67151.pep
EMHEKASTDPKKKTKEPLLENGHCICRVSDYLIAKNSLISLLGSLLYTEGNNTVASCDFLHWR

SEQ ID NO: 172734 - protein, 113 aa, Triticum aestivum
  Clone ID: PAT_TA_67152.pep
RSCSPRRTSSPTSHLGVSPRRTGDEIATPGTETMLGFSDHVRSFVNPVWTSSLSGNYSNTTSRTGKQLDISHEKVRGLSRSFLPAIHLEHYPCENFSFSPPPIDRRRTRQGCK

SEQ ID NO: 172735 - protein, 90 aa, Triticum aestivum
  Clone ID: PAT_TA_67153.pep
ARDTIFFLEYARVCVSFITRETLLCIQHAKKNIQKNINYGRNSLLQTTNQIFNTKRKRTVPHLAGELWTYKNPIYSTGYMGTVTHSTLQQ

SEQ ID NO: 172736 - protein, 55 aa, Triticum aestivum
  Clone ID: PAT_TA_67154.pep
PMRRNLWGAPMLSSASYSSDLAVGGVANCLPGPTLLDVMVSGDTKPRDVVIGVAV

SEQ ID NO: 172737 - protein, 100 aa, Triticum aestivum; identical to SEQ ID NO: 170998
  Clone ID: PAT_TA_67155.pep

SEQ ID NO: 172738 - protein, 44 aa, Triticum aestivum
  Clone ID: PAT_TA_67156.pep
CNLVLWCTTDYRASAVRSGRIDPKGTRIDWEVNAAPCQCGRGRW

SEQ ID NO: 172739 - protein, 107 aa, Triticum aestivum
  Clone ID: PAT_TA_67157.pep
MAAAPAGPQNRCVFVGNIPYDATEEQLVQICYEVGPVVSFRLVVDKETGKPKGYGFCEYNDEETALSARRNLQGHDVNGRQLRVDFAENGRNTDRNREKVEDPQSIT

SEQ ID NO: 172740 - protein, 104 aa, Triticum aestivum
  Clone ID: PAT_TA_67158.pep
MTTPQNTAKMSFLGMGRPQPTSEQKIAAVESEMRMMADTYNRLQQSCQKKCVPNDYREGELNKGESVCLDRCTAKFLDTSMKVSEIMQQQGQALGGQQGGGGMF

SEQ ID NO: 172741 - protein, 131 aa, Triticum aestivum
  Clone ID: PAT_TA_67159.pep
ITGALDPYVEVKLGNFKSVTRHLEKNANPVWRQMFTFSAAHLQSNQLEVIVRHKDVLRADFVGRVVFEMSDIPSCIPPDSQLAPQWYHLSDAHGERFPHGNSLGEIMLAVWLGTQPDEAFLEAWHSGTHSL

SEQ ID NO: 172742 - protein, 49 aa, Triticum aestivum; identical to SEQ ID NO: 147490
  Clone ID: PAT_TA_67160.pep

SEQ ID NO: 172743 - protein, 157 aa, Triticum aestivum
  unsure (1)..(157): unsure at all Xaa locations
  Clone ID: PAT_TA_67161.pep
TRTTTKTTRRRTTTWRTSGRLPTPTIWTLFPSRSFSTYMPTSTTAPTPPPPMPPSSRTQXSGLPSGSPTRRASPASRSTPTAWNPASSPIRPWSSPPRTTWSSSAPPLALRNTSVPPVTSIITMSTGPAPTQLFAGSPTPAPLSLPTAQRALFAVVT

SEQ ID NO: 172744 - protein, 106 aa, Triticum aestivum
  unsure (1)..(106): unsure at all Xaa locations
  Clone ID: PAT_TA_67162.pep
ACPPEFGSIVVHDLTIRDGPNLQNKIGARAQXLHLGAGMNETNWFTSFNIIFTDERFKGSTLQVLGTTSIRDGEWAITGGTGEFAFAQGVATHIKSKERGGAGRDW

SEQ ID NO: 172745 - protein, 89 aa, Triticum aestivum
  Clone ID: PAT_TA_67163.pep
HYISDGDNNGVIYYAGTSFGKRQWINPVLAKNITVTASSPNSRYTDPNALVSKNYQGTCFAGPRDEDGKKCSWWMVHIGQDHQLMCNYY

SEQ ID NO: 172746 - protein, 100 aa, Triticum aestivum
  unsure (1)..(100): unsure at all Xaa locations
  Clone ID: PAT_TA_67164.pep
ARRCPGCATWFWLEELLCFCICTCSLLLLLKVCSPFPLHVPCLWLNMYLSLGALXLWRRLLQPMRLHPVLPFQFKVFRPHPSLREEILQELLFLMVKQNA

SEQ ID NO: 172747 - protein, 87 aa, Triticum aestivum
  Clone ID: PAT_TA_67165.pep
GHIQLAPSAPQDHTRRVSGHPRGLPPTGASDHSQWCLEFWTPARATLLLLLLSSRLCCCSFYFSDAPACSELSHSLLLHLSAATVLV

SEQ ID NO: 172748 - protein, 140 aa, Triticum aestivum
  Clone ID: PAT_TA_67166.pep
SEDGRHVDYRSIQGCEEFKRYIRTTEELQRVETSDLSREEKIAFFINLYNMMAIHALVTCGHPAGPLDRKKFFGDFKYVIGGCAYSLSAIENGILRGNQRPPYNLVKPFGHKDQRSKVVLSYPEPLVHFALVCGTKSGPA

SEQ ID NO: 172749 - protein, 119 aa, Triticum aestivum
  Clone ID: PAT_TA_67167.pep
MMVATPMWTIESMQRTCDKPDTTCTWNFKINTGSGAATACKYVVKASKNASQANGGPVKCGTFTVTSGWSGQFGPDNGFTTLSVVSNKKQIVYPSYTDKQVSGGKVVKPDQKYAPASLP

SEQ ID NO: 172750 - protein, 96 aa, Triticum aestivum
  Clone ID: PAT_TA_67168.pep
MSAGLKTIIALSFVLAVGFLLVILSCALWKVYYPLLVVATYVIAPIPNWICGHCANPDDFVESSGAAVLDLGRFFTGFFVVMGIALPVVLAHSGLI

SEQ ID NO: 172751 - protein, 45 aa, Triticum aestivum
  Clone ID: PAT_TA_67169.pep
HCSSSSLNYPSPAPMASFAYQLLDVSYDLDERVTGYSVRPDDDNG

SEQ ID NO: 172752 - protein, 54 aa, Triticum aestivum
  Clone ID: PAT_TA_67170.pep
CMHLRHPNKRTNCVVKAGLNWASQNNIKWVPKEWPTVTMALTRPLTSQRRDRAV

SEQ ID NO: 172753 - protein, 121 aa, Triticum aestivum
  Clone ID: PAT_TA_67171.pep
DKQNCPHFFRALISNSFMEHVTIPPGFHKYLEDCTGMVSLRGPSRNKWPVELAKISGELCFARGWKEWRSDHRVGYGYLLVFRYDGQSQFSVTVFLPSSCEAPYASLAQPQHKDIDVAREE

SEQ ID NO: 172754 - protein, 119 aa, Triticum aestivum
  unsure (1)..(119): unsure at all Xaa locations
  Clone ID: PAT_TA_67172.pep
MMHPSRQAYVEDVEPQGIGGGDVPDDHDYDISMGGTGVPSEKASAILNQFNRKRLAATIAVPTDDTRVRAKLREMGEPVTLFGEALVDRRDRLRELLTIXAEITGLENGDIDMGDADDD

SEQ ID NO: 172755 - protein, 53 aa, Triticum aestivum
  Clone ID: PAT_TA_67173.pep
GEGSIESRRAGNSGGTAVRCRSRVRTPRGAPTTWRGGGLDGWRRGRRSVRGRG

SEQ ID NO: 172756 - protein, 78 aa, Triticum aestivum
  Clone ID: PAT_TA_67174.pep
GGEDAIASPLLLPAPNIGSPPPGRGEKGEEGTGTDVLATTSLTHSETAGRSGTSRGSPSLSGPNHCDWVGGGGVGASA

SEQ ID NO: 172757 - protein, 59 aa, Triticum aestivum
  Clone ID: PAT_TA_67175.pep
RLKLTANAKKIIADLRRPLEILMKGNTINQPDLTVSAVQLLLSHDGVLMQLVILKERLE

SEQ ID NO: 172758 - protein, 145 aa, Triticum aestivum
  Clone ID: PAT_TA_67176.pep
HPHPTDARQPPPRPHQRPVQSPTDTRPPCRLKITWPPPIGGEKLLQPSTRAHFDMDGGSSPPSLAAICNTQGQPPTTSSDRVSTRARGAAKHSVRTHPLLSRCPRVCQIWRIKIRVETQLQRSHNNSSHSRLPPDAHHRHQPRQR

SEQ ID NO: 172759 - protein, 100 aa, Triticum aestivum
  Clone ID: PAT_TA_67177.pep
RDETFNPDLIRAIFKLVWSRRTDRGGPVDEAVDIEPAAETSRRNRSTSANASALQVSCELLRMFVAEAVQRCAVIAEAEGATTIEPTHLERVLPQLLLDF

SEQ ID NO: 172760 - protein, 114 aa, Triticum aestivum
  Clone ID: PAT_TA_67178.pep
VEFAWGLAQSGKQFMWIVRRDLVKGDAAVLPEEFLAETAGRGLMASWCPQQQVLDHPAVGAFLTHSGWNSALESLCGGVPVISWPFFADQQTNCRYQCNEWGVGMEIDSNVRRD

SEQ ID NO: 172761 - protein, 125 aa, Triticum aestivum
  Clone ID: PAT_TA_67179.pep
WAGDALGLSAGLKARWDLAAGSHDKKSTRRGCGDLSLLERNRGAARRETEAQGTKGRGSKRRTAVEETGTAWGDEEEAAGEGGARQEARQAAVTGTPSFEVRGHGVVLLRLVPNSARGRERERER

SEQ ID NO: 172762 - protein, 51 aa, Triticum aestivum
  Clone ID: PAT_TA_67180.pep
PLCSDLSNLLEQGTHIGKIVCSTHLLHPACCQHGKKCFSELNSHTHTHTHT

SEQ ID NO: 172763 - protein, 56 aa, Triticum aestivum
  Clone ID: PAT_TA_67181.pep
VQPAPAGSSILPSTRPLVHYAPQALLVVQANCSNKLHNVPSKSDQTVIKSTKKKKK

SEQ ID NO: 172764 - protein, 34 aa, Triticum aestivum
  Clone ID: PAT_TA_67182.pep
AIPHANAKLGTIGSCNLLLSDVHQGDYPRSLFIY

SEQ ID NO: 172765 - protein, 155 aa, Triticum aestivum
  Clone ID: PAT_TA_67183.pep
LTKLPPVAFSPTSQSSSFPIMSGASSSAASLLSTMQASAAKTSDVSSPTVSSTLPPQESAPKTHPTVPEGTVSCSLPSIPTPVKESLPDLNKNASKPEVVTPEVTGTTVSVSATLTGVPTSESKTALLPVTNGSLSSNPASIPVPKVVPRATESA

SEQ ID NO: 172766 - protein, 144 aa, Triticum aestivum
  unsure (1)..(144): unsure at all Xaa locations
  Clone ID: PAT_TA_67184.pep
LGTKQSLQASFSSTELRYARDRASTSKPQCNVQLLSEGPMFLNGQLKLHSGAKTRFIFACRRWQTRSSLEMLRCLLEYLLFQYTLAEHHLYHVAIPFKTSFFGACESDLXTIPAPEVVPIRPGPVRSSRRSCNFDKPIATIVLL

SEQ ID NO: 172767 - protein, 74 aa, Triticum aestivum
  Clone ID: PAT_TA_67185.pep
SLASILLFSQLAPDHAVRIHAINNYGLYLDSVWLLSIVWFEVASLQLWHLFSLYDIYVVYYYSGVRQSCSFSHS

SEQ ID NO: 172768 - protein, 75 aa, Triticum aestivum
  Clone ID: PAT_TA_67186.pep
RRDLHAKGWRSLQAFGNIAFAYSYSIILIEIQDTVKAPPPSEAKVMKKATGISVATTTAFYMLCGCMGYAAFGDA

SEQ ID NO: 172769 - protein, 57 aa, Triticum aestivum
  unsure (1)..(57): unsure at all Xaa locations
  Clone ID: PAT_TA_67187.pep
STYAPQIVDTIGAGVEKLVAXMGAVDVVVPGVLPIGCFPIYLTIYGTSSAADYDALG

SEQ ID NO: 172770 - protein, 105 aa, Triticum aestivum
  Clone ID: PAT_TA_67188.pep
FLTNLGGVYAKTKRFSKVPLKQGLRVNFKETEGLFRKNTDDVRPEALRALLVLAKGPVRCNGRKKFIISNGHDHISLHHRDTISLSISRNHKHFEIMNNLLNSCT

SEQ ID NO: 172771 - protein, 169 aa, Triticum aestivum
  Clone ID: PAT_TA_67189.pep
MEMGSFPFFYVAAITFLTALLLRSFLTKKRRRLPPGPALAVPFLGHLPFLKKPLHATLARLAARHGPVFSLRLGSRPAVVVTSAELARECFSSDLDATLANRPHFPSVREVSFDYTVLTLANYGAHWRAARRVAVVHLLSARRVDLMYDAVVARELRALVRRLARLTAG

SEQ ID NO: 172772 - protein, 117 aa, Triticum aestivum
  unsure (1)..(117): unsure at all Xaa locations
  Clone ID: PAT_TA_67190.pep
MAPKAEKKPAAKKPVEEEPTTEKAEKAPAAKKPKAEKRLPAGKTASKEGGEKRGRKKGKKSVETYKIYIFKVLKQVHPDIGISSKAMSIMNSFINDXFEKLAGEAAKLARYNKKPTI

SEQ ID NO: 172773 - protein, 68 aa, Triticum aestivum
  Clone ID: PAT_TA_67191.pep
FFFFFFFFFFFFFFFFFFFFFFLNPTFCILSKLRKIKQQSLLSSAEMQYSMCTGIRQHHNRQPHRGQR

SEQ ID NO: 172774 - protein, 64 aa, Triticum aestivum
  Clone ID: PAT_TA_67192.pep
HPIVYIATSVYGHPHALTVHFQSYMNIMKLVLAVDDEQFPNSHQLLDDFAESLRLVRQAASERS

SEQ ID NO: 172775 - protein, 218 aa, Triticum aestivum
  Clone ID: PAT_TA_67193.pep
RTKKPNVGAVTAASIIGFGLIMLMVLLLIWRNRFKWCGLPLYSNEGSSAGIIAFRYTDLVRATKNFSEKLGGGGFGSVYKGVLSDSKTTVAVKRLDGANQGEKQFRAEVSSIGLIQHINLVKLIGFCCEGHHRLLVYEHIFNGSLDSHLFKKSNNADAAVLNWNTRYQITLGVARGLSYLHQSCRECIIHCDVKPENILVDASFAPKVADFGLAAFVG

SEQ ID NO: 172776 - protein, 172 aa, Triticum aestivum
  unsure (1)..(172): unsure at all Xaa locations
  Clone ID: PAT_TA_67194.pep
GKSDTPLVQKIKEALPRLPQNTIAEDQTLMEWAQDFKDPEVTHRHLSHLFGLYPGHTITMQRNPEICEAISNSLHKRGEDGPGWSSTXEXALWARLLNSENAYRMILKLITLAPPGEKVGFEGGLYTNLWTAHPPFQIDGNFGFAAAIAEMLLQSTPTDLHLLPALPRDKWP

SEQ ID NO: 172777 - protein, 189 aa, Triticum aestivum
  Clone ID: PAT_TA_67195.pep
VRCGLFSQWEESSDEDEDEGGEGKKETPKRSDVDPYAEAAMREYPRFFEFIPQRPHYRGLVNTSDTIRDLVCSGLWFMLVGLAREVLKTSCDTEALEVAYLMRKARQLERNGFNVKHLIARLREPQARLRRLEDSRARLEDARTKEQEPKDVKSLSSHLSNLKHNVLTMQRHLEGKKQARSASVRDESS

SEQ ID NO: 172778 - protein, 65 aa, Triticum aestivum
  Clone ID: PAT_TA_67196.pep
NLLHYLVMTIILLPSTWQYMCLLIDISILVTKDIFLPLRLHNILSFSIDLLVLLCLLALLLEMMK

SEQ ID NO: 172779 - protein, 114 aa, Triticum aestivum
  unsure (1)..(114): unsure at all Xaa locations
  Clone ID: PAT_TA_67197.pep
RIDWCTDVLMAEPLALRYGLSIAKRAGCNRLVINSDNLEVIETMNNGGRTXSTASTAVAVFDDCYFLACGFSXTRFEHCNREANEVAHELAKIAKFSSTVDWFEEPLSEIVSIS

SEQ ID NO: 172780 - protein, 175 aa, Triticum aestivum
  Clone ID: PAT_TA_67198.pep
LCTVTEVEETKQIMKLIPLLVTMFVPCTLIAQTNTLFVKQGTTMNRHMGAGSFEIPPASLGAFVTLTMLVAIVVYDRVFVKAVRRYTKNPRGISLLTRMGIGLLVQVLTMGTASLIESQRLSYARSHGLDVTGGKLRLSIFVLLPQFVLMGLADAFLVVGKIEFFYDQAPESMKS

SEQ ID NO: 172781 - protein, 184 aa, Triticum aestivum
  Clone ID: PAT_TA_67199.pep
NDDCTRHVVRALLRKCGYEVISAENGLHAWQYLEDVQNRIDLVLTEVAMPCLSGIGLLSKITSHSICKGIPVIMMSKNDSMSTVFRCLSKGAVDFLVKPIRKNELKTLWQHIWRRCHSSSGSESGIHTQKCSKPKAGDEYENNSHDDDDDCGSHDDDDDDDDDADDDFSVGPNARDGSDNGSGT

SEQ ID NO: 172782 - protein, 103 aa, Triticum aestivum
  Clone ID: PAT_TA_67200.pep
FRGYSLLFRCINGMKKSPDEDGGDPCVGASTVALCRLATGICIPHTHGRVGVLLSRSRWRLSGGRRRPQLSRLRCLLMLRFATGFPRAATLDLAGVRMEGERG

SEQ ID NO: 172783 - protein, 43 aa, Triticum aestivum
  Clone ID: PAT_TA_67201.pep
TNKEHNTWFMWCVNCISTLKATQSEKHHNTRCRRQNKTTGDRD

SEQ ID NO: 172784 - protein, 84 aa, Triticum aestivum
  Clone ID: PAT_TA_67202.pep
VERNNFARMKRFRMHDILRELAVDLCQKNCFGVIYEDKCGGSLQMDGRLLVMHRVKKDIHQSFSIMHHLRTVIILDGCMPSFTL

SEQ ID NO: 172785 - protein, 104 aa, Triticum aestivum
  Clone ID: PAT_TA_67203.pep
LHVTTGIIGSVVCFLLYAAPILTFRRVIKKGSVEEYSCIPYILTLFSSLTYTWYGLPVVSSGWENWTLSGISSLGVLFESTFVSVYIWFAPREKKKLVMMMVSA

SEQ ID NO: 172786 - protein, 36 aa, Triticum aestivum
  Clone ID: PAT_TA_67204.pep
AYVVYFSSVGISGRLGSKRRFINKSMMRPSANTPIC

SEQ ID NO: 172787 - protein, 107 aa, Triticum aestivum
  Clone ID: PAT_TA_67205.pep
PLLPLARSFPARTSDWFHGRRLARLWKPAPSRGQIFDATMHGQGAGSRLTRLNSLPRELPRAADHRLRRQGPATVTHDDVSAMADGGQASGMGDDEQQKQSCSAPCC

SEQ ID NO: 172788 - protein, 136 aa, Triticum aestivum
  Clone ID: PAT_TA_67206.pep
AGLSRRLSGLLGGDKLAVTPAKEEVTAGSPKSTLCGLPKSGQESPNSGASQGNSPPSSPLEQQPPDPWDVLYEAAGQVNSIPAPGNPYGLHGRGGFLPPARKASPPPPPPHVPAPAGTAAGGVYYHPFAHLITQRQ

SEQ ID NO: 172789 - protein, 44 aa, Triticum aestivum
  Clone ID: PAT_TA_67207.pep
AVSTENFCRLKWDKAYFLNPEEYFSSVASELNHLVNSAANGLSS

SEQ ID NO: 172790 - protein, 36 aa, Triticum aestivum
  Clone ID: PAT_TA_67208.pep
NVTCAGMIIKSTDRLDHADTKERKQPCLFTNPRTLQ

SEQ ID NO: 172791 - protein, 84 aa, Triticum aestivum
  Clone ID: PAT_TA_67209.pep
VRKPEKVILKAYFLHQLKPIPIKLAFFMENKKHLKAKHFRQLNDPPSDLIILIVESLHKDQIFTSMRELQLTNLEQGKSLGAAG

SEQ ID NO: 172792 - protein, 106 aa, Triticum aestivum
  Clone ID: PAT_TA_67210.pep
NVGSRPQRLNTITIGWEPSWGYGNGRIIGISFVYVDQNDKEITVGPWGKIDREHSRAIQIDQDEKLYVVSGTFNDAGVTSLMLKTNKTEHGPFGHAAGSAFSVPLK

SEQ ID NO: 172793 - protein, 70 aa, Triticum aestivum
  Clone ID: PAT_TA_67211.pep
GSNGTAGVWRINALEDSGIWMERTTVEDMDIVVRAHIKGWKFLLWFMTFLYGIHIFTDHSSSATRISIQC

SEQ ID NO: 172794 - protein, 52 aa, Triticum aestivum
  Clone ID: PAT_TA_67212.pep
MGQQLGRDKIGSNLTADDIASAFYFSLLLSPVVSYWDCIFRKIRYSFRPEWV

SEQ ID NO: 172795 - protein, 213 aa, Triticum aestivum
  unsure (1)..(213): unsure at all Xaa locations
  Clone ID: PAT_TA_67213.pep
DLLVVNVSMFSPAPSLSARVVRRYGLREDVKVFNLTGMGCSATLIALDLANNFFRTHANKVALVMTSESIAPNWYPGNRRSFMLGNCLFRSGGCAYFLTNSPRLRPHAKLRLRHVVRTHTGASDEAYNCALQMEDDAGRPGFHLGKELPRAAVHAFVKNXRVLSPRVLPLPELLRLAYATLSARXRTRTNKKKSSSALTIRMKAGVDHFCVHT

SEQ ID NO: 172796 - protein, 208 aa, Triticum aestivum
  unsure (1)..(208): unsure at all Xaa locations
  Clone ID: PAT_TA_67214.pep
SAPTGTAPVDTATESAPTGTESAPVDTATGTAPVDTATESAPTGTESAPVDTATESAPTGTETAPVDTKTDSVPTGTETAPVDTKTDSVPTGTETAPVDTTQTGANGVSTTGATVPYTTKTVYTTXSTLTPSAPTTSRTAPLVVTALXTVTETVAVSTTVCPVTXEYPSKPTGYSPEKYTTKTIYSTEVYTVTKCPPSVKDCPYGSVT

SEQ ID NO: 172797 - protein, 125 aa, Triticum aestivum
  Clone ID: PAT_TA_67215.pep
MGDQNPYHASIPHQAWHLHLPHSTPSPPPAATAARQAWRRATSTSTITLRFPSIHHPTRQHTPRLHSTLARPTRRGAWCPARPSPRCCCSSHVPDAALLAPNLAVALNLNLLLLLLSISLLLSSP

SEQ ID NO: 172798 - protein, 102 aa, Triticum aestivum
  unsure (1)..(102): unsure at all Xaa locations
  Clone ID: PAT_TA_67216.pep
VLCVAHLLRTLQWEFTGKTSYKXSYCQRKGLTPHRADPHVRQHRPPAAGRTRRCRQRAERVDERLRGLVAVQSVIYNVSRRVLGNKAAPLSRITYLILTTLC

SEQ ID NO: 172799 - protein, 68 aa, Triticum aestivum
  Clone ID: PAT_TA_67217.pep
RSFFTMIEHAFIRHNHYSENVHDVRTRRHGTMIFHTSTFYNTSYKLNTHISSFVYLRRLSLFWLQAHR

SEQ ID NO: 172800 - protein, 47 aa, Triticum aestivum
  Clone ID: PAT_TA_67218.pep
AHQSSDPCLGQQPVIAEHDNTRWITAASLSLFYLSLRPIWQISRLEV

SEQ ID NO: 172801 - protein, 85 aa, Triticum aestivum
  Clone ID: PAT_TA_67219.pep
SRSTGRRTGSRTRPRTSRRGRPPRRPPRGAPPPAAARTAAPSASPWRRKQEKLEPFSRPCSLAARVSSFFLLLLSFLVCSARLGL

SEQ ID NO: 172802 - protein, 169 aa, Triticum aestivum
  Clone ID: PAT_TA_67220.pep
MISAYSLEDNELWKRHIVTLVSQVTVALYVFCRWWSGEKTQLAAGVVLFIFGVLRFAQKPWALRIASFNSLQSSTVPLRRGQREYTPTEYVEAAKRCVLDTKVNIEYKYNMDCMFVDQSAPYSVRIEGLTSFLKLKDKHAYSELQKGISNTYDGMYTRVRSVVTGLGIS

SEQ ID NO: 172803 - protein, 116 aa, Triticum aestivum
  Clone ID: PAT_TA_67221.pep
MPRRLVAVHDRHLLVREDEIVRAGAGASDALPHAPHSLGAVLRLVRLHAGRPQHRSRHNPVDLLVLHQEHPDPPPIHSPCVCVCVCVCVCVCVCVCVCVCVCVCVCVCACVRTVTH

SEQ ID NO: 172804 - protein, 148 aa, Triticum aestivum
  Clone ID: PAT_TA_67222.pep
MVGITVPMSMDKVPLVKCANAAAVPTVDLSAAGAAAAVEQACRSVGIFRAINHGVPTALADALEAGAAAFFALPHKSKLEASATPLGYGSKSIGRNGDVGWLEYILLSVGSGSVAAASLPPPLGAALEEYTDAVREVGARVLELMAEG

SEQ ID NO: 172805 - protein, 148 aa, Triticum aestivum
  Clone ID: PAT_TA_67223.pep
RGSCVRRTLSHGTTTAAYYATIDVAATNLLADLCLEIGQRALVGRVCMDNPDMCPSYYRDESVEEGLEKTRQTIQHVQKIDPGFNLVSPVLTPRFAPTCSSESMKGLAKIQKELDLPVQTHVSENEGEIELVAELFPESESYTQLYDE

SEQ ID NO: 172806 - protein, 129 aa, Triticum aestivum
  Clone ID: PAT_TA_67224.pep
AQMCVFLLLNFRISTLFSFQASLATIFEKNSLLSNDFFFSVVFLKFMNELIDVIYCLLSRLCKICYHVTCTHASVIKLIIFILSQGCSVHLSLFMFSSEEGYIPNYAEIIKGVKLLLISDWDYEIIKGH

SEQ ID NO: 172807 - protein, 51 aa, Triticum aestivum
  Clone ID: PAT_TA_67225.pep
RRFLKRAEQTQHDTLISDQDHRRADHPSSAADGFVSPQGDRGRSGGGGGRG

SEQ ID NO: 172808 - protein, 182 aa, Triticum aestivum
  Clone ID: PAT_TA_67226.pep
DIRYLKTELAIIAAKIDDQHKGQQPSVLQNISTADMRDLAFDIEDCLDQFLPCAACKRGAVSKGDLVDFAIQVGKLKKRLERAKQQRTDNGANGNQQAIDLADQLLAILAEPADQVGIEEPKQEILGLLGSEKLLVISIVGFGGSGKTQLARAVFDCDEAKEKFRARAWHTASEHKDGLELL

SEQ ID NO: 172809 - protein, 95 aa, Triticum aestivum
  Clone ID: PAT_TA_67227.pep
RPNLVSGHNLFLSKVPGHVPRHGHLCAKIRLLAQGPAPSPPALDCHRRCASTSSSWISLMKAEPNFPGQWAGQHETGSRLEDHEEPAVEAEVEEK

SEQ ID NO: 172810 - protein, 119 aa, Triticum aestivum
  Clone ID: PAT_TA_67228.pep
MAGDDARTGAVAPAEEEPHVERLPADILAHVLSLLPSFHDLSMAGAVSRRWRRAVGRSLATRRRLSLAGQRTGDESTARLVRAAVNLRDLDMYVSRSVNRSPEQSWPIKHSIPAPHPQL

SEQ ID NO: 172811 - protein, 160 aa, Triticum aestivum
  Clone ID: PAT_TA_67229.pep
MDPPLWVEQLMHSYLPASPVSATGSLSASTSTSDQDGGGEDRISALPNDLLCNVVSRLPVKDAARTGALSQRWRGLWRAAPLVLDDAHLLPDAAAAFRVLASHPGPFRSVRLVHNLIDESNKDALLAEWLRLLADKGVEDLILANDPCSRGAMPVQLPPS

SEQ ID NO: 172812 - protein, 139 aa, Triticum aestivum
  Clone ID: PAT_TA_67230.pep
GEGEAGLCPWRGRDSKQGEAVLLDPRIDEMGTAGGGRRRGTTGWARGGAWFQIRLGEVRIGSPSWGGTSYKAMAAPVACWSPAGVGNAGPAREVYRVEVVELGRGSAHGLLVFYWSCSPRDDGKGGARRGRGERDEVEV

SEQ ID NO: 172813 - protein, 180 aa, Triticum aestivum
  Clone ID: PAT_TA_67231.pep
PDFIKNMITGTSQADCAVLIIDSTTGGFEAGISKDGQTREHALLGFTLGVKQMICCCNKMDATTPKYSKARYEEIVKEVSSYLKKVGYNPEKVPFVPISGFEGDNMIERSTNLDWYKGPTLLEALDQINEPKMPSDKPLRLPLQDVYKIGGIGTVPVGRVETGVIKPGMVVTFGPSGLTT

SEQ ID NO: 172814 - protein, 154 aa, Triticum aestivum
  Clone ID: PAT_TA_67232.pep
NIYMAQNQLTRVPGAIFDLTYLTILSLRHNKLTELPPGIGKLQHLKELNVSQNRLRHLPVELLDLFVSNSKLDTLVVHPNPFWQPKRALEQTEEKSDNVLFSHTESEPSSVPHLVSRLLGRSPSQLSDTTGRVVSDFRFPTDHRKLVLPVDEGE

SEQ ID NO: 172815 - protein, 93 aa, Triticum aestivum
  Clone ID: PAT_TA_67233.pep
ITHDDPQYLEHQPQPGQQPATQDTDRASAKIAPSDQSIAESETSAKASGNLLLPSFSSTYRMKDNPSIVKQLTQFLLRTQQTPPNHVFRADKP

SEQ ID NO: 172816 - protein, 56 aa, Triticum aestivum
  Clone ID: PAT_TA_67234.pep
PWSGMEGVRRVLSRGGAGGMVVCSWLCGSWEGHRLLGYDGEVLLRRRSGQLGCCGP

SEQ ID NO: 172817 - protein, 92 aa, Triticum aestivum
  unsure (1)..(92): unsure at all Xaa locations
  Clone ID: PAT_TA_67235.pep
AVEQSLRLCGRPRAGKAGPAPSSHALPADQGPAGEVLTAKAEEKGRTTVGGRSSEAFRCRXGGVDLQLGSLLVVLEISRMWGIWFHECVLLL

SEQ ID NO: 172818 - protein, 124 aa, Triticum aestivum
  Clone ID: PAT_TA_67236.pep
KKSVETYKIYIFKVLKQVHPDIGVSSKAMSIMNSFINDIFEKLAGESAKLARYNKKPTITSREIQTSVRLVLPGELAKHAVSEGTKAVTKFTSSAMLFCNSQLFRPCLPVTCVGSVGTPCFITS

SEQ ID NO: 172819 - protein, 208 aa, Triticum aestivum
  Clone ID: PAT_TA_67237.pep
IAISTTICPVTEQQTKPQATGPEPTGPEPTGPEPTGPKPTEPKPTEPKPTEPHATGPHPTEPAKTTGYTTSTVYTTSVRTVTTCAPGTPDCPEGPHVVTETIAISTTVCPVTEEQSAPTKPSEPEQPQQPEQPGQPEQPAPTKPAGGNEPHYPVPTQHIVTTGYSTSTIYTTAIRTVTACAPGTPDCPDSPHVVTETIALSTTICPVT

SEQ ID NO: 172820 - protein, 57 aa, Triticum aestivum
  Clone ID: PAT_TA_67238.pep
RCGRQGPTASRRVPGSDLDVPRGVVMGVIGPSGSGKSTLLRALNRLWEPAPGAVTLD

SEQ ID NO: 172821 - protein, 124 aa, Triticum aestivum
  Clone ID: PAT_TA_67239.pep
QLRRVHACDPIYPEDLPDRRFAYGLAVGVAGEVLPETLERMIRLCRAVLVDAQALIRAFDAEDDGSGAAVCHVALEDTPYARLLQRVAFLKASSEEAPYVGVETARRRCCVIVTEGKDGCRLYW

SEQ ID NO: 172822 - protein, 163 aa, Triticum aestivum
  Clone ID: PAT_TA_67240.pep
AAIVSFLLPLVAAKPAQKGKTFSNVEIFDPPTNYRDPQVLYARPLELSDGTLLGTWENYSPEPPDVWFPIVKSKDGGKTWKEISKVKDTHNNWGLRYQPQLYELPRAFGKYPKGTVLCSGSSIPSDLSETLIEVYASRDKGYTWEFVSHVALGGEALPNPGLT

SEQ ID NO: 172823 - protein, 120 aa, Triticum aestivum
  Clone ID: PAT_TA_67241.pep
AAFQPRLSHSHPQPHAHGHQRCDSEAISRSGRQPRCGEVAGGTAAGCAAVCCCFPCVMVEVVVLAAGRAPAALCRRAVRARRRRRSASAGQAVDMYELLVDDGTVAGPGDAAVVWPAGQP

SEQ ID NO: 172824 - protein, 142 aa, Triticum aestivum
  Clone ID: PAT_TA_67242.pep
MAKRPRRSYSLESRVRRVILSDAGLAVPGSSADDVARAIRSRHREYQRYKLELFASVVRRAISSLPPAGDACSDSASPPSRRCRSHDTTSSSTTLSPPSPAFDVTKSLLRSSYSSQKSKRDPDANQQLEMEVTAEKVMMPDA

SEQ ID NO: 172825 - protein, 51 aa, Triticum aestivum
  Clone ID: PAT_TA_67243.pep
IPSSSSSNGRPIPSMRSCSPPGSCSVARFRKSYLVHMSCYWQWTNYLCREL

SEQ ID NO: 172826 - protein, 139 aa, Triticum aestivum
  unsure (1)..(139): unsure at all Xaa locations
  Clone ID: PAT_TA_67244.pep
MAVVEPVPGGDVKLFNRWTFEDVQVTDISLNDYLAVTSMKHYSFLPHXAGRGAAKRFRKAQCPIIERVTNSLMMHGRNNGKKIMAVRIIKHTMEIIHLLTDANPIQIIVDAIINSGPREDATRIGSAGVVRRQAADISP

SEQ ID NO: 172827 - protein, 146 aa, Triticum aestivum
  Clone ID: PAT_TA_67245.pep
LLATTALLLAGGAAGKAGPPAGGHGTGALPPLPPAAAPLRRARGAVALVGGEAQDQESQGAGARPPVPPAGAPLPRSRGTGALPPLPPAAAPLRRAHGALALVLPEFKGQEIQCAGARPPLPPAGAPLPRSRGTGALPSLPPAAAP

SEQ ID NO: 172828 - protein, 161 aa, Triticum aestivum
  unsure (1)..(161): unsure at all Xaa locations
  Clone ID: PAT_TA_67246.pep
NNVTGGVIAHWKXAAEMVLANCSMYVNTDRAARELGVEXQRRNLEKVINDMAVGSLRCIGFAYKQVNSTTEQSKIDDDGLTLLGFLGLKDPCRPEVKAAIEACTKAGVAVKMVTGDNILTASAIAKECGMISSNDPSGIVIEGHEFRAMSPEHQLDIVDRI

SEQ ID NO: 172829 - protein, 121 aa, Triticum aestivum
  Clone ID: PAT_TA_67247.pep
MEEDLVLANYVAANGEGAWNSLARAAGLNRTGKSCRLRWLNYLRPDVRRGNITPEEHLLIVELQARWGNRWSKIARHLPGRTDNEIKNFWRTKIQKKRSGGATASDSTGCQLPSSTAVTES

SEQ ID NO: 172830 - protein, 150 aa, Triticum aestivum
  Clone ID: PAT_TA_67248.pep
KVIQEADQRKTDLARSSIAPCDVYDGRWVFDESYPLYASNLCPFVDQGFSCEANGRTEQKCTKWRWQPRHCNIPRFDARKMLEMLRGKRLVFAGDSLNRNQWESMMCLLREAVSDPARIHETRGRKITKERGDYNFKFLDYNCTVEYHVT

SEQ ID NO: 172831 - protein, 116 aa, Triticum aestivum
  Clone ID: PAT_TA_67249.pep
LPRSGHANFEETGPARRFCHQVQDQLPIKFDCRPEAEVEGDPIEARRERKHLQFWPDTRDVLEFCSSQQHQDSVAKACITHDWCYGVGNFTNNEKSGSLMNGPRPLKELRLKNTKL

SEQ ID NO: 172832 - protein, 151 aa, Triticum aestivum
  Clone ID: PAT_TA_67250.pep
PVSTPRPPPPVVAAPATSRRGRRLSSSRGHRAQIQPRPPPPRPTAAAALRANDPFPRCCATGPLRHELQRRHIPPLLVIPSSVSSTSPEPRPAGDARRGGGARKTGRSGHGVDRSGGWCGGLFQCQRRPAHPENEREGPEGERKQRKKEEG

SEQ ID NO: 172833 - protein, 76 aa, Triticum aestivum
  unsure (1)..(76): unsure at all Xaa locations
  Clone ID: PAT_TA_67251.pep
GFMTLGGSIILMLTTIIFLTRIQWLSVACGFDHFKLLQSILFCSLLTVMPFSSTRNSSLLEYFICXYQSKAGEEAX

SEQ ID NO: 172834 - protein, 87 aa, Triticum aestivum
  Clone ID: PAT_TA_67252.pep
ENSPRVVGAAAVAFRSACLNRRPQTPADAVATLPLDQLANQPVAAVFNQSPQSPTTSGRHQHHAPATTHLLPCSSTTMSAIHLMHQP

SEQ ID NO: 172835 - protein, 179 aa, Triticum aestivum
  Clone ID: PAT_TA_67253.pep
MVIKLGRLSSLHAGNLHKALEVLEESETGRSQDMPSARPDLLQSDSSVEKDKSSSGSREGVSQDLVIDTDGSLQDECWISPPEHSYTSSSGCTTLLTQLTSSENLEKIDALLDSGPGIEGPAANSQQASDGRTDSESDSSSNKQAFSNNVTQASNIHVAETSFAEEGRIETEDNTGAFK

SEQ ID NO: 172836 - protein, 165 aa, Triticum aestivum
  Clone ID: PAT_TA_67254.pep
VAGSAQGGYLKDLSAPSGFKYVEGSRPWKLVERVDVALPSATQNELDEEDAKALVAAGCGFVAEGANMPCTLEAINVFEAARKEKGSKGVWYGPGKAANCGGVAVSGLEMAQNSARLQWTEEEVDAKLKNIMQTAFKTCYETAQEFAGEGELPSLVSGANIAGFL

SEQ ID NO: 172837 - protein, 125 aa, Triticum aestivum
  Clone ID: PAT_TA_67255.pep
MRYGGISPNGITFNTLIRCMCNQRMYGRAITFWKEQLRIGWPPYVMTSTLLVDLVCKNCGPKRAMEVLNELALEGCQPDVVTYNALISASCKAGRLKYAKTILTRLIAEGLEPNSTTYCILLHSL

SEQ ID NO: 172838 - protein, 97 aa, Triticum aestivum
  Clone ID: PAT_TA_67256.pep
FVLTNLPMWGAIIYGGWKGHEDESMGEDHHDLCYLALTEPHPLGEDDNLDHLSLEQAHDLALEPGDDYSQGPLAVAPVVQSRMMVVSTEFQLVVGQE

SEQ ID NO: 172839 - protein, 131 aa, Triticum aestivum
  Clone ID: PAT_TA_67257.pep
GCFPALSVLVIVGYEECVMQFPSSSSLQKLTFSCFRGLVLVPEEKENGGGIQEDNSLLQSLTIVGCGKLFSRWPMGMGESETICPFPASLKKLDVFQEPSMKSMALLSNLTSLTTLQLNYCSNLTVDGFNP

SEQ ID NO: 172840 - protein, 92 aa, Triticum aestivum
  Clone ID: PAT_TA_67258.pep
RRRRCRRGRCRRTPRASPAPSSRPEPPPPPGSRRTRRAEAGGARPPPRAEMTADVGRWRPSCLAIPPLSRPSLSLSQADSRSILIYPWSRLP

SEQ ID NO: 172841 - protein, 49 aa, Triticum aestivum
  unsure (1)..(49): unsure at all Xaa locations
  Clone ID: PAT_TA_67259.pep
GGREMEEEAWLDRHGFXQPQSLLLIVTITLMGSRSRQNDIVVASPPLFF

SEQ ID NO: 172842 - protein, 168 aa, Triticum aestivum
  Clone ID: PAT_TA_67260.pep
VSTARTPIGSFLGSLSSQTAVQLGSVAIKGAVERAGIKPEDVDEVFFGNVLSAGVGQGPARQCALGAGLPQTVIATTVNKVCASSLKAIILGAQNIMLGTSDIVVAGGTESMSNTPHYLPNLRNGAKYGDQTLVDGVLKDGLTDSFQKDHMGISAELCVDDHHLTPEA

SEQ ID NO: 172843 - protein, 160 aa, Triticum aestivum
  Clone ID: PAT_TA_67261.pep
RLLSPASFFHLRPPPRPGQRGGAPPSTSTTRHHSPPPAPSIHRSRTTSPSPASTIIDPSLHHLQPPPYLARPTRQRGAQVSGHPREGAPVLLFSFSCALLLASSPESTLLLLFPYLCYCSCFFFFPTNLLLLRQHDLLLLLLALLVAAFPLNPLLNCCCS

SEQ ID NO: 172844 - protein, 139 aa, Triticum aestivum
  Clone ID: PAT_TA_67262.pep
MSSESTFKRFVEVGRVVFLNDGPNAGKLATIVEIIDHNRALIDGPSTGVPRQAFTYRRLVLTPYVLKKLPRAAGSTTVKKVWEASEVEAKWAKSAWNQKRVAAEKRRNTTDFERFEVMVLKKQRRRLVQAAAAKAAKSA

SEQ ID NO: 172845 - protein, 146 aa, Triticum aestivum
  Clone ID: PAT_TA_67263.pep
MAGRKGGDRKKAVTRSVKAGLHFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKKAAKSPKKNVAANE

SEQ ID NO: 172846 - protein, 173 aa, Triticum aestivum
  Clone ID: PAT_TA_67264.pep
MAAPNLPLFLPVAFLLLAAAPAPSAAEKFVVGGKKNWAANVNYTTWPDQYHFHVGDWLQFNYARDMYDVVQVADAAAYDKCDASKPLVKYDRGRGFVFQLNHTGRYYFICSRGYCWSGMKVTVLVEESPAQPPHAAAPSPNAAARHGVVAWAVAAAAASLCAAVLGLPFAVWL

SEQ ID NO: 172847 - protein, 61 aa, Triticum aestivum
  Clone ID: PAT_TA_67265.pep
RQKARTHARTTNTAPLLLSLRPTHSHNSIYHQSVTRVRRRRLLSSTYLRAGRRHGEVPVLR

SEQ ID NO: 172848 - protein, 155 aa, Triticum aestivum
  Clone ID: PAT_TA_67266.pep
GSPTPPLPPHQLHRRAPMLPTRAQPPYPAALPAGPLPSPGSLLCLDRPAHRHNRPARRHNRPAQARIARSVRACDDLLDALLFCGPRSLLAPSVSCSSRPPRTPFPSARSDRLPSRPCGLSMICCMNMVACSSRTVHLPPSLSLPLLSLCHDFFI

SEQ ID NO: 172849 - protein, 64 aa, Triticum aestivum
  Clone ID: PAT_TA_67267.pep
TTTTSNRNLGCAKDIVVLSLVLSVAALAEAEVDKTTDNNQTSNTDTSTDTSLGASRKALIVRAL

SEQ ID NO: 172850 - protein, 97 aa, Triticum aestivum
  unsure (1)..(97): unsure at all Xaa locations
  Clone ID: PAT_TA_67268.pep
TRFSSRRGLEKAAASIKEEGEGAAAASESRTWGAWPCRCMSAGARPWPAPWCSDGDDGADXDXGXDGPSSPNPHPRPPPHAMTSCTPWAAPARPRRS

SEQ ID NO: 172851 - protein, 64 aa, Triticum aestivum
  Clone ID: PAT_TA_67269.pep
VIPLLNLIWDPPTDMIDYDNYCMDWTVVQPIVLTRLSPRTPKTQERIMVKYSVVHSTGQGFRET

SEQ ID NO: 172852 - protein, 146 aa, Triticum aestivum
  unsure (1)..(146): unsure at all Xaa locations
  Clone ID: PAT_TA_67270.pep
FVKQQQQQQLRLGGNGHQHRRRQLRVGGNGHQHRRRAGAAHADAAVRRRVQEMPLCEAEWAVPERADGVRRCAPVHREEEGAAADGGRVVGRQPQXRPHAHRQAPHVPPVRVGPVPRRQPPPRGRDLLLPSPPRGRRRRPPCAQGG

SEQ ID NO: 172853 - protein, 113 aa, Triticum aestivum
  unsure (1)..(113): unsure at all Xaa locations
  Clone ID: PAT_TA_67271.pep
AREQNGDGVRGRRRHGRRGGGEGEGAEDDEPHAARQDAQRRRGQQPLQGARHRRRVLLQQLRXTRHQDHADPMSTLRPLLCFAAFGVTAVMACLGSGERCGCLEREGGCLVPN

SEQ ID NO: 172854 - protein, 149 aa, Triticum aestivum
  unsure (1)..(149): unsure at all Xaa locations
  Clone ID: PAT_TA_67272.pep
PRAAGRLLSGEAAAGRGGGGGASARLFGSKRSMHSTSSLPDLSQMPGGAGPXPFPAASAPPPYQAPECLKSLRPNAKWDVYSFGMVLLELLSGRVYSEVELCQWHAGAVDVQRGRVLRMADPTLRGEAADAGGEDALLGCFRLAFACCA

SEQ ID NO: 172855 - protein, 126 aa, Triticum aestivum
  Clone ID: PAT_TA_67273.pep
MARSWLAGLRSRLGGGARQDGLGILAFEAAAAMSRLVSLHLSLSDAEVRRLRADVLRAEGVARLTSTDQSRLLRLACAELMAGLDRAADDAARLGARCRGLPDAPFLHDFDRVYADAKRGAGLARL

SEQ ID NO: 172856 - protein, 146 aa, Triticum aestivum
  unsure (1)..(146): unsure at all Xaa locations
  Clone ID: PAT_TA_67274.pep
IVQLERHLDRQQTVHGALKKALGPNSXSVTLFNERAILKPTNQLIREVATLELEIKHLEXYLITLYMKAFEEAPTLSSRSAVLEETPKAKATVERGSDAMLHCSCLPLARGGMAHGGFLSVQMPNEGSMVMNQSSCDIKGWRVHLM

SEQ ID NO: 172857 - protein, 59 aa, Triticum aestivum
  Clone ID: PAT_TA_67275.pep
MNMHKSPPLWPGLRQLVGTMLEIDSPSTRLTAPMIDSPIPAGLQRRARLICLLPRPTHS

SEQ ID NO: 172858 - protein, 58 aa, Triticum aestivum
  Clone ID: PAT_TA_67276.pep
SIYWQKTNWFDQRQGINIQKTNCRRQPSSSTPLWLTLARSGSKPTTRYCNWGAEDGGE

SEQ ID NO: 172859 - protein, 142 aa, Triticum aestivum
  Clone ID: PAT_TA_67277.pep
RHTLQTYVVSLLPFLLSLSLMRSNRGLEAHNPPPPPSFAGQSSLVRHRSDLLRRRTNRRRSSTPTPGLAAPLEHRRVPPPPNSAITVGTAPADELAGAHTPPATNLDEEAGGEGSTYASRVATGIVFLPFSPLKQSCRCQSS

SEQ ID NO: 172860 - protein, 59 aa, Triticum aestivum
  Clone ID: PAT_TA_67278.pep
YEHYSGRLGSGFWSGYRKEEASGGAGESRGVEREQRSSRHADGWRDSMPCIGWDASRAL

SEQ ID NO: 172861 - protein, 222 aa, Triticum aestivum
  Clone ID: PAT_TA_67279.pep
RPPPLCAVPWPPAPSTSSTPPPVPCVSSPSSSFTTARPRTLVSPRTGPSSSSTGPPPATSSGSAASPTAPVSSCCPERSAACREFRLLCSHEEQRRSSPAVSPLSSPYSTACSSPLLASPPPPPFHHGELLSESFPLTLRSSTGEEAMSPPHDLLPPPPPPLFHRGELLSESFPLTLRSSTAEETTSPPHDLLPPPPPPWLPLAPAGTWDEFLFIPPTPMMT

SEQ ID NO: 172862 - protein, 105 aa, Triticum aestivum
  Clone ID: PAT_TA_67280.pep
PLHSTSKMSAMTFYIFASLMGLWTGTAMALEGDIFKLAFYSSGHFAGAGEEYRGGTGAKQPCPYRLRCPGRSLSGHGLRDVHGHVLVRRRGPSLRRELLLGLRPV

SEQ ID NO: 172863 - protein, 150 aa, Triticum aestivum
  unsure (1)..(150): unsure at all Xaa locations
  Clone ID: PAT_TA_67281.pep
RNLHSSASTHSQTLSPEPEQASKQARWTASRRKKVAANKFGGPRNNSVTKSIKAGLHFPVGRIGRYLKNGRYAQRVGSGAPVYLAAVLXYLSAEVLELAGNAANDNKKTRIVPRHLLLAIRNDQELWRLLSGVTIAHGGVIPNINPVLLP

SEQ ID NO: 172864 - protein, 85 aa, Triticum aestivum
  Clone ID: PAT_TA_67282.pep
FLPSPRARAEALRRGGPRRPCTTPCPSPFQEPAPARSPSTPPPPSQPPGARARSRPARRGSGSRPPAAATTPRATTTTSGASRRA

SEQ ID NO: 172865 - protein, 130 aa, Triticum aestivum
  Clone ID: PAT_TA_67283.pep
RPRPICALQHLGVLNGGGGRCWRRGALCRRRKKSAALGSGSEEAGSRDMERMMPVRACGCCAEQARTACCARELLPLAGRTRSRTRLLLLAALNSQRAALQWLLKNNWIHAQKLFDEMPRSKRDVKKMIV

SEQ ID NO: 172866 - protein, 66 aa, Triticum aestivum
  Clone ID: PAT_TA_67284.pep
IRHEAHRFPVPHPESEIEGKASRAMSKLEARSTILLYAMPSSFLRRKKPMFQIWIVRQEDFRSTES

SEQ ID NO: 172867 - protein, 224 aa, Triticum aestivum
  Clone ID: PAT_TA_67285.pep
VLNYHGSSYLSHQMIYRKGKLQNFVDSAERAYRKFVRVKLSVFDQNVRSSLNRCGLCGVQASSFELYRNKFVEAKKSDLTDPEVVEAQKDCPGAIVFFKTRYAAIVASQVLQSSNPMLWVTNLAPEPRDVYWSNLWIPYRQIWLRKIATLAASVFFMFVFIVPVAFVQSMMQLEQLKQMFPNLRGALKTSFCVRVVTGYLPSVVLLLSLYTVPPLMMRFSAIEG

SEQ ID NO: 172868 - protein, 50 aa, Triticum aestivum
  Clone ID: PAT_TA_67286.pep
GSLRRHSWRCAYVLTRKLHRALLKTMWLLAEEKCQLISELHEPRACYENW

SEQ ID NO: 172869 - protein, 91 aa, Triticum aestivum
  Clone ID: PAT_TA_67287.pep
HSDLLILKKTAVISKEEELSECMIGQRKGRYLGVLGTIACPFPLNADIGVFILFFTKIFRRILLLLFFLRSLLSCSGLIKLEFADQKKVAN

SEQ ID NO: 172870 - protein, 193 aa, Triticum aestivum
  Clone ID: PAT_TA_67288.pep
FGTRHNASISKALVVFGADAPGTRESPTNQIADMDRLVEDDSLGDNVDSFLSHDDAAGPSDARSRSMASSKGFTFREISSARASTNKVVCCHFSSDGNLLATGGHDKKVVLWNAETLKQKAVLEEHSLLITDVRFGPSIPRIATSSFDKTVRVWDVDNQDDTVHTFTGHSASVMSVDFHPNKDDLICSCDGNG

SEQ ID NO: 172871 - protein, 140 aa, Triticum aestivum
  Clone ID: PAT_TA_67289.pep
MGKIKIGINGFGRIGRLVARVALQSDDVELVAVNYPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNED

SEQ ID NO: 172872 - protein, 195 aa, Triticum aestivum
  Clone ID: PAT_TA_67290.pep
MATAGCAGRWAPLALALLLAAVVALALIPQAALAASGGVMGGRSYSSSEPDDSSSSNSYSFYDSSSHISIGAPSRRRAAKDDDDDDNSDVIFWMVFVGLVLLIAAVWYYYEYERQRTTVVKLQVALLGWAKPFQKELNEIAERVQASNKHSYKFMLTETICSLSRHRDCCVFSSLSVNVKNGADTWEAHFDKLSI

SEQ ID NO: 172873 - protein, 111 aa, Triticum aestivum
  Clone ID: PAT_TA_67291.pep
MSLIAGEEFQHILRVLNTNVDGNHKIMFALTSIKGVGRRFSNIVCKKADIDMNKRAGELSAEEMDRLMAVVHNPRQFKVPDWFLNRKKDYKDGRFSQVVSNAVDMKLRDDL

SEQ ID NO: 172874 - protein, 155 aa, Triticum aestivum
  Clone ID: PAT_TA_67292.pep
ARNGLEMKGSTAHCTKDNEDGDDHTRWRPRFPHGLFRGRVSVLMGQHTRTNARVLMHELMQQHTQGLKQRVSCGSTHVLMHAATRDGHGARRTWRRLVAIQNGEDGCFAEYYGRDSTWTAGSARSRLRSRVAAARGRKRRGSPGKDPGGGQGKEP

SEQ ID NO: 172875 - protein, 118 aa, Triticum aestivum
  Clone ID: PAT_TA_67293.pep
RLADLARSVRVRFSFRGVAANSLNEVHPWMLQITPGEAVAVNFVLQLHRLLADIADQAPIDAVLDCVASLQPKIFTVVEQEADHNKPGFLDRFTEALFYYSAVWLEGLDGAASSAQGT

SEQ ID NO: 172876 - protein, 102 aa, Triticum aestivum
  Clone ID: PAT_TA_67294.pep
FTARPSCADHEPLAGELQVLNERLNCTASKTTHHFFLLKAVEMVLNNTKPGRDSHGELHGVAVSTAYHVWAGTSPEYDEGGSVKSWPWFHTTSHAHGQREAL

SEQ ID NO: 172877 - protein, 62 aa, Triticum aestivum
  Clone ID: PAT_TA_67295.pep
RRHHPPRKGGCLAAAATADAAPAASAATAAAGARCSPTLRPPPAPPPWSCPPPPTRGTYRTR

SEQ ID NO: 172878 - protein, 146 aa, Triticum aestivum
  Clone ID: PAT_TA_67296.pep
TSAFGGSGYGPSGHVLLWSGWLLCSPRPWGHGPSGPSAGGASQGAHWRHPADSRARSWSRRVRQREWVCWWCLVEAGVVRESALCSWICKWEVAEAAATGRGGAGRLADRVDGGTWPMVRARVVAADALGAGSDQSCWILAACGRP

SEQ ID NO: 172879 - protein, 67 aa, Triticum aestivum
  Clone ID: PAT_TA_67297.pep
ALRGAQEANVSWEQLQDQAMHELCRRGCHLADGKVELRMPDASSEVQDQVVFMVFVMIVCLLFCRNA

SEQ ID NO: 172880 - protein, 141 aa, Triticum aestivum
  Clone ID: PAT_TA_67298.pep
PAVGTSSSAAWHMEHYSTAFGMTAPEEYVPHMVDQGHAHEGEQGSLLSPSWGDETPEAELFQEPRDGSIGHAGGDNYRVPLIPQEQAYGNHGSQEVQVAAASSCPAPTVSYPSGGGRMGLQDRGRDPTSPPRRSEQGVLRR

SEQ ID NO: 172881 - protein, 59 aa, Triticum aestivum
  Clone ID: PAT_TA_67299.pep
MPVISLELIYPLSYLRERVIGSSDEPEKPNADYCIKLHVGEVPGHTSVTDGLNKPLLNT

SEQ ID NO: 172882 - protein, 178 aa, Triticum aestivum
  Clone ID: PAT_TA_67300.pep
GAEQAATGKTFYHIAFEPWLKGPADVISSWLVHIKIVKNPEVPTFESLEDMIREIEQAAAVRLTSVDEGGAAQQSTTSPLDAILLGFYYSDHLHPPTLKSFPADIPVIATGPGAEIIKAWNHFSTIRVINNLDASATSWQTPDLHPGEPFPKWLTPIFLPGSSILNFVFAIIWSHTVD

SEQ ID NO: 172883 - protein, 42 aa, Triticum aestivum
  Clone ID: PAT_TA_67301.pep
VSSVEFWSAAAGRKKLRLSCIIFMIAHAECPCTPLEKKFRRP

SEQ ID NO: 172884 - protein, 57 aa, Triticum aestivum
  Clone ID: PAT_TA_67302.pep
MAYRLLEVTLQSARNLKNVNLMSRLEVYAVATISGDPMTRLCTPPDPYGGRHPTWNT

SEQ ID NO: 172885 - protein, 140 aa, Triticum aestivum
  Clone ID: PAT_TA_67303.pep
YSTSSAFDDYCASLVRAGESLNMSYLSPYMEALGSDFGDGANFAIAGSGTLPRDRPFALHVQVQQFTHFKQRSLQLIAHGEKAPVDAEGFRNALYLIDIGQNDLSAAFSIGLTYDHVVHHRIPSMLYEIQDAIVTLFYDG

SEQ ID NO: 172886 - protein, 64 aa, Triticum aestivum
  Clone ID: PAT_TA_67304.pep
AAKVEEVDEGELTISDLGPPCIGRSELHISNNISFNTTNYKECSAWQDISKGKHYINFRSDLSV

SEQ ID NO: 172887 - protein, 79 aa, Triticum aestivum
  Clone ID: PAT_TA_67305.pep
MGATTSVGDPSRLQCAHARSTLSSADAGGGRGVGTGGAISSGAAGGAGLGHMSSSGSGAVVRWAAAASAGDMARVGFSL

SEQ ID NO: 172888 - protein, 128 aa, Triticum aestivum
  Clone ID: PAT_TA_67306.pep
GSPVRDKRLGFRPPIPSPLRRRLPPPPSQPSPPASRLPPPASRIPSPPPSLAPPPAASFAAGTSTELPRQQIDAAGPVRPVSPPPSSSPASGSPPPRSVLPGLLPFALKALRVTSTEIVQLPEPTWRN

SEQ ID NO: 172889 - protein, 132 aa, Triticum aestivum
  Clone ID: PAT_TA_67307.pep
RGAGAARGSGRFAADYISLGIREPVYEVVEVKANGSVSTEKISRRQLLKSSGLRLRDTRSVDPSLWLMNSMPSLLVREQAILLNLGSLRAIAMHERVLIFNYNSPRGKVFLELLRPRLNPRNINGGPAMPFQ

SEQ ID NO: 172890 - protein, 69 aa, Triticum aestivum
  Clone ID: PAT_TA_67308.pep
QAGLCSYFSLLFIEHIRRLIDSLDPKCREARFIFLEVLYCSWCYFVMSNCVFFQLPFLMYELVYGGMGI

SEQ ID NO: 172891 - protein, 159 aa, Triticum aestivum
  Clone ID: PAT_TA_67309.pep
MAATTTMALSSPAIKLAGASYALGGGGRITMRKAAPKASASNSPWYGPDRVLYLGPLSGEPPSYLSGEFPGDYGWDTAGLSADPETFAKNRELEVIHCRWAMLGALGCVFPELLARNGVKFGEAVWFKAGSHIFSEGGLDYLGNPSLVHAQSILAIWAC

SEQ ID NO: 172892 - protein, 137 aa, Triticum aestivum
  unsure (1)..(137): unsure at all Xaa locations
  Clone ID: PAT_TA_67310.pep
KVHRPPGSSCCSSPLPQGTNPLRKLLLPDPPPTTPAPPPRCCCTSSFSRRPPPPPLPMRSSSLPAPXARSPSPPSSTAARPLSPAPPTSSPRSPARRRAWAVPEATAASNYSIRSSNLGSRPPGSLGRSHSPSAGGW

SEQ ID NO: 172893 - protein, 117 aa, Triticum aestivum
  Clone ID: PAT_TA_67311.pep
GAAAEHGDGPEVRQAELPRLRRRRRERLRRHGHRERARGRRRLGLGVVPCACTYASERGRVGWGIGCGLIGCGSRRERPPEGREGGRGVGILPEGREGGAEHGDLDRGERGELGRSP

SEQ ID NO: 172894 - protein, 82 aa, Triticum aestivum
  Clone ID: PAT_TA_67312.pep
LFSSAEVPSCLICMALGHCRTMLIDKFLLWETFPLCCLRWILHYAVFEFPPNSVAEAQMRRTSNFLVTLQSLVTVYSKKEFV

SEQ ID NO: 172895 - protein, 84 aa, Triticum aestivum
  Clone ID: PAT_TA_67313.pep
VAGVRGDHHSPTGLVTEFLMKQRVTTIMHELTIPRNAICKCLSFKVALVPFAYGPSIVLIAQWGMSFKIQYVLIKPNIPAVLVF

SEQ ID NO: 172896 - protein, 73 aa, Triticum aestivum
  Clone ID: PAT_TA_67314.pep
GYHSPARQKNAEARAGKGEKIPSAPPPNRAGQYKSTPRRLRPASNPSVLSADDTAGDSGRALHLEPVSGGGRG

SEQ ID NO: 172897 - protein, 65 aa, Triticum aestivum
  Clone ID: PAT_TA_67315.pep
MCGGAILSDIIPPPRRATGGNVWRADKKKRARADAAAGRPRRAPEEFEEEGDAEFEADFEGFVEA

SEQ ID NO: 172898 - protein, 91 aa, Triticum aestivum
  Clone ID: PAT_TA_67316.pep
IRHEESTEFLKGFLGVHRLIEAVKHMLAVRMDLGDPGFVNVAGNVSEMMSPEFADKIRRRIADNTTFPPAYYLAKWSQLRDNGTSHLCVVD

SEQ ID NO: 172899 - protein, 161 aa, Triticum aestivum
  Clone ID: PAT_TA_67317.pep
ELEPCAAEIVPQIIIVQGGQDVAMEVKSYGGNGWAVFIMSAEGAVSNVTLHQPASPLETVIHKGCFDIVSMTGSYLPSKTDGVSSLKGGFAISLVGADGRIFGGGLAGPLIAASPVQVVIGRFAAGEKEETKQDVASGTPGATEPSDSPSGSSSDPGSPSN

SEQ ID NO: 172900 - protein, 153 aa, Triticum aestivum
  unsure (1)..(153): unsure at all Xaa locations
  Clone ID: PAT_TA_67318.pep
MPPAMQAAEGAGQRRSGPRILMNAAQRALSRGASSSLGSPRSPPPSYGSIVTVLSIDGGGVRGIIPGTILAFLEEKLQELDGPEARISDYFDVIAGTSTGGLVTAMLXAPDDAGRPLFAAKDINQFYLDHCPNIFPQASKGPFGLMRSMMGPK

SEQ ID NO: 172901 - protein, 196 aa, Triticum aestivum
  Clone ID: PAT_TA_67319.pep
DQPLWNNERPEASIAGFAHTNDGIWNAETSSYEAGWEHANQGFAADDSQNPKSSVWGRIASKRKSGPGKTANTTSTSATGNQRSDYNDDMGPSTVQVKPASTKDTNGRPSSRMSADVGRQSNSRTSHKASRTLYVNGIPPESNRWEALLSHFEKFGQVIDIYVPANSEKAFIQFSKREEAEAALKAPDAVMGNRFI

SEQ ID NO: 172902 - protein, 158 aa, Triticum aestivum
  Clone ID: PAT_TA_67320.pep
CSTKSTPMAQIQDLQARSDELGLSNKTMLESLVSLESVRIAWESYALLRPLIKESWIWVCPQLKILSDVAGLSLEIQKLEHDVLPQLKLQEAKLETGALEALLLMKNSAVALLHLRKCFKEDLGVLFCEDHLVSAKVKRLSKMLKDKCFRSVNATLSG

SEQ ID NO: 172903 - protein, 132 aa, Triticum aestivum
  unsure (1)..(132): unsure at all Xaa locations
  Clone ID: PAT_TA_67321.pep
MGISRDSMHKRRATGGKQKAWRKKRKYELGRQPANTKLSSNKTVRRVRVRGGNVKWRALRLDTGNFSWGXEAVTRKTRLLDVVYNSSNNELVRTQTLVKNAIVQVDAAPFKQWYLTHYGVEIGRKKKAAAAA

SEQ ID NO: 172904 - protein, 127 aa, Triticum aestivum
  Clone ID: PAT_TA_67322.pep
GAARSPAKSVSVSSSSSSSPAAGKSRRSCMCSPTNHPGSFRCGLHKERRQAAPSGSSKPCSPPCVGSAGSKCTGSALVRVVPMESGHWARRALAPSPAAQQSLQRRRAGGSRPRPSRLSAVSVAGDR

SEQ ID NO: 172905 - protein, 72 aa, Triticum aestivum
  unsure (1)..(72): unsure at all Xaa locations
  Clone ID: PAT_TA_67323.pep
CQQRHTATAATLEKGEAADGAGTVAGFTVVMKFGGSSLSXAARIRDVADLILSFPREAPIVILSAMGKATNR

SEQ ID NO: 172906 - protein, 143 aa, Triticum aestivum
  unsure (1)..(143): unsure at all Xaa locations
  Clone ID: PAT_TA_67324.pep
IERSWSPWRLRDSNFAAEEERGHRPGVAVGDEESSSYKEMIMSLLDSTGLFNISDFVLARSWLGXMRQVHRQFDGLMTKLLAEHAATAEERAREEGRLDFVDRLRLVAWSRPRRGGQREPRAEDEARMSGAGSAEPLGACRSP

SEQ ID NO: 172907 - protein, 132 aa, Triticum aestivum
  Clone ID: PAT_TA_67325.pep
VLAFGAAATWPEAVVQCLLFVLAAGMLVALHSLPRRVAHRLRRGASGSSAAQSRRHFALGAQLLARARAAAAKPPGPLARAALAEADRAIALDPRDAAPLILKALALDLQGHRLPALRTLDVALAPPLARSL

SEQ ID NO: 172908 - protein, 77 aa, Triticum aestivum
  Clone ID: PAT_TA_67326.pep
FASLSANVTAKPPGSRRRLLAPPAHSGVPMPQQLSPSRAPPTMSAPSAAPQRFLSKPSRAATPPPLPKQPRPRRSLR

SEQ ID NO: 172909 - protein, 135 aa, Triticum aestivum
  Clone ID: PAT_TA_67327.pep
SSPPSTLEPVGRGTHSVASRTLASFLPTPERNYLLPPGARGAARGRAPCVPRNSSIPLSRPQIRRGSTRRCLSRHRRDALDRATGEPPRGHALDPLSSSLDSAFASNTYAQEVPPPHPRPATVTPRHDPPPRSSP

SEQ ID NO: 172910 - protein, 81 aa, Triticum aestivum
  Clone ID: PAT_TA_67328.pep
PKKTDPTTSTIVTTPTSLTHIVKNHGSPDTSTAGRRWKFVIYASIPRELLEQSPIVNPRVSGGPLQDEGLFLSYSSTSTSA

SEQ ID NO: 172911 - protein, 79 aa, Triticum aestivum
  Clone ID: PAT_TA_67329.pep
PRQCYAAGVILSTSLVHVLPDAYAALADCAVASRRPWKDFPFAGLLCLVGALLALLVDLSASSDLEAHGHHQPQQEEGQ

SEQ ID NO: 172912 - protein, 103 aa, Triticum aestivum
  Clone ID: PAT_TA_67330.pep
RPVPWTFLPSPAPMLASKHPPWTGMTTTRRRTRTRTHRTPTPSPRRRTSLGLTSCSTPRLHPTRPSQGTAQDIFSQWCSSWCLVLVERLCSMDRLLLELPNTL

SEQ ID NO: 172913 - protein, 166 aa, Triticum aestivum
  unsure (1)..(166): unsure at all Xaa locations
  Clone ID: PAT_TA_67331.pep
NNSGTXRPLNNQTVPVSTVHYNGVSEYNAHNLFGLFEARATHAALLKDTARRPFVLTRSTFPGAGRYAAHWTGDNSARWDELANSINTMLSFGLFGIPMVGADLCGFRGNTSQELCSRWIQLGAFYPFARAHTERTTERRELYVWESTAQSARKAFGTRYRMLPYI

SEQ ID NO: 172914 - protein, 99 aa, Triticum aestivum
  unsure (1)..(99): unsure at all Xaa locations
  Clone ID: PAT_TA_67332.pep
SSRPVVPSPPLVRPLCPAKLPSCPWWAPRPSISWRFFFPPPNCFYLFLGGASSTYIHIPSPXTAGLSIDGSPGLVLLTWRGLGRRYVAEREAGSGAYRP

SEQ ID NO: 172915 - protein, 107 aa, Triticum aestivum
  Clone ID: PAT_TA_67333.pep
MARNARAKRRAARRLRATPYPIPSYRWKAMKGANRKKALPTVQKMDWEDANCSVCMEYPHNAVLLLCSSHDKGCRPYMCGTSYRHSNCLDQFKKAYTKGALLEELPA

SEQ ID NO: 172916 - protein, 132 aa, Triticum aestivum
  Clone ID: PAT_TA_67334.pep
MLPFLHCFPLLVVGMERHARNVAQGAGRRGERRRVEAGGGALPAVEVPGPDHADAPLGHSEDLGGQALAVVGAASQVHVQLPHQLLDVAQLGHHKAASSIFIHALHRSALLIFLPLRKSLSQKRMAQRVCVC

SEQ ID NO: 172917 - protein, 75 aa, Triticum aestivum
  Clone ID: PAT_TA_67335.pep
IDLSELESLFSVSMPSTDAKRTRQRPPVASKQEKVHLIDLQRSKNCEIMLRNIKMPLPDLMASVLTLDDSIADGD

SEQ ID NO: 172918 - protein, 92 aa, Triticum aestivum
  Clone ID: PAT_TA_67336.pep
FSHSRFAKFLLWFSSCDALRPVFHLAKMTAVKREEADTTGDISGGQITHGKAGSIQKFKGKKIQLKPGKYILRGEPCIHYLDEFSRHIVGAT

SEQ ID NO: 172919 - protein, 77 aa, Triticum aestivum
  unsure (1)..(77): unsure at all Xaa locations
  Clone ID: PAT_TA_67337.pep
EAVDWISKFPVSNTSLESLMFDCVAVPFNFEALXALVARSPSVRRLRVNHYVSVEQLRRLMARAPQLTHLGTGAFRP

SEQ ID NO: 172920 - protein, 144 aa, Triticum aestivum
  Clone ID: PAT_TA_67338.pep
MMEREDRYVRFQDWRSEQSVNSENTVSPRRHSVFRSLKERTGGLFAFLGNLFHFKTLKRSMLEDWKSTQNVFHPQGPFLQRWNKIFVLSCIFAVSVDPLFLYIPVISDKNPCWYLDRKMKIIASVLRSFTDIFYVLHIIFQFRT

SEQ ID NO: 172921 - protein, 182 aa, Triticum aestivum
  unsure (1)..(182): unsure at all Xaa locations
  Clone ID: PAT_TA_67339.pep
NPLAVVTIPPPSQCPPLTQAQKQRIAREFNISETVFVHDVENHSESSERQIDIFTXGAELPFAGHPTIGTAVLLHPQGVKTMIAKAGKIDLEFDANGSASASIPHNVRLHSHRLTQPEYEAGSDGQIAQVAAAEHGAQLFSIVKGMTFALIELPSLDLLGAAKIGAMAYISGDLQDEGWKHD

SEQ ID NO: 172922 - protein, 61 aa, Triticum aestivum
  unsure (1)..(61): unsure at all Xaa locations
  Clone ID: PAT_TA_67340.pep
SRNLNGSTSPRVRFISPTRGEXFSPPVLLNPTLPSLNENDSVEFEIITGTTDAPSQRRHRT

SEQ ID NO: 172923 - protein, 160 aa, Triticum aestivum
  Clone ID: PAT_TA_67341.pep
PPCSLGARHPLAMRPPAPVDDAMRAVFTRLPADDPRSLVRAAAVCRSWRAILSDPGFAHGYRALHGAPPMLGFLHNEYRMGNRFVPTSTFRRRASQDRPDCVLDSRHGLVLLYAPAYDPPLEARDLFTGDWWDIDDDPKCRDIMHWPGDGPDDFFTGTGM

SEQ ID NO: 172924 - protein, 127 aa, Triticum aestivum
  Clone ID: PAT_TA_67342.pep
VPGDSNRCPGECNIVRLRSNPTVGTGVNAQTRSPGAVQWAAAALVSAIVSRSRTCIQWKSEGVLHRCASLDASCQSQSKGPRRYSLDLVTFWDACRRPFSQTGKQLGIWRRCGGALPSFFVCLLGLV

SEQ ID NO: 172925 - protein, 140 aa, Triticum aestivum
  unsure (1)..(140): unsure at all Xaa locations
  Clone ID: PAT_TA_67343.pep
MEKSEAEIQVLPKGDNVDGKEKKKKGKRIRRSKLKKDRLITRAAQRNMFGSALKDEFPVLKDGSKPKVLITACQYIMDKQGPSSSFIHELMQLIPDACYIHRTNVCLDEVVEYANERKFTSLIXALSDGLKIINLPDGPL

SEQ ID NO: 172926 - protein, 150 aa, Triticum aestivum
  unsure (1)..(150): unsure at all Xaa locations
  Clone ID: PAT_TA_67344.pep
SARGASDAAPGAGGSRGSDDDDGRSARKKLRLSKEQAAFLEESFKEHSTLNPRQKVALAKQLNLRPRQVEVWFQNRRAXTKLKQTEVDCEYLKRCCETLTEENRRLQKXLAELRALKTVHPFYMHLPATTLSMCPSCERVASNSAPASAA

SEQ ID NO: 172927 - protein, 35 aa, Triticum aestivum
  Clone ID: PAT_TA_67345.pep
ARRNRCGAGVLPYELMAPSSGPGITCRGVPNSVTI

SEQ ID NO: 172928 - protein, 190 aa, Triticum aestivum
  unsure (1)..(190): unsure at all Xaa locations
  Clone ID: PAT_TA_67346.pep
VSPARSTATTVIPAYPSTLRPMTIKQLYDGFLEDIERYPIVVDGDTVSSVILIGTVSHSTVRMNHWSFDLQDATGSETTSDFKLAWSSSNGDYVQLFGKPAMNDRFLQIKSFKIRLIENYNDTTHHYLYTIHTTLDIRKRNTHKARMEPDSTASTVFXKGPSITPSEVPLHSSTKDKIVAILRDPSYRDI

SEQ ID NO: 172929 - protein, 58 aa, Triticum aestivum
  Clone ID: PAT_TA_67347.pep
RFHLIVGTTKTLIIRGTNKYYFVCLDDAFRNVSCIEIMNPLLCSIICAIPCYSGWKYV

SEQ ID NO: 172930 - protein, 108 aa, Triticum aestivum
  Clone ID: PAT_TA_67348.pep
MSPPVPEQKPQLQQSQQQQQTPPGESASGSASNDSKSVTPAPSSSSNTSQSSGAASTSNDDNLICRWNACNQKFPAPEALYEHICERHVGRKSTNNLNLTCQWNSCRT

SEQ ID NO: 172931 - protein, 89 aa, Triticum aestivum
  Clone ID: PAT_TA_67349.pep
LLPFVLCPKYITFTSGMAYYCVTACIERLNAKVIPDGPREVQACLEITELWDLKRLECEIVGFSPYLLLLLAPGSSNARIAICICICGH

SEQ ID NO: 172932 - protein, 154 aa, Triticum aestivum
  Clone ID: PAT_TA_67350.pep
CVFAPKDPSDENGHHNPGFAVDAHRAEGSRRPSFFSEEPLLNSPAHSTEDKPNETNPTGGDSAPSGQKFMNTEGSCRWSQPLPAASATTDISCATTLNSLQGKGSRSLNSSRRTRKGKGQSATPAVAPPTEKKSRGGSIVSRLNSTVERIEAWR

SEQ ID NO: 172933 - protein, 70 aa, Triticum aestivum
  Clone ID: PAT_TA_67351.pep
ASLDGGLPWKLLNLQWSRFPVSMKFLRLAVRLLVVTMLFCQAFPSSCRNNIKVDDVKYESTKLCTLLLWL

SEQ ID NO: 172934 - protein, 135 aa, Triticum aestivum
  Clone ID: PAT_TA_67352.pep
TTPPSPPSISAVPPSTSTMHHQHHSRSTSRNSPDRGSAVSDPSRARCWCLLLQPAASSSSPPLLLLLLFLRSCCCSSEPLVPLLLIFSNLLLLCLLYLLAPLLLLLPRAPTCCCSFPTESATAPLSKASFADSLL

SEQ ID NO: 172935 - protein, 78 aa, Triticum aestivum
  Clone ID: PAT_TA_67353.pep
DQSPPPVSSPARIPRLPAPIRWARRSRGRIELARSRLLGGVRSDRGRAVDLTPSLSPSGGGEPDARRGAMRVTDASPL

SEQ ID NO: 172936 - protein, 104 aa, Triticum aestivum
  Clone ID: PAT_TA_67354.pep
HRRIWTGFPHPLPSFILLPAAMAPRPPLVRPPFSPRPATHALLAPLCNRQLMHARRVHGIMPLADGRSSAVVDPRAPCRFLAAKSTFRQRPAVHAIAGLDISSS

SEQ ID NO: 172937 - protein, 115 aa, Triticum aestivum
  Clone ID: PAT_TA_67355.pep
TGLVLLDFWVSPFAQRCRIALAEKGLACESLEQELLGAKSDLLLGSNPVHKKVPVLLHDSRAVCESLVILEYIEDAFPGAAPRLLPADPHARAQARFWADYVDKRVYSCGTRLWK

SEQ ID NO: 172938 - protein, 149 aa, Triticum aestivum
  Clone ID: PAT_TA_67356.pep
MPALAKPAAAAPKPKPAAAKPKAAAAGAAHPTYFEMIKEAIAALKDRTGSSSVAIAKYIEEKYGKALPANFKKMLSVQLRASAAKGKLVKVKASYKLSDAAKKDAPKPKAAAKPSKDAAKPKKKAAEKPKKTAAAGTKRKAPEKKKLVT

SEQ ID NO: 172939 - protein, 129 aa, Triticum aestivum
  unsure (1)..(129): unsure at all Xaa locations
  Clone ID: PAT_TA_67357.pep
MDASATGAGAKAKXGAAGRKAGGPRKKSVARSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVL

SEQ ID NO: 172940 - protein, 70 aa, Triticum aestivum
  Clone ID: PAT_TA_67358.pep
YRGLYIWCKWHVLKKAKESLGALLAKGSEFKPEFSKLVHHAVSIDEFENGWACMLEKYGLQKKCIPDPAV

SEQ ID NO: 172941 - protein, 52 aa, Triticum aestivum
  Clone ID: PAT_TA_67359.pep
ALSFETVRVVIGSSGWDVLVPGVAHGALIQVERIIPGSLPSSIKGPVVLLVN

SEQ ID NO: 172942 - protein, 47 aa, Triticum aestivum
  Clone ID: PAT_TA_67360.pep
LDFSSSTYFYRTILFRRSFGEASSGAPYLMHRSSRPDTIAFLDINHP

SEQ ID NO: 172943 - protein, 102 aa, Triticum aestivum
  unsure (1)..(102): unsure at all Xaa locations
  Clone ID: PAT_TA_67361.pep
TQLSSACTPTAAHATLAASRERSARLRRGGRGRASGRAACGGGVLLRQXGKPSRPPLPSGDLRASDGKARRRKRRGGGGVAVGGEAPRRRRRRRRRWEGAGG

SEQ ID NO: 172944 - protein, 161 aa, Triticum aestivum
  unsure (1)..(161): unsure at all Xaa locations
  Clone ID: PAT_TA_67362.pep
MAVGKNKRISRGXKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQI

SEQ ID NO: 172945 - protein, 166 aa, Triticum aestivum
  Clone ID: PAT_TA_67363.pep
AANWRYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALL

SEQ ID NO: 172946 - protein, 108 aa, Triticum aestivum
  unsure (1)..(108): unsure at all Xaa locations
  Clone ID: PAT_TA_67364.pep
FTALRAPSGRLSATMVSALLRSATTTHGTSSRSAXSGKCHYASYEKEECNQRIVCYGNKCERDQHYSIDYARKFVCDVDEDRWYFDDCKDDCYTYEKCSHGECEPVHP

SEQ ID NO: 172947 - protein, 105 aa, Triticum aestivum
  Clone ID: PAT_TA_67365.pep
WRKIWNDAPALPVSEQKSLLDSVREREKVVHYLETLSPQQLLEQMVCTAFKSSADILNKTTCGGFKLMKTKMDQLYATLASTLRSLQGKSDPSDLAGDLKRLCQV

SEQ ID NO: 172948 - protein, 98 aa, Triticum aestivum
  Clone ID: PAT_TA_67366.pep
MSADQPLPFIYQFAAGAIAGVSEILVMYPLDVVKTRVQLQTGSGATAEYNGMLDCFRKIIKQEGFSRLYRGISAPILMEAPKRATKFAANDEWGKVYR

SEQ ID NO: 172949 - protein, 110 aa, Triticum aestivum
  unsure (1)..(110): unsure at all Xaa locations
  Clone ID: PAT_TA_67367.pep
NHNVFESYYCSTLTAPLASPNSRLLASTKSSLFDWPVGSDSWSELKLSNVQVRQIVEXNGQFIAMDDHMKIYTLQLAPQLGLQDLPIEWCGGKIPSMDSKPFLVVCRDML

SEQ ID NO: 172950 - protein, 75 aa, Triticum aestivum
  Clone ID: PAT_TA_67368.pep
MASGTVLTNGGASPMLQCCRAVVGVVRTGAYNVCLILTGKVIFSLPINYTLGISLPRICKSLPVPLVCRIRRRRS

SEQ ID NO: 172951 - protein, 138 aa, Triticum aestivum
  Clone ID: PAT_TA_67369.pep
TNFLLTTQVGGLGLTLTKAARVIVVDPAWNPSTDNQSVDRAYRIGQTKDVIVYRLMTSGTIEEKIYKLQVFKGALFRTATEQKEQTRYFSKRDIQELFSLPAQGFDVSLTQKQLQEEHGQQLVMDESLREHIEFLERQ

SEQ ID NO: 172952 - protein, 189 aa, Triticum aestivum
  Clone ID: PAT_TA_67370.pep
IGSIIKHLAPGSALNSIQSKNPDDIVITLAVRTPLTKAKKGGFKDTSLEYMVYAILKQVRERSNLDPALVEDICLGNVSDVKAAYKVRASALAAGFPNTAGASSINRFCSSGLKATADIAHSISNGSIEVGIAMGAEQMSIGGDALDKPFDEAVTSQSQEAVDCMQPMGWTSENVSKDFGVTREMMDKF

SEQ ID NO: 172953 - protein, 132 aa, Triticum aestivum
  Clone ID: PAT_TA_67371.pep
WLSTLASLKYYAAAPRKATLSLPPSLSRPPVSAHLLRLRRRRTHRGSSDSPDQERRAGRKSTYAGGEEMGLTFTKLFSRLFAKKEMRILMVGLDAAGKTTILYKLKLGEIVTTIPTIGFNVETVEYKNISFT

SEQ ID NO: 172954 - protein, 84 aa, Triticum aestivum
  Clone ID: PAT_TA_67372.pep
RARTRSSPPPRPRRPLCTRSRPPPRQPRPRGGQSRRPLLRAQRRARAGPPPAAGGARGHGAAGMACRRAVPWRGTGSDRIGRRG

SEQ ID NO: 172955 - protein, 64 aa, Triticum aestivum
  Clone ID: PAT_TA_67373.pep
RRFMAPEYINECAISPKNDVFSLGVIIFYLVAGRKGYGEYCDSRSSPRQEFIDRVICFHRYFVL

SEQ ID NO: 172956 - protein, 52 aa, Triticum aestivum
  Clone ID: PAT_TA_67374.pep
SHRVPRITSAGATGCMSSTEHSKKPQCSSFHGSNNRREAQTMPDGAPLKHPR

SEQ ID NO: 172957 - protein, 104 aa, Triticum aestivum
  Clone ID: PAT_TA_67375.pep
MPMPMPVPVTAATPTPAVVVSTPPPPAPMSSSVAAAAAVFFTPPLSDVVGCASGANFTPHILNVATGEDINMKVISFSQQGPRAICILSANGVISNVTLRHHDS

SEQ ID NO: 172958 - protein, 157 aa, Triticum aestivum
  unsure (1)..(157): unsure at all Xaa locations
  Clone ID: PAT_TA_67376.pep
MATAAAVVDAANSKPRDTERRPRRLRRVKXDRAAGANAAVGEGTRESAGPDPHPQVEVEYVPEKADLDVDDLLLGVFTTIFEKFSFTVTATAKGEGNEKEASNDAAKKKGSDVDYDEQDAPKKKQLQRMKIAELKQICNKPDVVEVWDATAVDPELL

SEQ ID NO: 172959 - protein, 102 aa, Triticum aestivum
  Clone ID: PAT_TA_67377.pep
MAATVGKEREEAVVHPNARQGGKLLSRLLTRDSSAAAPSFLVYYGVASAGAVPFLWESQPGTPKNAVSDAAMPPLTPPPSYYAAGGTAAAKKHAARKAAAGG

SEQ ID NO: 172960 - protein, 167 aa, Triticum aestivum
  unsure (1)..(167): unsure at all Xaa locations
  Clone ID: PAT_TA_67378.pep
QSCSVCRGRKIXCDQKEPSCTQCTKKGMACPGYRNIVDLMFRDESSHVIKKAENRRAQHLVPNKKSSAGQGLPSPSPSPSTPTEPIGSSPTFIINPRPVGVLPPASKVENSNKATDRRSRKRAARCRAPVLSALNNDWSRSSSETSESPPDTNDDGRTSELDVPLDR

SEQ ID NO: 172961 - protein, 175 aa, Triticum aestivum
  Clone ID: PAT_TA_67379.pep
IIAHRCRNVQPRLLPTHPALTRGFADAKRPPSAPKPIVDIKHIRQHAELYQQTCVERNYRKQAQNPAKILELHARWQDLQRQGRALRERSNLLRRQLANPATSSGDEDLKEVRQLTREQIQDEARQLKQDLSAIEKGESQSVTQMEELALELPNLTHPDTPKGSEFEVMSYINDP

SEQ ID NO: 172962 - protein, 134 aa, Triticum aestivum
  unsure (1)..(134): unsure at all Xaa locations
  Clone ID: PAT_TA_67380.pep
VGVSRAIPALVPLLRSTDXPVAHDNTVTALLNLSLEERNRSDITAVGAIKPLVYALRTGTASAKQNAACALLSLSGIEENRATIGTCGAVXPLVALLSAGSTRGKKDALTTLYRFCSARRNKERAVSAGAVVPL

SEQ ID NO: 172963 - protein, 105 aa, Triticum aestivum
  unsure (1)..(105): unsure at all Xaa locations
  Clone ID: PAT_TA_67381.pep
GHKRLPISKVVYSFLNDTLSASFHYPKWNKGRVICLKSQLKKLQAAIDSSXNGAAVPGFVHMTESRLPSPGSKVYTGEPHVENGSAHSTAESLVEEEKESELLPL

SEQ ID NO: 172964 - protein, 93 aa, Triticum aestivum
  unsure (1)..(93): unsure at all Xaa locations
  Clone ID: PAT_TA_67382.pep
MRKIKIGINGFGRIGRLVARVALQSDDVELVAVNDPFITTEYMFYMFKYDTVHGHWKHSDIKLKDDKTLLFGXKPVTVFGVRNPEEIPWGEAG

SEQ ID NO: 172965 - protein, 78 aa, Triticum aestivum
  Clone ID: PAT_TA_67383.pep
SPAPKPRVHHSMSGPAAGGGEDRGGGQLYGDHPPAAADVLVDDVFFQSRSACGGGDDGGVAPSAYSSITDYLQGLLDP

SEQ ID NO: 172966 - protein, 104 aa, Triticum aestivum
  Clone ID: PAT_TA_67384.pep
HHLFRRRVGPGCISLDFGNLARLAEESRCFSVNEVEALFELYKKISCSIIDDGLIHKEELQLALFKTPSGQNLFIDRVFDLFDEKKNGVIEFDEFIHALSVFHP

SEQ ID NO: 172967 - protein, 183 aa, Triticum aestivum
  unsure (1)..(183): unsure at all Xaa locations
  Clone ID: PAT_TA_67385.pep
IEPLHWLGRLGRKAPLPGVYDDECDEDGGVDNILQNNNELVVKGTAKFXPGMLDFSRLVDANAQEPSTGPINSVQFHRNGQLMLAAGLDKHLRFFQIDGERNPKIQSIFIQDPPQKKIIEDCPVYKASFLPDGSEVILSGXRKFFYSFDLXEAAVSKIGPLTGREEKSLESFAISPDSKTIAS

SEQ ID NO: 172968 - protein, 69 aa, Triticum aestivum
  Clone ID: PAT_TA_67386.pep
HLLVAVSHSCGLLKLEFLEHLLKSYTNNTELSPRFKFFAEWGSVELPRLVCGFESGAGIYGVEQSQTGS

SEQ ID NO: 172969 - protein, 97 aa, Triticum aestivum
  Clone ID: PAT_TA_67387.pep
ARPAGPGLYADIGKKARDLLNRDYTTGQKFTFTTTAANGATITSSITKKNEAILADLQTQVKIKNFTVDVKATSDSSVVTTITVPELYTPGLKGVLS

SEQ ID NO: 172970 - protein, 65 aa, Triticum aestivum
  Clone ID: PAT_TA_67388.pep
TPRASLHTRQLPPGPPRRRAAPRRAARRGPRAAASVRSNTSPTASLRPVPAGPAGEIHRRGGRDR

SEQ ID NO: 172971 - protein, 110 aa, Triticum aestivum
  unsure (1)..(110): unsure at all Xaa locations
  Clone ID: PAT_TA_67389.pep
GVLYYLENQLAAGMYPRRRSRILXSFPLVHIQASSQLDGLFWKLAYIWIDSSWMLADDEDWWLLSPEVRTVHALVLLKPVQFLRPPEGGMAADGAGWICPWIWRLRAPHG

SEQ ID NO: 172972 - protein, 86 aa, Triticum aestivum
  Clone ID: PAT_TA_67390.pep
RGCSSPCLFHAGRLLLPPPLRATAAAQARPRSSAAAHHYQDPGPPSPTNMMPLCAQIRSSLCSGATFHPLQCGLPSPAARPPLAPP

SEQ ID NO: 172973 - protein, 79 aa, Triticum aestivum
  Clone ID: PAT_TA_67391.pep
SSPPQSRLALPQPAPSSALHLMRARCSLPPASARRASSSSTSPRRAPWTCSASSSMARRSRSSGTTSGRRSWGSRCRAR

SEQ ID NO: 172974 - protein, 164 aa, Triticum aestivum
  Clone ID: PAT_TA_67392.pep
GASQNSPQRSLVPNSARGANWNWIVDPLNGEKFIKVAEVQGSEIKPFVESLSKCPKHGLHNPLRAPERYLMYGDISTKAAHMLGQPEVLDFFAKLVQRVSPKSYQQALLEVQVSQKFLENFCGDQVRFLARSFAVPGNHVGQMSNGYRWPFGPVAIITPFNFPL

SEQ ID NO: 172975 - protein, 105 aa, Triticum aestivum
  Clone ID: PAT_TA_67393.pep
PASSRLPASPAATATAEPAANAVALPGADTHGACRCFVQAASSSRSSPAASIRREQQHQQMSSAHVLSFLHLLMPVPFFSPHTTVCVSLLSRSSQGRHSSSISRR

SEQ ID NO: 172976 - protein, 109 aa, Triticum aestivum
  unsure (1)..(109): unsure at all Xaa locations
  Clone ID: PAT_TA_67394.pep
CLGADLGSTRPFTTGSSPPPPSFVVLAPLTPPTGARRRRRAVQLLHRQAGRRAAPPTPADLLGTGEAVLPSSVAASFFWPATRSXLSYVPFFHLTSSSGGCSCLPLLFH

SEQ ID NO: 172977 - protein, 87 aa, Triticum aestivum
  Clone ID: PAT_TA_67395.pep
NPSFTDLVRSDVSENLEGAETQASQEPPAEWGSEGAPSSASGPDDGNLPYPYLPTVLEEPSTSFSEVAEDGPLPAIDGLRITGEAFP

SEQ ID NO: 172978 - protein, 128 aa, Triticum aestivum
  unsure (1)..(128): unsure at all Xaa locations
  Clone ID: PAT_TA_67396.pep
RLRRRGASQRKGDGSSLNQFVYNCLLGAVKNSGEFGRIQDVLADMEAQGISPNIVTFNTLMSVYVEQGKVXEVFRVYDDIEGRGLVPTAATYSTVMSAYKSAGDGFAALKFFVKLRERHKNGDLVGEP

SEQ ID NO: 172979 - protein, 48 aa, Triticum aestivum
  Clone ID: PAT_TA_67397.pep
AYFDSADWVLGKQAANSSSTAAVESLKPKLKRTPHPQLPPRKPTCASG

SEQ ID NO: 172980 - protein, 72 aa, Triticum aestivum
  unsure (1)..(72): unsure at all Xaa locations
  Clone ID: PAT_TA_67398.pep
FMRLDHVEDTLXLSGKTKTYFATAVALWDANFYVKVDDDVHVNIATLGQILSKHISRPRVYTGCMKSGPVLS

SEQ ID NO: 172981 - protein, 64 aa, Triticum aestivum
  unsure (1)..(64): unsure at all Xaa locations
  Clone ID: PAT_TA_67399.pep
RVLSNFMKQQCLGHRLTYGRAIPLRSLVDMIGEKAQMNTQMYGKRPYGVGLLXAGVDERGPHLF

SEQ ID NO: 172982 - protein, 50 aa, Triticum aestivum
  Clone ID: PAT_TA_67400.pep
RCRWRGRIRARTRRLRRSRLPRRRRSLPRTWPAQGPPGRRAPWRRCRAPA

SEQ ID NO: 172983 - protein, 52 aa, Triticum aestivum
  Clone ID: PAT_TA_67401.pep
SGSFKPGVLTALMGVSGAGKTTLMDVLAGRKTGGYIEGDISISGYPKKQETF

SEQ ID NO: 172984 - protein, 112 aa, Triticum aestivum
  Clone ID: PAT_TA_67402.pep
RLLRVGTSVWNSSLVLVKFAERCLGDAALPFADALRFAGARAIELGAGCGPAGMGLSRLGLADLVLTDTAAVLPALRRNLGRNRRHLPRAPRLAQLHWNCPAHLSQLAAPRR

SEQ ID NO: 172985 - protein, 61 aa, Triticum aestivum
  Clone ID: PAT_TA_67403.pep
HVRFNGAWHGKVQQTTLQIKWRSICNELHIDETPHLIIYFSFIYVPNNIKCGLTWQEVKHK

SEQ ID NO: 172986 - protein, 126 aa, Triticum aestivum
  Clone ID: PAT_TA_67404.pep
PCQLVIEIPRVERRSAGALWNLLQGQPRVRDVDGVAGEKVDDRRRTVSNEDKLLVFLDEIGSFRDLLYFSVLDAALAYTSGRTQIFSVVDAVCLNAYELISIDSQAPLMTNENGIVVDGVHILQLT

SEQ ID NO: 172987 - protein, 51 aa, Triticum aestivum
  Clone ID: PAT_TA_67405.pep
RGSSAQQKMRPLGSHTSHALHGRSGHAASTSHRPSREEWAVEIGKAVRGQA

SEQ ID NO: 172988 - protein, 153 aa, Triticum aestivum
  Clone ID: PAT_TA_67406.pep
MQIFVKTLTGKTITLEVESSDTIDNVKAKIHDKEGIPPDHQRLIFAGKHLDDGRTLADCNIHKESTLHLVLRLRGGMQIFVKTLTGKTITLEVESSDTIDNVNAKIQDKEGIPPDHQRLIFAGKQLEDGRTLADYNIHKESTLHLVLRLRGGH

SEQ ID NO: 172989 - protein, 53 aa, Triticum aestivum
  Clone ID: PAT_TA_67407.pep
QACHPQQSRRLGTISFASAPLGAALRRRRRRGVEGDEGRVGAALTAIRASCVP

SEQ ID NO: 172990 - protein, 155 aa, Triticum aestivum
  unsure (1)..(155): unsure at all Xaa locations
  Clone ID: PAT_TA_67408.pep
QPWAPKADKKPAAENKXEKAAEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSRGTKAVTKFTSS

SEQ ID NO: 172991 - protein, 56 aa, Triticum aestivum
  Clone ID: PAT_TA_67409.pep
LGAAGWLDATAMIARACLDLEASERRARIGAGEALAFLGSEEAAVVVEGRRYRAIG

SEQ ID NO: 172992 - protein, 103 aa, Triticum aestivum
  Clone ID: PAT_TA_67410.pep
PLCRQRACRPRLRNSWLAHEVEQPRRLARSGVEREEEAAHVREVEEDADVVVPGSSGLAACGGRRRRTRGCFSRFRKAGDGGDHAGADLALALSMATAASVGA

SEQ ID NO: 172993 - protein, 87 aa, Triticum aestivum
  Clone ID: PAT_TA_67411.pep
FRASRDETARRSGCSLCARRERLSESRLLRRRELDGAPLGVAGLIGLCVLCHLAKLFWVLKPLDCRAKLFWFFSALCSRAKLFWDLL

SEQ ID NO: 172994 - protein, 108 aa, Triticum aestivum
  unsure (1)..(108): unsure at all Xaa locations
  Clone ID: PAT_TA_67412.pep
VTVTAAATALRGAATSRARALKEVWNIAAVIPVEKGTMGGGGAGGGHHHXXIVQKQHFFXLESNGSSVSDLSLEEENNFLGACSQELLVRGTELLKRTRKGALHWKVV

SEQ ID NO: 172995 - protein, 92 aa, Triticum aestivum
  unsure (1)..(92): unsure at all Xaa locations
  Clone ID: PAT_TA_67413.pep
MAPNGDNTVANVHSGIDSTNKTLLKSDALYTYILDTTVFPLXHECMRDLRLITDKHPWGYMQSSSDEAQLLGMLIKMAGAKKTIEVGVFTGY

SEQ ID NO: 172996 - protein, 87 aa, Triticum aestivum
  Clone ID: PAT_TA_67414.pep
RCIACHFGCVELKFADQMHPYKVKDICIPLRRFSLIPQALIYKNRMCIAAKLVSLIPDEYCHVSRNMVALRCLVRSDKRLGMQMCSL

SEQ ID NO: 172997 - protein, 108 aa, Triticum aestivum
  Clone ID: PAT_TA_67415.pep
AAVAAATAAASSSGKDDRAARTDMAMASAATLVAAQCVEAAESLGAEREHLEAVVSSAVNVRTPGDIVTVTAAAATALRGAATLRARALKEVWNIAAVIPVEKGTMGG

SEQ ID NO: 172998 - protein, 124 aa, Triticum aestivum
  Clone ID: PAT_TA_67416.pep
PHVATGFSDTSSLLRELTLKSMLVLAPKLSQRTISGSLLKYLSKLQVDEEPAIRTNTTILLGNISTYMNDGTRKRVLINAFTVRALRDTFPPARAAGIMALSVTSSYYEMTEIATRILPNIVVL

SEQ ID NO: 172999 - protein, 67 aa, Triticum aestivum
  Clone ID: PAT_TA_67417.pep
FNIMSLEEVTDLKLNLLEAITNQFSEKLRIGSGGYGEVYRGLLNGCEIAVKKLYLNNASLDDKSFTN

SEQ ID NO: 173000 - protein, 144 aa, Triticum aestivum
  Clone ID: PAT_TA_67418.pep
EKKPAAKKPAEEEPAAEKAPAAKKPKAEKRLPAGNSAAGKDGDKKGKKKAKKIVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 173001 - protein, 101 aa, Triticum aestivum
  Clone ID: PAT_TA_67419.pep
CASIHYFYSYHPIFRKEWVRSSTPRPMVLSLKKLQGILNMEQSMDNDCFNIVVHILACDEGVLFADPPIHYMDLQFCVNYQNSSFNIISINMFLNSFLLSP

SEQ ID NO: 173002 - protein, 171 aa, Triticum aestivum
  unsure (1)..(171): unsure at all Xaa locations
  Clone ID: PAT_TA_67420.pep
TAGAPSPGNRRRAEPRQVSPMHTPHAKKPRGRRXWPASVSCLDARNGVDRTWHSVFYLVACGDRLLMVERRTLVERFVVWEGGTRERGSRPIRTQLEACEGVDLIGGHGHWSKVDTLMGHALFVSRGCSHSLPAAAQCGAREDCIYFAMTESPRRKREPQDDDVFRCVVTT

SEQ ID NO: 173003 - protein, 99 aa, Triticum aestivum
  Clone ID: PAT_TA_67421.pep
DAFLKKSRTYLLLLAILAVSLTYQAGLNPPCGCWTSNVTKHSAGDPILGDSGRVWTSSGTKHSAGDPILEDNYHKRYLAFFYFNATAFAASLVMILMLL

SEQ ID NO: 173004 - protein, 80 aa, Triticum aestivum
  unsure (1)..(80): unsure at all Xaa locations
  Clone ID: PAT_TA_67422.pep
EDRRREDARVTIKRRRETRRQSDRRNGPDVDXAHARWRRLPAFEVGCPAFTRELRQVRWPSARTFKPEIEEKYDGRLNPA

SEQ ID NO: 173005 - protein, 52 aa, Triticum aestivum
  Clone ID: PAT_TA_67423.pep
RGTPAGTRRGRALAQTARGLGSPAPPAWACPSSPRPFPRRSPPQAGLTGKAT

SEQ ID NO: 173006 - protein, 83 aa, Triticum aestivum
  unsure (1)..(83): unsure at all Xaa locations
  Clone ID: PAT_TA_67424.pep
VLRLRGGMQIFVKTLXKDITLEVESSDTIDNVKAKIQDKEGIPPDQQRLIFAGKQLEDGRTLADYNIQKESTLHLVLRLRGGQ

SEQ ID NO: 173007 - protein, 99 aa, Triticum aestivum
  Clone ID: PAT_TA_67425.pep
CCRRRPGDRPAASPVSPAARLPLPPTGDGLPEAPRPPAPRRPAAGGGGAPPAFPRRIAPVHRHLRAAARGPPPRHLPPIPPPPSDESMDCERSVGFGAR

SEQ ID NO: 173008 - protein, 123 aa, Triticum aestivum
  Clone ID: PAT_TA_67426.pep
VSSEQKVYDVVVKQAALLKRQLRPSQQGGQAPPAVARELDAPRGGLGEAYARCGEICEEYAKTFYLGTLLMTEERRRAIWAIYGNLKIRRHMGHLRIKVHEKRLQEHIPQIAWGHESEVWCTR

SEQ ID NO: 173009 - protein, 59 aa, Triticum aestivum
  Clone ID: PAT_TA_67427.pep
GQGGGRCRTGTGRGPGPAGAAAPTAGAGPRRRRSGPSSSRRRRRSRPPGPGRLPWWTDG

SEQ ID NO: 173010 - protein, 176 aa, Triticum aestivum
  Clone ID: PAT_TA_67428.pep
IKTLPPDALVADQPLPPLPPPPPPPPPGLGDWFARILDVELHKLNDFYMERDEWYVIRLSVLKEKIERVKANKNGAFTSKTEFTEEMLEIRRDFVLIHGEMILLQTYSSLNFAGLVKILKKYDKRTGGVLSLPFTQRARHQPFFTTEPLTRLVRECEANLEILFPVEDEVLESGSS

SEQ ID NO: 173011 - protein, 62 aa, Triticum aestivum
  Clone ID: PAT_TA_67429.pep
RSTGPTRPPAGPWATPFRPSWRRSSAPAPCTAAPSPGWRDGWGGVDLSLLPPAGRLLIGQAA

SEQ ID NO: 173012 - protein, 188 aa, Triticum aestivum
  Clone ID: PAT_TA_67430.pep
LPTLHFESSTCLSHQQLLPVRESGTEAVLHAANFVLALSSFADGKALRRCSAILFEWDDHLKTGVVLTTAHLIRSNCPSIDHWLGKNEYRPDAKVVVHFLDDTTAEGDLLYHQEHYDITFFKVKVGQCPQLPLFVDNVKSGQEIFQLGRDEKLNLRITYGRAQSKNPNMYRRQHFMYMHRKDDNNEFD

SEQ ID NO: 173013 - protein, 88 aa, Triticum aestivum
  Clone ID: PAT_TA_67431.pep
MNNTKALCFVLLIALSTLQYWPCHASEGHISVEEGGIRHMCRYMLGGNTTTERCRELCLALGSIYNADLIYLQFCDKRYTCQCCCKMY

SEQ ID NO: 173014 - protein, 131 aa, Triticum aestivum
  unsure (1)..(131): unsure at all Xaa locations
  Clone ID: PAT_TA_67432.pep
SHPPGVHLPGRSGDSSPSSPLLPDLPRDGXGVGWLPSLRSAARFLQRMGSRRLMREPSMAVRETAAEHLEERQADWAYSKPVVVLDVLWNLAFVAVAAAVLAASLTERPAGPLCFLLAGYVLXCLLHFLCV

SEQ ID NO: 173015 - protein, 201 aa, Triticum aestivum
  Clone ID: PAT_TA_67433.pep
LAKGENSVARDQIEELFNRCIIHRRDIRQNSRVKSYQIGPVLLEFMICKQACRNFITLIENGQRQPYCGKKDSAVRQLYLSGKTARAVEEDRLSSIRSLTISDHDGEELVDFEKCKMLLVLDVENCKKVEDTDLQKICKLLYLNYLNLRGTNVKTLPSKAAKLHYLQILDMRETSANIELPMEVLILGQLVHLFGRFKLPP

SEQ ID NO: 173016 - protein, 200 aa, Triticum aestivum
  Clone ID: PAT_TA_67434.pep
WWIPESPRWLMANERHEEALTILSKYHANGDVNNATVQFEYNEIKDTIALEYQAQKTGSYIDFLRTKGNRYRLMLLISLGIISQYSGNALISNYSNIIYEGAGIKDQAQKTGLNAGENMLKLFVAIGCSLGIDRFGRRPLFLTATVGMLLFFLAWTIVAARFEATGETEIKRLGYPQIALIWLFDVCYSIAWSGLIVAYA

SEQ ID NO: 173017 - protein, 156 aa, Triticum aestivum
  Clone ID: PAT_TA_67435.pep
MYTARKKTRRQGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDP

SEQ ID NO: 173018 - protein, 155 aa, Triticum aestivum
  Clone ID: PAT_TA_67436.pep
IYQLSQVQHQLSHHHDYQLFRRSSPSLRLPCSTTTRHVSHCAHQQSTSSSLVRSHSNRFGYQDKTKLRCTHHYINVVCASPELGTSRAADKIGQEEWRCGIKAKSIRLDIAIGDRIGKHKEAIDTTISYSGMRLGLVPIHDILITCISSKKKKKK

SEQ ID NO: 173019 - protein, 102 aa, Triticum aestivum
  Clone ID: PAT_TA_67437.pep
MASTSCFLHQSTARLAASARPAPAVGRTQLFVCKAQKNDEAASDAAVVTSRRAALSLLAGAAAVGVKVSPAAAAYGEAANVFGKAKKNTDFVAYSGEGFKLM

SEQ ID NO: 173020 - protein, 175 aa, Triticum aestivum
  unsure (1)..(175): unsure at all Xaa locations
  Clone ID: PAT_TA_67438.pep
PMLQLAELLRARGLAVTVLHTDFNAPDPPHHPELAFVSIHEALPHVATSPDADIVAQLLALNNGCEAPFREALASLLLLREDVACVVVDGQWYAALGAAGVLXVPVLALRTDSAATFGSLLAFPRLRDAGYVPIKEERRDELVXELELLRVRDLIRIDGSDVDALCGFIARVADA

SEQ ID NO: 173021 - protein, 111 aa, Triticum aestivum
  unsure (1)..(111): unsure at all Xaa locations
  Clone ID: PAT_TA_67439.pep
VLAMVLAAMVVAPPATVHAIXCSTVYSTLMPCLQYVQQGGSPARGCCTGIQNLLAEANNSPDRRTICGCLKNVANGASGGPYITRAAALPSKCNVALPYKISPSVDCNSIH

SEQ ID NO: 173022 - protein, 92 aa, Triticum aestivum
  unsure (1)..(92): unsure at all Xaa locations
  Clone ID: PAT_TA_67440.pep
CGFGERRQELGNAGSAGAPDHAKKPEEADGVVWAPPSTVRFFPAVAQHTAWQPPPIKLEGEDLPSSPPTTAGXGVDEDMAAPRYLWLVYALG

SEQ ID NO: 173023 - protein, 117 aa, Triticum aestivum
  Clone ID: PAT_TA_67441.pep
APPRPQAPATPPLRRATSAVSTLRESPQPPLAPLSISSRRAALLALVLAASPARPAAAAFSFSFPGPKELLREQKRKSARFLLAPIAASRETLVKAQNLLASENASAADAEEVRGRL

SEQ ID NO: 173024 - protein, 94 aa, Triticum aestivum
  unsure (1)..(94): unsure at all Xaa locations
  Clone ID: PAT_TA_67442.pep
SSIHSQDFGKEEIVDATFSLSSTIQMIVPATFALINFLAAHDIFNIICIIPPKDYSPHCTCPTXLESIAPYDLHPDWISKNTSSCHLASEEHLI

SEQ ID NO: 173025 - protein, 123 aa, Triticum aestivum
  Clone ID: PAT_TA_67443.pep
SHLTHPISCFVFITCYFIYYYLHILAVSLYCCFKKLPYPVSPYSYRRIRVAVSVSPYRCFIGRQSSRKSANQPVVELVRWTVVSSTHQGSNPGARIIPGFISGFPAMRFQWEETFPSTTRRLR

SEQ ID NO: 173026 - protein, 97 aa, Triticum aestivum
  Clone ID: PAT_TA_67444.pep
AAIRRDLAPWRRRDGGGGGITRALVESGRHRACMRVTITGGGTRLHVDLYYACVQSRALFTVWSLLQLMRRYPGRVPDVDLMLDCMDRPAINRTEHT

SEQ ID NO: 173027 - protein, 139 aa, Triticum aestivum
  Clone ID: PAT_TA_67445.pep
GLPAPSPGYRAHGRTLRRRRRQPRRRRRRRRRRRPGRDVERHHAEDAPGDGAGRIHHLPSSPTLVASPANPIAAAASPGAIRRRGGAEQAVGGFHQEDPQLLRAAPMIPTTHPPTINPKIPNQSKSKISRLCKDHIPLN

SEQ ID NO: 173028 - protein, 191 aa, Triticum aestivum
  Clone ID: PAT_TA_67446.pep
SALLLSLGLLLFHTTPWSSSFVAANNDTLMAGQVLAVGGRIVSRNGKFALGFFQFQPASAISKSSYNTTSPIPSLWYLGIWFNKIPVFATVWVANRDQPITNPSINQTRFKISSDGNLVIVNHAANNESIVWSSHIVNNRTHINTNNTSVAVLLNSGNLAFKESPLSDLPVWQSFDYPTDVILPGAKFGRD

SEQ ID NO: 173029 - protein, 59 aa, Triticum aestivum
  Clone ID: PAT_TA_67447.pep
PRVACDFTCSSFALHFVLIDEGSVTVRPSLVCWKCLTSQKHIVTRQFLSCDQPCKSSRR

SEQ ID NO: 173030 - protein, 174 aa, Triticum aestivum
  Clone ID: PAT_TA_67448.pep
HTTPGYRLDFPPSSPFHRRQVPSKPTRWGNVNVVDAERRLLANALLDFSNERFVLVSESCIPLYPLPVVHAYLTRSRHSFVGVFDDPSPHGRGRYRAGLAPDVTLSQWRKGAQWFEMDRRLAVFVIADERYYPRFRTECRAPCYVDEHYLPTVLSIEAPTQIANRTVTLVDWSR

SEQ ID NO: 173031 - protein, 87 aa, Triticum aestivum
  unsure (1)..(87): unsure at all Xaa locations
  Clone ID: PAT_TA_67449.pep
DPRAAPLHTSRANSRXNRCPRPTAGAEGGGRGRVGRASHHRPGNPSPKFAVRPFGLAAAAFASLSRGGGLDGWMEGEKRRRVGCAVP

SEQ ID NO: 173032 - protein, 88 aa, Triticum aestivum
  Clone ID: PAT_TA_67450.pep
PPRTQLRPALLAVEHHGRSTFKLRPASPNLRVFSTDRAPILIYDSCFFHVKSGVPAAESATKVAPPGRRSCNRLQNTAATTPITSAPY

SEQ ID NO: 173033 - protein, 60 aa, Triticum aestivum
  unsure (1)..(60): unsure at all Xaa locations
  Clone ID: PAT_TA_67451.pep
CLVQVSWLKQHSAPTSGVCVSPSXDKIIATVGLDKKLYTLDSASRRAAHTIPHDAPFSLL

SEQ ID NO: 173034 - protein, 133 aa, Triticum aestivum
  Clone ID: PAT_TA_67452.pep
MGISRDSMHKRRATGGKQKAWRKKRKYELGRQPANTKLSSNNTVRRVRVRGGNVKWRALRLDTGNFSWGSEAVTRKTRLLDVVYNSSNNELVRTQTLVKNAIVQVDAAPFKQWYLTHYGVEIGRKKKAAAAAK

SEQ ID NO: 173035 - protein, 70 aa, Triticum aestivum
  Clone ID: PAT_TA_67453.pep
SVLYKNGQAIRLFQQPRTKPNRAQTRKKQLERRRIRRAGDPSIHVGSALDQRRHDPETNQPTNRIDRAAS

SEQ ID NO: 173036 - protein, 112 aa, Triticum aestivum
  Clone ID: PAT_TA_67454.pep
MHRVSPGKTAGTAARAQRDDELLDDRWVAESRRRGKARGAQPQTKHLNELNWEVIVVRDKLINAMCLPGGKIVVFTGLLDHFKTDAEIATVLSHDIGHAIARHLPEMITKGM

SEQ ID NO: 173037 - protein, 230 aa, Triticum aestivum
  Clone ID: PAT_TA_67455.pep
VSAATAENMQQLEQSYRDSKAAATNPVRGSEIANAASRFLGRIWASSNNKSSNLSPGTSAPARPSSILRRTASKQSLASTLNSMEASSASVTSSTSTDATTMSRDSSNTEDRRDSTPVGNKTITIHKNTDERNLHSQIEDLLTALSELQRNHSLLSNQLQREREDRQEDQKAVQSLLNGLRQKADSTSSRSSSPQVTVSPNKEDSPVDEMDESTTPSPKETVESSEDESP

SEQ ID NO: 173038 - protein, 160 aa, Triticum aestivum
  Clone ID: PAT_TA_67456.pep
GSAVAGGVVVDMSRGGKAPSRALPVYSPELGGHYVDVWGGELWIDVLNWTLSHGGLAPRSWTDYLYLSVGGTLSNAGISGQAFHHGPQISNVYELDVVTGKGEAVTCSEAKNPELFFGALGGLGQLGIITRARIALEPAPRKVRWIRALYSNFTEFTADQ

SEQ ID NO: 173039 - protein, 118 aa, Triticum aestivum
  Clone ID: PAT_TA_67457.pep
MDTANMCTVERRGRVHLITLTGAGEHRLSPALISAIRAAVAACPGAGALVLAAEGKYFSNGFDQAWARTVPPHLHTTMSEGFRGLVADLLALPMPTVAAVTGHAAAAGCALALAHDSV

SEQ ID NO: 173040 - protein, 77 aa, Triticum aestivum
  Clone ID: PAT_TA_67458.pep
AYQFHQIYHTHSKEANTKGFNPLLNNNFTKRGELDGPAIKFSAQLTELLFGESWQELQLLTTNDWLNNNTNHTFTMD

SEQ ID NO: 173041 - protein, 113 aa, Triticum aestivum
  Clone ID: PAT_TA_67459.pep
TACPKPLPVLGFRHPAITFVFGPSTAAYGASSPSSIAPSRAPSLPDGPPREGRHGGPHPVRSMDAAHRAATRPGRGWAPWLVLLNHSCGECVCCSSSLNSNEKRQSNRSTPRP

SEQ ID NO: 173042 - protein, 147 aa, Triticum aestivum
  Clone ID: PAT_TA_67460.pep
AAYTGCLVHTHNQKEQVSTTSSYSMTMVEGGAGACGFLARGGAGAREERQRGQGSPKEHMKALRRLRRKAHDELRRRTTVTKGDGVSRSGRLNEGLLDPIIVVDVDDEGATPGHLREAPGLLRSMSTARRRMFRATASREESEWERA

SEQ ID NO: 173043 - protein, 112 aa, Triticum aestivum
  Clone ID: PAT_TA_67461.pep
SLKLHKHRTMIYSTEQRIKHPATLCRRTLRRSLDHDGRVSLLPHPRRRGSRLLDPQELAHGKQVTKPCSSALHVRLELPTDAAVARAPATSPLGRKDRPPWCFRSRPAAPGC

SEQ ID NO: 173044 - protein, 115 aa, Triticum aestivum
  Clone ID: PAT_TA_67462.pep
LLPHTGRHRGQAGVAARHHLYFAATHPSIHATPSQPSRHLHNPTPPATSAHLACHTRALDQTRGSWRVIPSKLSYCCSSTTLPAAVFQQDRLPSAPFCCRSCFFSEPQSAAASSL

SEQ ID NO: 173045 - protein, 106 aa, Triticum aestivum
  Clone ID: PAT_TA_67463.pep
CPTIFALILARGPRGSKVNDYSQWRRHHRCCFEVSSCSPFFCSSFRRNDSILLLETEELFLPIHLSLIQSRCQDRNIYLKPNEVNDVRDSVFGGWLKDQLHQTKKV

SEQ ID NO: 173046 - protein, 146 aa, Triticum aestivum
  unsure (1)..(146): unsure at all Xaa locations
  Clone ID: PAT_TA_67464.pep
GIYADLKISELDLNTLSYQSLEMSYFGANVLHPRTIIPVMKDNIPIVIXNMFNLSAPGTXVCKQPANKXADLDACVKSFATIDKLALVNVEXTGMAGVPXTSSAIFSAVKEVGANVIMISQASSEHSICFAVPEKEVAAVSAALHV

SEQ ID NO: 173047 - protein, 184 aa, Triticum aestivum
  Clone ID: PAT_TA_67465.pep
MDASGRRGRVLWLVRLQIVLILVWSGGASANSDDGKASLSLEGADAGDKDVYLSHSCIHDEILHQRRRAGRKEYSVMPQVYHMPREKVERVRGRQLLGVSSWRAPRSNVKKPIRIYLNYDAVGHSPDRDCKNVGDIVKLGEPPVPSAPGTPICSPHGDPPLVGDCWYNCTFEDIAGEDKKQRLR

SEQ ID NO: 173048 - protein, 151 aa, Triticum aestivum
  Clone ID: PAT_TA_67466.pep
GRRDNHVPRFADLRQVHLRRGNGMMNRRQFLNLVVWSWSDRLYSLRRIDPSKNLFYESTQQAQKAASAEKRKKFDKTFRSLPDPIASFDPSPTGVVNSGLEWFELFAPRSSESRIVNSNKAGEITMFDADKRLILALPNLYQPKGHDAVVI

SEQ ID NO: 173049 - protein, 44 aa, Triticum aestivum
  Clone ID: PAT_TA_67467.pep
FALNSPFVTKEGSPNNKKNVTKVHRTSAANRPWHHLRGKQGRQM

SEQ ID NO: 173050 - protein, 183 aa, Triticum aestivum
  unsure (1)..(183): unsure at all Xaa locations
  Clone ID: PAT_TA_67468.pep
ISQTLRDASRKRCXDALAQAKLRLGNLRFAEEASAAHLETECFKKYQKVGKTFYNSQIAATVRWLSSSTSDQIHDRLETLTNQTTEAGAATSSPCNISDALGKAEKPAEATTSHEHAKTKPSDEFAKTMASTENMEPSKMSPSEKSIDEEARDRAISTMDLPKIPSFREFMSQKGRSHTTGSS

SEQ ID NO: 173051 - protein, 109 aa, Triticum aestivum
  Clone ID: PAT_TA_67469.pep
MALSLITRLLTLALGYAYPAYSCYKMLEVHPPQIEQLLFWCQYWILVATLTVFERFADWIVSWLPMYGEAKLLLVLYLWHPGTRGAGHVYDGLLRPLVARHEHDIDRGL

SEQ ID NO: 173052 - protein, 68 aa, Triticum aestivum
  Clone ID: PAT_TA_67470.pep
PPPRHLPPLHKPLESSHRSAVAGLETLLPLHTAVASVHLMSCITIDSTCWCSISQGDLMDSSDDDDDE

SEQ ID NO: 173053 - protein, 127 aa, Triticum aestivum
  Clone ID: PAT_TA_67471.pep
MGKIKIGINGFGRIGRLVARGALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKGGISAPS

SEQ ID NO: 173054 - protein, 154 aa, Triticum aestivum
  Clone ID: PAT_TA_67472.pep
MEVLSVCFVVVATLSATWLLKLAALSCNSIKAKKRMVLPPGPWTLPIIGSLHHVISLLPHRTMMELSRRHGPVMLLRLGEVPTVVVSSANAAAHVMKTNDLVFASRPLSPTQDIISCGGKGIVLSPYGDHWRQMRKVCILELLSSKQVNRMEGI

SEQ ID NO: 173055 - protein, 57 aa, Triticum aestivum
  Clone ID: PAT_TA_67473.pep
YRKAAIKNHPDKGGDPEKFKELAQAYEVLSDPEKREIYDQYGEDALKEGMGGGGGGG

SEQ ID NO: 173056 - protein, 147 aa, Triticum aestivum
  Clone ID: PAT_TA_67474.pep
ARARSAPCSPASATPPPTSGSSTSSTPRRPVPSSAADPRPPRSSRRSRTTSSASTRPPRSPAPARVRSPSLTRRWRKATMTTTRRLPCWALLWCHTSRRAPRGRPRLHRTWRSRCTTCLCARSTTSTRLRTAATCPGRFTTLSVEGE

SEQ ID NO: 173057 - protein, 103 aa, Triticum aestivum
  unsure (1)..(103): unsure at all Xaa locations
  Clone ID: PAT_TA_67475.pep
ARHGLLHPSRAPNEAEVACALAIELVFVAYVVVVHRRLPPFRSTSIFPERGGGLXTLEPRSQTPLSTTTPTTLEVPTTTCSPLTTTRSSLGGSQAGCLLLFRS

SEQ ID NO: 173058 - protein, 120 aa, Triticum aestivum
  unsure (1)..(120): unsure at all Xaa locations
  Clone ID: PAT_TA_67476.pep
ATTVAPFQGXKSTAGLPVRRRSSASLGSVTNGGXIRCMHVWPIEGIKKFXTLSYLPPLSTEALLKQVDYLIRSKWVPCLKFIKGGFLFREHNISPGYYDGRYWTMWKLPMFGCTDTTQVL

SEQ ID NO: 173059 - protein, 165 aa, Triticum aestivum
  Clone ID: PAT_TA_67477.pep
TAIDSHVFLLRWFDRFPEYNGREFFIVGESYAGHYIPELAVTIDVQNKNPKLTPINLKGICIGNGILEFAEEHAELYEYLWHRAFISDAAHDTIAKHCKGPDDLSTVCQAARDTAYSNTGDISAFNVYAPTCHDKKVRPTDSKCTDIAGPCLAHCVEAYLNQRQV

SEQ ID NO: 173060 - protein, 134 aa, Triticum aestivum
  unsure (1)..(134): unsure at all Xaa locations
  Clone ID: PAT_TA_67478.pep
SKWFDLLNVLKPVILTHQNDTPVWVLESSGSYSVSSFYKLVNFGGIPSALKDXWKINVPLNIHVFLWLIVXNKSMMLDNLAKRRXVDDMTCVFCGELESIQHLFFECIVAWNIWGIIVDIIGISIPQSFADVAC

SEQ ID NO: 173061 - protein, 52 aa, Triticum aestivum
  Clone ID: PAT_TA_67479.pep
VLCTATSPVHYYDTEGSQVSLHYPAAQQEQGGGEEMAAPAKASWMVATSVGT

SEQ ID NO: 173062 - protein, 146 aa, Triticum aestivum
  Clone ID: PAT_TA_67480.pep
SWATGYWRQEVVNDGATHVTDSSDHAFNLATQMAFKKSFPEAGGQVLEPLMKTTITAPNEFQGNILMLMNKRNATIHDTDIGSEDFTLICDCSLNAMFGFSSQLRAATQGKGEFSMEFSHYAPAPPHLQKELVAKHQAEIEAKRTK

SEQ ID NO: 173063 - protein, 200 aa, Triticum aestivum
  unsure (1)..(200): unsure at all Xaa locations
  Clone ID: PAT_TA_67481.pep
GGHETKDEMDGGKFPVSEEQVTVLGTQEIPCSLLLLEIESYMQVLNELKDARRCFYGEELDNSKQLRIKGVAGTKEVAALHTRLSEAKRKMDLLLRGDTEAASRVLKCARAHEVERKQLTGVGMEDSFLEKQVIGPLPCEAGMGGESGKXQQSQFLPCRPGIQSSDPHMIEWTKSNVKATDLTPTITKSENGDNGDVDVD

SEQ ID NO: 173064 - protein, 146 aa, Triticum aestivum
  unsure (1)..(146): unsure at all Xaa locations
  Clone ID: PAT_TA_67482.pep
AVAVALPRTPLPPPLPTSNYPLHQWSQPPTQQPQVYLHTQPAGSPPPADTWPGSGSPPAPAAVPSRPPRXPPAPRPPPPAGPAAATPXAAPPPPPPLAAPXSPPPQPPRPRGCSTPLRCAGGAGRSPVMPPRRGSPPPSWWRCPWR

SEQ ID NO: 173065 - protein, 183 aa, Triticum aestivum
  Clone ID: PAT_TA_67483.pep
VHLTCPDCAPASLPTAVLPLPSGRSPLWLYDARRPRNLPSPRSTSSCPSASPMAHGTCRLTRPSTISCVAGRTSLRAARHRIGPPVRLSYDAGLQLRPPPSPMVHDARRRPHPLASPMARGVRPSASLVANGCCCSMSRTTLQSGPATASSYTSSVFAFSMIHPLSHMICQMMTLIYRRISHI

SEQ ID NO: 173066 - protein, 140 aa, Triticum aestivum
  Clone ID: PAT_TA_67484.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSTGNAG

SEQ ID NO: 173067 - protein, 134 aa, Triticum aestivum
  Clone ID: PAT_TA_67485.pep
SFVAVHCLWNVEVKQPMSEVWDWNMYGTKLKFHGWFINTANEDGDGGEDGDGGEDDASFASEHSDDEDLTEVSILRAVQVLAIRANFRISRMDAHDWYQSFVIYVALEGEVQEEGKDLVLAGPCGILQAYGAFC

SEQ ID NO: 173068 - protein, 162 aa, Triticum aestivum
  Clone ID: PAT_TA_67486.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYG

SEQ ID NO: 173069 - protein, 186 aa, Triticum aestivum
  Clone ID: PAT_TA_67487.pep
TTLKLILLNGNQLSGFLPDEIGNLQNLNRLQIDQNQILGPIPKSFANLRHVKHLHMNNNSLSGKIPSELWRIPLLLHLLVDNNNLSGPLPTELAKAPALKIFQADNNNFSGSSIPATYSNIKTLLKLSLRNCNLQGAIPDLSAISELGYLDLSWNKLTGPIPTNQLASNITTLDLSHNMLNGTVPL

SEQ ID NO: 173070 - protein, 101 aa, Triticum aestivum
  Clone ID: PAT_TA_67488.pep
ELHGRRSLSEVAAPPSRRRRSKYLHLFTDRDERQIQLHPRNQRLTQLLHLVRALPALAESTVPDPRIRTPATSSSHGSGMHRRRRAPLRPPCPSVRRVLCR

SEQ ID NO: 173071 - protein, 166 aa, Triticum aestivum
  Clone ID: PAT_TA_67489.pep
MAAKCYPTVSDEYLAAVAKAKRKLRGFIAEKNCAPLMLRLAWHSAGTFDVATKTGGPFGTMKCPAELAHGANAGLDIAVRLLEPIKEQFPILSYADFYQLAGVVAVEVTGGPEVPFHPGRQDKPEPPPEGRLPDATQGSDHLRQVFSTQMGLSDQDIVALSGGHTL

SEQ ID NO: 173072 - protein, 38 aa, Triticum aestivum
  Clone ID: PAT_TA_67490.pep
VRANFTVITEKDYRQALRFLGMYILRASANKCPSSFCP

SEQ ID NO: 173073 - protein, 131 aa, Triticum aestivum
  Clone ID: PAT_TA_67491.pep
RPARAGAVSRAVTDAVSAALKAHPGPFPFVSLTCSFMDATDRRVLARWFQILATKGVDELVFVNRPWPLPGLPLPSSLFSCASLSRLCLGAWVFPDTTALPRGAGFPNLRELVLGCVVMKDKDLEFLLAVS

SEQ ID NO: 173074 - protein, 201 aa, Triticum aestivum
  Clone ID: PAT_TA_67492.pep
LCRMLVLKYLSLRRTEVAKIPSKIEKLQYLETLDVRETNVGVLPKAFGQLQRLRSMFGGSKNPRKALKLPQEKNKVQMKALRILSGIEITERSTGVASLHQLTGLKKLAIYKLNIEKDGPTSTQLRSSIGYLCSCGLQTLAINDESSGFINTLDSMPAPPRYLIALELSGKLERAPKWTENLKTLYKLTLSVTVLRADTLE

SEQ ID NO: 173075 - protein, 54 aa, Triticum aestivum
  Clone ID: PAT_TA_67493.pep
MLTATQLLLPALLLVAGVAGGAPSLEFHHRFSARVRRWADARGHELPGGWPPPG

SEQ ID NO: 173076 - protein, 75 aa, Triticum aestivum
  Clone ID: PAT_TA_67494.pep
LRVYVLPVSSIDGPTNSEVTWKICNSNAIRFMLTSTFLVFIDSFLPPFHHNSQLNFQILCSHVHRSCKEIFVLSL

SEQ ID NO: 173077 - protein, 181 aa, Triticum aestivum
  Clone ID: PAT_TA_67495.pep
LLFQEVDSFFKDGMEVLDCMSEVSPREEIVESYPIGSETVSNSGDEVKLIHTENTSTDHSTERSSQNLSAQGTSGIQLPVDNSCLVNSVCSVPGYQNDLAVTNVNGMLKSIAEDNCSKGILVKGSALDSSCEARPEQQEEICNRESATEVPTNYQVSTSQEHVTLLMDQVSSTKNPFNIDD

SEQ ID NO: 173078 - protein, 65 aa, Triticum aestivum
  Clone ID: PAT_TA_67496.pep
GYETVSLASAQSAVRASGAAPPDRPPSFLPIGRSAAWEGGTRSGGGEGEPGSSRPLLPLPAALSL

SEQ ID NO: 173079 - protein, 97 aa, Triticum aestivum
  Clone ID: PAT_TA_67497.pep
NAMFTFGDSMDETGNICVGSSNKTELNVLTCTHPPYGETYFGRPSCRWCDGRVVVDFFGCKGYVRKSLFMFGAYGGNDYNVQLLERGLTPEQAMNYT

SEQ ID NO: 173080 - protein, 73 aa, Triticum aestivum
  Clone ID: PAT_TA_67498.pep
MEAVASSRDWSVPVEAPSQMWWLHVGNTFQEDNSRGGLDLHLHTSACSYDWLQLEEEVGPFVQTYCQVSADGN

SEQ ID NO: 173081 - protein, 102 aa, Triticum aestivum
  Clone ID: PAT_TA_67499.pep
FLTVAKAAGIPARNYAQRRLSAPGRGLPELRRRGHRRRAPADGGIGPARVLVQMADARQAGGRGRGSRRVGRWEVGAKGGRPGAGRGEEGDRRRRVRAAGDG

SEQ ID NO: 173082 - protein, 93 aa, Triticum aestivum
  Clone ID: PAT_TA_67500.pep
AQIKATGTGVAEHRQIQGAGRGRSSRSRPRAKMRRDGRPTKDTSTVMVRRFRGTNEPKVPERAQPPWRAGSAATTADHGRRKECKSTAAGPKP

SEQ ID NO: 173083 - protein, 93 aa, Triticum aestivum
  Clone ID: PAT_TA_67501.pep
RVQCLPCGRSSKDFADVHRLVMHAYNPPNADSFVDHLGLHKALCVLKGWYYTKVPGNSKAYQSLPPDLDLANREDLIMWPPTVIIRNTTTGRN

SEQ ID NO: 173084 - protein, 67 aa, Triticum aestivum
  Clone ID: PAT_TA_67502.pep
RFRLTVKMSSDTFQSRKSKENRLRNGTCTYRWEKQKRRCRDERICTVDPLFGGLEMEGGPVLAAHDG

SEQ ID NO: 173085 - protein, 127 aa, Triticum aestivum
  Clone ID: PAT_TA_67503.pep
CTALPSSIKRVFYMSSEGCNLLHEVFPEANHTVLEQLSKVDCIVYAMGSLFTSVCPSLVLRGIGETIASRSIPKVLLLNGSHDRETIGLSASGFVTAITDSLNRTYGDPDKSLKYHPKDYVNAILVP

SEQ ID NO: 173086 - protein, 205 aa, Triticum aestivum
  Clone ID: PAT_TA_67504.pep
RHLHPYPTGAATHHRLSATALWPFPSIAPALPASAGYWIHSSARLQQASKHRQAKTTIMDIPDKSSLDMDKTTSVFSNQILMGTSMDPTCAFSNQILMGTSMDPTCAFSNQILMGTSMDPTCALSGATTPPDGLSDAEHPKSYQVPSRLMTRARARALESEVTSLLLQLPFESYETWLLPQTETLCILRYQGVSHGEAKEQGGSE

SEQ ID NO: 173087 - protein, 189 aa, Triticum aestivum
  Clone ID: PAT_TA_67505.pep
MPAAAAAAPGTAVASYTDYIPDSVKSFVSDLYRSIRGGDVVGTDKLYEGDFRRLSARVYRDKPWPPAKAVASYCDDDHVFLLLYSELTSRHAHARLPGLTLTHGADSWDTYCSLFTVVLQNVLTMQLPNQWLWDMVDGFVSQFQRFCEYRTKLEDKTEEEISLLKRFDQAWSVYGVFNYLKALVENSMI

SEQ ID NO: 173088 - protein, 87 aa, Triticum aestivum
  Clone ID: PAT_TA_67506.pep
MIIALQDLIAPQAFQASELLQEIKSFLLVAPPRDGTMKHTTSDSDVTSLATTSPTRSPKRAAYYVVSPSRDSRDDGDKCSSTQATPV

SEQ ID NO: 173089 - protein, 144 aa, Triticum aestivum
  unsure (1)..(144): unsure at all Xaa locations
  Clone ID: PAT_TA_67507.pep
VSDLGALSAVALEPALIRVPLLVGVXCAETPAPSPPPPCPPLPSRSGDPAKNGPMASARRLLQTYPGQFQAAEPPDALGPDSDVVVILAALLCALLCVVGLAAVTGCARSRRDAGGARSAASSSGPGASKGLKKRALMALPKLA

SEQ ID NO: 173090 - protein, 92 aa, Triticum aestivum
  Clone ID: PAT_TA_67508.pep
LAPSSASLELAPVRPAAGAMLPIGLHVVIHSAYHTTTCRWRRPRLASKGGLHLQVYSRCVHVTLARTCAGFLLVERSQHGSASTCESYCSPN

SEQ ID NO: 173091 - protein, 84 aa, Triticum aestivum
  unsure (1)..(84): unsure at all Xaa locations
  Clone ID: PAT_TA_67509.pep
VPQTIGNDILLMDNTXGFDTAVEAAQRAINSAYIEAHSAFHGIGLVKLMGRSSGFITMHASLSSGQVDICLIPEVPFTLDGPNG

SEQ ID NO: 173092 - protein, 56 aa, Triticum aestivum
  Clone ID: PAT_TA_67510.pep
RRHPRSRPPAAMDPQVTLHTRRSRRPRPRDAGCWLKSAALHPVRLPPSPARLPHRR

SEQ ID NO: 173093 - protein, 66 aa, Triticum aestivum
  Clone ID: PAT_TA_67511.pep
PARMWLSLSVGLPLLLKSTEIHRSPLPSDAIADLSLRLQSHPPSFPCGLHAVFLRSGPGSPVASLA

SEQ ID NO: 173094 - protein, 86 aa, Triticum aestivum
  Clone ID: PAT_TA_67512.pep
SRRQIRDERMRSPVACSWDELAMAFQLTDDVASGHRDCWNSMQKCWNRQPMVLEPAVLACFQQHFYDAELQPAHGNAGTNVIFCFH

SEQ ID NO: 173095 - protein, 91 aa, Triticum aestivum
  Clone ID: PAT_TA_67513.pep
DGLQANEIQYKIEWLKKGKPMDLPLCPIWPFSRSSRTRTRPRYTHVQLDRNGVARRRPAGRRAGPGRQLHLRPQARRPARLRRRLPLHPHG

SEQ ID NO: 173096 - protein, 68 aa, Triticum aestivum
  Clone ID: PAT_TA_67514.pep
LNKFVKLKLFQREKNAFLPCFLYIKNFVGVSKPIKKLKHTIFLSLGWKMFRQVLAWCLSHNAASKNRG

SEQ ID NO: 173097 - protein, 71 aa, Triticum aestivum
  Clone ID: PAT_TA_67515.pep
DGHPPLGWSDTMAYLVLPILLVISQYVSAQIVQSSQSNDPSQQGAQAAVKFLPLLIGYFALSVPSGLSLYW

SEQ ID NO: 173098 - protein, 109 aa, Triticum aestivum
  Clone ID: PAT_TA_67516.pep
PMSAPQTWSVSQLKEWIAASLGLDTETHTVSVHALWTRSSTIIYFYLRPIERDSDWVRWLQGCERMGCNPIALVLPVVNGVTAHEGQGGNDPEQSIVCRRLSMSNAGDD

SEQ ID NO: 173099 - protein, 63 aa, Triticum aestivum
  Clone ID: PAT_TA_67517.pep
LRSKQNIVECFVTEKTNVHIFNSTCALRQYVMSPYASGTLTRCTVYGHARPNPYDLSSNLRGG

SEQ ID NO: 173100 - protein, 84 aa, Triticum aestivum
  Clone ID: PAT_TA_67518.pep
LLTCVQKTEQLHMLFAWLLHAFLMGVFPSLISGACILRSPASCTYLLVRNRTYIVQIRFAALATPVSAFFAFFFSLLFERWTSS

SEQ ID NO: 173101 - protein, 110 aa, Triticum aestivum
  Clone ID: PAT_TA_67519.pep
MDKDSLKSTLEEVRKSVVRISFDWKREENMENMVIAGLVTSVVDELATIIANPVFFRRSNEFSVRLPQNGGYGELIKISCSLVKYPTNNFFTFLLELKGNAYRKPVNFEL

SEQ ID NO: 173102 - protein, 52 aa, Triticum aestivum
  Clone ID: PAT_TA_67520.pep
MSSSSGASLGGQPPPAAPPEEEKKNLNSVLWHACAGPLVCLPTLGTRVVYFP

SEQ ID NO: 173103 - protein, 96 aa, Triticum aestivum
  Clone ID: PAT_TA_67521.pep
PHARCRMPRYGWLGLALRRFGLAMAGERYSSQDAMIPVGSGSLRTSPSSAATNSRKAASQSSESSSVGQPPRIFAFPADGDWPGRPLPRSLVANFL

SEQ ID NO: 173104 - protein, 98 aa, Triticum aestivum
  Clone ID: PAT_TA_67522.pep
LDDPLEQIVVMDVNITHHVRRRSPLPSCYAPFCHHNKPGKTKRNQRRSQANRAGSGGIRDLAISLLCWLLSPPLSPRPPLLLLWLRRSSWTPAMLLTA

SEQ ID NO: 173105 - protein, 53 aa, Triticum aestivum
  Clone ID: PAT_TA_67523.pep
INLQMLTLRGCHNSASLGALCPAPLSPESMFGGELVQTWKLKVLVVKVHSAAT

SEQ ID NO: 173106 - protein, 53 aa, Triticum aestivum
  Clone ID: PAT_TA_67524.pep
DGCILFSMVTFYLDFFLSCLNTIRLFSLLIFFCFCHFFLLIHAPNTHVLKIYV

SEQ ID NO: 173107 - protein, 174 aa, Triticum aestivum
  Clone ID: PAT_TA_67525.pep
MAPKADKKPAAENKVEKAAEKTPAGKKPKAEKRLPAGKTASKEAGGEAKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSCYTDPASLAVTCLWTLTLLMYL

SEQ ID NO: 173108 - protein, 65 aa, Triticum aestivum
  Clone ID: PAT_TA_67526.pep
RGVRLAGDLGRWPTDMVGEERCECQLVGFPPPFTLRRGQARVGEASGQGGYHGDGRWPRRLRRSR

SEQ ID NO: 173109 - protein, 129 aa, Triticum aestivum
  Clone ID: PAT_TA_67527.pep
ISTHPRIVLPNRRREPAAASDHRSVLPRPGSHGSHSRPIAQRPHLAPGCCHAARAPAAALGGVRGWGRGRSRGVGIGTEAAELGRTGERGDAVVPVEDAPVERGRRRGGRGRVEEVGAAGTARPARALA

SEQ ID NO: 173110 - protein, 100 aa, Triticum aestivum
  Clone ID: PAT_TA_67528.pep
PPPCPPATLPPPAPSSVAASPPLPYPSLSRRPPLRASPYPLFHGAPPRGGGGCPDWRPSAWGDRGGTAIDTFYLTDQQLRDSPSRKDGIHEAAETTLRVY

SEQ ID NO: 173111 - protein, 141 aa, Triticum aestivum
  Clone ID: PAT_TA_67529.pep
AVVLAPTNPRDEYQHWYKDMRHSTRVSDAEGHPAFALVNKATGLAVKHSLGQSHPVKLIPYNPEYLDESVLWTESNDVGKGFRCIRMVNNLNLSFDALHGDKDHGGVHDGTGVVLWEFCKGENQSWKILPWGADGGYGYGY

SEQ ID NO: 173112 - protein, 100 aa, Triticum aestivum
  unsure (1)..(100): unsure at all Xaa locations
  Clone ID: PAT_TA_67530.pep
GNAGLPPLPPPPRRNKDHHQDELVGGFQEPQVIAYILGGSQAPASHNIFKXYAREVNPALPKPKATHPLSWSKCAINFSCLDQLKCTGTAGVLPMFCSPI

SEQ ID NO: 173113 - protein, 82 aa, Triticum aestivum
  unsure (1)..(82): unsure at all Xaa locations
  Clone ID: PAT_TA_67531.pep
MADHLTDNHIAEFNEAFTLFHNXGDCCITTKELXTAMLSLWQNPTEAELQDMINEVDADRNGTIDFPEFLNLMARKMKDTDS

SEQ ID NO: 173114 - protein, 111 aa, Triticum aestivum
  Clone ID: PAT_TA_67532.pep
APRTPSPPNQHSQPRKIPRSRMGGRQRKEINTSRSEHDALELDSAAHQQQPRNGISLRWRRRKEETGKGGSPLTAKQISCAGAVPRVSPVATLLLCMDGDGDGDGGRRGQA

SEQ ID NO: 173115 - protein, 104 aa, Triticum aestivum
  Clone ID: PAT_TA_67533.pep
FQKHSVSTCSSIIRPYSIISFISQNIVISLCSHYRRTIDSLKDIRQTPNTQILMHSCQNKQTPVYQKYLGMSPGGGCGQVTRFERGKMRTWCSWAHEVGASDQT

SEQ ID NO: 173116 - protein, 75 aa, Triticum aestivum
  Clone ID: PAT_TA_67534.pep
MKALAGDSNASAPLLQEAKISIPASSTGGAAEAALLGKGRYNVWALAAIALLSLWSMSAASVSLRWSAGDLAAVI

SEQ ID NO: 173117 - protein, 123 aa, Triticum aestivum
  Clone ID: PAT_TA_67535.pep
IRDCPNITSLPESIRNLTALEELYISGSSGLVRRSRREDAYKVSHIRKVVFELEEPNEEQGQEESQEAWMNRLSKKYGENPSRHREEREELESQMSDSDSEHLSRYGQEDSENEDDEQDDWYL

SEQ ID NO: 173118 - protein, 109 aa, Triticum aestivum
  Clone ID: PAT_TA_67536.pep
EAFYGDNHRAMFKYATEADPSRLIHYEGDEQAETTHMYSYVYPTVERLIKYAKDEGVKDGKFEKPIVLCEYGHAMGNGPGWLEDYEQAFRDYPRLQGGFIWEWANHGLW

SEQ ID NO: 173119 - protein, 152 aa, Triticum aestivum
  Clone ID: PAT_TA_67537.pep
LNEFGEALTKIIGLICILVWLINVKYFLILELDGWVPRNIRFSFEKCTYYFEIAVALAVAAIPEGLPAMITTCLALGTRKMAAKNALVRKLPSVETPGCTTVICSDKTGTLTTNQMSVSKLAAIGDAPGKVRSFKVDDTSHDPRDCKIYYWP

SEQ ID NO: 173120 - protein, 67 aa, Triticum aestivum
  Clone ID: PAT_TA_67538.pep
QLHTTVLKLLVFNKTVWKPLNYKSRMVKRPNEIPADIHIYITSAQNNHFGQRMTPRTVNTRVNKLPA

SEQ ID NO: 173121 - protein, 103 aa, Triticum aestivum
  Clone ID: PAT_TA_67539.pep
ASNFLLHHLQRISFLLVAFAPHACWSAHFAPLGCQGAAQAIHDADEAPPRTGYETADVSATTRLGRGMPPGAATVPLLSRDLSNSGTVIFIGAATSITKRRRR

SEQ ID NO: 173122 - protein, 42 aa, Triticum aestivum
  Clone ID: PAT_TA_67540.pep
QLSPQIMDVHISTTLELNLESPALVLQVQRSTTENVNMRFSN

SEQ ID NO: 173123 - protein, 203 aa, Triticum aestivum
  Clone ID: PAT_TA_67541.pep
RCGIYGGNSPEWVVSMQACNAHGIYCVPLYDTLGAGAIEFILCHAEVEIAFVEEKKIGEVLKTLPNATKFLKTIVSFGKVSPDEKEKVEQNGLSIYSWSEFVLKGDGAEEKYELPPKDKADICTIMYTSGTTGDPKGVLISNKSIITIVSAVDEFLHNSNEQIPEDDVCISYLPLAHIFDRVIEEVFIHHGASIGFWRGDVKL

SEQ ID NO: 173124 - protein, 170 aa, Triticum aestivum
  Clone ID: PAT_TA_67542.pep
MTGMAVARLAVALLLLATGCAGRDFAVGGRAGWTANPAEPFNHWAERNRFQVNDRLVSRYKGQEDSVLVVSPSHYDACNTSDPFMRLGGGESGFVLSYSGPYFFISGDAGRCQAGERLIVVVLAVRTPSPAPSTPSPPPLSPPSSPPPAPAAAGNSSTSPPPALAPPAAG

SEQ ID NO: 173125 - protein, 201 aa, Triticum aestivum
  Clone ID: PAT_TA_67543.pep
INANHVGIDINGLQSLRSYNAGYYDDESGDFRGMKLISREAMQVWIDYHGERKEINVTLAPFDMGKPARPLLSASYDLSTVLTELVYLGFSAATGRVNSRHFVLGWSLGVSRQAPAIDMAKLPKLPRVGPKPRSKVLDIVLPIVTATFVLGLGGILVLVMRRRSRYAELREDWEVEFGPHRFLYKDLFRATDGFKDKHLLG

SEQ ID NO: 173126 - protein, 85 aa, Triticum aestivum
  unsure (1)..(85): unsure at all Xaa locations
  Clone ID: PAT_TA_67544.pep
NECGKKFSRXDNLAQHARTXGSGAIVMNLIDDDSHAYDASMVSADDYSNYGKVLFHIASEVPGSASELSSDEGSNQDKKKRKRSD

SEQ ID NO: 173127 - protein, 149 aa, Triticum aestivum
  Clone ID: PAT_TA_67545.pep
ADKKPAAESKVENAAEKTPAGKKPKAEKRLPAGNTASNEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 173128 - protein, 158 aa, Triticum aestivum
  unsure (1)..(158): unsure at all Xaa locations
  Clone ID: PAT_TA_67546.pep
RPRVPPPQQPVLPRRRPQPPARQQAPPPPSPPRPPPALPQPRPPWSLSRPRLAPRPPARPQLRARAPWSPPSQRRPAPPPXSPQPRRGQQALRLRPPPAWGPPPSSRPPRRPGVSPPRAPPPSARPPGSGHQQWPLPSWMQENARSGRRWLAQASATV

SEQ ID NO: 173129 - protein, 128 aa, Triticum aestivum
  Clone ID: PAT_TA_67547.pep
FFFFFFLSSCNNRSISIITVQRPKRHPPNYYVYFLTYLRPTGNQFYLSSLSKLFFTGAKPMLKTRNRMQSILSYLSKLLYTSKRMLKTHGGFVLLCAVHPSQNKTKLLRREFDRPTFETWKSNKGANS

SEQ ID NO: 173130 - protein, 204 aa, Triticum aestivum
  unsure (1)..(204): unsure at all Xaa locations
  Clone ID: PAT_TA_67548.pep
WCIPHLGDTKGRTPIDLLSGPVSQANGDSPNSVATEVFSWGSGTNYQLGTGNAHIQKLPCKVDALHGSYIKTVAASKFHSVAVSSDGELYTWGFGRGGRLGHPDIQSGQTTAVITPRLVTVGLGRKKVNVVAAAKHHTVIATSAGELFTXGSNREGQLGYPSVDTQPTPRRVSSLKQRIIAVAAANKHSAAVADTGEVFTWGSN

SEQ ID NO: 173131 - protein, 55 aa, Triticum aestivum
  Clone ID: PAT_TA_67549.pep
DSFWNQAIRRILSLLPGSQRSRSPSRRRHPPSSRRRQRAGARVLALNLRCSALIT

SEQ ID NO: 173132 - protein, 123 aa, Triticum aestivum
  unsure (1)..(123): unsure at all Xaa locations
  Clone ID: PAT_TA_67550.pep
LGEGRSGGERLSKYSTQGLDEFKNEVVLIAKLQHVNLVRLLGCCVHGEERILVYDYXMENKSLDMLLFDKARSAQLDWPKRFDIVLGVARGLLYLHQDSRFKVIHRDLKAGNILLDGDMNPKI

SEQ ID NO: 173133 - protein, 50 aa, Triticum aestivum
  Clone ID: PAT_TA_67551.pep
IAPHQRECYIHHRTITYSHELTKNHLLTNFHWSKQPCGDPKESFIPFSKF

SEQ ID NO: 173134 - protein, 83 aa, Triticum aestivum
  unsure (1)..(83): unsure at all Xaa locations
  Clone ID: PAT_TA_67552.pep
KFLGVAINNESFVSWMGTRVWLNFFYDLWPMEGGLCQGTXELHWIILFQFPSSLQHFFLILTNRVMKMASSTIFTSRLYVLCT

SEQ ID NO: 173135 - protein, 177 aa, Triticum aestivum
  unsure (1)..(177): unsure at all Xaa locations
  Clone ID: PAT_TA_67553.pep
SPVAKRDDLDGEERFYLKKVSXKKSNYVPIGRRGVFGGVILNMHLHWKKHDTVKVICKPWGPGQIQEYANEIARVSGGVPINVIGNDTIVFYRGKDYVQPEVMSPIDTLSKKKALEKSKYEQSLETVRRFIAISEKELELYYRHVALYGKPQPQNADLVHGGGSPASSPEMEELNHG

SEQ ID NO: 173136 - protein, 70 aa, Triticum aestivum
  Clone ID: PAT_TA_67554.pep
MRRSSSGARVSEGGDAFSSGHRGDGTALPTFDPQSAAGRREAARTRALGRAVHCIPLLLLLCALVLWLSA

SEQ ID NO: 173137 - protein, 127 aa, Triticum aestivum
  Clone ID: PAT_TA_67555.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGI

SEQ ID NO: 173138 - protein, 110 aa, Triticum aestivum
  Clone ID: PAT_TA_67556.pep
RNNAVTRSVKAGLHFPVGRIGRYLKNGLYAHRVGSGAPVYLAAVLEYLTVEVLELAGNAAKDNKKTHIIPLHLLLAVLNDQELGKLLAGVTIAHGGVIPNINSVLLPKKS

SEQ ID NO: 173139 - protein, 74 aa, Triticum aestivum
  Clone ID: PAT_TA_67557.pep
QRPSYQTYSPSFLPCFSLSLPLFSRFSLPHSFAQCRDCGKQVYLGGFDTAGAAARAYDRAAIKFRGVEADINFS

SEQ ID NO: 173140 - protein, 85 aa, Triticum aestivum
  Clone ID: PAT_TA_67558.pep
GGQGDHRSSRRRQRRRRPRGHPSRPKARSFSAISARAAAASCCSPRSSPSSPASRLSLHLLDGASFFLLACGFTLWRLEGEGEGE

SEQ ID NO: 173141 - protein, 122 aa, Triticum aestivum
  unsure (1)..(122): unsure at all Xaa locations
  Clone ID: PAT_TA_67559.pep
NVQQPGFTHPSWKKASIPLKSGCVKYYVTEVKPGFNEFALKNVLXDFDEHRILGETLLHHIQCPRKEIDFMDEIPEAPPRATNVAPQPVTLSLPQQLSHASPKEPNTRNPTADASTCDQPTR

SEQ ID NO: 173142 - protein, 81 aa, Triticum aestivum
  Clone ID: PAT_TA_67560.pep
FTYVVMHRLIAIAPIEHARDDICLIFFSRKDICLNLYIGAVLVGGGYGHVAAASVITLFLGDHIAGAVLYTHVAIPGLATM

SEQ ID NO: 173143 - protein, 100 aa, Triticum aestivum
  Clone ID: PAT_TA_67561.pep
ALLTARAGEAASVCMSGRSSRREGVVTCNERVCSDNLTGDRLTFKANKHTYTVKCHKGRKQSALYGRGWRKFVAHNKLGKGQMVLFYLDQHSPRAVVCVV

SEQ ID NO: 173144 - protein, 170 aa, Triticum aestivum
  Clone ID: PAT_TA_67562.pep
ALTAHVNAGRHGDALAWFAHMASDPALPPLADPSCTYALPLALESAAALRLPSSAAAAPIHALARKCRGLLSNPFVASALVVSYGACAGSSPESARRLFDKLPGRTAVVWSAMISVYVRSGDVASAARALCEMDVVPTASCFVSVIAAVAESGDRPARAVYLYRRMHGMG

SEQ ID NO: 173145 - protein, 80 aa, Triticum aestivum
  Clone ID: PAT_TA_67563.pep
PCRRPCRSSSSPPPDPTGLRRPRPFPAGSRQQGPVPVSGTSRPTPEPSARAGAPPPCFAPRPTPATSPSPPATGAPSYLR

SEQ ID NO: 173146 - protein, 160 aa, Triticum aestivum
  unsure (1)..(160): unsure at all Xaa locations
  Clone ID: PAT_TA_67564.pep
HFKPSIDKTAPLFRKNKQRTPPRPLARPRPLAPAPPPPPFALCPFLAAPPEPPAAPPXPPEPPATPFAAGSPSSREPPSSPSIAPEPPRSRPSPWPAGRRAALRRGPQVPQPPPWSHPSPQXPPPEPPFATCLLPSSRPALTALVFKPKIKLLLRTNEGV

SEQ ID NO: 173147 - protein, 141 aa, Triticum aestivum
  Clone ID: PAT_TA_67565.pep
PPSPMMESTRMPYTCHGQSVRLAVWHKRVCSAVQFFAGPMYLSLHPMRSSLLLACSAIFCSFAASVSFSELLCDLNLLQGKSSSKHVVMWFNLPCIYDLIAIYFLARFAITRWLATFRSLVASCTDRRSRVLQPCSHLPPL

SEQ ID NO: 173148 - protein, 172 aa, Triticum aestivum
  Clone ID: PAT_TA_67566.pep
IGTRLLHTHSLLCFFFLKSLHPWHLMLHAETACTAVDFLLPCSAQPLPCRSVGHVRHHRGSGMIFCCIIFAGTAICFCWKHLSFLQHIERMLVPSLYDFLLHPFFLLEPLHFFLEAELGFATMLVRWLPSILLHRFFWLELAISFATSSRKAELELVRFLSKTIGGSVLLEL

SEQ ID NO: 173149 - protein, 64 aa, Triticum aestivum
  unsure (1)..(64): unsure at all Xaa locations
  Clone ID: PAT_TA_67567.pep
TYDTIIFFLKXSRIIFHRNTNAYQGITLNSRKXFNRPMHGHVYXLSNSQIPIKGRRSCPNERKK

SEQ ID NO: 173150 - protein, 188 aa, Triticum aestivum
  Clone ID: PAT_TA_67568.pep
MDLRLGYHQIKIRNRDIPKTAFVTRYGQYEYTVMSFGLTNAPATFSRLMNSIFMEYLDKFVVVYLDDILIYSKNEEEHAEHLRLVLKKLREHRLYAKFSKCEFWLSEVTYLGHVISGKGIAVNPERVQAVLDWTPPESVKQVRSFLGLASYCRRFVENFSKVAKPLTELLKKDKKFEWTPQWSTAFRN

SEQ ID NO: 173151 - protein, 67 aa, Triticum aestivum
  Clone ID: PAT_TA_67569.pep
GTDTSCTAPEHPFSVSDEPARASLLVFEDKRHRRRWLEGVMVAQFVAGIQLLVPPQQEEVWIMNCIY

SEQ ID NO: 173152 - protein, 151 aa, Triticum aestivum; identical to SEQ ID NO: 151947
  Clone ID: PAT_TA_67570.pep

SEQ ID NO: 173153 - protein, 151 aa, Triticum aestivum; identical to SEQ ID NO: 151947
  Clone ID: PAT_TA_67571.pep

SEQ ID NO: 173154 - protein, 199 aa, Triticum aestivum
  Clone ID: PAT_TA_67572.pep
FPTSGSNHPRCLRLELEPVGEAPPRPPSLRSIHRHVSRGRRPIQGLGVRSLIRATPAHTIDGAPPLHRKRHEALTGRSGRGRCAGSMSRRHGRFNHDGDQGARPAAAPAVVDHADCTAQSCRSCVAVSLADCIALGCCPCAVVSLLGLALVKAPLAVGRRCVQRLRRRHGKLQHKKRVRDMDLAGGRPGPSAAGAKCAG

SEQ ID NO: 173155 - protein, 62 aa, Triticum aestivum
  Clone ID: PAT_TA_67573.pep
MAMASSSGLRSCSAVGVPSLLAPSSRSGRSGLPFCAYATTSGRVTMSAEWFPGQPRPAHLDG

SEQ ID NO: 173156 - protein, 85 aa, Triticum aestivum
  Clone ID: PAT_TA_67574.pep
LNMTAAALLTFLSPQVLRGIRVAPRSTAGFTRHRGTFARRTGKAIEPQLLKADPTLNLNTSHPLITDSAIRPETSTATTTATAQE

SEQ ID NO: 173157 - protein, 159 aa, Triticum aestivum
  Clone ID: PAT_TA_67575.pep
FQGLKSTAGLPVSRRSSASLGSVSNGGRIRCMQVWPIDGIKKFETLSYLPPLSTEALLKQVDYLIRSKWVPCLDFSKVGYVFRDHNSSPGYYDGRYWTMWMLPMCGCTDATLVLNEVEEVKNEYPDAYVRVIGFDNLRQVQCVSFIAFRPPGCDESGKA

SEQ ID NO: 173158 - protein, 82 aa, Triticum aestivum
  Clone ID: PAT_TA_67576.pep
RCRIPSYLATAAALLLAFLLPPLAASQWQNCGKNGNFNQNSTYQANIQALSVTLPKNASSSRTLFAADSVGTVPDIVYALAL

SEQ ID NO: 173159 - protein, 75 aa, Triticum aestivum
  Clone ID: PAT_TA_67577.pep
FTKWSEWFAILPISLSLVSGLYQLHLVALILAIASRTALHDRPIATFRPQNHGIKTQLSIIVTFTWKKLSNIRVE

SEQ ID NO: 173160 - protein, 40 aa, Triticum aestivum
  Clone ID: PAT_TA_67578.pep
VFGRNGGLSFFFLSSFTHVALLLSFGSVGSRLKASYFSVT

SEQ ID NO: 173161 - protein, 103 aa, Triticum aestivum
  Clone ID: PAT_TA_67579.pep
FLMTLNVPQGCGEETALLKVGCVYKDPLMKETINMAEVQVKISRPAFVSVQTVSIQVDRQKNRLHAAEVMAAARFSAERGELAHAVSLLEDCRRMIMGSASGQ

SEQ ID NO: 173162 - protein, 127 aa, Triticum aestivum
  Clone ID: PAT_TA_67580.pep
NQALLQMQDIHSSVSALQYYSGVQPSIRGRHVYMQFSSHQELTTDQSSHSRNSDQESEPNRILLATVHHVLYPITVEILHQVFKAYGYVEKIVKFQKSAGFQALIQYQSRHEAVEALAALHGRNIYD

SEQ ID NO: 173163 - protein, 68 aa, Triticum aestivum
  Clone ID: PAT_TA_67581.pep
WNPVVVLTEAIWAGMGLWRGHSRLVAQHKLYSFTQYIETATSLVSVPSSYCYCRSIVRRPVYVHVLQI

SEQ ID NO: 173164 - protein, 103 aa, Triticum aestivum
  Clone ID: PAT_TA_67582.pep
MNGFYSSIAHGLDALHATLASSPDAAFMSAPFLQQAAALLRSLHSQLVHLVQRLHLPPGESWLDEYMDETSRLWEACQVVKAGASALDTYCASAARIDAALDD

SEQ ID NO: 173165 - protein, 109 aa, Triticum aestivum
  Clone ID: PAT_TA_67583.pep
GACGCFVVRPCGCLFLLFREIALIGSSSDLPCCFIYSKDHLSLQYFQVNYTEENLLDYIDPNNDTLMVRLADDHLVAKCRIMVATDKRATITTNWSEFRRRANIREGDV

SEQ ID NO: 173166 - protein, 126 aa, Triticum aestivum
  Clone ID: PAT_TA_67584.pep
RDLVGITGTRDQEIIELLSEGDDMSKKKLKIISVVGFGGLGKTTLVKTVYDKIKGDFNCRAFVPVGRNANAKEVFMDILHELDPEKDKGQLTMLNERQLIDKIQLRLENKRYVHISHATHLMMVTS

SEQ ID NO: 173167 - protein, 131 aa, Triticum aestivum
  unsure (1)..(131): unsure at all Xaa locations
  Clone ID: PAT_TA_67585.pep
VPDFQRGAPPNTPKEKFNKIHSSKRNCIERTFGVWKMKWQILLKMPNYSFQTQMKIVAATMTLHNYVRLHDKDDIHFVRCERDPDYVPTIPDRYKKYAIPSSASDASTXGXKCPDMDRFRNELATAIALGW

SEQ ID NO: 173168 - protein, 66 aa, Triticum aestivum
  Clone ID: PAT_TA_67586.pep
FFFFVHTATYLLNIRPSKVNPQTTPYFSLFLSHPNYSDIRVFGCLCFPNSYSISPNKLFPRSIPCG

SEQ ID NO: 173169 - protein, 48 aa, Triticum aestivum
  Clone ID: PAT_TA_67587.pep
CGYWYGWVQDFFNPLVFQGSSRTHQTSQRCKALPVIKPYLRIIRFQGF

SEQ ID NO: 173170 - protein, 47 aa, Triticum aestivum
  Clone ID: PAT_TA_67588.pep
VPFNMYIKAGYDIVQTDSILVWLSLQKRKHLMRKELPQVSVGSDVQP

SEQ ID NO: 173171 - protein, 104 aa, Triticum aestivum
  Clone ID: PAT_TA_67589.pep
MAAIMLCTCSGDQSKFEEMPRSPESLATRDFSASGSCSRPGKREATPDDSQVNEVESDLRETLSLNYEEARALLGRLEYQRGNFDAALQVLQGIDIRSLKPRMT

SEQ ID NO: 173172 - protein, 141 aa, Triticum aestivum
  Clone ID: PAT_TA_67590.pep
VRIGDHAPEVEQGILVGSSIMKPDRTELAHGISRVNRVTTSPQRTISWDILVFAVGWFESEDNSWFKANNNCSLHPIFRWYRRCKGKHVTCQWVEETSSMREIPGPEDEETAWPRQSARRGRRPSCPCTRRRRWWRGRGRR

SEQ ID NO: 173173 - protein, 146 aa, Triticum aestivum; identical to SEQ ID NO: 105633
  Clone ID: PAT_TA_67591.pep

SEQ ID NO: 173174 - protein, 41 aa, Triticum aestivum
  unsure (1)..(41): unsure at all Xaa locations
  Clone ID: PAT_TA_67592.pep
SSTSCQFSTPDXAHLXTNXMCPALPSQSTGXGWFACPXRGR

SEQ ID NO: 173175 - protein, 135 aa, Triticum aestivum; identical to SEQ ID NO: 130416
  Clone ID: PAT_TA_67593.pep

SEQ ID NO: 173176 - protein, 124 aa, Triticum aestivum
  unsure (1)..(124): unsure at all Xaa locations
  Clone ID: PAT_TA_67594.pep
MPEITIQTNVSSDKIASDLQEIVVELVSQHLNKPKANICVTVLTDLWMSFGESEEPCACCTVTSMCRLQRRNLRKXAALLMPPLQKALGVSGTRFYLQFHEITAGIMGFQGTTVKVVRERKQSS

SEQ ID NO: 173177 - protein, 69 aa, Triticum aestivum
  unsure (1)..(69): unsure at all Xaa locations
  Clone ID: PAT_TA_67595.pep
FFXXFFFFFFFFFFFFFFFTEEHKFKRLIQLFCYIQPYSGIEVVFYSDIHNVGIMNNTGNIVMAKSELI

SEQ ID NO: 173178 - protein, 77 aa, Triticum aestivum
  unsure (1)..(77): unsure at all Xaa locations
  Clone ID: PAT_TA_67596.pep
IAPFPRPXRSPWXSPMTAALRSTAPSSXXXEERSXHPTQPXQPXSPSXPTPHDVSPPISLTXTSPPXMAAPXLSSPP

SEQ ID NO: 173179 - protein, 196 aa, Triticum aestivum
  Clone ID: PAT_TA_67597.pep
RSDEELGSLPELALSTQDYLSLRETSSQLLDGHRTYLKPQKDCRVLIGGFRCPDALPTALRSEEQLSELVRECPDNSIIQEKMKILSKHYVLFRRTRQDGSCFYRAFLSSYMEILRQMQDKQAEVTRLMECFEMYTDRFSRLKWDEAYFLNPEKYFSSVVSELNEVLNVIAAGCTSEWLYQRSLQESFSGRIISFL

SEQ ID NO: 173180 - protein, 56 aa, Triticum aestivum
  Clone ID: PAT_TA_67598.pep
KEIAGLGDILGPNFVGLQAQTTHMRDTTKAHLYTQNLGTLINLLTVLSSCSYQVGT

SEQ ID NO: 173181 - protein, 198 aa, Triticum aestivum
  Clone ID: PAT_TA_67599.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHSSSQYPDVN

SEQ ID NO: 173182 - protein, 110 aa, Triticum aestivum
  Clone ID: PAT_TA_67600.pep
MCSMIRRFVHLIVHDVKGGAGGGGYALRNIDTKPLFAGIGGGSTSMAVTTRLPRPAAFFESANTDNNNHTEFFLLGSKIVSVNMNRRTVLYDSLTSGISGGPDLRHCKFV

SEQ ID NO: 173183 - protein, 146 aa, Triticum aestivum; identical to SEQ ID NO: 108767
  Clone ID: PAT_TA_67601.pep

SEQ ID NO: 173184 - protein, 196 aa, Triticum aestivum
  unsure (1)..(196): unsure at all Xaa locations
  Clone ID: PAT_TA_67602.pep
MSKDFSNLRVYAIDVDEADELDDALSATRLPDGRIKVWIHVADPTCFLQPRSILDREAMHRGTSIFLPTATFPMFPERLAMNAMSLQQGTDCRSVSVSVILHPDGSIAEYSIENSVIKPTYMLTYEGATELLYMNLEEEEDLRILQEAASIRAQWRRSXQGSIDTAMIEPRIKVANPDDPEPNINLYVEDQTNPAM

SEQ ID NO: 173185 - protein, 78 aa, Triticum aestivum
  Clone ID: PAT_TA_67603.pep
AAEYHLVDVFERANHCAIHAKRVTVSKFSLNENFLSFTILCRRKHASYERVSITRSPLLSFDVVSSFDVVSRFKNSND

SEQ ID NO: 173186 - protein, 137 aa, Triticum aestivum
  Clone ID: PAT_TA_67604.pep
RSIHGTQPPKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 173187 - protein, 137 aa, Triticum aestivum
  Clone ID: PAT_TA_67605.pep
MRSGRGGMPPWLMGGLDMHNSAAWGLNAGASGWGHQGDTGVSTSSLMPGAQTAGPSSKGGADIQPLQIDESVSFNDIGGLSEYIDALKEMVFFPLLYPDFFANYHITPPRGVLLCGPPGTGKTLIARALACAASKAG

SEQ ID NO: 173188 - protein, 39 aa, Triticum aestivum
  unsure (1)..(39): unsure at all Xaa locations
  Clone ID: PAT_TA_67606.pep
AEXLKMXIIPNPKEXDGVKVLXXETAXGAXIRFFEKAIX

SEQ ID NO: 173189 - protein, 203 aa, Triticum aestivum
  Clone ID: PAT_TA_67607.pep
GNRGRATNNAPKHRKTDSPVQRWRPVSTQASSPKAHLDDLSNSARKQTVGTSISDSENLASDENTMEVMGEKYPSSVEVDVPLMRFLKGKGGSVQKQIEQETGVKIIFPSAKEETLVALEGKSAESIRKASERISKILEEAVQSPMLDYSHFISLPLAIHPALVEKLNNFQRSILGASASNVDSDKDESLSEGSMEEIDEAAN

SEQ ID NO: 173190 - protein, 308 aa, Triticum aestivum
  unsure (1)..(308): unsure at all Xaa locations
  Clone ID: PAT_TA_67608.pep
RGSTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXESTLHLVLRLRXGMQIFLKTLTGKXITLEGXSSDXIDNVXGQIQARXDFPGPQXLXFXGXQLXEGXTLADYNXXKGPSP

SEQ ID NO: 173191 - protein, 105 aa, Triticum aestivum
  unsure (1)..(105): unsure at all Xaa locations
  Clone ID: PAT_TA_67609.pep
GFRTLLLLDGALVADVDTAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 173192 - protein, 98 aa, Triticum aestivum
  unsure (1)..(98): unsure at all Xaa locations
  Clone ID: PAT_TA_67610.pep
GRRFYTVWRKNGGSSTQWQMENEPFLLDSGSLIKGAVGRHLLLYYVGSSXVKQXXYTRDXXTFXXERVCGSCPDSSEAYXNLPPXXLXXXXXXXAXXX

SEQ ID NO: 173193 - protein, 164 aa, Triticum aestivum
  Clone ID: PAT_TA_67611.pep
RHEGQREVESVRSQHAADLETLVTTTEELERFRRELSMANEAKKAALGHADDAMKIAEVNADKVEILSGEVTRLKGLLDSSAAVEESRNREREEFVKNLESEISVLKGKLEEARVLEERLADMEKLTEELKTQLADAKKAQSEVHQQFEEWKNKAGSLEMELEE

SEQ ID NO: 173194 - protein, 50 aa, Triticum aestivum
  unsure (1)..(50): unsure at all Xaa locations
  Clone ID: PAT_TA_67612.pep
FXXPPXFFFFFFFFFFFFFFFFFVNNIAYIYAINGILTLNGGTLFIQVHR

SEQ ID NO: 173195 - protein, 283 aa, Triticum aestivum
  unsure (1)..(283): unsure at all Xaa locations
  Clone ID: PAT_TA_67613.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLXXGMQIFVKTLTGKNITLEVESSDTIGNGKXKXQDRXGFPRTTXVYFXWKQXXDGPPG

SEQ ID NO: 173196 - protein, 57 aa, Triticum aestivum
  Clone ID: PAT_TA_67614.pep
MAERHNQPGVLEKFFLAGGVSVISKSAAAPFERVKLLLQYQEELVRLGILPEPFKGI

SEQ ID NO: 173197 - protein, 87 aa, Triticum aestivum
  unsure (1)..(87): unsure at all Xaa locations
  Clone ID: PAT_TA_67615.pep
APGDGIGGAPXKRRGRRFDRETRTGRSGFLLRSQIQETPRGREGAINLSGDPPRCLLVVVVLLLVVGCDXVGWAGERRGRRQGGGGR

SEQ ID NO: 173198 - protein, 88 aa, Triticum aestivum
  Clone ID: PAT_TA_67616.pep
MARIKPKQLLIQSKTKKGPSRISYSSIITWNLIVVLVVLSLYATYRHWHHRPAFEAEMDLPRAENIERSEDSTKISTPSYVIMDTLKG

SEQ ID NO: 173199 - protein, 128 aa, Triticum aestivum
  Clone ID: PAT_TA_67617.pep
PDSRTKWRKRKRNSDALPLPSAAADHSDDSDSAADNDDDDTAVPSPAVDNADDEILAGAAARDPVPDLREAELLSSAEVISAFPAATRRTVNRPHPSVMAVVAAERSAYVGDVSAAAPPVLENISHGQ

SEQ ID NO: 173200 - protein, 154 aa, Triticum aestivum
  Clone ID: PAT_TA_67618.pep
RREEREPGEVSSGSGSEESRGCPLKAREPGVNGVAGVSREGGVPSPTKKRKYSPIILDRNGSKPRVQDFASSMKDVGTVVANLPDVGNPSSIDLDASVDVQNVERLQEHCNDRVIMEEDEEEDAYPTMINIRTSRWADADDEEEIVSKKKKSVS

SEQ ID NO: 173201 - protein, 142 aa, Triticum aestivum
  unsure (1)..(142): unsure at all Xaa locations
  Clone ID: PAT_TA_67619.pep
ERREPQEERSGALAAGRDGGAARRRPPSAEHHGRSSLAPRQVNDARLGGGSWGKSQDPSPAGQGVLRSIAGWVRGGRNELGGRRWVKVMRTGGAPVLGGSAARPRGEGAMGREARGRSHGEGGAGKEEVRWDGRPRAEXPAX

SEQ ID NO: 173202 - protein, 90 aa, Triticum aestivum
  Clone ID: PAT_TA_67620.pep
FSVTTPKLVLLNDFSASQTAQAITSAFLVREFSVNVSSGSSLDLTFAPSAHRNGSYAFVNGIEIVPTPDIFTAPDTRNVGDNTAPFSFDT

SEQ ID NO: 173203 - protein, 170 aa, Triticum aestivum
  unsure (1)..(170): unsure at all Xaa locations
  Clone ID: PAT_TA_67621.pep
TKMSTSRSMGPWSIIAKQIENTCCEKEELKEQEDRQRKGLEEGARISRCHQKKGEGDVGVLGRWMAFLADICNPQLPSMEEQMTKPRGLGELADRPLGSDKHRGRTVVGRAAALVRFIWSRGRGRGGSGDAGWRRTVRRLRRLRGKGVLAAFAGKERTXSGTLVPNXLQX

SEQ ID NO: 173204 - protein, 164 aa, Triticum aestivum
  Clone ID: PAT_TA_67622.pep
MASSDPALPPPLLLLPPPVPEQALVPPPARANPRPTVLDGVLSLLRSGESFIRGAFRGNSRRASPPWPPTSQQQQQQPPPQQHHRNHPGEIMKRLQRETFPDVMRLMDKHEQIDRILSMYRSGKGFHFPELPVRVKVALDAVGALLLVNDEEFDHAREILGKAG

SEQ ID NO: 173205 - protein, 189 aa, Triticum aestivum
  Clone ID: PAT_TA_67623.pep
RRLSAADDRILQIFRLVVVELRDIAASLDQLLPLLDLRPYHVENYELWLLKLRNLARYIGNHLDKYERFITRKEQETYVRTACFRCDSEFRLPHPDVTRLIEEELSWINGQPYRYEHLMLAGDDDSIPLSGMPQLQPYATEAGTVARGDLLVGIESTRKKLLRWFTPAQEDNMALSIVSMVGPAGVGKT

SEQ ID NO: 173206 - protein, 152 aa, Triticum aestivum; identical to SEQ ID NO: 126264
  Clone ID: PAT_TA_67624.pep

SEQ ID NO: 173207 - protein, 55 aa, Triticum aestivum
  Clone ID: PAT_TA_67625.pep
IPHLYQKWFHLQKCFCPQPFRRGWNALLCLFLWPFGVLQLELFYTSHEQCNYEMG

SEQ ID NO: 173208 - protein, 30 aa, Triticum aestivum
  Clone ID: PAT_TA_67626.pep
SKSHVMFHVIWNRNLKPYVHTQFSNLTMPF

SEQ ID NO: 173209 - protein, 204 aa, Triticum aestivum
  unsure (1)..(204): unsure at all Xaa locations
  Clone ID: PAT_TA_67627.pep
EEAAPAYILWCKDQWAEIKKSPDADFKEVSNALGAKWKTLSNEEKQPYEERYRQEKEAYLQVVGQEKREAEAMKLLDEEQMRWTAKELLEQYXQERRAALAAEKKSVPEIGKITGEEWKGMTEAQKVPYEEVARKQKEEYQKQMEVYKQKKLEENASLEKEEEEQKKILKQEALQLLRKKEKADNIIKKTKEKRQKKKQQQNAD

SEQ ID NO: 173210 - protein, 135 aa, Triticum aestivum
  Clone ID: PAT_TA_67628.pep
MEDGSGGAGGEGSTSGGRFPILQANRDPESNWEVDVAKSLEEYLLKICSGEISAEDGAHSFNFAEAALLLQGSVQVYSRKVEYLYSLVLHALEFLSQNKQDQQEKGSAEANENGPSTTVNKEDDMFMGLDDVPAE

SEQ ID NO: 173211 - protein, 166 aa, Triticum aestivum
  unsure (1)..(166): unsure at all Xaa locations
  Clone ID: PAT_TA_67629.pep
MSVLDKASSVARSNATSKIRGDMSMNMPADAQEFSELRHIHMAKCTRSESSCMNGGDANEGESSESMNDVFSPDRSHHELSAPPPKRLKGRPTTAREKAPYEKNVKRSRFCKIXRGEGHKCTTCPMRGDASVKPRKQSTCTNCGVAGHRRKNCGKKAVFNDKIVME

SEQ ID NO: 173212 - protein, 41 aa, Triticum aestivum; identical to SEQ ID NO: 133945
  Clone ID: PAT_TA_67630.pep

SEQ ID NO: 173213 - protein, 51 aa, Triticum aestivum
  unsure (1)..(51): unsure at all Xaa locations
  Clone ID: PAT_TA_67631.pep
XRPWYVVRQSCTLAHLPMPDLLKLEDGVGLEDYSIRSRFCDASAAAIAPDV

SEQ ID NO: 173214 - protein, 104 aa, Triticum aestivum
  Clone ID: PAT_TA_67632.pep
RGSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 173215 - protein, 70 aa, Triticum aestivum
  unsure (1)..(70): unsure at all Xaa locations
  Clone ID: PAT_TA_67633.pep
FFFARNNNNXLNFSSTRTRVKNGHYXKVSSSXAPPAQHPQELXNXEPRCRVKRQNFTAPVPSPASAPPSR

SEQ ID NO: 173216 - protein, 200 aa, Triticum aestivum
  Clone ID: PAT_TA_67634.pep
MAAAVVAMLTSPLLAGAEVSPVEAQGMPDCDITCGNMSVPYPFGMGPARCYWPGFNLTCDRASNPPRLLLGDGTLQVQELSLIPTFVAVIRIGDIKVDDLGDGTLGSGLTTDGPYAISSNQFILVGCNVHATLKNGDVTMSSCYSRCKNGDGLSQARNTLEAGMQCSGNGCCQSDIIFNPAEVAERLVNSTSYDVHLKWF

SEQ ID NO: 173217 - protein, 36 aa, Triticum aestivum
  Clone ID: PAT_TA_67635.pep
MSVAALQIWEATSTKRHQAIYPYSGAFVPVLTVLLQ

SEQ ID NO: 173218 - protein, 124 aa, Triticum aestivum
  Clone ID: PAT_TA_67636.pep
MNSSMDEINLLRQHQRHQQHHLSVRGIGEEIDLEIDQCEDPTFSGAALEGVTCHHPQDPVVPADDHKSFLIPCSQPGAVDGQPQPTPPQAEERAGMLRLSAHTKKKKKKVVKKWRDEWADTYKW

SEQ ID NO: 173219 - protein, 199 aa, Triticum aestivum
  Clone ID: PAT_TA_67637.pep
MGGLKEDVDNTVDPDFDDDTLDNFGEVDRVSEEDEYDKFDDWDIQPGAEASLPWLQKTDAEVSYNSRTPIPILVDEKYNTFKQFDTVDDHSDHYYSKPELWKAQVVNEPSNDWVMRIQHECEVLGKDLPGSIFVRAYKDRMDLLRAVIMGPAYTPYHDGLFFFDIYFPPHYPNTPPLVNYRSGGLRLNKNMYPCGKVCL

SEQ ID NO: 173220 - protein, 153 aa, Triticum aestivum
  unsure (1)..(153): unsure at all Xaa locations
  Clone ID: PAT_TA_67638.pep
MAPKAXKKPAAKKPAEEEPATEKAEKPPAAKKPKAEKRLPAGKTASKEGGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 173221 - protein, 163 aa, Triticum aestivum
  Clone ID: PAT_TA_67639.pep
PTEQKEKEFLSELGIQVHVCHPNTADLLGCCVENGLYLVFELCANGTLASALHGNSGKVLEWPLRQKIAVGVARGLQYLHMFCRHRIIHRDIKAANILLGDDSEPQISDFGLAKWLPKQWTHHSVVPIEGTFGYLAPEYFMHGIVDEKTDIFAFGVLLLEIVT

SEQ ID NO: 173222 - protein, 181 aa, Triticum aestivum
  Clone ID: PAT_TA_67640.pep
NQHVKSDFSPTTATKSHLLLPFRRRSRRGTGHRIQISKTENFSREMVNRTQRAPAAPRDSSNPDGFNLKKKVNLIISTQKEQKRRKQHAKTSTQNGPTTERRREHHRTRPPSVDRRTGRKSHTELLRREQNPRGSTEETPNRAPNGTDQTGEGGGGGERTLTLWRGGGGGGAGGGGRGGVR

SEQ ID NO: 173223 - protein, 47 aa, Triticum aestivum
  Clone ID: PAT_TA_67641.pep
TYFKSEKQIQAVHNPNSDGLKNTQWDSSAQDTPTHQLSDQKPCTIKP

SEQ ID NO: 173224 - protein, 185 aa, Triticum aestivum
  Clone ID: PAT_TA_67642.pep
MATSTPASWSELPPDVLGLVINRLVSLPRRASLWSRLRRHLGFRARFREWPRVRRFLDFIAGFGFKKVRRDRHWVSFDRARFRMVCRSWHRAMRRHIAASRQVPWIVMSDGSFFTPSDPVGTSPSRLPTLPSNTTCIASCDDWLALDLIDDDKMHSYSLHNPFTGTTVLLPELDAIIGNVSKIFK

SEQ ID NO: 173225 - protein, 183 aa, Triticum aestivum
  unsure (1)..(183): unsure at all Xaa locations
  Clone ID: PAT_TA_67643.pep
GLLXXDSLFEWCPXTGYYVLLSNIYARAGRWADVTSVRSVMASKGIKKLPGASNVEIGDQVHTFHVGDRSHPQSEMIYKKLDELLGRIRGMGYNPGVEGTLHDVEEEEKEGHLSVHSEKLAIAFVLINTSPGTPIRITMNLRTCSDCHHAAKLISAITDREIILKDVNRFHHIVQGVCSCGDY

SEQ ID NO: 173226 - protein, 90 aa, Triticum aestivum
  Clone ID: PAT_TA_67644.pep
KERMRAFAEKQGWRINRDDGGALERFCLEIGVKRNVLKVWMHNHKHQLASPTSTAAGMGMGMGMGGINPGVLGTGTGTGAGAGAGVGVGA

SEQ ID NO: 173227 - protein, 101 aa, Triticum aestivum
  unsure (1)..(101): unsure at all Xaa locations
  Clone ID: PAT_TA_67645.pep
CSHYQGVRRWRWLHGQAASTGATTAGGTATAITFSFQPSDPPVNGGLSHHHSLLGYSPLVLDHPTTTTXSSTMPYRRSHTXPHPCSCRSHPYCKVIPXTSM

SEQ ID NO: 173228 - protein, 46 aa, Triticum aestivum
  unsure (1)..(46): unsure at all Xaa locations
  Clone ID: PAT_TA_67646.pep
FFFSNSNITISSGPQAAQFLQRXVTSHCCQLHTRCLPPSTHETTTT

SEQ ID NO: 173229 - protein, 180 aa, Triticum aestivum
  Clone ID: PAT_TA_67647.pep
QIRHEVVVCLDTCVSASGKTLVVTGSKDNTVRLWDMEKRSCIGTGKGHLGAIGCVAFSKKSKNFFVSGSSDRTIKVWTWDDTLIDAGGEVPLKAKAGVAAHDKDINSLSVSPNDGLVCSGSEDRTASIWKLPNLVSSVVLKGHKRGIWSVEFSPVEQCVITSSGDKTVKIWHVADGSCLK

SEQ ID NO: 173230 - protein, 36 aa, Triticum aestivum
  Clone ID: PAT_TA_67648.pep
MAKGEGPAIGIDLGTTYSCVGVWQHDRVEIIANDQG

SEQ ID NO: 173231 - protein, 60 aa, Triticum aestivum
  unsure (1)..(60): unsure at all Xaa locations
  Clone ID: PAT_TA_67649.pep
HEVGDSSTRXDPRRAQGSSSRNVIRDAVTYTEHARRKTVTAMDVVYALKRQGRTLYGFGG

SEQ ID NO: 173232 - protein, 154 aa, Triticum aestivum; identical to SEQ ID NO: 125480
  Clone ID: PAT_TA_67650.pep

SEQ ID NO: 173233 - protein, 98 aa, Triticum aestivum
  Clone ID: PAT_TA_67651.pep
CRFGTRPNPTPSSPSSPASASPAPTSPPSSPRTPSSSVPAWRKPWPPSSLGSPAWASRIPTWRASPRSPASLSAASPSSPGCGTACPSSGPPRTSFKP

SEQ ID NO: 173234 - protein, 60 aa, Triticum aestivum
  unsure (1)..(60): unsure at all Xaa locations
  Clone ID: PAT_TA_67652.pep
XSFNLEEVRLKRSAPFSTACIAAMSNHPPVCALPHKRKQTIQALFSCQCSSPSHPALSRS

SEQ ID NO: 173235 - protein, 179 aa, Triticum aestivum
  Clone ID: PAT_TA_67653.pep
QIRHEGSFLRIKGSSRVSRMSLEIYLIGNYSHDIGPLVRDAIDNGMIKELDLTIADDKDYDCKGGDMLRKARDVDGFFSAYPNILPCLTRLQLYNLRFAEGDIHNVLFDCCKQLQHLSLEHCDVGDCSVWQVDSPNSVLRVLEVRYSYLKRLEVLCLPKLELLSWEAWMHCEPPLHFGY

SEQ ID NO: 173236 - protein, 289 aa, Triticum aestivum
  unsure (1)..(289): unsure at all Xaa locations
  Clone ID: PAT_TA_67654.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTXHLVLRLRGGMQIFREDPHWGRPLLLEVESXDTIDNVKAKIRTRRAFPXDQQXLXXXGKQXEDGRTXGTTS

SEQ ID NO: 173237 - protein, 67 aa, Triticum aestivum
  Clone ID: PAT_TA_67655.pep
SKAQCLLFLMDAVFIPSANPLGLSCGSILMELVELSSTSLAEAMFEKLGLPKPVYFVHHLSQNRFRT

SEQ ID NO: 173238 - protein, 202 aa, Triticum aestivum
  unsure (1)..(202): unsure at all Xaa locations
  Clone ID: PAT_TA_67656.pep
PRVEPDPIPASPLIPENVNPDPLPLIVVTIVPPSTNERTDPSTPRDDRNDTTFDESTNQPRMPILEFHPSQIIADPGLRIPIEDYAPEIRRSDVRRAYLLNKRNKAVGHTFKNTKDGKIWRSFQRAWLDKFDWLEYSVDKEAAFCFHCFLFKKPSQAIRFGNDVFMKDGYTRWKTGLASFEKHVGGQSSYHNXARGDCDDFN

SEQ ID NO: 173239 - protein, 286 aa, Triticum aestivum
  unsure (1)..(286): unsure at all Xaa locations
  Clone ID: PAT_TA_67657.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIXDNVXAKIQGQGGXIXPDQQRLIFAGXSSLRMXAPLPDYNXQXKESTXHLVLXLSWXHAKFLSRTLTGKNITLEGGSSGTXGHVKAXXXDKEGNXXEQXXLXFAGQAVGCL

SEQ ID NO: 173240 - protein, 137 aa, Triticum aestivum
  Clone ID: PAT_TA_67658.pep
MGKEQAAPWRLNVSDLQFQMPERAKEPPPFASRVFMRGHGKQRKIAKYYEKQESLLKDFSEMESMNELGFLDQNSAPTEEELRQLAKGEKLAINLSNIINLVLFVGKVVASVETQSMAVIASTLDSLLDLLSGFILW

SEQ ID NO: 173241 - protein, 79 aa, Triticum aestivum
  Clone ID: PAT_TA_67659.pep
SRHVQDTIGVDVKADSDLGNSPGCRRDLDCTHSNYQTLMRPVLLFIVTTSPCQDWVICAPAAFLGCGSRFSGSLSGIEP

SEQ ID NO: 173242 - protein, 73 aa, Triticum aestivum
  unsure (1)..(73): unsure at all Xaa locations
  Clone ID: PAT_TA_67660.pep
MAAAAGEAPRALSQKEQDIQMMLAADVHLGTKNCDFQMERYAYKRRSDGIYIINLGKTWEKLQLAARVIVXIE

SEQ ID NO: 173243 - protein, 143 aa, Triticum aestivum
  Clone ID: PAT_TA_67661.pep
ATRAAAAARPSILSRHPPDSRVSRGQNRPDPHPSPGAGGEEEHNGGLLCPSFTPLFPPRCCQRLRAGKGSACGSSSSGSGCGKWEQRSAKLEEEDEHTPQSVGCWCSFCCWGERNRRTGGALIVQKSTKGGWIRGGRRERASV

SEQ ID NO: 173244 - protein, 91 aa, Triticum aestivum
  Clone ID: PAT_TA_67662.pep
RVWRSRREDGRERERILRKSIGQGDLSLSLSHLPRLISFPGYNFYGGQMLQKICAAYWNHVVQGKTSKVLFDVLYIRLTCFLQYPNFFCLF

SEQ ID NO: 173245 - protein, 47 aa, Triticum aestivum
  Clone ID: PAT_TA_67663.pep
TCTFTLNSNKNNFILYAYYYFSVLTMETSSCSCHWYITSCFHLYLFH

SEQ ID NO: 173246 - protein, 54 aa, Triticum aestivum
  Clone ID: PAT_TA_67664.pep
VSLPIAWFALQKHELVIRPNLSTLFELTRLMSAHDSRNNCFKREGNYCTPTCYN

SEQ ID NO: 173247 - protein, 152 aa, Triticum aestivum; identical to SEQ ID NO: 126264
  Clone ID: PAT_TA_67665.pep

SEQ ID NO: 173248 - protein, 156 aa, Triticum aestivum
  Clone ID: PAT_TA_67666.pep
ATFPRSLWCQAPAPCISPRSSISPSTAAPRFPYLPAPPCPLPLPPGAAAPLHPASPTSKCHSPNLRVQPGCIPPSPLALACLPSPWLRNASHRHTPGPGALPAIALSPEAAATRDQRRHKQLQIQWDSPPLLSIVAWLAAKQGRREEHLPSGKEHL

SEQ ID NO: 173249 - protein, 73 aa, Triticum aestivum
  Clone ID: PAT_TA_67667.pep
FFLEILGDCVHARCQIHLINILSMGNFAFLCSRHNFEEEVSLTLFNHSGRGKSESGSPTLHTLYLNAHTLSAS

SEQ ID NO: 173250 - protein, 159 aa, Triticum aestivum
  Clone ID: PAT_TA_67668.pep
PEGHPSSCRCPSVLSLSFFLLLLSVTNLCFLYGRKSPWNDPRCLGARPAFGPPPLCRPRPPPPRSVRPAAGSTPELPCPPPRPPIKSHLLHVVRSGGGRPRGAPIHLPHGPPWSSPCLRAATSPSASCSSASIHPPHRRIRRPDHQPSAASCLSCDLVK

SEQ ID NO: 173251 - protein, 94 aa, Triticum aestivum
  Clone ID: PAT_TA_67669.pep
EEIRSCQRTYQTHEWPPGSRSALFLCPPPHPHAATPSPSSILTHKEKCSRRLHHLSRAAEASPDPPPPAHPLRHAQRERLGLSSATPSHAVVRR

SEQ ID NO: 173252 - protein, 200 aa, Triticum aestivum
  Clone ID: PAT_TA_67670.pep
MLDSAIDTKVSKFDGLKEVSATDLSTRFSDVKGVDEAKAELEDIVHYLRDPDSFKRLGGKLPKGVLLVGQPGTGKTMLARSVAGEAGVPFFSCSGSDFEEMYVGVGARRVRELFSAAKKRSPCIVFIDEIDAIGGRRDTEGVPSQRPALNQLLVEMDGFKQNDGIIVIAATTLPQSLDSALVRPGRFDCQVHVSVPDVEG

SEQ ID NO: 173253 - protein, 75 aa, Triticum aestivum
  unsure (1)..(75): unsure at all Xaa locations
  Clone ID: PAT_TA_67671.pep
MAAVAEDVEAFLAMCAVLGDAAYGATKAMLEWLNAPAKRAEARRLLGTVRXRFTIGGPAAGLECFRISGEAPIPP

SEQ ID NO: 173254 - protein, 173 aa, Triticum aestivum
  unsure (1)..(173): unsure at all Xaa locations
  Clone ID: PAT_TA_67672.pep
VESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGXTLADYNIQKESTLHLVLRLRGGMQIFVKTLTGKTXTLEVESSDTXDNVKAKIXDKEGXX

SEQ ID NO: 173255 - protein, 43 aa, Triticum aestivum
  unsure (1)..(43): unsure at all Xaa locations
  Clone ID: PAT_TA_67673.pep
VLRGRRXCSVEIXLFGGQVTSWKNDHGEELLFVXSKAIKPXKP

SEQ ID NO: 173256 - protein, 90 aa, Triticum aestivum
  unsure (1)..(90): unsure at all Xaa locations
  Clone ID: PAT_TA_67674.pep
PGSLLPLVEKSIATSPEKTARTIKQQLAALAPTLEQLGKQKKERINKFADIMSRIEQIRGEIAGNLEIGQXVAIPQINEDDLTDEKLRDF

SEQ ID NO: 173257 - protein, 132 aa, Triticum aestivum
  Clone ID: PAT_TA_67675.pep
AAPLLGAAVSNRISKSSSDPQSSGSSPSCNRQSKQSSGSSPSRSPQSERLLFLVANRESKQSFPDYNQKQALFRIQSPSLHWWREPSSYIYCVARQSSEKTRSSNCLDISFQTDRRQLRRWRGLVAGDRLPN

SEQ ID NO: 173258 - protein, 116 aa, Triticum aestivum
  Clone ID: PAT_TA_67676.pep
SKASPSTNWWSPSFSTGSRLLVVRHWLMRKILARRSAPRRAIQTAHSGIHQGLRQPIGRLSLPRQAGDSRKEPLRSEQTETAMGVSIRDLAVRRRTAPAGREGGGHGRPARRRGHG

SEQ ID NO: 173259 - protein, 66 aa, Triticum aestivum
  Clone ID: PAT_TA_67677.pep
FHILNVGIFFYKLGQRSQGLTSDKSYMQTKKDRKGVLVSFPLLETIFVPSTFSGSYRNVIFVALIN

SEQ ID NO: 173260 - protein, 95 aa, Triticum aestivum
  Clone ID: PAT_TA_67678.pep
SPVVSPPTSSHKTLKCDEAADSAKCVFFLCYLGTLEKLRKVDINLRAVVWNSTFLEEYNGIGEIRVFSKAQVVVSGTNIQYSPTSVVTDEVATSV

SEQ ID NO: 173261 - protein, 193 aa, Triticum aestivum
  Clone ID: PAT_TA_67679.pep
QIRHEADVPVPSVLLILLALSVVVTQAPFFRARRLISDDGGGRATACTKDAASCDCDYSDGKWVRSRSTDAMPYGEDCPFLDPGFRCVQNGRNDSSFRHWRWQPRRGSCHLPKFNATDMLERSRNGRIVFVGDSIGRNQWESMLCMLAAAVPAGSRIYEQFGKPLSRHKGYLSMVFADYNLSVEYYRAPMLVM

SEQ ID NO: 173262 - protein, 98 aa, Triticum aestivum
  unsure (1)..(98): unsure at all Xaa locations
  Clone ID: PAT_TA_67680.pep
GSAGNSXRGTTHTLNLTLPRRRPXICAPPPQISSSFPSRHGISDPGLPSLIPHSRRSSNIPLTSSNASRRAESEEQQHRPPXSSSSVXRQRQLVQRSC

SEQ ID NO: 173263 - protein, 81 aa, Triticum aestivum
  unsure (1)..(81): unsure at all Xaa locations
  Clone ID: PAT_TA_67681.pep
KEASKAQKSTSNAFSMFDQNKIQEFKEAFSIMDQNRDGFINKIDLKDTYAALGIRDXSMDKLEAMVLEAXSAINFTXXLNM

SEQ ID NO: 173264 - protein, 190 aa, Triticum aestivum
  Clone ID: PAT_TA_67682.pep
RHEGSPLRFASTILCDVGVVVCAADDCDHLGCHGSPFLVGYVGTDYRSAHASVFSSETNSWSPVVSCPHPDVEILRGQPKPLVGNAVYFICEYHPDESFILCFDLFSRKLSKFDGPPIHHYKYALMKTEEGVLGCASMEGSRLCLWSTETGPDGAVAWMESRVIDLHKLLSSNSFLHVIGFEDRAGVYYL

SEQ ID NO: 173265 - protein, 208 aa, Triticum aestivum
  Clone ID: PAT_TA_67683.pep
HCAAMSDLRHRILPPIFLSESPKEAGFCLWLLHPDPFSRPKARDILGCDLINEGRDLSVLDKAPAAINEEDTESGLLLNFLSQLKEEKEMHAAKLSADLASLQTDIVEAERRHSFRMGFSLEDMDVPASSNDVPGTSSNALRGALLSGGRSGIYEERVMKNLQQLENAYYSTRSTIDTSETNVIKRSDNDALRVRENFNHSDADAMNG

SEQ ID NO: 173266 - protein, 149 aa, Triticum aestivum
  unsure (1)..(149): unsure at all Xaa locations
  Clone ID: PAT_TA_67684.pep
DSSSDSDYVISEEELKDLGVPRPQETMPQLPSPPARRTIAPRRVDEKGKEPEEALKQICGICLSEEQRATIQGVLNCCSHYFCFACILEWSKVESRCPLCKRRFNTITKSSVADLGLGLRNAPVRVEKRDQVYQXTEDEMRRWXDPYEN

SEQ ID NO: 173267 - protein, 130 aa, Triticum aestivum
  Clone ID: PAT_TA_67685.pep
MDDVLPIVISFLPAHEAVRTCVLSPRWRHFWTSAPGLRITAVGDFGSADKFNQFVDRLLFLRRHSDCPLESCEFDLDDREFGFNSISSFQHVYRWSLQSALDCNVRVLRCSFTDTNPNFRMLPEQLSEYP

SEQ ID NO: 173268 - protein, 153 aa, Triticum aestivum; identical to SEQ ID NO: 168119
  Clone ID: PAT_TA_67686.pep

SEQ ID NO: 173269 - protein, 57 aa, Triticum aestivum
  Clone ID: PAT_TA_67687.pep
CRQKTTDFAVACKQPGEKGPCSTHFCHTCLFNRYGENAKQAAKKARWACPKCRGICN

SEQ ID NO: 173270 - protein, 92 aa, Triticum aestivum
  Clone ID: PAT_TA_67688.pep
CPPPRSLARVHLKEPAGVVGWLTRGAEPNTERTRNTSVWCLCGCKPGPNNLGGFASTQTADRQNGFTSACWLSFLPTRTQTDKNGRNPRPNS

SEQ ID NO: 173271 - protein, 85 aa, Triticum aestivum
  Clone ID: PAT_TA_67689.pep
DQREDRRRSSSRRLREQQQGRSSQVGEQQRGKRRSSRGRGRRRAAAKEQFTGGGAAARQEKKEQQRSGASRIGEEEQQQSCKKAS

SEQ ID NO: 173272 - protein, 35 aa, Triticum aestivum
  unsure (1)..(35): unsure at all Xaa locations
  Clone ID: PAT_TA_67690.pep
DFXVANAGCPNGTSGYNRIIGPFQSTKQVIXXYSC

SEQ ID NO: 173273 - protein, 178 aa, Triticum aestivum
  unsure (1)..(178): unsure at all Xaa locations
  Clone ID: PAT_TA_67691.pep
MERTGENRRPAVGKPVPSVREMGNRRPLKELNNLAGAHPYPCAVAKKPMLEKSRRDEKKPALVTHRPMTRKLALLLENREQLDHLATAADAAKPGVDPQDEPILDDTAADTDEEIESVDDDTDMDEEEQEDIVDDVSLMDIDSGDSGNPLAATEYVEEIYRFYRENEKMSCVRXDYMS

SEQ ID NO: 173274 - protein, 89 aa, Triticum aestivum
  unsure (1)..(89): unsure at all Xaa locations
  Clone ID: PAT_TA_67692.pep
LPRAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 173275 - protein, 162 aa, Triticum aestivum
  Clone ID: PAT_TA_67693.pep
VKKVCLQKASTNWDTDRKRRRPPAWDPPKLLLVVVSGLHVVVGTSRVVVVVINGGVWLLDSNVWLLWQEGGVIFDRCSRTHGHRQRSWCRESGGADGKAGGGRSGADRWRDGGGQTKKTMAALAMQRPGSSWCPERTKPAATDLLGVLPHAGEVDGRDDDSE

SEQ ID NO: 173276 - protein, 91 aa, Triticum aestivum
  unsure (1)..(91): unsure at all Xaa locations
  Clone ID: PAT_TA_67694.pep
RGNPKVLLLDEXTSALDAESEKVVQDALDAARAGRTCIVIAHRLSTVKNADVIAVIENGCVVESGTHSELLALNGSYFSLVNAQLHNKKNE

SEQ ID NO: 173277 - protein, 136 aa, Triticum aestivum
  Clone ID: PAT_TA_67695.pep
IAHTMGTVLPQHQGNAVGDNAMPDLEIGQPTMEIDQSTIINILHSMLPSASPPAVAQLGRALWGLGSLTLVLALTTVLHLPAAGPVFAHYKAAYYAILAFVLFVAVPVELATAFCLPGHGRDGRLRVFAWNAVLGS

SEQ ID NO: 173278 - protein, 62 aa, Triticum aestivum
  unsure (1)..(62): unsure at all Xaa locations
  Clone ID: PAT_TA_67696.pep
NGXXIGLVLSQCGTDKTKNDIKIGLLASHAQKIRDDLLEESKKEMKVAERSEESKQHEEGAE

SEQ ID NO: 173279 - protein, 105 aa, Triticum aestivum
  Clone ID: PAT_TA_67697.pep
MAQRMGDKCGDIPRGTQFLLVESKAGAGEEEVSYVVFLPLVEGVFRASLQGGGAGGDKFQLCVESGDAGTLASSFYRVLFVGAAESDPFAAIAGTVAAVCLGNLP

SEQ ID NO: 173280 - protein, 64 aa, Triticum aestivum
  Clone ID: PAT_TA_67698.pep
AAAPVLENNDGADAACEVAKEKPLAGAEAGCEVAKEKPLAGAEAGVVGAADALLENEKAEAEGA

SEQ ID NO: 173281 - protein, 56 aa, Triticum aestivum
  unsure (1)..(56): unsure at all Xaa locations
  Clone ID: PAT_TA_67699.pep
NLCAHLSDPFGNNLLTVISGAAEXGAQPVSWPLIARPPPSAVDDQLHARDASSCAV

SEQ ID NO: 173282 - protein, 78 aa, Triticum aestivum
  unsure (1)..(78): unsure at all Xaa locations
  Clone ID: PAT_TA_67700.pep
YVATXCCSVTLLQHIAKHENLAVFKCCLLLPQMFKLVQSRYMHQYFILCRIRTRRMLAMWTKVLVQSLCYNILLNMKI

SEQ ID NO: 173283 - protein, 55 aa, Triticum aestivum
  Clone ID: PAT_TA_67701.pep
MAVKPRKVNEAVVSGWLFFRYLVIGAYVGLATIAGFVWWFVYSEDGPRLPYSELI

SEQ ID NO: 173284 - protein, 155 aa, Triticum aestivum
  unsure (1)..(155): unsure at all Xaa locations
  Clone ID: PAT_TA_67702.pep
MSTSYDIAAVDIKNKTHIYHHQNYMLQFKHNTKVHRLETRGTNIPKFSFNFCPFDNLPEKDTFAKPLQDIIGVIXPFDYASQTCTNXLRKIKIQNLDEQTQEIRLWGHHGETFDEEAVLKKSQEGIIVGIFAGLTAWSFLAINGNLRLCDNNYLR

SEQ ID NO: 173285 - protein, 73 aa, Triticum aestivum
  unsure (1)..(73): unsure at all Xaa locations
  Clone ID: PAT_TA_67703.pep
GRATPASTAVRFLLAIATPRLNPCFFAAPPLXRRVISLNSGRRHTAELRCNATGATSGGGCGEHICCCVLLIA

SEQ ID NO: 173286 - protein, 128 aa, Triticum aestivum
  unsure (1)..(128): unsure at all Xaa locations
  Clone ID: PAT_TA_67704.pep
ADERAHAAVGGQGKLAACRYLVETVRMDVNMWDSSPSKKTPLEHAVDGNNLPALRYLLDHGADLTQEEDDGDTVLHHAARRGRCEIVKLLLARGADVNGXSQHGTPLHLAAVKGHESTVEALLEHHAD

SEQ ID NO: 173287 - protein, 72 aa, Triticum aestivum
  unsure (1)..(72): unsure at all Xaa locations
  Clone ID: PAT_TA_67705.pep
IAGHPRIDDEEPRVPTPPCPQVYDTENANQKEKFEADLKKEIKKLQHYXGXIKTWIQSSEIKDKKIPWYGMK

SEQ ID NO: 173288 - protein, 152 aa, Triticum aestivum; identical to SEQ ID NO: 123242
  Clone ID: PAT_TA_67706.pep

SEQ ID NO: 173289 - protein, 135 aa, Triticum aestivum
  unsure (1)..(135): unsure at all Xaa locations
  Clone ID: PAT_TA_67707.pep
WPTPQNXTELRGFLGLTGYYRKFVQGYGIISKPLTQLLKKQAFIWSPEAQQAFENLKTAMMTTPVLVLPDLEQQFCIATDACATGIGAVLTQGGHPVAFYSKALGVKNQSLSIYEKEFLAIMMAXEKWRAYLQRG

SEQ ID NO: 173290 - protein, 44 aa, Triticum aestivum
  Clone ID: PAT_TA_67708.pep
EALPVETPSSDMLVDSFGRFHNYLRISLTERCNLRCQYCMLALV

SEQ ID NO: 173291 - protein, 90 aa, Triticum aestivum
  Clone ID: PAT_TA_67709.pep
MNSFINDIFEKPKAEKRLPAGKTASKEAGGEAKTRGRKKGSKAKKSVETYKKPTITSREIQTSVRLVLPGELAKHAVSEGTKAVTKFTSS

SEQ ID NO: 173292 - protein, 127 aa, Triticum aestivum
  unsure (1)..(127): unsure at all Xaa locations
  Clone ID: PAT_TA_67710.pep
SAAXSRLLVPFVPPLPRPFLPGPAAGYPDPKPSHIALPGPHPAGGATALLGYAAAPPPLLCHSSTGRRASLAQGTMMAWRMLRRKDVHTGLVNLAFRLDHGGTKHFATGTLGRLPQFRPWQWTPRCC

SEQ ID NO: 173293 - protein, 139 aa, Triticum aestivum
  Clone ID: PAT_TA_67711.pep
MRTASMCTASTVRGTHTFKIAGYSLHKGLGVGNFIPSATFDIGGYLWRVLYYPDGEMEMENGDHASVFLDLVSEDTEARAFFEVRLVDKTNKLPPSVVLSQKTPYVFNSNGRRSSVGDDFLQPSAYLLDDSLVLECDVT

SEQ ID NO: 173294 - protein, 54 aa, Triticum aestivum
  Clone ID: PAT_TA_67712.pep
ININTQVWFGSNLFSAALETWAYVSSHAVPAHSLLVKTREAVGEPNSVLWVISV

SEQ ID NO: 173295 - protein, 203 aa, Triticum aestivum
  unsure (1)..(203): unsure at all Xaa locations
  Clone ID: PAT_TA_67713.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRXIFAGKQLEDGRTXADYNIQKEFTLHLVLRLRGGMQIFVKTLTGKTXTLEVESFDXIDNVKXKIXXQGGXSHRDQQXXXFAXKQL

SEQ ID NO: 173296 - protein, 85 aa, Triticum aestivum
  unsure (1)..(85): unsure at all Xaa locations
  Clone ID: PAT_TA_67714.pep
NASLACGNCXXWHTHNWVIVLLXRLESRESRCYESSEPAFYSCHAFVFAIQRCFIFNLYVLVLNLAIFISLNTVLEHNQPLQIRP

SEQ ID NO: 173297 - protein, 84 aa, Triticum aestivum
  Clone ID: PAT_TA_67715.pep
MCLPKRCSANMTGHPTKQKGLCMAVQAFIPCESGGYVNILSSYEDGSTLWWDVRKPGSPLSSVKYHSESGVQLYPLLLTVYAPV

SEQ ID NO: 173298 - protein, 74 aa, Triticum aestivum
  Clone ID: PAT_TA_67716.pep
HSCHYIYYTHQKSTIFKFKTCLTVYRSLAYFSLYRIKLYYTSFNRQCYPVLVCLRIYVSSTLCILNHALVYIKI

SEQ ID NO: 173299 - protein, 102 aa, Triticum aestivum
  unsure (1)..(102): unsure at all Xaa locations
  Clone ID: PAT_TA_67717.pep
SNSILXDGMSMKESSEHXXSSSVIDDEACARRGPTVXARLMGLDXMPAXSSSGPYPAPFTGQHTFQAIAHDELIGRSYVGLSSPHKMPSSPIDRFRMEALPX

SEQ ID NO: 173300 - protein, 107 aa, Triticum aestivum
  Clone ID: PAT_TA_67718.pep
FGTRLTTPPLPQLAAGSLSPPMCFPQTSGGSPPIHLSLMQLFSLCRDTSLPPQMPADSGVLRRQPPPRNTFPSSPCSIGSFPPAGFAAPGLQLSPATLHVARFQARW

SEQ ID NO: 173301 - protein, 108 aa, Triticum aestivum
  Clone ID: PAT_TA_67719.pep
MAAKGDGPAIGIDLGTTYSCVGVWQHDRVEIIANDQGNRTTPSYVAFTDSERLIGDAAKNQVAMNPINTVFDAKRLIGRRFTDSTVQSDIKLWPFKVVAGPGDKAHDQ

SEQ ID NO: 173302 - protein, 162 aa, Triticum aestivum
  unsure (1)..(162): unsure at all Xaa locations
  Clone ID: PAT_TA_67720.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIXPDQQRLIFAGKQLEDGRTLADYNIQXESTLXLVLRLRGGXXIFXKTLTG

SEQ ID NO: 173303 - protein, 94 aa, Triticum aestivum
  unsure (1)..(94): unsure at all Xaa locations
  Clone ID: PAT_TA_67721.pep
TLRLQKRLAATXLKCGKNKIWLDPNESSMISNANSRQNVRKLIKDGLIIRKPVAVHSRARVXKNTIARRKGRHTGRGKRKGTANARMPEKXVWI

SEQ ID NO: 173304 - protein, 127 aa, Triticum aestivum
  unsure (1)..(127): unsure at all Xaa locations
  Clone ID: PAT_TA_67722.pep
MQIFVKTLTGKTITLEVESSDTIDNVKAKIQDKEGIPPDQQRLIFAGKQLEDGRTLADYNIQKESTLHLVLRLRGGMQIFVKTLTGKTITFEVESFDTIXDTSRARXTDKEGIPXDQQRSSFXSGKQ

SEQ ID NO: 173305 - protein, 102 aa, Triticum aestivum
  Clone ID: PAT_TA_67723.pep
SGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 173306 - protein, 130 aa, Triticum aestivum
  Clone ID: PAT_TA_67724.pep
LHMHTPPTYCTQQGNSAATARSKKNRTHLLSSAARINEMELNETGGMRMQCSNASLMHHHHYSWLYSMMMIRSKSNHGARRTGRPAEFCAPWSGAYSGCTISLASGEHTRAVAWVGGGEGGGLAEVAVPR

SEQ ID NO: 173307 - protein, 126 aa, Triticum aestivum
  Clone ID: PAT_TA_67725.pep
RSGGASVERRAARRGPMADKLRELTHRFRAARADGRLRLPWDWEKPMPYRVFYSPSKGCITVTDPYPASRDPNEGNRHRDKPPMSTRVRRGLQAIDQWLELPDLARKVLIKGGKIVGTGVTAVGVC

SEQ ID NO: 173308 - protein, 96 aa, Triticum aestivum
  unsure (1)..(96): unsure at all Xaa locations
  Clone ID: PAT_TA_67726.pep
EEVRHGVAGEPAXRLLVEADDELVDGQGQILVGRVLGAAAAAVQARDQAPPKGTRTAGRPPPRAGRSRSRRHQRRSASRDGGRKFVAGEQADASCR

SEQ ID NO: 173309 - protein, 167 aa, Triticum aestivum
  unsure (1)..(167): unsure at all Xaa locations
  Clone ID: PAT_TA_67727.pep
SARGRAEXEAPTPSMVTTVLAVTASAAPAPPSLGAARFSPVAGPAVNFRPQVCGLRCWMAAKMKLQKALRSHGWQVQRKLGIRGDGQIPDCFEVASRTGKITRRNVQPADETGGNNSIDDKSSMHLGLNHSEADRPVLEEGVVLFDNFDDQPESVPSXCIAXIGATG

SEQ ID NO: 173310 - protein, 43 aa, Triticum aestivum
  unsure (1)..(43): unsure at all Xaa locations
  Clone ID: PAT_TA_67728.pep
AEQDQVGGKKGRRASTKSRGEKGXIEGCXXXLCCCWICEMCCD

SEQ ID NO: 173311 - protein, 62 aa, Triticum aestivum
  Clone ID: PAT_TA_67729.pep
MEAKSSSIKKETEAMEEAERVVKKQNVTMAMEVFDCPVCSTPLRPPVFQCALGHFVCSPCRD

SEQ ID NO: 173312 - protein, 127 aa, Triticum aestivum
  unsure (1)..(127): unsure at all Xaa locations
  Clone ID: PAT_TA_67730.pep
GVPGQDVGPDLDVADDAVGGAVVQLLXVRVGHHHVRHVGLVDEVHGEYRGAHHDDADGQQRAQDYRHPHQRGAPLPVVVRVPPPVPPMAVMTRARLSRPLVVVAVGLHPAVSGPHLMPRALRSSLVP

SEQ ID NO: 173313 - protein, 52 aa, Triticum aestivum
  unsure (1)..(52): unsure at all Xaa locations
  Clone ID: PAT_TA_67731.pep
MSSAKQVLDPAFQGAGQKPGTEIWRIEDFKPVPLPKSDYGKFYCGDSYIVLX

SEQ ID NO: 173314 - protein, 67 aa, Triticum aestivum
  Clone ID: PAT_TA_67732.pep
INWIIKKRDREIQSLIVPLHREAIDLLMHGRMYVLPEINIGSSFSFTKHETSSVPYLQRKRGDNKSV

SEQ ID NO: 173315 - protein, 139 aa, Triticum aestivum
  Clone ID: PAT_TA_67733.pep
MRSDGRMESFWAQKFVTSELLNYIASRCNSLKSIRLIGAYYFWDDEDVVIKLAAKCPMLEEIEYSGQKLTWDFFKGIGAARPALKRLRVCLPWFDSDSIEREIRMEQRQNDQEEEEEEEEPYEAWEARHNEEAFAIAKS

SEQ ID NO: 173316 - protein, 103 aa, Triticum aestivum
  unsure (1)..(103): unsure at all Xaa locations
  Clone ID: PAT_TA_67734.pep
EKSLVMLCNSGNGRSFGSSSPLTIRXSTLWSPILGFFGTAEDLALYVCRQRSTNWIWNTSYLKPDASMDQAGSGLQATASPAARDNTARLLGARRSRSRGSPS

SEQ ID NO: 173317 - protein, 49 aa, Triticum aestivum
  unsure (1)..(49): unsure at all Xaa locations
  Clone ID: PAT_TA_67735.pep
LVLLXXDVSYANLYLTNGTGXTDCYSCSFAKSTPIHETYQPXWDYWGRY

SEQ ID NO: 173318 - protein, 44 aa, Triticum aestivum
  unsure (1)..(44): unsure at all Xaa locations
  Clone ID: PAT_TA_67736.pep
YFVCPQFYPSFSHEVKVPPXXQLRPCTTYYNRIREAHDLILKKR

SEQ ID NO: 173319 - protein, 44 aa, Triticum aestivum
  unsure (1)..(44): unsure at all Xaa locations
  Clone ID: PAT_TA_67737.pep
RSPGQRKPALRCPRTRRAQTPXSLLDLLSWRCTCFLPFRRAPAR

SEQ ID NO: 173320 - protein, 77 aa, Triticum aestivum
  unsure (1)..(77): unsure at all Xaa locations
  Clone ID: PAT_TA_67738.pep
PGPAGNSARGTVAPLCGQIFGGSITYLFQILSDFAVPRQAAIGHWHPANCSILPLYXAFITYFYITAIACASSRFTF

SEQ ID NO: 173321 - protein, 104 aa, Triticum aestivum
  Clone ID: PAT_TA_67739.pep
RRRGRRTIGRSSWHVSCFRSLPTTGAAPTLVYGTRRIPDLFNKLKEEKEPCLLNGALHQNHDQASPQAKVQFHTHQISTCTVFFVSSSSSRGSCNCTDIYVWLD

SEQ ID NO: 173322 - protein, 154 aa, Triticum aestivum
  Clone ID: PAT_TA_67740.pep
MAPKADKKPAAESKVEKAAEKTPAGKKPKAEKRVPAGKTAAKEGAGGEGKTRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 173323 - protein, 101 aa, Triticum aestivum
  unsure (1)..(101): unsure at all Xaa locations
  Clone ID: PAT_TA_67741.pep
HRFFNLLKLCPYHFVPPGLLIPLTAIYDTRYGEIEEKQSELRRNLHFRLGLPLDRPLLRTSNALTFGAMEMRDRSSSKSGSSLLRDVHKEXPSSGVSGGIM

SEQ ID NO: 173324 - protein, 119 aa, Triticum aestivum
  Clone ID: PAT_TA_67742.pep
PASIPPPRVTTASTPEPRRRLIILLHHASPSTSPSFFLSSAPVIDAWFQIGRGLGEVDGGVNGQGRRATRAGNSRPVAMWSSYREEGGGRRQGEGAGRPSWRQRYQPAREAVRLASAMP

SEQ ID NO: 173325 - protein, 114 aa, Triticum aestivum
  Clone ID: PAT_TA_67743.pep
FYPPTVNHPRMYAHVKAVARALLGDAGYRDVPPMMGAEDFSFYSQAVPAGFYYVGVRNETLGSVHTGHSPYFMIDEDVLPTGAAVHAAIAERYLAGGAEQHSDPRFAGTGAVNS

SEQ ID NO: 173326 - protein, 87 aa, Triticum aestivum
  unsure (1)..(87): unsure at all Xaa locations
  Clone ID: PAT_TA_67744.pep
DVCATACXSMQXRPLIXXXXCXSCSLYACXQKXDPSIHXXNNXQRKKKDEQFEREEEDDLHLNGNQSARPSRIRERRLTNLDPDTGG

SEQ ID NO: 173327 - protein, 191 aa, Triticum aestivum
  Clone ID: PAT_TA_67745.pep
MLPSILSKSRNAPSPAGHRRHLRRLLSSSLGRATTFPPTTAIALSPPPPSTNSHLASSPHSYHRYASILQSCVAAGSLRAGRKLHGRLLVSGLGPDTVLSTKLVDLYAACGHVGQARRLFDGMPKRNVFLWNVLIRAYAREGPREAAVQLYRGMAEHGVEPDNFTYPLVLKACAALLDLETGREVHEHISG

SEQ ID NO: 173328 - protein, 190 aa, Triticum aestivum
  unsure (1)..(190): unsure at all Xaa locations
  Clone ID: PAT_TA_67746.pep
RATAAATSLVEWMVPKLFDSLLAKHELRKSLKIDINYIKNEFAMISAVIHDDDRRSGCCGGREDXNMVWINMVRELAHAIEDCIDRFMHRVRADQDTGRVRQAFHRAKTMKARNKFAAEIQQLKKRSEDVFKLRDSYNNASSSTSPRQSLSSQQTDTPTIEDDDGTHSEASIAVPVGMDTPGRASGSDPA

SEQ ID NO: 173329 - protein, 209 aa, Triticum aestivum
  unsure (1)..(209): unsure at all Xaa locations
  Clone ID: PAT_TA_67747.pep
TRRPLLSLPHRRPPPARHRRHAAAAQFAGEKICLANLSWWRFRESRVKFTCCVPMDNSQSQPLPPGVGAWQPPPSNHPPQFQHPPQFQHPSQFQPTPRPHAYPTPYDTRPNGGNNQNGANMYYATQPFHPSPHPHAYPTPYDTRPNNGNNQNTAGTFYATQPSMPFTPAQSAPSITTEAGNGQPDLKAHQTDHEVANHXANAANIESAV

SEQ ID NO: 173330 - protein, 143 aa, Triticum aestivum
  Clone ID: PAT_TA_67748.pep
MFSVASVVSSLATSVLGKAASFGTDWAVNEIKSAWNAQEELRKLENSLKFICGVLRDAEDRESASHVLHEWLDCLKDAVYDIDDLLDDASTEALMLHVHKGLSRIESMSLLVTGPFKLSHKIEQVRKKLDEIAKDRGQFGLNE

SEQ ID NO: 173331 - protein, 165 aa, Triticum aestivum
  Clone ID: PAT_TA_67749.pep
MRPKESKRWVPVNRPAVASPAAGNPSNGMPPKVSQRWVPVNRPAVTPPAAGNPSDGMPPKVVPVNRPMGTGTGTSHGAGKPSNEIPRKASKRWVPVNRPAVPSPAAGKPSDGMPPKVVPVNRPMGTGKPRGAGKPSNQIPRKVSKQWVPVNRPPTVGTPRVAGEP

SEQ ID NO: 173332 - protein, 41 aa, Triticum aestivum
  Clone ID: PAT_TA_67750.pep
SRISTIGYSDLTERKLGQQTISITDTDIAIAAINVKPHFKS

SEQ ID NO: 173333 - protein, 200 aa, Triticum aestivum
  unsure (1)..(200): unsure at all Xaa locations
  Clone ID: PAT_TA_67751.pep
TKCALDRXTLIQERQKQIAMSNEAVLKSKKEQVKKKERSRKIAALSFAVDDEDDDQEEEEEIVLPKKPKKNPDVDTSFLPDRDREIQEKELKEQIRKEWVEKQERMKNEEIEITYSYWDGSGHRRKVKMKKGNSIQQFLIKCIEQLRTDFSELRTAGVEHLMYVKEDLIIPQYYTFYDFIMTKARGKSGSLFQFDVHDDV

SEQ ID NO: 173334 - protein, 108 aa, Triticum aestivum
  Clone ID: PAT_TA_67752.pep
SARGSNLPPPRQSSSSTPLLIHTAISRFEKQSRVPVPRPRSLLAAAAPSVFQSIPSQGQRLPGRSGRSPSSSSTPTVPRLFLDLPGAGGSSGSGTLLTFTSLSRFGYK

SEQ ID NO: 173335 - protein, 103 aa, Triticum aestivum; identical to SEQ ID NO: 107316
  Clone ID: PAT_TA_67753.pep

SEQ ID NO: 173336 - protein, 150 aa, Triticum aestivum
  Clone ID: PAT_TA_67754.pep
MAAAAADVLLPSKRQKNNPSCLGTLPVLPATATADWSSLQPDIVRHIANSFLTTDDVDCYMDLRAVCHNWRCATDDPKDDTSDPRFLPYRWIILNDAFQSGTRRLLVNTSTGRFLHRELPLLRDYYVITTTLTGFFILTDRSPPHAARVF

SEQ ID NO: 173337 - protein, 157 aa, Triticum aestivum
  Clone ID: PAT_TA_67755.pep
KTLFYFQLWFLLYFQKHQPPRSPWIQITIKILDFVFGFLPGQNEMGEFRYFGKNSDENLKLKFEIWKKMTENSSKRFEPIRTKTYSRVTFNWRKTKAESMDFRINNPKSSRKGWPSQARSIWFSSAAIEEVVRSRSTTARGEGCGQSAGGEEGRRRR

SEQ ID NO: 173338 - protein, 120 aa, Triticum aestivum
  Clone ID: PAT_TA_67756.pep
MEDEENIEEELLLVESQLNGLQDKIKTLLDQQEELYERQAQLKAMLEISKTSRDASNSAPSVALEDWSGKFSWDSQADDTRFNVFGISSYRSNQREIINSIMSGKDVLVIMAAGGGKSLC

SEQ ID NO: 173339 - protein, 261 aa, Triticum aestivum
  unsure (1)..(261): unsure at all Xaa locations
  Clone ID: PAT_TA_67757.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTIDNVKAKIQDKXGISPGQQRLILXWQAXEDGRTLXDSKFRRSXXXHWGLRLRGGCKIXXKTXPGRTLPLXVXXSPTSLGPNGKGFG

SEQ ID NO: 173340 - protein, 133 aa, Triticum aestivum
  Clone ID: PAT_TA_67758.pep
MGGGAWPFLVGGAICLVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYDNEWGYSQRVVDLADIVANQWK

SEQ ID NO: 173341 - protein, 203 aa, Triticum aestivum
  Clone ID: PAT_TA_67759.pep
MEMETETETEMERESRKRPRVAAAAAEDPSLGAAASAEYAAWLEEMAVHEAKAAEFRKNLLANPLTPEQLREREEAAWEKYNIESWERARDNWIWHPFEAVTEIPCMRFTNDNVNDPNYPRLVRTMPTLQIVSVQVKDITGGLHWPLDVYGFVAVRDVVDRKHIMVFDRERDDYQRISEQDSYLTLTGPTRGVVMTIDPSYLE

SEQ ID NO: 173342 - protein, 127 aa, Triticum aestivum
  unsure (1)..(127): unsure at all Xaa locations
  Clone ID: PAT_TA_67760.pep
SRWRRPPRXKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 173343 - protein, 66 aa, Triticum aestivum
  Clone ID: PAT_TA_67761.pep
VRLIRGVLSSDTIACFYGYGFRLGFFVTRWIAFCEQPFQCSNVTQGCKGISNADHQGYTIQSGLTI

SEQ ID NO: 173344 - protein, 91 aa, Triticum aestivum
  Clone ID: PAT_TA_67762.pep
TNTRVGEIKSASHSMLLLQYACLATLKSYQPKRTSKRRNLDDWEGHIVVEFICEDILRRGGNNCPFTSEHHQLLVPQKLQRHYRLTVLSFS

SEQ ID NO: 173345 - protein, 218 aa, Triticum aestivum
  Clone ID: PAT_TA_67763.pep
AGNSARGLRLQKLMVQDGCFVEWREMIADAARKGFAGGVAFQWNSHKILTEQLRQEWLEKVQQRRSMPRPTGNRRAPKTPEQRRKIAEAIAAKWLDREYRERVCSAINSYHGTSSGSKVPRKQRTPREPGAKREKKKSIQHRAVSMDDAHAKTAPVKRKKSATPYKDPMAGEKLEMITKIRAQRTALEIEKKEAIERARSLIVEAEKAANALEPVAAK

SEQ ID NO: 173346 - protein, 42 aa, Triticum aestivum
  Clone ID: PAT_TA_67764.pep
FSTGHLADYVRCIFAGLLIIPGCATCMLHQELMKPKELAEKK

SEQ ID NO: 173347 - protein, 138 aa, Triticum aestivum
  Clone ID: PAT_TA_67765.pep
SSRRRRFLAGDLAFLEDDDAAVLWLVVGWQRLRLRLWWWCVIQIQIQIDLGLDLGLVEIFRGARLRFVAAETDELLHPSLSLSLRGFRIRIRIKSKQQAWCPLESWALLVPAGGAVDSSSVRPIRRGEERRGGGGGEL

SEQ ID NO: 173348 - protein, 146 aa, Triticum aestivum
  unsure (1)..(146): unsure at all Xaa locations
  Clone ID: PAT_TA_67766.pep
LQAIRHEAFFXXKKKTRPTLLSPSLPQPPQVDMPPRRKPQPSAKKPLRRSGRVNSAAAMADSADPTPSPPPPEASSAAIIWGIIEKEIHELPGRDDGVCQYGAYLQRLIRVQKPLLFDLPQKEEAGKLVQKVSFDLVKDERGGDAD

SEQ ID NO: 173349 - protein, 252 aa, Triticum aestivum
  unsure (1)..(252): unsure at all Xaa locations
  Clone ID: PAT_TA_67767.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEXESSDTVDXVKAKIQDKEGIXXPDQQXXXFPGKQXXDGRTLADYNIPXRSPPFXFVLRLXGXMXIFXKXLTGKTXXLRGILRHP

SEQ ID NO: 173350 - protein, 189 aa, Triticum aestivum
  Clone ID: PAT_TA_67768.pep
NHLDWLKGIDSKHTSFYRILLMCSSEWWFMIYLATFSSIRKHIRTPKSLPVTIYAVGESRRDKKNSTEQPMLERIDHRGDLITLKPHGMYFTATTSSVSLFRIRRVTLTLPSPMSLSTSYLSMDPGLRRAAAEGTGAPLLALGQGLHLDLADQLLQVRARGIPWTRRSWSKVMSAWRLVAAWRSLTLVR

SEQ ID NO: 173351 - protein, 82 aa, Triticum aestivum
  unsure (1)..(82): unsure at all Xaa locations
  Clone ID: PAT_TA_67769.pep
FSXELTARCIRKQVGTKSIFDCEYASRRSCDSRCTMEPENFAYVSTKCHIKISINFKYKTNMSISWGISSRSSKVLWLARPG

SEQ ID NO: 173352 - protein, 234 aa, Triticum aestivum
  Clone ID: PAT_TA_67770.pep
QEPLEFPIVNTCFSFCTDASSVDDSKECIGMGCCQTPFPGNISSFNTGSAPLPSLYNSTNQSFSPCSYSFVTEEDWFKFDRSYVSSTNFATKYTDGVPLVLDWVVGNKSCSEATKMGSQYACQAKNSQCINVSNGPGYRCNCSQGYEGNPYLQGGCQDINECEPPNQSLYPCQGKCTNTVGNYTCFCPSGFRSDDPKSIPCVPADPKKALKVVLGISFSAIFLMVCIFALRAEY

SEQ ID NO: 173353 - protein, 202 aa, Triticum aestivum
  Clone ID: PAT_TA_67771.pep
ANRHGVEDLEAEAGRRSKLMMPEQEESGVGEMVEEIMLHGHDIIMKGIEDLHIAMGTEAEKNHRKGTGKAARGRRGASEVDLRTMLIHCAQAVATGDHRGSNELLRQIKQHSSPKGDATQRLAYCFAEGLEARLAGTGSHVYQSLVAKSTSVGEFLRAYKLYMAASSFRKVNFIFVGKIIMDAMVGKSRLHIVDYNVEYGFQ

SEQ ID NO: 173354 - protein, 87 aa, Triticum aestivum
  Clone ID: PAT_TA_67772.pep
GPCVHNDIKFIFCGGGPTTVACCWGPHASPGRCTAALARRSPTKSSKLLKSVKFGLCHYFQWKLLYFILNFKGYSEGISNRVGFCSS

SEQ ID NO: 173355 - protein, 167 aa, Triticum aestivum
  Clone ID: PAT_TA_67773.pep
PASYTHLSACRTYRRAIRTEMQRSRGCAPGGEHAWAAADGGIQLQRRERELVAQLHELLYPSTSPSRSGASSCSGLAADLCWEHGSSQVKATAASCAGGKRRGGRKRVREDERHEEGQGHRGGAATATKATTRCRRKKQGATTTTLVTTVPDFDGYQWRKYGQKQIE

SEQ ID NO: 173356 - protein, 57 aa, Triticum aestivum
  Clone ID: PAT_TA_67774.pep
SSPCLRGHGHPRATTRCLEAAPSSSPWTSTTGTKPGRPSRVAIALISASASRQPPSS

SEQ ID NO: 173357 - protein, 126 aa, Triticum aestivum
  unsure (1)..(126): unsure at all Xaa locations
  Clone ID: PAT_TA_67775.pep
NPLDLSPPTXASPRSSPPLPSCPFWIGARADELRSPSRFSPPPCLARCLICIASQASCKRPRAASLARAPQELDPERVELAVPVSDEQQQLPQLRLAMPLVNPSGNLSFLPRCYFSEFDSLPCPCS

SEQ ID NO: 173358 - protein, 107 aa, Triticum aestivum
  unsure (1)..(107): unsure at all Xaa locations
  Clone ID: PAT_TA_67776.pep
MDLLTHLXDSLSSCLWNISFSKEQAQALNXSYNNLPHYLKICLLCLNMYPEGHTIWKDDLVKQWVAEGFIHTTEGQDMXKVAASYFNELINRRFIQTLCSKYNNEVL

SEQ ID NO: 173359 - protein, 180 aa, Triticum aestivum
  unsure (1)..(180): unsure at all Xaa locations
  Clone ID: PAT_TA_67777.pep
PVVLPDTLXVLISCSCLLFTLFLAVTPLKSASNEAETXXFSMHSQREPLGSTHHXRRCFSXDVAHEEVQRSSTDAILRDPMESHQNHQKSALEHTESSDTTVESDPDSQQSTAYAVSTPKAQPSPPVFHEEPKPVCVADWTESVPKVSTASEVEHIHAENIKRKSATEKDVEVVAEVCRD

SEQ ID NO: 173360 - protein, 57 aa, Triticum aestivum
  Clone ID: PAT_TA_67778.pep
CSRQLWVRHEEEHGGINVIFYKRSGQKARGMSILQYKDTAVESSFSTGSCLGITIHI

SEQ ID NO: 173361 - protein, 227 aa, Triticum aestivum
  unsure (1)..(227): unsure at all Xaa locations
  Clone ID: PAT_TA_67779.pep
DLARLSFRFIRVDLPNSFSARSHPFTALEVIHLRCVHISDDTVSSLVAACPLLHTLDLRYCEGLDSVSVAAAGAHLSSLTVAECDPCTDVVLADEASGLRSFRYSGAYMPAYSIPATITSLADLYICFRASNRRRRLSGTRIRFYGQEAYACELRRNWLQLLTSLSNLTVLTLCSSILRRLSAKARARLAATGAAPCKLLNLRELQLLMFEVEINNMNDIYSXLVAC

SEQ ID NO: 173362 - protein, 117 aa, Triticum aestivum
  Clone ID: PAT_TA_67780.pep
IRHEGNTLLFASCAKEVVTNAQVNVVMSDKALVKHLQRELARLESELRCPATYSSLEALVKEKDNHIRKVNATSDIYAGVFFLYIIGNRSIVLNTSHRAYCFSMKIITHIEKMNMDI

SEQ ID NO: 173363 - protein, 103 aa, Triticum aestivum; identical to SEQ ID NO: 107316
  Clone ID: PAT_TA_67781.pep

SEQ ID NO: 173364 - protein, 123 aa, Triticum aestivum
  Clone ID: PAT_TA_67782.pep
RGGYPQQSILLSASKPSHPIGLPVIKFDDEVGSRSKKRKRSTEDVLASHAQAMFEGGRLQCRRTPELAWADATLTEKVDGEKATSENSTFVSRAQRRLTLTTSLIQCLLPALSARLLAAKVAD

SEQ ID NO: 173365 - protein, 57 aa, Triticum aestivum
  Clone ID: PAT_TA_67783.pep
FFLEWGTLTLYHSCMYNPFFKGDVSFLFSFFLFTLFSLRTCTKHGKGKKICLFPRAE

SEQ ID NO: 173366 - protein, 49 aa, Triticum aestivum
  unsure (1)..(49): unsure at all Xaa locations
  Clone ID: PAT_TA_67784.pep
AWLRRQGHPASRRFXTSXTQHQLYKVTKNSQVSDCFLNRKKDYKDGTFS

SEQ ID NO: 173367 - protein, 46 aa, Triticum aestivum
  Clone ID: PAT_TA_67785.pep
TKKGYGIGYSLWHTKVITLPVSWYFLLRCSFPKMMLVVYCSMPVIC

SEQ ID NO: 173368 - protein, 36 aa, Triticum aestivum
  unsure (1)..(36): unsure at all Xaa locations
  Clone ID: PAT_TA_67786.pep
RRRSHTRSRSPACALRXRLSRTWGXSCSRPGSVALG

SEQ ID NO: 173369 - protein, 105 aa, Triticum aestivum
  Clone ID: PAT_TA_67787.pep
NGTNTPRQPGNTPVRIRSILQVQNFQNNDADSTPMQSTYISVNFKPPVMQKSNYHTMNPRATRLVLTSLSPHFQQSPKQLYIFLHRSIFFEKNDPQHVQLAQHRK

SEQ ID NO: 173370 - protein, 153 aa, Triticum aestivum; identical to SEQ ID NO: 109663
  Clone ID: PAT_TA_67788.pep

SEQ ID NO: 173371 - protein, 195 aa, Triticum aestivum
  unsure (1)..(195): unsure at all Xaa locations
  Clone ID: PAT_TA_67789.pep
MEDSLVPPVPPAPTTLFLTRRRSHLDSASYRTLSRLFSHCLHHRPSQLAAPAPLEVEPAAANPICDESPQGCSVPPGRGKDLGEEETAVRTSVIENPSPAAVDAATGNPIADPAVAPQRYMENQVAGVQRVEGVTDMVVGGNVCRETVAFVEELGAEDVLRSMKDCXEGEVDELAEPDVVVVNDDEHLLLDTMMT

SEQ ID NO: 173372 - protein, 303 aa, Triticum aestivum
  unsure (1)..(303): unsure at all Xaa locations
  Clone ID: PAT_TA_67790.pep
MRLHARRILLPHRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXESTLXLVLRLRGGMXIXVKTLTGKTITLEGESXDTIXDNVKGQIQDKXGXXPDQQRLXFXASXWXDGXTLPDY

SEQ ID NO: 173373 - protein, 161 aa, Triticum aestivum
  Clone ID: PAT_TA_67791.pep
GILASRWRDLWLSAPLNLDCRELTAGRNEVRSDVVSRILSSHRGPGRRLYINTCIHWILADTVEACLRSAALDNLEELDFINHLLEKPQRALILRFSPTLRVANIGGCNLSDVNFHELHLHFPLLKQLGLVNVMISESSLHSLIAGCPALECLLIDMCSGF

SEQ ID NO: 173374 - protein, 171 aa, Triticum aestivum
  unsure (1)..(171): unsure at all Xaa locations
  Clone ID: PAT_TA_67792.pep
FGTRILLIPNMGNGLTAXKVDSPQPLLTSEEVLRVRLDMYNLKESQNSEESLFNCLTSKEELKVNFPHTMTYYYHSIRDGLKAKSYPHFFHQFVGKFSSPCCNYIEPTTLEGDLQYIDFFDKLMESARYRETKDGVLAKAIVIANKFFQKMLFFQIRIAVDEYLQLMHHLE

SEQ ID NO: 173375 - protein, 153 aa, Triticum aestivum
  Clone ID: PAT_TA_67793.pep
KVVNHMLIIDEFEAAWGIFLDKYNSRKHTSMTQLYEIRLKWDKRCFKGVFCAKMTSIQRSESANHMLKTYIPPASPMHVFVRQYMRLQFDREREESYEEKRTMIGGAVRRTNLAIERHASRIYTRAMFEEFGRLLIEATAYNITEIEKMRKYV

SEQ ID NO: 173376 - protein, 76 aa, Triticum aestivum
  Clone ID: PAT_TA_67794.pep
MQLRRHPAKTLPIELNGEAIVDSLTEINKKRVWASRMVRDDELYIVQVQGIPGISLPTTLVVKKCQNVNLALQVDD

SEQ ID NO: 173377 - protein, 186 aa, Triticum aestivum
  unsure (1)..(186): unsure at all Xaa locations
  Clone ID: PAT_TA_67795.pep
AEVVQXESESISRKTLRNSAEKFEFQAEVSRLMDIIINSLYSNKDIFLRELISNASDALDKIRFLTLTDKEALGEGDTAKLEIQIKLDKENKILSIRDRGVGMTKEDLIKNLGTIAKSGTSAFVEKMQTGGDLNLIGQFGVGFYSVYLVADYVEVVSKHNDDKQYVWESKADGSFAISEDTWNEPL

SEQ ID NO: 173378 - protein, 171 aa, Triticum aestivum
  unsure (1)..(171): unsure at all Xaa locations
  Clone ID: PAT_TA_67796.pep
SARKSLESFMLVGTYDENFSAKFAKTLEKLQYVRLLRLSMHFNIDALLSSVTKFIHLRYLELRYTSQERKPLPEAICKLYHLLLLDIMHWSGLDDLPKAMSNLVCLRYLLVPGSGSLHSRISRVGQMKFLQELSEFRVQEEKGFEIAQLGSLSEIRXGSLSILDLDNVKTK

SEQ ID NO: 173379 - protein, 65 aa, Triticum aestivum
  unsure (1)..(65): unsure at all Xaa locations
  Clone ID: PAT_TA_67797.pep
KRVGARFISILTGGLAEXHVCLFPYYILTRNAMQCNLTLPCVACDYXLCYPPWAPRTRMTCCLVP

SEQ ID NO: 173380 - protein, 102 aa, Triticum aestivum
  Clone ID: PAT_TA_67798.pep
MKTILASETMEIPEEVTVKVSAKMISVTGPRGTLTRNFKHLNLDFQLQEGGRKLKVDAWFGTRKTMAAIRTAISHVQNLITGVTKGFRYKMRFVYAHFPINA

SEQ ID NO: 173381 - protein, 156 aa, Triticum aestivum
  Clone ID: PAT_TA_67799.pep
ELPGVDDYPTKFSVEHLAPISLTCLMPPSYPSHHSPYFTLAVQWLDNVKISSLCDMLDSLWAQQPGQELIFEWVQWLQSSTLSHFGFDDGIVIRDSVSTMDHVDVRVVGEILSVEDVVQQLINYNEEQCQESFLQGFHVCMICFSEYKGIDFIKLP

SEQ ID NO: 173382 - protein, 169 aa, Triticum aestivum
  Clone ID: PAT_TA_67800.pep
KSGLVPNAVIFTTLIDGFFQVNRISDAKNIFLDMHRYGVAPTVPVYNSLIDGAFRSGDSQEALTVYEDMARLGLCPDEFTCSIIVRGLCSGGQVQVAARFLEAMQQSGVYLNAAAYNALIDEYCKNGDLAEALATCTIMSEVGIEPNVVTYSSLIDGHSRKGKMEIAMA

SEQ ID NO: 173383 - protein, 64 aa, Triticum aestivum
  Clone ID: PAT_TA_67801.pep
AVYVFYRLICTPYTDKVGLSMDGSSQMYAYINIPHPEFSCVFSDLCTNDTCFHNFFTIKVIGCD

SEQ ID NO: 173384 - protein, 289 aa, Triticum aestivum
  unsure (1)..(289): unsure at all Xaa locations
  Clone ID: PAT_TA_67802.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTVDNVKAKIQDKEGIPPDQQRLXIFAGKQLEDGRTLADYNXQKESTLHLVLRLXGGMQXFVKTSPARPFHLEWNSSDTIDNVXRAKIQDKEGIXPDXKGFIFAGKXLGGWAALLTT

SEQ ID NO: 173385 - protein, 136 aa, Triticum aestivum; identical to SEQ ID NO: 106789
  Clone ID: PAT_TA_67803.pep

SEQ ID NO: 173386 - protein, 135 aa, Triticum aestivum
  Clone ID: PAT_TA_67804.pep
MAPLESSSSQLFFDSTFDVYDCGTLAGTRVVPDPPPLPGTSYGKQRSSRNAKEARCVHDVPEEVRDCWNRLFLEGYQADVRVSTDDGSEILSHSCILGIRSPVLRSMLEEARVEDGFRNILISGVPSEAAPCLHQ

SEQ ID NO: 173387 - protein, 170 aa, Triticum aestivum
  Clone ID: PAT_TA_67805.pep
GDARVSAKSAKAKVRAAGHGPAPATLDDALGSDDDDSEDEAEVAAQEKAMRREVVEDDEDSESGESEGEGVPLVTIAAAAKRKRVRKLSDEFDRIAAAQLEWGGKKKPAAAAPAKAPLRKKASGAAAVPAPAAEAPAKKSLKRKAVAPAAVTAARTSPKRKAAEAPAARR

SEQ ID NO: 173388 - protein, 179 aa, Triticum aestivum
  Clone ID: PAT_TA_67806.pep
MAPEPEDDFLNEKNPRPLDEDDIALLKTYGLGPYSNSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCKEQIEK

SEQ ID NO: 173389 - protein, 194 aa, Triticum aestivum
  unsure (1)..(194): unsure at all Xaa locations
  Clone ID: PAT_TA_67807.pep
SARGSPGPPXGEKKAINSELWHACSGPLVAMPPVGSLVVYFPQGHSEQVAASMHKEVDIIPNYPSLPSKLICKLLSLTLHADSETDEVYAQMTLQPVNKYDRDAMLASELGLKQNKQPVEFFCKTLTASDTSTHGGFSVPRRAAEKIFPPLDFTMQPPAQELMAKDLHDIPWKFRHIFRGQPKRHLLTTGWSVF

SEQ ID NO: 173390 - protein, 118 aa, Triticum aestivum
  Clone ID: PAT_TA_67808.pep
MVGTQGFESLYKMKKSTFSYICSLVKVPLSEDMMVGGHTFVDERVMSFHDGVAIALRMLSSCETPEVVGSSFGVDGSTVSLLTQRFVKAMVGRARHHISLLGSAQVEKIKRKFDKIYG

SEQ ID NO: 173391 - protein, 213 aa, Triticum aestivum
  unsure (1)..(213): unsure at all Xaa locations
  Clone ID: PAT_TA_67809.pep
SARGLSTPWXGLLSLCFIALCTLLVGWFLKLSGGKSKPAGKPQLPPGPWTLPIIGSLHHVASALPHRRMMELSCRYGPLMHLMLGEVPTVIVSSAEAATLVLKTNDPAFAGRPNSVILDIFSCGGKGFAFAPYGSHWRQIRKVCIVELLSSKQVKRMEGIRAEEVANLLRSMTALNGTTFNISEKMATLSNNLVSRAVFGGKFPQQELYLREL

SEQ ID NO: 173392 - protein, 153 aa, Triticum aestivum; identical to SEQ ID NO: 109663
  Clone ID: PAT_TA_67810.pep

SEQ ID NO: 173393 - protein, 211 aa, Triticum aestivum
  Clone ID: PAT_TA_67811.pep
FGTRPLQLLASVLLLSAAAGAADASDHAGSNTTGDLAALLAFKSQLSDPLGILRDGWTRNKSFCSWVGVSCSRRHQQRVTAVSLPDMPLQGGLIPHLGTLSFLHVLNLTNTSLTGSIPDVLARLEHLQPHPQDQTIFSGRRQKTPKSCPQDDEKRRFDPSFRPAAAGQTRRTGGRPGAPAQGKSTAGPHCQVKSQDFFPDSPPTPRALGRH

SEQ ID NO: 173394 - protein, 207 aa, Triticum aestivum
  Clone ID: PAT_TA_67812.pep
GSRRNLPTDGLKDDLVKRLFEELQGDIFGGDGPVGGSPPDDDLKEDEAPGSADASVCQAAVEQNVDEGPSQVATLEGYPVGSVTEASEESADATTEVIQDAVVSTEEVSQTTLVAEASEKNADATTEVIQDAVVSTEEVSQTTLVAEVSEKSADATTEVSQDAVVSTEEVSQTTLVAEASEKSADATTEVSQDAVVSNEEVSQTTLV

SEQ ID NO: 173395 - protein, 52 aa, Triticum aestivum
  unsure (1)..(52): unsure at all Xaa locations
  Clone ID: PAT_TA_67813.pep
GTRQQQQQXAVGAPNPDPYPYIYDLQGKKMSREIRNAGSLYNFVACSATRTS

SEQ ID NO: 173396 - protein, 40 aa, Triticum aestivum
  Clone ID: PAT_TA_67814.pep
DLCEWLVDDAWSGNHRIMVNKPHNFIGGVFHVHSNTSEIL

SEQ ID NO: 173397 - protein, 138 aa, Triticum aestivum; identical to SEQ ID NO: 141364
  Clone ID: PAT_TA_67815.pep

SEQ ID NO: 173398 - protein, 142 aa, Triticum aestivum
  Clone ID: PAT_TA_67816.pep
KDYNVALVESAGKLLLIREQPEIIQVFSIDVKRKLLEPIESLGSSALFISHGNCMVVDADMLPSIKGNCIYSISFAGIQLDSVHVLYDLSDGKRRCFSGPLIPGDGLPPESDIIHEGPLSLAQVLLAPYPRVEAQLDRIQQI

SEQ ID NO: 173399 - protein, 110 aa, Triticum aestivum
  Clone ID: PAT_TA_67817.pep
ITIPGALVSGNWNEYNLNPLTRIHWRASLELAGNAAKDNKKSRIIPRHLLLAVRNDEELGKLLAGVTIAHGGVIPKINPVLLPKRTAEKEGKEPKSPKKTTKSPKKTTKA

SEQ ID NO: 173400 - protein, 58 aa, Triticum aestivum
  unsure (1)..(58): unsure at all Xaa locations
  Clone ID: PAT_TA_67818.pep
IIPWXELFXFYCPXKGXQXATXDQXLTIXWXXHYIQEXXQXDKCSXIVXLXWTVMPXC

SEQ ID NO: 173401 - protein, 67 aa, Triticum aestivum
  unsure (1)..(67): unsure at all Xaa locations
  Clone ID: PAT_TA_67819.pep
MASXKAXKPTXLXGKAKEPXXVSXPKXPAXXSXXATKPAAAKGGIXKXXSXXREPXKRXVSPAAAKN

SEQ ID NO: 173402 - protein, 123 aa, Triticum aestivum
  unsure (1)..(123): unsure at all Xaa locations
  Clone ID: PAT_TA_67820.pep
LANNSIXIILHMFLXHLPSCSFLSNTGVTNNSISKNEKTKEQRSHRLFGSRPTNGRTHTHYTRLSVGFPVIIPEEVFVNEANSQSLFTCGKECHSDHAYTTRSARVRHQMITSRRRCFPPPAV

SEQ ID NO: 173403 - protein, 181 aa, Triticum aestivum
  Clone ID: PAT_TA_67821.pep
GKLPPPVLQFADVTFGYTPDNLIYKNLDFGVDLDSRVALVGPNGAGKSTLLQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 173404 - protein, 135 aa, Triticum aestivum
  Clone ID: PAT_TA_67822.pep
WTLPFEGRVQYIPEYGIYFGFSKRLNKLCSAEMIAGAKASEPPVHKQVWDNVDVYVGEGWHLAHSYLTYLGEGKFCVTRFYDTRREWDDWCIPLSNVAVMSALEMRLDANTGELKMIRGASTRYKFPDAVHGWAL

SEQ ID NO: 173405 - protein, 152 aa, Triticum aestivum; identical to SEQ ID NO: 126264
  Clone ID: PAT_TA_67823.pep

SEQ ID NO: 173406 - protein, 84 aa, Triticum aestivum
  unsure (1)..(84): unsure at all Xaa locations
  Clone ID: PAT_TA_67824.pep
LNXXXKNKDXXXXXRQXGHTCXVSAKPFQEFXEXGEQIRXXXATIXLXNANPCWDXXMRTTPSXXIILXXSXXLSRXXFTWPLV

SEQ ID NO: 173407 - protein, 135 aa, Triticum aestivum; identical to SEQ ID NO: 130416
  Clone ID: PAT_TA_67825.pep

SEQ ID NO: 173408 - protein, 103 aa, Triticum aestivum; identical to SEQ ID NO: 107316
  Clone ID: PAT_TA_67826.pep

SEQ ID NO: 173409 - protein, 46 aa, Triticum aestivum
  Clone ID: PAT_TA_67827.pep
VQYRFFSKKKQHEATVLNVLVVSNLVVRWSFQIFVDATTSLFSCAS

SEQ ID NO: 173410 - protein, 122 aa, Triticum aestivum
  unsure (1)..(122): unsure at all Xaa locations
  Clone ID: PAT_TA_67828.pep
LKICGDGAYPLCTMRSRLVEQLPAPDYVSKISVHFDDLLGQRALAYTDTSWKRPGMTGMPLTLDACLDYLRYTTSIQKLTLRFFYFYIPFIFALLRVQPEEIVSVEMSNNKEETLIFGEXGF

SEQ ID NO: 173411 - protein, 54 aa, Triticum aestivum
  unsure (1)..(54): unsure at all Xaa locations
  Clone ID: PAT_TA_67829.pep
QGAQGXQDPGCVVRAARVXLXXSRSXDTHLVCMXTWVDRXRXNNRGXNVXXCVY

SEQ ID NO: 173412 - protein, 87 aa, Triticum aestivum
  Clone ID: PAT_TA_67830.pep
LYFFLRFLFSHLVITCCIHFPFLVYRFLEFSYLPVSSANVSFPSKHEDSLYFDLPFPFLFVVFCSLSHATQGSNLIAPLTKTCFRGM

SEQ ID NO: 173413 - protein, 136 aa, Triticum aestivum
  unsure (1)..(136): unsure at all Xaa locations
  Clone ID: PAT_TA_67831.pep
RILGPRAHVKDLYRGYLVSSYGAGIYXRGLYFGLYGALKSIVLTGSSKQDDFLANFALAWMTTNMSAFATYPIDTIRRRMMMNGFSFSEVLLDVGATPRLLYKGAGANILRSGVAGAFMLAGYDQVQASLTSRGKV

SEQ ID NO: 173414 - protein, 100 aa, Triticum aestivum; identical to SEQ ID NO: 143758
  Clone ID: PAT_TA_67832.pep

SEQ ID NO: 173415 - protein, 134 aa, Triticum aestivum
  unsure (1)..(134): unsure at all Xaa locations
  Clone ID: PAT_TA_67833.pep
PSRGFSAXRIQAMRACSNPPETSLPTSGGSTMSPNPTNISPRPLAMPRSMAEATVPAAYANYMQGQGHPQMPFVQRRPQMLSFGPRLPFTAIQTQPVAQAPNIMFSSGAMPGSVTPNHHPHLLRSSSSGNTTLG

SEQ ID NO: 173416 - protein, 56 aa, Triticum aestivum
  unsure (1)..(56): unsure at all Xaa locations
  Clone ID: PAT_TA_67834.pep
XXLLKTXPDGSXVSLAPXDPAGRAACRLWSPLAALPRRPMGTLLLCPVSLLPLYSS

SEQ ID NO: 173417 - protein, 101 aa, Triticum aestivum
  Clone ID: PAT_TA_67835.pep
PDQRAQEAHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 173418 - protein, 80 aa, Triticum aestivum
  Clone ID: PAT_TA_67836.pep
AKYFVISFYGNYLGLGRKQRCSYHVLCMLEMLVYRILCVLASPYRHMVIVVIQEKNDGLIALPSPGSQSFVLSSWYNIQW

SEQ ID NO: 173419 - protein, 140 aa, Triticum aestivum
  unsure (1)..(140): unsure at all Xaa locations
  Clone ID: PAT_TA_67837.pep
CNRSVCTSLYRPSELNTAAAGAHLKLQQNHTTTRNLSPSVTSSRVGTGRARSRCSRGTGLALQWILVKXLDCTHSNYQTLMRPXIVIYCHYLPVSGLGNLRACCLXLDVVAVSQAPSPESNPNSPSPVTTMVGPYPTIES

SEQ ID NO: 173420 - protein, 121 aa, Triticum aestivum
  Clone ID: PAT_TA_67838.pep
MARNDPAAHGPQPRPVQSIAAAMVECELFEAMRAQGWVEMEGWSGHGPVRWGCCLSDTPEHELGWGVRMGGAAEGDTHGPHLEGFLSFNLGRGGKLQPGLVYVMEGEKRTPALVLRSTWFM

SEQ ID NO: 173421 - protein, 97 aa, Triticum aestivum
  Clone ID: PAT_TA_67839.pep
QVFNREVSSSVSIDRWLWCFSGKPSYQQSDGKRSLRSNSSCWLTERFGVVRLMFFAVDCTSHLPGAFVMAQSRLFYVFAVTMVQRPRSALRIQKISF

SEQ ID NO: 173422 - protein, 81 aa, Triticum aestivum
  Clone ID: PAT_TA_67840.pep
RNFSWKCLIRKGIVFGPLKIVVFAFRPSNVSSLAPPLRTGVHLFLFYSITFLSSFAARATQVGKNGSWREWLPSGQNGLEI

SEQ ID NO: 173423 - protein, 55 aa, Triticum aestivum
  unsure (1)..(55): unsure at all Xaa locations
  Clone ID: PAT_TA_67841.pep
MHXXKAXMARXXXXXIXXXXXYGXXXXLXXXITWXQXXHXXQXGWXXEXXRXXXX

SEQ ID NO: 173424 - protein, 79 aa, Triticum aestivum
  Clone ID: PAT_TA_67842.pep
SPAGAVDVRRVNNGGLVSACFPFCTVPTLMYLRPPHIWSIYQQCRSSSWSGSVQPNTHEPATALVSGVVNLSGLGLNQV

SEQ ID NO: 173425 - protein, 170 aa, Triticum aestivum
  unsure (1)..(170): unsure at all Xaa locations
  Clone ID: PAT_TA_67843.pep
SXHDWRXGTPQHKFIEECLSTVDRKHQPWLIFTAHRVLGYSSNKWYAEQGSFEEPEGRESLQKLWQRHRVDLAIFGHVHNYERTCPLYQNQCVTGERSRYSGTMNGTIFVVAGGGGSHLNGYTSAVPKWSVFRDRDYGFTKLTAFNHSSLLFEYKRSSDGKVYDNFTLAT

SEQ ID NO: 173426 - protein, 36 aa, Triticum aestivum
  unsure (1)..(36): unsure at all Xaa locations
  Clone ID: PAT_TA_67844.pep
VVIAHDVDPIXAGCVAPCSXQENVGPLLHCQGKISP

SEQ ID NO: 173427 - protein, 92 aa, Triticum aestivum
  Clone ID: PAT_TA_67845.pep
CIFFAPPALCGFIIHHDHTIDHDYLDHGYIDIDTHDHVYSNTSAATTVNSVRVITSIHATPAMIAGGNRGETREAPKGDAVIALGVDPSESY

SEQ ID NO: 173428 - protein, 77 aa, Triticum aestivum
  unsure (1)..(77): unsure at all Xaa locations
  Clone ID: PAT_TA_67846.pep
GIGRSTWGRIRLHAPPTDDLLLYAIAACVLXRRRLIIXRYSSMDXILRECXSMAGQLDXWRLXXDXHDLVVNXHNXX

SEQ ID NO: 173429 - protein, 116 aa, Triticum aestivum
  unsure (1)..(116): unsure at all Xaa locations
  Clone ID: PAT_TA_67847.pep
PFSYISSEDEGLVTHFXALFTQGKLSEILDPQVMEEGGSDMEEVAALAAMCIALRGEDRPSMKQVEIKLEGTQASRGHEGGGVRNGPWTADGGRSQVLSRQYSMEEEFASSARYPR

SEQ ID NO: 173430 - protein, 34 aa, Triticum aestivum
  unsure (1)..(34): unsure at all Xaa locations
  Clone ID: PAT_TA_67848.pep
VGCSTVMSCTLVFXISIVDRALSGSGTTFFTVVS

SEQ ID NO: 173431 - protein, 54 aa, Triticum aestivum
  unsure (1)..(54): unsure at all Xaa locations
  Clone ID: PAT_TA_67849.pep
EAEKIQHGKSPHSTWCIYDXLNEYFWTPDCFSLGCPMRDYGDFFKSALRNDRYR

SEQ ID NO: 173432 - protein, 116 aa, Triticum aestivum
  Clone ID: PAT_TA_67850.pep
RWGVPYKCLVLMVIDGNGNSGRQDPHTKSSSRRRRNHRSRTLLWESPRASIGGVGRRERQGGGGAPQRPQAVRELRPFPCQGRANPLLQGHPCIWSASRCRLTSPSTSPSSLKNSS

SEQ ID NO: 173433 - protein, 107 aa, Triticum aestivum
  Clone ID: PAT_TA_67851.pep
YDWHPGLNQMAYMKATNLVDLLDLGASTAAGSRRVLVHASRHVSTSALVHLGDDGVAEALQWILVKGFRLYSFQLPDTNAPGIVIYCHYLPVSGLGNLRACCLPWMW

SEQ ID NO: 173434 - protein, 62 aa, Triticum aestivum
  Clone ID: PAT_TA_67852.pep
LGWCWCVGCMLTEISSSSRSLPLCFLLVLPGLNCFARCRPIDRVAEAAQCVHDDWAAAHLGS

SEQ ID NO: 173435 - protein, 90 aa, Triticum aestivum
  unsure (1)..(90): unsure at all Xaa locations
  Clone ID: PAT_TA_67853.pep
IYAIGAGITAAAGTRLALQWILVKXLDCTHSNYQTLMRPXIVIYCHYLPVSGLGNLRACCLXLDVVAVSQAPSPESNPNSPSPVTTMVGP

SEQ ID NO: 173436 - protein, 76 aa, Triticum aestivum
  unsure (1)..(76): unsure at all Xaa locations
  Clone ID: PAT_TA_67854.pep
VRXXXLXRHRXKHQLPRMKLHQRKKTXRPFSTRTPIRSLVHHXLXRSSRSIALXYFCSDFLVGSELEFGNLILVID

SEQ ID NO: 173437 - protein, 128 aa, Triticum aestivum
  Clone ID: PAT_TA_67855.pep
SSFHFAGNLKVRVSLGEALQVKSLLVNITTSICYTQAELVSSTPSRELVSPMVPSKLADLNSLSIYLQGLPFGWGFDFFPLASLSLETFISHVSNELMQHVLVFKGVVSPRNKSLVELACHIVRAWLS

SEQ ID NO: 173438 - protein, 148 aa, Triticum aestivum
  Clone ID: PAT_TA_67856.pep
ISRMAKRLRSGGQIHAERIVLRPPMSTAIAVMEVGDILDENYSGEASVGCYIKKTTNQVVKEDKLLLAQQHVCFEIEEGYGETDPYVSTLFDEIWYVEDVGDCCSRISSKFKTKEDDNDDYGEEVDSFACKRRKTKPGSAHCHLGKIY

SEQ ID NO: 173439 - protein, 50 aa, Triticum aestivum
  unsure (1)..(50): unsure at all Xaa locations
  Clone ID: PAT_TA_67857.pep
XXXXLXMGXRKXXWFIKXELXXMQAFLAAXEAMKEKDMLLKVWAKQVRDL

SEQ ID NO: 173440 - protein, 66 aa, Triticum aestivum
  unsure (1)..(66): unsure at all Xaa locations
  Clone ID: PAT_TA_67858.pep
ILEVLRRTTGSKNCQLNLSGILPVHXSIFFXLPCLTDKHFLEDMSLNHCRRTVXTGTKAPGXGYMA

SEQ ID NO: 173441 - protein, 152 aa, Triticum aestivum
  Clone ID: PAT_TA_67859.pep
LALDVIGFEHIEELYEHDETFATPYTKCLSNTSWERYYIKDGYLMRANKLCIPKSSLRLLLLQESHGGGLMGHFGRDKTFATLSKSYFWPKMFRDVNRFTNRCLTCRKAKSKAQSHGLYMPLPIPYQPWEDISMDFILGLPRTRNGKDSIFV

SEQ ID NO: 173442 - protein, 157 aa, Triticum aestivum
  unsure (1)..(157): unsure at all Xaa locations
  Clone ID: PAT_TA_67860.pep
NPXKKETLIDDLKETFDNLRVNKMMLNLDKCVFGVLAGKLLGFLVSNRGIEANPEKIKAITSLAKPKCINDVKRLAGRIAALSRFISRLGGKAIPLYHMLKKTDDFVWSDAANAAFEELGSWLXPPVLAAPVDNEPLLLYVAANARAVSVAIVVERK

SEQ ID NO: 173443 - protein, 206 aa, Triticum aestivum
  unsure (1)..(206): unsure at all Xaa locations
  Clone ID: PAT_TA_67861.pep
VCRSXLELARGVAQWAHGFKSGVLFLFNTGEEEGLDGAHSFITQHHWRNSVRFAVDLEAMGISGKSTLFQGTHQWALESFAAVAKYPSAQIATQDVFRSGAIKSATDFQIYQEVAGLPGLDFAYTDTTSVYHTKNDKIELLTPGSLQHNGENMLAFLLHAASSPKFMKDAHQAKQESTEQNNAIFFDILGKYMVVYPQRLATMFHN

SEQ ID NO: 173444 - protein, 159 aa, Triticum aestivum
  Clone ID: PAT_TA_67862.pep
MTMLLATALTDIPNISHFGLEELKQCDSSGIPSTVIKNESTQIVKQPYYFDKTEDGCLSQNNGAQKSQIRLWIENGQNMKCESASASNSKGLDTQSKSNRKRSRPGESSKARPKDRQLIQDRIKELREMVPNGAKCSIDALEKTVKHMLFLQSVTKHAD

SEQ ID NO: 173445 - protein, 250 aa, Triticum aestivum
  unsure (1)..(250): unsure at all Xaa locations
  Clone ID: PAT_TA_67863.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLADYNIQKESTLHLVLRLRGGMQIFVKTLTGKTXTLEXVESSDTIDNVKAKIHDKEGISPDQQRPDLLFXKQLEEGRXPCPTXTXRKEVHPFTWGXRLRXGXADFPXXPPPARTXPLEV

SEQ ID NO: 173446 - protein, 121 aa, Triticum aestivum
  Clone ID: PAT_TA_67864.pep
EETHASSRSRRGWRREAMPLTTRFPWICFRERGLTRAEPFRIMRRSGRTSYRRRVSRSLASGAGALAGALAGAVSGVRGPCARRHNDPRLLLAGWLALERALASLACCRLAVAVGLVAGCL

SEQ ID NO: 173447 - protein, 160 aa, Triticum aestivum
  Clone ID: PAT_TA_67865.pep
MTSLQAAPRLSLHLTPSEHRGRLLPPWRLVLSPSSCRLYTLISRQHPICNAQSYADDLLVASAQSSTTALSRLLAAEREEAKAVLSLFLRQKGLRSAVAARIANKSDGFIEHLSSKLQSAYRSRYAEGRELSTPEIRDALLPYLEALSKEHGDSLVEVVE

SEQ ID NO: 173448 - protein, 99 aa, Triticum aestivum
  unsure (1)..(99): unsure at all Xaa locations
  Clone ID: PAT_TA_67866.pep
LTQYKQSSINLTQKTANSTATEKFSTNARNHAEYRYSVYSWQWEVHAVSSRLPRKLPNHISHKLQMAQQDCRSYCPYQHQNPNYLPPLLHLXPRGEVSA

SEQ ID NO: 173449 - protein, 178 aa, Triticum aestivum
  unsure (1)..(178): unsure at all Xaa locations
  Clone ID: PAT_TA_67867.pep
METSPPPSPSPASSPGRPAKPRLFIQEMVLRNFKSYAGEQRIGPFHKSFSAVVGPNGSGKSNVIDAMLFVFGKRAKQMRLNKVSELIHNSSNHQNLDSAGVSVHFQEIIDLDGGNYKVVEGSEFSITRVAFRDNTSRYYINNRGSNFTEVTKVLKGKGVDLDNNRFLILQGEVEQIXL

SEQ ID NO: 173450 - protein, 36 aa, Triticum aestivum
  Clone ID: PAT_TA_67868.pep
FFLVPSISVSRQNRCNIQTTHHTVHRKDTSRDPRAE

SEQ ID NO: 173451 - protein, 210 aa, Triticum aestivum
  Clone ID: PAT_TA_67869.pep
RVGVTEPFLMHMAHGAAMPIRGRPKKNTSGGSGANTLINDQSLRVSKRFYVALMISRLAQEIPVTDVCESFKVARGTIQALQENAGRFASMVSAFCQRLGWQDLEGLVAKFQNRVSFGVRAEIAELTTIPFVKGSRARALYNSGLRTPVTIAEASIPEIAKALFENSWSGQDDSGLRRMQFGIAKKIKNGARRIVLEEAEAARVAAFSAF

SEQ ID NO: 173452 - protein, 79 aa, Triticum aestivum
  Clone ID: PAT_TA_67870.pep
MERANTELYLENLCIMQANERLRRKAQLLAQENEQLLADLKRKQQHMAASSRAAPQMAKGAEPSGHNAASLKSGKQQPQ

SEQ ID NO: 173453 - protein, 156 aa, Triticum aestivum
  Clone ID: PAT_TA_67871.pep
MCILCAVQRWSRRVATMLPWLVLPLILLWALSQLLPAAYRFEVTSPRLACVSVLLLTLFWYEILLPRLSIWRARRSARLREERRAHALELQKLRKTATRRCRNCNNPYRDQNPGGGKFMCSYCGHVSKRPVLDLGPAGKVPAGWPCSQDWANAVGD

SEQ ID NO: 173454 - protein, 165 aa, Triticum aestivum
  Clone ID: PAT_TA_67872.pep
MPKILSSSSSSSSISRRKPAPAAFTRSPGCRVTPPPSLRSNTRFAGSCHTVASSGTSLAEYSGEGASAVGYQDGGLPFVNLSSSNIQRTEPILPKDESTPSLLLAALPAPQKGNGPEGHLESTPAYPAAMKALFGACLAGNATEHLWNFTWPAAVATLHQSLLPV

SEQ ID NO: 173455 - protein, 69 aa, Triticum aestivum
  Clone ID: PAT_TA_67873.pep
STAPSGTPPTTCSSGSPTTAATRTRCSCSCSSRCPSTVSAAPSSRPAPTRKTAASTAPTTPTSSCPPPT

SEQ ID NO: 173456 - protein, 123 aa, Triticum aestivum
  Clone ID: PAT_TA_67874.pep
RTPATTPSTQPSTLPQQHRSRPSSYQLAAPPARLLSLHPQWWSDPRRVLVGACVRPPHSTLERPLLESSPPGKAATICLTKMTTAASSWGTHLVGDRPGETLLHEQGSTNRSRWINSPRSSPE

SEQ ID NO: 173457 - protein, 74 aa, Triticum aestivum
  unsure (1)..(74): unsure at all Xaa locations
  Clone ID: PAT_TA_67875.pep
ARGSLQVGAPXASSVKTSWTEVVGMSVEKAKEIIAKDKPDAEIEVLLVDALVTQDLRPDRVQIFIVVADTPTVG

SEQ ID NO: 173458 - protein, 287 aa, Triticum aestivum
  unsure (1)..(287): unsure at all Xaa locations
  Clone ID: PAT_TA_67876.pep
DRSVSYFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLXGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTIDNVKAKIQDKGGHXPXDQQPPDLLLGKQLXDGRTXXRXPXFXKXSPPSXLXXGLAGXGMQXXXKNPSPKNHSL

SEQ ID NO: 173459 - protein, 189 aa, Triticum aestivum
  Clone ID: PAT_TA_67877.pep
PSLRDKCFSAITKNSLATLLSFGEAIAMSKRSPEKLFVLLDMYEIMCELQTEIDTIFVGESCSQMRDSALSLTKCLAQTAQKTFSDFEEAVEKDATKNIHTDGTVHPLTSYVINYVKFLFDYQSTLKQLFQEFKREDGSGSELASVTMSIMQALQNNLDAKAKQYKDPALMHIFLMNNIHYIVKSVRRS

SEQ ID NO: 173460 - protein, 146 aa, Triticum aestivum; identical to SEQ ID NO: 141836
  Clone ID: PAT_TA_67878.pep

SEQ ID NO: 173461 - protein, 50 aa, Triticum aestivum
  unsure (1)..(50): unsure at all Xaa locations
  Clone ID: PAT_TA_67879.pep
FFLSDVYRLLNSFRTRIYYVVAMEHEENEVISGGITITQADYLVLSLSXP

SEQ ID NO: 173462 - protein, 99 aa, Triticum aestivum
  Clone ID: PAT_TA_67880.pep
MAGSGLWVVGLASLLALPGIFVSVSVEASPGDADPHYRTCVGECQNTGIIGGNIISHCQSRENDSISAGSSWYTQEALRVQWKQLNCMTDCRYYCMMRR

SEQ ID NO: 173463 - protein, 39 aa, Triticum aestivum
  Clone ID: PAT_TA_67881.pep
ESDDTGPEGDTEKDKDTFGSIQRRRMARPKGGSQASQRE

SEQ ID NO: 173464 - protein, 179 aa, Triticum aestivum
  Clone ID: PAT_TA_67882.pep
SARGIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMR

SEQ ID NO: 173465 - protein, 111 aa, Triticum aestivum
  Clone ID: PAT_TA_67883.pep
SAPPRRRRHHRGHRRFRCSAAHQGGPVWPALSVLSTKPSRGGPYALHRRRLLATTAVSCRQIRRIPVTPRSLTSTTNTRMVESRSQMPYLTTTTTPRVPTTTRRPPTTRSS

SEQ ID NO: 173466 - protein, 102 aa, Triticum aestivum; identical to SEQ ID NO: 173380
  Clone ID: PAT_TA_67884.pep

SEQ ID NO: 173467 - protein, 91 aa, Triticum aestivum
  Clone ID: PAT_TA_67885.pep
RTQPMPSPARRRRARASGREGRWRSESRPGKGRQSSPRRSWRRRRSRNPSRREGTRPRGADLAGGKEGAWRGEHVRVLRAGEGRQNSPESP

SEQ ID NO: 173468 - protein, 77 aa, Triticum aestivum
  unsure (1)..(77): unsure at all Xaa locations
  Clone ID: PAT_TA_67886.pep
WDSSAMLPSNQEFCSHDSTQSWANTGFSPKPKLITVQSMTCILLHTSKIAKTETNLSIFLCHXDLNFWPPKFKPYLI

SEQ ID NO: 173469 - protein, 54 aa, Triticum aestivum
  unsure (1)..(54): unsure at all Xaa locations
  Clone ID: PAT_TA_67887.pep
LYKVHCVKCTGCXLILRSNPSVLHPVAQNQSAHSLHQFIRCTGYVLLGRDEAIF

SEQ ID NO: 173470 - protein, 51 aa, Triticum aestivum
  unsure (1)..(51): unsure at all Xaa locations
  Clone ID: PAT_TA_67888.pep
GGWGTSSSXGSPSSSPSSTLGSAEXEGSSCWXDGGLGVAMAGGFRGSSAAS

SEQ ID NO: 173471 - protein, 161 aa, Triticum aestivum
  Clone ID: PAT_TA_67889.pep
GKAPVPAKKKTEKVTNPLFEKRTKQFGIGGALPPKKDLHRFVKWPKVVRIQRQRRILKQRLKVPPALHQFTRTLDKNLATNLFKMLLKYRPEGKTVEAKKPIVVKYGLNHVTYLIEQSKAQLVVIAHDVDPIELVVWLPALCRKMEVPYCIVKGKSRLGSI

SEQ ID NO: 173472 - protein, 65 aa, Triticum aestivum
  Clone ID: PAT_TA_67890.pep
CLSCSSKLYAPTFKIFVPHYTFLLRQYMRTGRRVGSGSSMTTDMSRTTSRLATFFTFSHTRDQWR

SEQ ID NO: 173473 - protein, 53 aa, Triticum aestivum
  Clone ID: PAT_TA_67891.pep
LSTNILWYDRGYTCPGQCVLHPRTRFWIRATSMLHAAICGRPCRNGLVHDLVP

SEQ ID NO: 173474 - protein, 150 aa, Triticum aestivum
  Clone ID: PAT_TA_67892.pep
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAAAEREAAKPAKKKESGKSSVLMDIKPWDDETDMKKLEE

SEQ ID NO: 173475 - protein, 209 aa, Triticum aestivum
  Clone ID: PAT_TA_67893.pep
PRLTHLLRKNIPFVWSSEAQSAFDQLKRALTTAPVLPLPNFQKQFVIETDACDTGVGAVLLQDGHPLAFVSKGLGLRTKGLSTYEKEYMAVLLAVERWRTYLQHAEFLILTDHISLSHLEDQRLHTSWQQKMFTKLLGLQFKIRYKKGIDNRAADALSRRPHLGEDLLAISSHQLAWIQEMLDVYQDSAEASELLVKLAVQRSENDPCS

SEQ ID NO: 173476 - protein, 139 aa, Triticum aestivum
  unsure (1)..(139): unsure at all Xaa locations
  Clone ID: PAT_TA_67894.pep
PYARYEKKKIXEKEKELKKEYKMIKEIRKQSGVSRDDRQCKILADPPLWKNIIISHPKDGKFKTKAFPLFEALGELHDGQTAEETYNFTSNESSHCSTQSHLENLGGAGKNQGETSADGENLGGERVQIDEDVEEVYVQ

SEQ ID NO: 173477 - protein, 233 aa, Triticum aestivum
  Clone ID: PAT_TA_67895.pep
VLILLPLLLLFFILLHASPIKALLTTAKLVLAPELSTVWKPQPASIFVTDHETAHSLLVRGSAGGSFSNRPPSISPSAILSHRQYQNITSAPYGEHWRAIRHNLTSEVLHPTQLHRHASARRRALHGLVVDLAEQRKNGVVHAAESIRYAMFGLVANMCFGDNINNNRVRAMADAQSDLVKSLSTARVFAHAKLPALTRLIYRNRWKKLAALRQQQEETYLPLINSRRGRHRR

SEQ ID NO: 173478 - protein, 133 aa, Triticum aestivum
  Clone ID: PAT_TA_67896.pep
FGTRASSPSSLLIVPSPALHGAPAAFSSLLGFGCLLRSHVRFQRRATAVRTRCLVKRQRRNASAAASVSLSKVAVTGFVCEQVGEHDPRVNTGGSVRAPCSHDGDAASSTYDGSAAVEQDSAEASSSCLKAHI

SEQ ID NO: 173479 - protein, 105 aa, Triticum aestivum
  Clone ID: PAT_TA_67897.pep
MTISTENQALCNVKGEGHDDLSKIRRKHSKRTGRQQGNVSHCQKRLIALKIMYFGQRFYGFASEAHTEPTVESEIFKAIERARLLVGSREDSCYSRCGRTDKGVS

SEQ ID NO: 173480 - protein, 111 aa, Triticum aestivum
  unsure (1)..(111): unsure at all Xaa locations
  Clone ID: PAT_TA_67898.pep
VTLSWQLTVXLVDLQMQLNLANESKDAALGQADRLDGERKSLALQLESKSAEVEKLQAVVTSLEESGASKELELELQLESTTAEVANLRKTVASLEAKIDAVKTLSAQHKA

SEQ ID NO: 173481 - protein, 153 aa, Triticum aestivum
  Clone ID: PAT_TA_67899.pep
MDASATGAVSKVKKYVVGRKLGGGPRKKAVARSVKAGLQFPVGRIVRFLKKGRYAQRVGMGAPVYLASVLEYLAAELLELAGNAAKDNKKSRIIPRHLLLAIRNDQELGKLLAGVTIAHGGVLPNINPVLLPKKTAEKEPKSPNKAAKSPKKA

SEQ ID NO: 173482 - protein, 96 aa, Triticum aestivum
  unsure (1)..(96): unsure at all Xaa locations
  Clone ID: PAT_TA_67900.pep
CASVVFDVEPGRTYRLRIASTTSLSALNVQVQGHXLTVVEADGNPVEPFTVPDIDIYSGESYSVXLTTNHTPTFYRSGSFWISVGVRGRPXKTLPA

SEQ ID NO: 173483 - protein, 122 aa, Triticum aestivum
  Clone ID: PAT_TA_67901.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGN

SEQ ID NO: 173484 - protein, 152 aa, Triticum aestivum
  Clone ID: PAT_TA_67902.pep
RRPPASSSDAETRLPTTSPLLLAGSSGPPPRSTHPQRRRRQLPCRRAPRPSSLRTRWSTPTSSFSRPRLRYNWSGVMVDMGYYASASQPVPPPKFNFCVLTVQIRAPSSNCPETSPAAQYNISGQAYGTHAGQTTPPRRHTTFRSNRLWGSV

SEQ ID NO: 173485 - protein, 178 aa, Triticum aestivum
  Clone ID: PAT_TA_67903.pep
FGTRDCCLCPVKGGALKPTNVDNLWVHVACAWFQPQVAFDSDELMEPAIGILSMAPLLFMKMCVICRQIHGSCTQCYRCSTYYHATCASRAGYRMELHCLEKNGKQTTKMISYCAHHRRPNPDNVLIIQTPAGTFSSKRLVQSSGTIAASRLIRKDLPKDSASEVETTENLCSARCRV

SEQ ID NO: 173486 - protein, 108 aa, Triticum aestivum
  unsure (1)..(108): unsure at all Xaa locations
  Clone ID: PAT_TA_67904.pep
ERPSAXSGRGKGGKGLGKGXAKRHRKVLRDNIQGXTKPAIRRLARRGGVKRISGLIYEETRGVLKIFLENVIRDAVTYTEHARRKTVTAMDVVYALKRQGRTLYXFGG

SEQ ID NO: 173487 - protein, 43 aa, Triticum aestivum
  unsure (1)..(43): unsure at all Xaa locations
  Clone ID: PAT_TA_67905.pep
RASSVCPAPSXAATAGPLQPLPXMAVGGLERXGWRREGEVGGL

SEQ ID NO: 173488 - protein, 306 aa, Triticum aestivum
  unsure (1)..(306): unsure at all Xaa locations
  Clone ID: PAT_TA_67906.pep
RGGTTNPQNLVSDRPQARRILLPRRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTVTLXVESSDTIDNVKAKIQDKEGIPPDQQRLIFAGKQLXDXRTLADYNIQXESTLXLXLXLXGXMQIXFXKXLTGKTFTXLEGESFETIXDNVKXKIQDKXGIPPDQQGLFFXGK

SEQ ID NO: 173489 - protein, 34 aa, Triticum aestivum
  unsure (1)..(34): unsure at all Xaa locations
  Clone ID: PAT_TA_67907.pep
ISKNARSSLAXAEXGILETRTVAVKYGRRHXPSP

SEQ ID NO: 173490 - protein, 129 aa, Triticum aestivum
  Clone ID: PAT_TA_67908.pep
EKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 173491 - protein, 83 aa, Triticum aestivum
  unsure (1)..(83): unsure at all Xaa locations
  Clone ID: PAT_TA_67909.pep
CWMNEARDLSYDMEDYMDSLIFDRPEDASIVPNNIKTTRSRFKFFGHAKTPKTKTKVDXIVETLYELRKYVQEAIERXHVYNL

SEQ ID NO: 173492 - protein, 98 aa, Triticum aestivum
  unsure (1)..(98): unsure at all Xaa locations
  Clone ID: PAT_TA_67910.pep
QVIRHEAAXRGAVPTRPPCGVGPPPRTNPRPPLCLPCASTGDGCSFESAAMLSVAGGEPMAAGGGVRRRRRPLRQVPCGQAWPWWSSLARRVPTLRFS

SEQ ID NO: 173493 - protein, 128 aa, Triticum aestivum
  unsure (1)..(128): unsure at all Xaa locations
  Clone ID: PAT_TA_67911.pep
MVNKLINKFQECLYMWTSTHQRAPCWPSKADLETGGDGRPARLVRKGRATPRRRALAVAGGDVALSPWHSQSPSCGCEEGGGGGGAGLERRSGGGRDRGNLEAGFVGARPAIAGDLRKDXLLRRGGAA

SEQ ID NO: 173494 - protein, 113 aa, Triticum aestivum
  Clone ID: PAT_TA_67912.pep
CPRPLERSRSCCASSATSRAWKIHPWREIMWKNVCTAASNRLGHACIALKDFYKLNMMQRVDWNEKHRVIFLHKKKNAYALLYSGDLSTAAKNAMKNNFETKISHIVDISYHS

SEQ ID NO: 173495 - protein, 118 aa, Triticum aestivum
  Clone ID: PAT_TA_67913.pep
PRICSLPGLLTVRLGSSRSQLVLQKFWGFRNPRAMESGDTKFDASQYAFFGNNVLEEVELGGLDDDDAGDAGFVGPGDEEYTPIYGRDMLEDEGVGSFTGVDDLAGAFSKLTRTVNEP

SEQ ID NO: 173496 - protein, 202 aa, Triticum aestivum
  Clone ID: PAT_TA_67914.pep
MESSTKFSDVKGVDEAKAELEEIVHYLRDPKRFTRLGGKLPKGVLLVGPPGTGKTMLARAIAGEASVPFFSCSGSEFEEMFVGVGARRVRDLFAAAKKRSPCIIFIDEIDAIGGSRNPKDQQYMKMTLNQLLVELDGFKQNEGIIVIAATNFPESLDKALVRPGRFDRHIVVPNPDVEGRRQILEIHMSKVLKGDDVDLMII

SEQ ID NO: 173497 - protein, 180 aa, Triticum aestivum
  Clone ID: PAT_TA_67915.pep
GTRDGSPETSSPTPPEVCDKPAEILDELASGIDIPARTTSVDASEEVSSWIASLVDVQNNAAQAETDCGLPFGFRKQEDEGFSVTAGWPTSPVLVPEDKSFFPGFKKHEEYEAKGSPFSSDRSLSNSDKAIEKRRTKIEKTVSLQELRKHFAGSLKEAAKNLGVCPTTLKRICRHHGIDR

SEQ ID NO: 173498 - protein, 91 aa, Triticum aestivum
  Clone ID: PAT_TA_67916.pep
VNCTIGLVRTCKMYHTRLYQLCAVLRHGLSVLHRSSPLSQRRDVRFIAFSSEINPTKDPNRASLSWTLLGFPFSCAQHLSSFSTRWRWLIL

SEQ ID NO: 173499 - protein, 128 aa, Triticum aestivum
  Clone ID: PAT_TA_67917.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFAR

SEQ ID NO: 173500 - protein, 98 aa, Triticum aestivum
  Clone ID: PAT_TA_67918.pep
MALPTLPFNPSTPMGPGFPDSAILCRVARVSADWNATTAECRTEDGQAVEVSFWLVDPPGISYFSVNCPGIKHEYHAWLICAEDAFVLFSLKFWGPAR

SEQ ID NO: 173501 - protein, 141 aa, Triticum aestivum
  Clone ID: PAT_TA_67919.pep
FWPKMFRNVNRFTNRCSTCRKAKSKAQSHGLYMPLPIPYQPWEDISMDFVLGLPRTRNGKDFVFVVVDQFSKMAHFIPCNKIDDASHVANLFCGEILRLHGVPKTIVSDRDVKFLSYFWKTLCAKLGIKLLFSSAYHPQTD

SEQ ID NO: 173502 - protein, 278 aa, Triticum aestivum
  unsure (1)..(278): unsure at all Xaa locations
  Clone ID: PAT_TA_67920.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDXKEGIPPDQQRLIFAGKQLEDGRTLADYNIQKEXTLHLXXRLRGGMQIFVKTLTGKTITLEVESSDTIDNVKXKIRXXXGIPPGQQRLIFRAAA

SEQ ID NO: 173503 - protein, 104 aa, Triticum aestivum
  unsure (1)..(104): unsure at all Xaa locations
  Clone ID: PAT_TA_67921.pep
MSGRGKGXGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 173504 - protein, 33 aa, Triticum aestivum
  unsure (1)..(33): unsure at all Xaa locations
  Clone ID: PAT_TA_67922.pep
VWAAVRLPCRRRYRLSLSSVPXLILKNYINIRW

SEQ ID NO: 173505 - protein, 157 aa, Triticum aestivum
  Clone ID: PAT_TA_67923.pep
MELGAAGMRRSASHNSLSGSDDFDLTHLLNKPRINVERQRSFDDRSLSDVSYSGGHARGGGGFDGMYSPGGGLRSLVGTPASSALHSFEPHPIVGDAWEALRRSLVFFRGQPLGTIAAFDHASEEVLNYDQGWEKKVDRFKLGEGAMPASFKVLHDD

SEQ ID NO: 173506 - protein, 79 aa, Triticum aestivum
  Clone ID: PAT_TA_67924.pep
HFTPQHLISSRFCFVSRLIFFFPFFFLKCHLCCMQHNHLNCPLRPLLPRSPNNRLATPPSTALPPLPLSLYRTTPITPI

SEQ ID NO: 173507 - protein, 69 aa, Triticum aestivum
  Clone ID: PAT_TA_67925.pep
MTEKREILSVMVGWFCCSNLAPTLQYVKCGFAGENFPTSVFPCVVGRPLLRYEESLQEQELTDIVVGAA

SEQ ID NO: 173508 - protein, 232 aa, Triticum aestivum
  Clone ID: PAT_TA_67926.pep
GPPPPHEFTVGFLNRITNGFSGELIIGRGRHGVVYKGMQDNGEWIAVKKLHLMPGLDDEEFKNEFNNLMRVRHQNTIWLVGYCCHTTEVPVEHNGEHVSARVEERALCSEYLHGGSLDKHLSNEPCALVWHTCYKIIKGICQGLRYLHEGFEYPIYHLELKPTKILLDKDMMPKIGGFGFSKLFDSIKTFDSSEVTGTSVYMPPEYISQGKISPKFDVFSVGVIILQIMVGK

SEQ ID NO: 173509 - protein, 212 aa, Triticum aestivum
  Clone ID: PAT_TA_67927.pep
RFGTRAVWVSEVMLQQTRVPVVIDYYSRWMARWPTVETLAAATQEEVNEMWAGLGYYRRARFLLEGAKQIAEKGEFPSTASTLRQVRGIGDYTAGAIASIAFSEVTPLVDGNVVRVISRLFAIADNPKESSTVKRFWELAGQLVDPSRPGDFNQAMMELGATLCSKTKPDCSQCPVSSHCQALALSHENPLVGVTDYPRVVPKAKPRRDFAA

SEQ ID NO: 173510 - protein, 133 aa, Triticum aestivum
  unsure (1)..(133): unsure at all Xaa locations
  Clone ID: PAT_TA_67928.pep
MKTLVIFFLGLAVANATVFFKDYFTDGDNWKTRWLSSEHKKDFGQWKLTPGKFYNDEEEDKGLQTTQDARFYAIATTFDKFSNEGKNLVVQXTIKHEQNIDCGGGYIKLFPSDLKPKDMHGESKYNIMFGPDI

SEQ ID NO: 173511 - protein, 81 aa, Triticum aestivum
  Clone ID: PAT_TA_67929.pep
LRLRVGLIIQVMASELARHLKCSGEEASMQLMSLSPYEMKRLIHNILSGKEFGITKSVKTHASSGDISVKTQESSKADKSE

SEQ ID NO: 173512 - protein, 186 aa, Triticum aestivum
  Clone ID: PAT_TA_67930.pep
VAAVTFYTYYLMSRVLDHREAAGRRHIRFRELAADVLGSGWVFYAVVTVQTAINAGITIGSILIAGNCLQIMYESLAPNGTLKLYHFIIIVAVVLSLFSQMPSFHSLRYINLGSLVLAFGYTILISGACIRAGMMSNAPVKDYSLSPSKSGKMYDAFLSISILATVFGNGILPEIQATLAPPAAGK

SEQ ID NO: 173513 - protein, 51 aa, Triticum aestivum
  unsure (1)..(51): unsure at all Xaa locations
  Clone ID: PAT_TA_67931.pep
CHLSSTCFGHLVLNNASSXLQKVYRCYIVKCIHQAVQIADIICLCTFEICN

SEQ ID NO: 173514 - protein, 137 aa, Triticum aestivum
  unsure (1)..(137): unsure at all Xaa locations
  Clone ID: PAT_TA_67932.pep
NVSVIGLTLVIGIVVFIVCSLCSGGNKKTEEESEQDEGEKRRKGVXKTXTKQKQKLPVKNKQQTFSFAHPLLHTALKGHGGNILDIHFSINGKYLATASEDRTVRLWSVKDFGTGNKCVRVNIELDHAKRIEFSPDS

SEQ ID NO: 173515 - protein, 218 aa, Triticum aestivum
  Clone ID: PAT_TA_67933.pep
FGVPINDDTLKLMSRYTGKKITQEDRAREAMRLIHAEDKHLSALNHALDLKNSHGIFGIGVTAMVLIYNATGDTLVLQVVEQQKDWSGEVARELSFFHPTVSFQNGQWIAFVHMDSTESEAARVFRGRDITGQVRDYMVAWSVSWSRRTNSAYTEVREKEHFPKLWDHYKGLLEKAGKVTRDQTDEYCASTISVGGYTSSEVIAVLQHKFSPLLEGGT

SEQ ID NO: 173516 - protein, 243 aa, Triticum aestivum
  Clone ID: PAT_TA_67934.pep
EFGTRGRAQWRTTQRSPGCSKYARTLSSMSGVGSELNDESGKPIWKNRVDSWKEKKNEKKASAKKAAAKAQVPPVEEQIMEEKDLTDAYEPLSRIIPISKNKLTPYRAVIIMRLVVLGLFFHYRITNPVDSAFGLWLTSVICEIWFGFSWILDQFPKWCPVNRETYVDRLIARYGDGEDSGLAPVDFFVSTVDPLKEPPLITANTVLSILAVDYPVEKISCYVSDDGAAMLTFESLAETAEFA

SEQ ID NO: 173517 - protein, 188 aa, Triticum aestivum
  unsure (1)..(188): unsure at all Xaa locations
  Clone ID: PAT_TA_67935.pep
AHPYSKTAAEHHHHRAPPRRRSTTNRRSQPHPAETADGQTSALGTGSTNGRPNXGHRTQREPPNLTEHHAGEEQRSTARGQEPPWFQAAAKHQEHQHAPRAPPCTCRRPDPKCHSTNQRWGRSKTGRSIPTSHHQQHSPPPXPPPLPPPPATNTTSPSRTTMGQIRPDPARPAKHHRCTSSSTSSDTG

SEQ ID NO: 173518 - protein, 130 aa, Triticum aestivum
  Clone ID: PAT_TA_67936.pep
LIISNLFRSASLILFSPQLRGSLPLHPQDPCRSPNQRATTHSRFNSSLRHCSIQILLTLHPSLCLAHPTFHSFSLKPEVAAEGSSVRSLAPWQRSGWVAARRGGGAVRDLRRRSAGTEVGAGGGLVPNSS

SEQ ID NO: 173519 - protein, 136 aa, Triticum aestivum
  Clone ID: PAT_TA_67937.pep
MARTKQTARKSTGGKAPRKQLATKAARKSAPATGGVKKPHRFRPGTVSLREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 173520 - protein, 66 aa, Triticum aestivum
  unsure (1)..(66): unsure at all Xaa locations
  Clone ID: PAT_TA_67938.pep
DDHLCCEIDGQHLTCGXILXXDGSXWAEXPNXXKFKPEEIAGIVKDXEEPGHLAPTGLFLGGTKYM

SEQ ID NO: 173521 - protein, 93 aa, Triticum aestivum
  Clone ID: PAT_TA_67939.pep
MEVVTGAMGSLLPKLGQLLMDEYNLLKRVKKDVRFLSMELESMHAALIKVGAMPRDQLDTQVKLWADEVRELSYNMEDVVDKFLVRVEGIQQP

SEQ ID NO: 173522 - protein, 204 aa, Triticum aestivum
  unsure (1)..(204): unsure at all Xaa locations
  Clone ID: PAT_TA_67940.pep
MASGSSRPQILCVSFNQDNSMFSVGTKEGFKIFDARTGRLCNDNKLGGLNVVELWFATNLIAMVGTGEQPSRSPRRLCLFNTITGASKKDLNFRSTILAVRFSRTRLIVVLQDKTFIYDLNSTRILEEIDTVHNPKGLCAFAPNSEWCYLAIPASTSKGSXLVYKASEPELICQIDAHESPLAAMAFSSNGXMYLATASEKGTM

SEQ ID NO: 173523 - protein, 216 aa, Triticum aestivum
  unsure (1)..(216): unsure at all Xaa locations
  Clone ID: PAT_TA_67941.pep
RRRRRPSQATLTLLPHPPPDLFPFPRDRCYYFHDCQVGLLRHRRNSDGGGGGGFYLRQHRPRAYDAYIVAALCTRLTFPETLGLYTYVSDTEVWSSKPASFPDGGKLPRAALRCDKVITIGGKAGTXAWVDLMRGIILCDVLPLDDDAKTLRYIPLPDPIRPDDTIDESGGMYRDVAVVGSRIKYAEVKMHVRPGSAGPKGSFTIDGWTAVVWSRP

SEQ ID NO: 173524 - protein, 139 aa, Triticum aestivum
  unsure (1)..(139): unsure at all Xaa locations
  Clone ID: PAT_TA_67942.pep
PSLLRPSVPTRGSTGILTCCPSTTPFGLILGPDSPSVDEPCGGNLGFSGHWILTNVFVTQADILASASSTPAFAVASXKAERSPTDXILTSHSFGRSLSPVHLQRKGARSVSYYALFKGWLLLGKPPGCLCTPTSFITE

SEQ ID NO: 173525 - protein, 160 aa, Triticum aestivum
  Clone ID: PAT_TA_67943.pep
MHRMALPSWSDISAYLSEYWSVVAATVIFALVGGVTIYYTINQLNKNISLSLMKAIRARAKKYKKLKDKVPAASHIWRKEPGSRSKGLKCCVCLKSVSPPQYLGGTIHQCDICGATAHPSCSGNAHKDCKCVSMVGLDHVIHQWAVQWIDTADRSEEDSF

SEQ ID NO: 173526 - protein, 164 aa, Triticum aestivum
  Clone ID: PAT_TA_67944.pep
MRTVASLTDDLLVEILSRLPVKSLRRCMCVSRTWRGIISHPHNRRQLPQTLEGFFYVPESKPAPAPSFTNVAGTGRPLVSPLFGFLPQHQSIFLLSCCNGLLLCRCWEGQDDFHYVVCNPATEEWVRLPDSVNAGTECMARLGFDPAVSDHFHVFEFSEDHDIS

SEQ ID NO: 173527 - protein, 145 aa, Triticum aestivum
  Clone ID: PAT_TA_67945.pep
LSFMPMLEAPNRIPAGRFSLQLDDIRPAPAAQGGGLVMPDKGFSVLGCRHGLVLISIPSWNQVLIWDPVTGDQHRIALPLGFDAKKTYITGAVLRSAAGDVHHFQVVVVCNDIQHTRVVACVYSSETDEWGNSISILIPFYVTGR

SEQ ID NO: 173528 - protein, 73 aa, Triticum aestivum
  unsure (1)..(73): unsure at all Xaa locations
  Clone ID: PAT_TA_67946.pep
ARYNKKPTITSREIQTSVRXVLPGELAKHAVSEGTKAVTKFTSXLDSVLLAAVVGCCLPRISVAPMEIRWNIV

SEQ ID NO: 173529 - protein, 71 aa, Triticum aestivum
  unsure (1)..(71): unsure at all Xaa locations
  Clone ID: PAT_TA_67947.pep
QXLQLSTLSLPTRNNHTRIYNKAKEIKTKETMQETTEAIIFTCVFLYTPQHFDEEAHGLNFEESQISLQLL

SEQ ID NO: 173530 - protein, 125 aa, Triticum aestivum
  Clone ID: PAT_TA_67948.pep
YMKRGEEREVRRTKIPKGVANANSVLAAAIGSATSLAKEFHWTEPSRLSAPSPPSPNARTLSHPRVAVAAAAGAISLDPRHRVLLFFIRATGHFSHFIQAVACSSPSHPPQSAVASSEGLLRRVD

SEQ ID NO: 173531 - protein, 66 aa, Triticum aestivum
  unsure (1)..(66): unsure at all Xaa locations
  Clone ID: PAT_TA_67949.pep
FMFFPGXVSPVWGTHGFFKXPAXRPXSKTCSXSLGVLSGDTGWLXGIXAXCKLPGXGRCSGMGVGL

SEQ ID NO: 173532 - protein, 46 aa, Triticum aestivum
  unsure (1)..(46): unsure at all Xaa locations
  Clone ID: PAT_TA_67950.pep
RFSSXXSFANPFIHVKTVSARIFILCDTGEKYNLKSQNYEPHLEGF

SEQ ID NO: 173533 - protein, 38 aa, Triticum aestivum
  unsure (1)..(38): unsure at all Xaa locations
  Clone ID: PAT_TA_67951.pep
VANTXLLRSFLINSVPTCMLRMHYVIILYLVTNSPHMS

SEQ ID NO: 173534 - protein, 76 aa, Triticum aestivum
  Clone ID: PAT_TA_67952.pep
RLRRFQRRIPMPLKLSFFSDGQAAFQGSQSKSETRSTFVCYNEQFRFTANDVVIVQCSHLASITLRKSTASSLTSR

SEQ ID NO: 173535 - protein, 76 aa, Triticum aestivum
  Clone ID: PAT_TA_67953.pep
GGPAHGDHHLRGAARPLPLPGRRRRRARQRRDELHLVAACAALPSRVRPARARPPTHERSMHACVLLLYRSAVVVV

SEQ ID NO: 173536 - protein, 55 aa, Triticum aestivum
  Clone ID: PAT_TA_67954.pep
FEKLAGESAKLARYNKKPTITSREIQTSVRLVLPGELAKHAVSEGTKAVTKFTSS

SEQ ID NO: 173537 - protein, 222 aa, Triticum aestivum
  unsure (1)..(222): unsure at all Xaa locations
  Clone ID: PAT_TA_67955.pep
SYAKXDAQEFSNYIRTRYPSISTEKLGVLLREQNARGLANISEMRQAFQSNMFTFTDKLMICIADSCTCCKAHGSKRCILKREDTNTDNVPPMASVDQTQFSTPLVSKIGPRLPAPGNHEGTVSANSPVSWKRDGSLSSSVQSGTSKKTYSRDQQAIVALTPTYSQSPHNQNPISQDRTIMEIASNIVAFTEKGFPPALYTKQPTEPSNDRCWGGNSTVTPK

SEQ ID NO: 173538 - protein, 143 aa, Triticum aestivum
  Clone ID: PAT_TA_67956.pep
HPPNWIPKDYLPLLVAAHTPYPDSKTKHHALLALRNAGHTIPLFMFLNTLTLAIGLGLLVKLLLMRKTPSRGEMKHVTAMVVVLAMTVACTFASGVSGSPLVDSLVLVFLAAYGVWTVFTVKGWLSNYGNCGLGRGDVSTPGD

SEQ ID NO: 173539 - protein, 131 aa, Triticum aestivum
  Clone ID: PAT_TA_67957.pep
PSYVVLCSDKWKEKMWKMHIVYILHYLCLAIPMLGCTNKDAAQMWKMYIIYILHYLGQEIPMQLGAQIKIACEPRPHFAFPIFQGLCIFGTPERDAFCISKISRALHIRHARKSTSTEVTLDSLLEHGKPC

SEQ ID NO: 173540 - protein, 120 aa, Triticum aestivum
  unsure (1)..(120): unsure at all Xaa locations
  Clone ID: PAT_TA_67958.pep
TPAGKKPKAEKKVPASKEGGDKKGKKKAKKSVETYKIYIFKVLKQVHPDIGISSKAMSIMNSFINDIFEXGESAKLARYNKKPTITSREIQTSVRLVLPGELAKHAVSEGTKAVTKFTSS

SEQ ID NO: 173541 - protein, 126 aa, Triticum aestivum
  unsure (1)..(126): unsure at all Xaa locations
  Clone ID: PAT_TA_67959.pep
PPHREDQIALASGRLSSSPNTAGSTPRRLRRIEQWQERVRVGPGSACQDAHLQPQQHPQRQQPPPRGAPARNFVERATGAPQGAQIVALTLAAGCCSDAQGTGQQKSPGGGGWRASGPGATAVAXQ

SEQ ID NO: 173542 - protein, 84 aa, Triticum aestivum
  Clone ID: PAT_TA_67960.pep
VRGRMRRRGTCQGIGIESYLRWFQHLDATSPALLNNLYGRRLVPRIRKKMNSSHRALQTWPAVRKTDKRVLPTRRGQCVTISQP

SEQ ID NO: 173543 - protein, 79 aa, Triticum aestivum
  Clone ID: PAT_TA_67961.pep
SARRYLSRSSYALIRMLHRTSLKIMQQLAEGRFQLDSVLHEPRLIRKLVCSLCHSVEKKALHCYELVLPRVVILHTSWN

SEQ ID NO: 173544 - protein, 58 aa, Triticum aestivum
  unsure (1)..(58): unsure at all Xaa locations
  Clone ID: PAT_TA_67962.pep
PPXXNXSVPVDTALSACRTLQGQGKLXGIFVWAADHSRNXXFKYXXQSQALLTDATTY

SEQ ID NO: 173545 - protein, 49 aa, Triticum aestivum
  unsure (1)..(49): unsure at all Xaa locations
  Clone ID: PAT_TA_67963.pep
LEPWVFTSVLGETLYSTIPLLELNTFTEPYIFXCIHXSSYKHIAHRHQT

SEQ ID NO: 173546 - protein, 49 aa, Triticum aestivum
  unsure (1)..(49): unsure at all Xaa locations
  Clone ID: PAT_TA_67964.pep
KLIILNLIAXALLSRTHGXHHSRXHHHHXHHXIXXHHQSHXHHSXXHHL

SEQ ID NO: 173547 - protein, 103 aa, Triticum aestivum
  unsure (1)..(103): unsure at all Xaa locations
  Clone ID: PAT_TA_67965.pep
MSGXXKXGXGLGKXXAKRXRKVXXXNIQGITKXTIXRLAXRXGVKRISGXIYEETRGVLKIFLXNVXRDAVXYTEHARRKTVTAMDVVYALKRQGRTXYGFGG

SEQ ID NO: 173548 - protein, 136 aa, Triticum aestivum
  unsure (1)..(136): unsure at all Xaa locations
  Clone ID: PAT_TA_67966.pep
MARTKQTARKSTGGKAPRKQLATKAARKSAPATGGVKKPHRFRPGTVALREIRKYQKSTELLIRKLPFQRLVREXAQDFKTDLRFQSSAVSALQEAAEAYLVGLFEDTNLCAIHAKRVTIMPKDIQLARRIRGERA

SEQ ID NO: 173549 - protein, 46 aa, Triticum aestivum
  unsure (1)..(46): unsure at all Xaa locations
  Clone ID: PAT_TA_67967.pep
WXLITQMPTTXIFSSYAXERKXKSSLVVNSXLHXDXXQQXGEXXGX

SEQ ID NO: 173550 - protein, 65 aa, Triticum aestivum
  unsure (1)..(65): unsure at all Xaa locations
  Clone ID: PAT_TA_67968.pep
SCSSTRFGHGEDRGASAASPPLAQRXRDQHTIELRLGFCGVALYTDDMLASWFNLGVYLEAKTEQ

SEQ ID NO: 173551 - protein, 48 aa, Triticum aestivum
  unsure (1)..(48): unsure at all Xaa locations
  Clone ID: PAT_TA_67969.pep
ASSXXVGARPAGWSSLAGPSPEHLERTSQPASCSEVASVAXXPLVRAW

SEQ ID NO: 173552 - protein, 36 aa, Triticum aestivum
  unsure (1)..(36): unsure at all Xaa locations
  Clone ID: PAT_TA_67970.pep
RNAVXYTEHARRKTVTAMDVVYALKRQGRTLYGFGG

SEQ ID NO: 173553 - protein, 55 aa, Triticum aestivum
  unsure (1)..(55): unsure at all Xaa locations
  Clone ID: PAT_TA_67971.pep
RQXQIRQAGPRAPASRPPXHGRPSSSSRWPPPSRSSSSLSSXXASRSTXPQNCKI

SEQ ID NO: 173554 - protein, 57 aa, Triticum aestivum
  unsure (1)..(57): unsure at all Xaa locations
  Clone ID: PAT_TA_67972.pep
LFGGRKFKNTSIAHVPSALKVHXTVLYYWKSIKLKYASYILTNWQRVSLCNHVIPSA

SEQ ID NO: 173555 - protein, 93 aa, Triticum aestivum
  unsure (1)..(93): unsure at all Xaa locations
  Clone ID: PAT_TA_67973.pep
YMRNNTEKWSDILPFDSNIEKGFRQLMQLTLKRELDKETPRICSLHNVLSQTTHLMCLTTFLRNDCSTTGVRPXALGFGLTXTSFTPRXNIAS

SEQ ID NO: 173556 - protein, 153 aa, Triticum aestivum
  Clone ID: PAT_TA_67974.pep
QTVAMHHYPPCRHPDKVIGITPHHDGLGLALLLHVDDTPGLQVRRGGRWFPLDPLPGALVVNVGDILQVLTNGKYRSAEHRVLVDAERGRTTVVMFQGASVAGTVRPLPGLGEARYRAIEYGEYVKGNFRALVEGTRFVDSLQTDVAQDEKEI

SEQ ID NO: 173557 - protein, 50 aa, Triticum aestivum
  unsure (1)..(50): unsure at all Xaa locations
  Clone ID: PAT_TA_67975.pep
XSAHHLHNIINATWIIILSNRHLRYERXQSAQQQSPDSRSSPHTXXLTVL

SEQ ID NO: 173558 - protein, 44 aa, Triticum aestivum
  unsure (1)..(44): unsure at all Xaa locations
  Clone ID: PAT_TA_67976.pep
IDMGYVCSVCLXMFCXXHKKCSXCGSEFSRVSMPDLNSLPDQRQ

SEQ ID NO: 173559 - protein, 77 aa, Triticum aestivum
  unsure (1)..(77): unsure at all Xaa locations
  Clone ID: PAT_TA_67977.pep
AQSMRRRHGMNKDAVFLXITYMTXMRGDGHPSRHREPETPSDAPXDCSHWCLPGVPDTWNQMMYGHLVYHGIRHEVN

SEQ ID NO: 173560 - protein, 47 aa, Triticum aestivum
  unsure (1)..(47): unsure at all Xaa locations
  Clone ID: PAT_TA_67978.pep
SVHIXLXYRSGXPAXAXRHRSXLLILXNXSXXXSGXSXPRRXCWGAX

SEQ ID NO: 173561 - protein, 81 aa, Triticum aestivum
  unsure (1)..(81): unsure at all Xaa locations
  Clone ID: PAT_TA_67979.pep
HMATAMXQMTTXMAQMXXXEAQMTTATAQMATAXALFQSRVLFRLPLFVSRLFLEPFILHYGPVLVRRKQPHALFVQPNQT

SEQ ID NO: 173562 - protein, 39 aa, Triticum aestivum
  unsure (1)..(39): unsure at all Xaa locations
  Clone ID: PAT_TA_67980.pep
NFPNSAVLLEDSLHLPILLIXNSSTSNHHPRLLRTSPVL

SEQ ID NO: 173563 - protein, 108 aa, Triticum aestivum
  unsure (1)..(108): unsure at all Xaa locations
  Clone ID: PAT_TA_67981.pep
AGXTFPMLKTLILNDWCLHADLSAVIHFIQHSPNLEKVTLKFAEEFDSSMVTEGDNSLLEGTFSSDHLKMVEIKCLKVDGRINKILKILSACGISLEKVNIRQANTSS

SEQ ID NO: 173564 - protein, 60 aa, Triticum aestivum
  unsure (1)..(60): unsure at all Xaa locations
  Clone ID: PAT_TA_67982.pep
XGGGMLAIPSVAEDPSGWVTSFCGREVMQWQKKQQLPEXAVTXFXSSGYVXSRWKLGRFL

SEQ ID NO: 173565 - protein, 99 aa, Triticum aestivum
  Clone ID: PAT_TA_67983.pep
KVLNMGSMYGFWRTLNKQERVAKQRYLQMFYNLQFRNLVKTVPRVGEQPPRAAATTGAAAERNQIVARPRERKPQGRVQRMMTSLLGPKPPTYEQNGYR

SEQ ID NO: 173566 - protein, 135 aa, Triticum aestivum
  Clone ID: PAT_TA_67984.pep
VLDTLEYNMSVPTQYVFMRRFLKAADSDKQLQLVSFFMLELCLVEYQMLKYCPSLLAAAAVYTAHCAINRCWQWTKICETHSRYTRDQLIECSKMMVQFHQKAAGGKLTGVHRKYSTFKFGCVAKVEPAHFLLGG

SEQ ID NO: 173567 - protein, 39 aa, Triticum aestivum
  unsure (1)..(39): unsure at all Xaa locations
  Clone ID: PAT_TA_67985.pep
PINDRGFRMIVHXNYLFLLRLFSETQHLLSFIIQSRLVQ

SEQ ID NO: 173568 - protein, 36 aa, Triticum aestivum
  unsure (1)..(36): unsure at all Xaa locations
  Clone ID: PAT_TA_67986.pep
FAVRDXRXTVAVGVIKGVXKKDPTGAKVTKAAIKKK

SEQ ID NO: 173569 - protein, 57 aa, Triticum aestivum
  Clone ID: PAT_TA_67987.pep
FDQSHLLICFLLTCTVLYNYMPPVLFCIEKPSFISCTLLSHLFFKSVNNYNIATSSL

SEQ ID NO: 173570 - protein, 175 aa, Triticum aestivum
  unsure (1)..(175): unsure at all Xaa locations
  Clone ID: PAT_TA_67988.pep
ASLQGPRGSIGNIAPEYGIGNKXSTAGDVYSYGIIILEMLTGKCPTDVLFKNGLTLQKFVGNAFPKKIRDILDPTFIIPRSGDEGLDHGNHAMVELLSCIMQLVQLGLSCSTETPKDRPTMPDVYSEVSAIKREYSASRAKELTWCYMLSAFPSPTTVQNFPGLSVTVDITVWIP

SEQ ID NO: 173571 - protein, 21 aa, Triticum aestivum
  Clone ID: PAT_TA_67989.pep
VNVRVFCILSNSQKVANELIF

SEQ ID NO: 173572 - protein, 64 aa, Triticum aestivum
  Clone ID: PAT_TA_67990.pep
QLLRESNSREGTNLASTTSGYIGHCKHSRQLSSSNDQSLTVHSIFVRQGWNLRPGLLALFKEKK

SEQ ID NO: 173573 - protein, 152 aa, Triticum aestivum; identical to SEQ ID NO: 126262
  Clone ID: PAT_TA_67991.pep

SEQ ID NO: 173574 - protein, 76 aa, Triticum aestivum
  Clone ID: PAT_TA_67992.pep
ERTRTTAGSGDFENDDFFPDLGNLVLDAMGDNVNAGGVAPAAPYVILSFLFEIVVEFMFLVCALDVICSSAMQFTY

SEQ ID NO: 173575 - protein, 174 aa, Triticum aestivum
  unsure (1)..(174): unsure at all Xaa locations
  Clone ID: PAT_TA_67993.pep
TFRPRARRSSLRSLTPSGGGHGQSAFYQDITTQXGIEAGLQSITAGGTXAPPKFAITDDAWKSVGTKKQSSGADFPSEAGKPPPLPRLTGNKENSNFXSGDDPATATGIETLVRAPKDKYGLKYVYMWHAITGYWGGMRPGVTRMEAYRSSMQYTKISPGMAENEPNMKRLFGL

SEQ ID NO: 173576 - protein, 57 aa, Triticum aestivum
  Clone ID: PAT_TA_67994.pep
QQLYFRFAKLNRVLLLNLKGIYYNSCQLVTQTIPLITQQKHQKDEDVSAPESVDPAI

SEQ ID NO: 173577 - protein, 74 aa, Triticum aestivum
  Clone ID: PAT_TA_67995.pep
RAWLPQASYPCGNFSDTSSFKLRRSKGSIGHAFTVRIRTGNQNQTSFYPFVPHEISVLVELILGHLRYLLTDVP

SEQ ID NO: 173578 - protein, 105 aa, Triticum aestivum
  Clone ID: PAT_TA_67996.pep
SFPVDNAQMLPSTKSTPSKELEKSPASSKSIQSPGSQNTSPLGQYMPPACQSATMDTDKNINRYSSAKRSIQFTEDGATNKEGQQQEHLQDTQVHLQVVKKHKQE

SEQ ID NO: 173579 - protein, 46 aa, Triticum aestivum
  Clone ID: PAT_TA_67997.pep
CSLDPIANELQEIIYISVSLIHLVLAYLYLAYLLSFSQSSNSTLSS

SEQ ID NO: 173580 - protein, 72 aa, Triticum aestivum
  unsure (1)..(72): unsure at all Xaa locations
  Clone ID: PAT_TA_67998.pep
GPRRCCFGAVFPSWTAVRFWSEAMRKGGSRARRPLGARSPMVALRACSIISLELAKQAALXSHXXFSLLGLF

SEQ ID NO: 173581 - protein, 205 aa, Triticum aestivum
  unsure (1)..(205): unsure at all Xaa locations
  Clone ID: PAT_TA_67999.pep
NXAHATNKPDDFSRKYPPSQPSRISVLVAVRCSKATAGDQLQRSAAGTCQSFTVAQHGPAITPMQPRQADNVRRSSIAAPTELQRSTDVVRRSSIAARTELQRSTDVVRRSSIATPAELQRSIDGVRRTPLQLQRSSIATPAKFHCSAGSASVGVERVASTHAPTSRMTTLIVPVVLCNKQQQQQMCSPQPSSTGSTGGVCNAAP

SEQ ID NO: 173582 - protein, 205 aa, Triticum aestivum
  unsure (1)..(205): unsure at all Xaa locations
  Clone ID: PAT_TA_68000.pep
VELVEXQNALGNLLRRIHQNRQQKSKKSTTALPWGVGAAVDSPRTHPENAPANCTRPPAHRALHVSFRGDARDARGGVGPVVDPDVGGRNRQQGSLATWGWLERAGSRGRQGMLLLGVAGFRQPHSCRGGRVVGAWATLGGEVGVGERQWLEVAWRRGDPASLLLAAEGSGRKRRWGSLRHCWRRWRRPREQWAAAARGRASGDF

SEQ ID NO: 173583 - protein, 40 aa, Triticum aestivum
  unsure (1)..(40): unsure at all Xaa locations
  Clone ID: PAT_TA_68001.pep
PRAERLEQLEGTLASQRVVVVTGRDQLYEEXTESISVXPP

SEQ ID NO: 173584 - protein, 69 aa, Triticum aestivum
  Clone ID: PAT_TA_68002.pep
MADWAPVFVGLALFILLSPGLLFQIPGKGRIVDFGSFQTSGASMLIHAVIYFALITILLLAVRVQVFLG

SEQ ID NO: 173585 - protein, 84 aa, Triticum aestivum
  Clone ID: PAT_TA_68003.pep
QDAREQEARCWLQLGDGQKALEDATRCKRRCPEWAEARLRRGQALMLLKDYEKACEELSGGVELDPENDEMDKLFWEAMELKKK

SEQ ID NO: 173586 - protein, 115 aa, Triticum aestivum
  Clone ID: PAT_TA_68004.pep
PLHIRDLEDAYLSPHRAGLAAPTARLPGLLLRHPTCDGTVISKTMWAQWNPPRGALLPGRGARRWGSRGQGGDGHLQISSQWGTPLPSYLVNWHAVEREIPDCKAGHNRQEHKLS

SEQ ID NO: 173587 - protein, 133 aa, Triticum aestivum
  unsure (1)..(133): unsure at all Xaa locations
  Clone ID: PAT_TA_68005.pep
IGLAAYKLQLPAEAXIHPVFHVSQXLKEFVPDHTPVFTTLPVLVDLSSLDVAPGSILDRKLVKRGDTTLLQVLIQWTGLHVEAATWENYDTIKIRYPTAPVWGQAETQAGGNVSASTLPLTSIKDGEAGPSTD

SEQ ID NO: 173588 - protein, 63 aa, Triticum aestivum
  Clone ID: PAT_TA_68006.pep
HLGIQPWNDILQFQQNTNIISERLFAPRGVDPVTFGFHQPSEPEIAQIRMLPQCDEMQPLLLA

SEQ ID NO: 173589 - protein, 119 aa, Triticum aestivum
  Clone ID: PAT_TA_68007.pep
MVKEAEEFAEEDKKVKERIDARNQLETYVYNMKNTVGDKDKLADKLESEEKEKVEEALKEALEWLDENQTAEKEDYEEKLKEVEAVCNPIVSAVYQRSGGAPGGEGADGGVDDEDHDEL

SEQ ID NO: 173590 - protein, 108 aa, Triticum aestivum
  Clone ID: PAT_TA_68008.pep
HRCCSWSPEPSGMGSSTYCNSCIKLHHSVLSGRTRLSRRAAHQATRTEKWCGMIRLQACYRFKSYASAAWQWASNIHLFELLPLIFFMHPFLWHLISFASTLGTLIWS

SEQ ID NO: 173591 - protein, 104 aa, Triticum aestivum
  unsure (1)..(104): unsure at all Xaa locations
  Clone ID: PAT_TA_68009.pep
KNLXXGIQLSWSAGQNNTKFGVXTKYNIDAEAALNAKVNNVGQVGFGYSXQXXKGVKLTLSSLVDAKNLNGGGHKLGLGVXFEVSTANHISILCDVISISFTHQ

SEQ ID NO: 173592 - protein, 50 aa, Triticum aestivum
  unsure (1)..(50): unsure at all Xaa locations
  Clone ID: PAT_TA_68010.pep
VDGWLIHKDYILTXPTYINIXIRGWIGSPMSTQAXDNXGPRSFSAKDTKG

SEQ ID NO: 173593 - protein, 132 aa, Triticum aestivum
  unsure (1)..(132): unsure at all Xaa locations
  Clone ID: PAT_TA_68011.pep
FPKEXRFAKLVYPLKKNLFSTTERTERFQGLVNPHNAGIMYPADVLAAWASGVTGITCTLTQKPFRKTAPHGNSLDIQIQHTEYCTTAFPLAPSSAAASPCSTASSLNLAANRQSTCYITACTKLFENWRPW

SEQ ID NO: 173594 - protein, 102 aa, Triticum aestivum
  Clone ID: PAT_TA_68012.pep
ISYSLFDGTCYSDNRSNSRANTCNKPRLLGGAHLLDKRLTRALLADPMIHDNSTDRTAFVPATHHSNFCPINPVLLPKKTAEKEPKSPKKTAKSPKKADKKA

SEQ ID NO: 173595 - protein, 93 aa, Triticum aestivum
  Clone ID: PAT_TA_68013.pep
PYTLELGIWISMAFTRCQVIDLQYMLHRAIALSYAPDSKKVVLCIQRDSVTLPTLHFGTPKLRSPRLRVGDNGSIHRPQYMHVAPSVSKYKSF

SEQ ID NO: 173596 - protein, 93 aa, Triticum aestivum
  Clone ID: PAT_TA_68014.pep
GKNTQPQVHNPHTRTRRGKQNTPKTKPTEYPLAKPIGLEAVHEPGPFSEPPEIPLDILTVLDLPVPCLAEPRERLHRPGDGRVLEHHHGRPAS

SEQ ID NO: 173597 - protein, 89 aa, Triticum aestivum
  Clone ID: PAT_TA_68015.pep
RESKKIDKHMYHTLYLKAKGNGFKNKRILMEHIHKQKAKQSRAKMFSDQASARRLKNKEGRRRREERIALKKKEMLSALAKEDEATKKE

SEQ ID NO: 173598 - protein, 110 aa, Triticum aestivum
  unsure (1)..(110): unsure at all Xaa locations
  Clone ID: PAT_TA_68016.pep
KGKXKWAHAASVGCLXRKGKWAHAASVGCLGIGKLRAASHWCPRCLAFLQLIRFQERLSELVACIWLLSCLGIGKLRAVSHWCTRCLAFLCLISLHERLSKLVSCIWLLP

SEQ ID NO: 173599 - protein, 84 aa, Triticum aestivum
  Clone ID: PAT_TA_68017.pep
AGRCYYGVHSARKIVYPDDAKYIPDDITFRGTRSVDGMLGMDLVYFSPKFDVEIAENLNMLHSEEEEKKKKKKKRTRRGMCRPN

SEQ ID NO: 173600 - protein, 112 aa, Triticum aestivum
  Clone ID: PAT_TA_68018.pep
SSFNIDVKFHGTTLLQLRAETFSVARESSLTLPYSGASRGAKLDLAGMRAMEEALRSRVVPITLSGKARTRWRMGIFLKVAFWTRLNCPLSFSYPPGSVMPIDHDTCRSRSP

SEQ ID NO: 173601 - protein, 52 aa, Triticum aestivum
  unsure (1)..(52): unsure at all Xaa locations
  Clone ID: PAT_TA_68019.pep
PIXEQXNGGRLXACIXSRPXQCGXXYGYILEGKELEXYMRKLQKKKGKXAXA

SEQ ID NO: 173602 - protein, 152 aa, Triticum aestivum; identical to SEQ ID NO: 126262
  Clone ID: PAT_TA_68020.pep

SEQ ID NO: 173603 - protein, 188 aa, Triticum aestivum
  Clone ID: PAT_TA_68021.pep
SIFEITYKSDTRWNRFKHQLKTISGHCNNTPVYDDGILQPRSGILLLHKILQNMATRPYMTVKALQFEPGQNILEKNYLLKAFRYCSMVNALALLPSDGRHLSSKLIASQSFLMALLLLNILLALLLLNILLDKEFAAETIRPHEDLLDSRQIAVQQLYRRAGKNFNTILLPFVLEVDFRKQCLQLFQ

SEQ ID NO: 173604 - protein, 92 aa, Triticum aestivum
  Clone ID: PAT_TA_68022.pep
RPPARCHRAQPHRNASHRPPAAGHLIQICRSWMGEPKEDVPCVGGGNGGRASSSCKRAATVCKISRRNQQDSENKFVIILLPKSDMQRGRNI

SEQ ID NO: 173605 - protein, 57 aa, Triticum aestivum
  unsure (1)..(57): unsure at all Xaa locations
  Clone ID: PAT_TA_68023.pep
HVNLCIIXCKXADLQSSRTTKDYLPSPAPLRQISCILWKVLKFHFTYSRKPYTQQSW

SEQ ID NO: 173606 - protein, 78 aa, Triticum aestivum
  Clone ID: PAT_TA_68024.pep
TYAHGLLGCQCVPHNPMNFTVCSPPPHGKSSIRSIMQDFQKRFKDLSYILFLQDLLHSFIVLFQGGYIISNLYTQQRG

SEQ ID NO: 173607 - protein, 58 aa, Triticum aestivum
  unsure (1)..(58): unsure at all Xaa locations
  Clone ID: PAT_TA_68025.pep
LARKQGKVGWRIFGPVSCHGGDSRRGRRRGRVGWSECRVXIPGIPXQVLPCDXFTLLR

SEQ ID NO: 173608 - protein, 176 aa, Triticum aestivum
  unsure (1)..(176): unsure at all Xaa locations
  Clone ID: PAT_TA_68026.pep
SDDNGNFDSANNDTGNIDEVVNNEEQSKEDTIEQRRKKTGDDMILEGITAWSDDEDEVRDHWYLVESCGKLLMVIRQVRVPSYNISSTLKVEVYEADACKGAHCWVPIVGGLGSQTLFISRFFCKSISTCDEADQDAIHFIDTXEKYNMKSQTMSKSWRDIEYFESMWIFSPELVV

SEQ ID NO: 173609 - protein, 121 aa, Triticum aestivum
  Clone ID: PAT_TA_68027.pep
AKIMLSCLPASSGPAQVPCFYRTSTFERVQVFYRQARISAMLISLFSFSIRRLKLPLRRTQIFSSGMSLALNNCASIWTLGSSLVHLIFTILRCLQANDPPFGLNLPSAFWMSKFISSWRK

SEQ ID NO: 173610 - protein, 195 aa, Triticum aestivum
  unsure (1)..(195): unsure at all Xaa locations
  Clone ID: PAT_TA_68028.pep
MIRMATSITKLLQSAKNPPSAAISVTQLPQWRDGELSIEPIELVIFTIDVGVVRQFLSDSININIHGNVLEVVSINFLSFSPRSIPMLSDPRVVTNTVHRHRFDFMLTEDRGSDNWLHFTLTKDRGSDHWLHFTLTEVRGSDHWLHFTLTEDRGRDHWLHLTLMEDRSSDHWLSLSRSPKTXSSDHWAXLYAHRX

SEQ ID NO: 173611 - protein, 66 aa, Triticum aestivum
  unsure (1)..(66): unsure at all Xaa locations
  Clone ID: PAT_TA_68029.pep
GKSGSXFQFDVHDXVRLVGXATVEKDESHAGKVVLRXWFEKNKHIFPASRWEPYDPEKKFDKYTVK

SEQ ID NO: 173612 - protein, 98 aa, Triticum aestivum
  Clone ID: PAT_TA_68030.pep
LSSEAQSLLPNFNTAEMRAASEDALKVERTTRKWLTIMNKDCNRFCKILTLEGKKAASHPELPRKRRRITFADEAGGMLCSVNVFSDVQTSPACEGES

SEQ ID NO: 173613 - protein, 133 aa, Triticum aestivum
  Clone ID: PAT_TA_68031.pep
MDFGGHLLAIIKGQGLIQVFKCDDENGTLSHVKSIIKHAIFIGHHRCLAVNTDMFPSIEANCIYYTEHLGSSARIWKFNIEDRKVETVSEAVDFAKKDKQFVLVADRPFTIIQLLSSYTINIQDSELALQQIT

SEQ ID NO: 173614 - protein, 133 aa, Triticum aestivum
  Clone ID: PAT_TA_68032.pep
MVASANQWGLLQCAFPEEGGSTIAVFTLDDYRPCKWSLKHRFCMGDAFGRDNFLPNRDYLSWLCFYRIVALDLERGVLFLVDKESNKLFSYKTSTGQLSEIKDGRLGWTWECFYYVACYSKLPVLSRLCDVIE

SEQ ID NO: 173615 - protein, 89 aa, Triticum aestivum
  Clone ID: PAT_TA_68033.pep
RRTISSRNGGIFPHAVLSTEQISLLNCHTPTTIAELEKLIGKVKTDKYGSDIIEVMWSETGSGKDSGDGAKRQKKDKGVVFVESGEEEG

SEQ ID NO: 173616 - protein, 107 aa, Triticum aestivum
  Clone ID: PAT_TA_68034.pep
QAHSRADSRAKVSEIDVNLEPAVTENGPSRDQQPTQDLPADANDGFWQQFLTEQPGLTHAHQEAQSERRDREANQTTAGDRGSFWLDKSSIEQMTKKLGHLTSAEKT

SEQ ID NO: 173617 - protein, 49 aa, Triticum aestivum
  unsure (1)..(49): unsure at all Xaa locations
  Clone ID: PAT_TA_68035.pep
TRGVLKIFLENVIRDAVTYTEHARRKXVTAMDVVYALKRQGRTLYGFGG

SEQ ID NO: 173618 - protein, 48 aa, Triticum aestivum
  unsure (1)..(48): unsure at all Xaa locations
  Clone ID: PAT_TA_68036.pep
ITRPHAEHQHRRXXXXPXITXHDGAGXGVXXXEQVGELVVLXXDLAGP

SEQ ID NO: 173619 - protein, 160 aa, Triticum aestivum
  Clone ID: PAT_TA_68037.pep
YDAIEYIQELGRTVEELTLLVEKKRGRREHQGDVVDPAPLVVAGEGECSAGELAAAVMPAMPPPPQPIRSTYIQRRSKETFVDVRIVEDEVNIKLTKRRRDGCLAAASRALDDLHLDLVHLSGGKIGDCHIYMFNTKIHPGSPVFASAVASKLIEVVDEY

SEQ ID NO: 173620 - protein, 157 aa, Triticum aestivum
  Clone ID: PAT_TA_68038.pep
LSKFAKTYSLGCYLPIKHTSKLCTLELQHYTVCSSVEATIRVQVIEGQFPRDFRGVLTASTDAESGVMISLLDFNNDELPVDADGSVKLSRQVVSVRKGGKLKVSVWQHGVGEEEDQEITAASFTATEAETSTNYMPMKKWKCWMEVTVAWSLFSCW

SEQ ID NO: 173621 - protein, 51 aa, Triticum aestivum
  unsure (1)..(51): unsure at all Xaa locations
  Clone ID: PAT_TA_68039.pep
QQTSTSLGXIXMIIIXLATTATNNXRSRAXATSXKLXXKXYSMAPQXXQHP

SEQ ID NO: 173622 - protein, 134 aa, Triticum aestivum
  Clone ID: PAT_TA_68040.pep
EKTPAGKKPKAEKRLPAGKTASKEAGGEAKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 173623 - protein, 125 aa, Triticum aestivum
  unsure (1)..(125): unsure at all Xaa locations
  Clone ID: PAT_TA_68041.pep
DNVKAKIQDKEGIPPDQQRLIFAGKQLEDGRTLADYNIQKESTLHLVLRLRGGMQIFVKTLTGKTIXLEVESSXTIXNVKXKIXXKXGIPPDQQRLIFAXKQMXDGXTXADYNIQKESTLHLVXR

SEQ ID NO: 173624 - protein, 66 aa, Triticum aestivum
  unsure (1)..(66): unsure at all Xaa locations
  Clone ID: PAT_TA_68042.pep
NYECXMAYXEXMRSAVLVAVHAARHAGRLXXEVSVGPGLXTSPPVXRGTLDWNLSCSQLMASMRNV

SEQ ID NO: 173625 - protein, 149 aa, Triticum aestivum
  unsure (1)..(149): unsure at all Xaa locations
  Clone ID: PAT_TA_68043.pep
LPPPKQSTATLPQXKSPPLSDIPIGVSSPSPPPPPPPPRPPSHRLPEAKAKTKKKHRKVQDEDGKVRLPLLEKMKKQEEKRMEDKKAREAANGGRQPTEHEDWDVSPKLLPASEDPGTPPTTELVTNMAAAVVVLVGIALSVWRTMSSS

SEQ ID NO: 173626 - protein, 100 aa, Triticum aestivum
  Clone ID: PAT_TA_68044.pep
ATRMPLSGPVYEYPDMRPQSRARGRPYREHLAGGEGMVVGSGGTASQRPSPAHTSSPSTSCCMMVIITLSPHCACMETPVSAFVGIQNRHSRTVWASAPG

SEQ ID NO: 173627 - protein, 39 aa, Triticum aestivum
  unsure (1)..(39): unsure at all Xaa locations
  Clone ID: PAT_TA_68045.pep
NMCFYCLCPFSTTVNSXWEXFIGADEPILARTSXYDSXX

SEQ ID NO: 173628 - protein, 99 aa, Triticum aestivum
  Clone ID: PAT_TA_68046.pep
PLLHICYQHERYNIFFSSSQTVADGAHFAEFSTKLPNFEGLQLKNTTLFVGVETRVIISAAREMYFLFVGHFLHLLWTVTFDTAISVQAIKINFNMSGL

SEQ ID NO: 173629 - protein, 110 aa, Triticum aestivum
  Clone ID: PAT_TA_68047.pep
KFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPDDDDDLIE

SEQ ID NO: 173630 - protein, 139 aa, Triticum aestivum
  Clone ID: PAT_TA_68048.pep
LTATELAVSTPPAPRSNQKRKSGGDGAKTSNRAAVKKPKTEPEARTLGVKEEPPSSVEPISKASASAGSDTDMSAITEEEIIRVLRAIAPVRSQDFVPRFKARIRTPEDKKHFHDIVMKYAYSHKTNGVSYLHLRKEYE

SEQ ID NO: 173631 - protein, 175 aa, Triticum aestivum
  unsure (1)..(175): unsure at all Xaa locations
  Clone ID: PAT_TA_68049.pep
PAKRTVQRNDDDGSDDGRPKYTVVYISEHSCKATESAAVPVILETTVRTDTAAAPDVAVVPGSSSGAISSETQSPASSSDITWSSGGSDGGANVPPRERDDYSRLFAIEDDCWGWNASPPAPAAAAALLQEMDFDGPIRSPVHVAAADGSWINDLFVNEPPFVLNSCHLFGXLDL

SEQ ID NO: 173632 - protein, 132 aa, Triticum aestivum
  unsure (1)..(132): unsure at all Xaa locations
  Clone ID: PAT_TA_68050.pep
RRSLMXEXSSEFVEXKVAYALAQGXKVIACVGXTLEQRXAGSTMEVVAEQTKAITGKIKDWTNVVVAYEPVWAIGTGKVATPAQAQEVHANLRDWLKTNVSPEVAASTRIIYGASLKPEFIDIINAATVKSA

SEQ ID NO: 173633 - protein, 46 aa, Triticum aestivum
  unsure (1)..(46): unsure at all Xaa locations
  Clone ID: PAT_TA_68051.pep
SGSRIHLLARLVCFSAPCAHPLIWWFLRRFVGVYCKLSGELFXLSX

SEQ ID NO: 173634 - protein, 69 aa, Triticum aestivum
  Clone ID: PAT_TA_68052.pep
LARPTKLNSRHNFPSSTIRVTASKLLNQNTRLNHYDWDKKRRDPPQLGAKLSVTRPDPPTRLRRQPSSK

SEQ ID NO: 173635 - protein, 64 aa, Triticum aestivum
  Clone ID: PAT_TA_68053.pep
EVFGKWKGRLTMVGFRPRPLSSLVNASIRTLLQSYSANYQLAEKDGVLYLGWKNKPLVVSSAWH

SEQ ID NO: 173636 - protein, 49 aa, Triticum aestivum
  unsure (1)..(49): unsure at all Xaa locations
  Clone ID: PAT_TA_68054.pep
WGTLTLYXXCMYNPFFKGDVSFLFSFFLFTLFSLRTCTKHGKGKKICLF

SEQ ID NO: 173637 - protein, 45 aa, Triticum aestivum
  unsure (1)..(45): unsure at all Xaa locations
  Clone ID: PAT_TA_68055.pep
ETRGVLKIFLQXVIXXAVXYXEXALRKTVTAMXVVYXLKQPGTHP

SEQ ID NO: 173638 - protein, 117 aa, Triticum aestivum
  unsure (1)..(117): unsure at all Xaa locations
  Clone ID: PAT_TA_68056.pep
NXLVFTNLQVLCHARKKRSSFRGHELHCFINFQGRGMTRFGGCWFKDNRSGVKDGIFTRYAITIAAMRIWXIAWXLGNAKRCTLWGCLLCYTRLPAERQSSQSHGKRPAMQHKWQVG

SEQ ID NO: 173639 - protein, 197 aa, Triticum aestivum
  Clone ID: PAT_TA_68057.pep
DKCKFSHVVPTADGPSKPDAKKSDASLVSEKPGREQTSSQKASTVHDGERVTSAPTKHYSILKNLAGISVNALKASTSTPKGVQFRPSSKDRSNSSMLHQDALTIEKHMYTNGSKHQNFGGPQAEEGDKNVSPNKQRSAPLLDEKNSSKEASSHPSSDPKGTSLPTGSTTVLGSLSTQHEVSEASRILQEFLFGAGS

SEQ ID NO: 173640 - protein, 30 aa, Triticum aestivum
  Clone ID: PAT_TA_68058.pep
SHVDNIFFKKEINSDYICTIIMHIRMVTAD

SEQ ID NO: 173641 - protein, 89 aa, Triticum aestivum
  unsure (1)..(89): unsure at all Xaa locations
  Clone ID: PAT_TA_68059.pep
SSWANSAGLDWCRHVGCTCMSLSFRHLGKEKREQRGDNYVVIEDDDLLATGCIYLCCRGLLVRSRDDDIELWRSSCSIGYCFSNSLCVX

SEQ ID NO: 173642 - protein, 42 aa, Triticum aestivum
  unsure (1)..(42): unsure at all Xaa locations
  Clone ID: PAT_TA_68060.pep
GAXLRRFFDTSKIHRNTSLADYPGSSEXTTQQKRPTCSPKQN

SEQ ID NO: 173643 - protein, 155 aa, Triticum aestivum
  Clone ID: PAT_TA_68061.pep
ASFDAAQMNMAGLDQPLPIAGLPLGNFGYSAPEYGVAASELTEKVDTYSFGVLLLELVTGRMANEFGADGHLATWARKNFTKLMANQQEMFQSAVDRDIPDQAQYMKEMATVFRLGVDCTAVDPQKRPSMRMALKRLRRGCGRGPFRGLLACYLL

SEQ ID NO: 173644 - protein, 39 aa, Triticum aestivum
  Clone ID: PAT_TA_68062.pep
RAPTHCCHGNINPFILFKFNKYKFACIGMLIIQGNKGDF

SEQ ID NO: 173645 - protein, 40 aa, Triticum aestivum
  unsure (1)..(40): unsure at all Xaa locations
  Clone ID: PAT_TA_68063.pep
KLGXVRKEPLXXSPXXGXKXXGXXPGSHYRSTXCXPXXWC

SEQ ID NO: 173646 - protein, 48 aa, Triticum aestivum
  Clone ID: PAT_TA_68064.pep
YTTYMDKIYHTTRIMNRYNPIYINKTYKLLRLSLVFLSPTLRSCRRPS

SEQ ID NO: 173647 - protein, 73 aa, Triticum aestivum
  unsure (1)..(73): unsure at all Xaa locations
  Clone ID: PAT_TA_68065.pep
KNRFIPYKYIYSFNFKIAIVAPAVSILPSMSSMISESLNPDNHSIFMLSNISSVKGLRNCEVCWXSVYHNVSG

SEQ ID NO: 173648 - protein, 108 aa, Triticum aestivum
  unsure (1)..(108): unsure at all Xaa locations
  Clone ID: PAT_TA_68066.pep
NLSSSTNKIKGRREHSSVPPSNIFYPCSNNQSLLPGSQRQISDEASAAASCTWLAGRHRSFIGHPSRTCLGTARAAELMTALGCFQSLQVQRXLVYPACDLAXHTXYX

SEQ ID NO: 173649 - protein, 65 aa, Triticum aestivum
  unsure (1)..(65): unsure at all Xaa locations
  Clone ID: PAT_TA_68067.pep
GSNIDPTAWEDKKCKGEXRIRRLCKALEEDAFRPVLHHYDGPKFRLELSIAETLSLLDLCKTEDA

SEQ ID NO: 173650 - protein, 70 aa, Triticum aestivum
  Clone ID: PAT_TA_68068.pep
RQKHWIANLIHSKETLLWRNHYAINILTYVLHLHRARSQPQARLSQRRARTLDAKSSRIISLKYTTIKMR

SEQ ID NO: 173651 - protein, 104 aa, Triticum aestivum
  Clone ID: PAT_TA_68069.pep
VLLEMITGRRAFNDDQDAVGDRHLVQWAQPFLANVRQFELCRMADPALQGRYPSFDLRKAVAYAGLCIQERPDMRARIDTVVKVLSHLANDVDRPESSHHAAPN

SEQ ID NO: 173652 - protein, 156 aa, Triticum aestivum
  Clone ID: PAT_TA_68070.pep
VDTRRQERAKRMEEKKVYLQLYEAMEALVHICRDGCRTIGPWDQKLKGSQVVCKFPACKGIELLVRHFSACKMRVPRGCSNCKRMWQLLELHSRMCSTPGTCRVPLCRHFKDKMRHRSKKEELKWVLLVCKVLGSKGTIDSVLKARKISPLKPIGA

SEQ ID NO: 173653 - protein, 59 aa, Triticum aestivum
  unsure (1)..(59): unsure at all Xaa locations
  Clone ID: PAT_TA_68071.pep
KSTIMSGICHHSFFFIIKNTLKCRKERGVAIPLCNIXVMKEHSVKKFPTITQESPCAPS

SEQ ID NO: 173654 - protein, 108 aa, Triticum aestivum
  Clone ID: PAT_TA_68072.pep
LPCTFSFPRSAGCARCTSCSLFLSPERDAATTASYSSSAAIVWAPDSTKCWDSISLALTPSSSSSATCHTCLMRLYSSSLGMPTPSSSMSITMLCNRQHVSTVQYASS

SEQ ID NO: 173655 - protein, 190 aa, Triticum aestivum
  Clone ID: PAT_TA_68073.pep
VRHPEIMGKAQQEVREVLGQDRATIGNSDLGELHYMRMVIKEVLRLHPPAPLLPRSATEDCKIMDCDMLKGTNVYVNVYAISRDPRYWKNPEEFKPERFEDNNIDYNGTYSEYTPFGAGRRQCPGILFGTSSLNITLANLLYHFDWMLPDGASLSSFDMSEKFGITVSRRHDLQLRAIPHEWFKATSSSK

SEQ ID NO: 173656 - protein, 181 aa, Triticum aestivum
  unsure (1)..(181): unsure at all Xaa locations
  Clone ID: PAT_TA_68074.pep
FGTRANDASWSAREAVVADGQWDTDRRMLCLRACRVELPVLPSAPAVPEHGCGIGMSFWFPAVWTMRERSVVAGMLWNSTQAGAGLITASSMDGQRSSTNLSDVKYSYNDTLLNDAMKHYLKISKEKKITXGSHLFPDFNTTHRDFEFGFYGPVIGSGHADPVTIGSAMVAGNMLAADDAF

SEQ ID NO: 173657 - protein, 314 aa, Triticum aestivum
  unsure (1)..(314): unsure at all Xaa locations
  Clone ID: PAT_TA_68075.pep
FGTRESPANLVSDRPQARRILLPRRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLXRLRGGMQIFVKTLTGKTVTLEVEXSSDTIDNVKAKXIQDKEGISPDQQXXLFFAGKQLEDGXRTLADYNIXKESTLHLVXXXRXGMXIFXKTPXXXTITPEGEXFXTXXXXKAXIQERGDFPGXQXLIFXGXQXXXGRP

SEQ ID NO: 173658 - protein, 156 aa, Triticum aestivum
  Clone ID: PAT_TA_68076.pep
FGTRKLWAAEGFARSSDEGKDLEDVCQGYFDVLVSASFLQPEVGKYSNKMDAYIVHDLLLDLADKVAGSDCFRIENQWKRSGDNWTMEGCEDEVPPDVRHVFVQTYGSELIIEKICKLDNLRTLIIDSAEWKKPVEEKVLKSLFAKLRKLRVLIIA

SEQ ID NO: 173659 - protein, 138 aa, Triticum aestivum; identical to SEQ ID NO: 141364
  Clone ID: PAT_TA_68077.pep

SEQ ID NO: 173660 - protein, 148 aa, Triticum aestivum
  Clone ID: PAT_TA_68078.pep
TVTKYVYASCGFLPLVTTELGASGGLSAAVVPVPPVAAAFFVLPKPELRDGPMWRECNWMGFVAVATDEGAAALGRRDIVVAWRGTVQKLEFLSDGIFSLGCAKPVLQPIPGPLAAAYNNAKVHDGFLTVYLTGDEYSQHYRTCARDQ

SEQ ID NO: 173661 - protein, 192 aa, Triticum aestivum
  unsure (1)..(192): unsure at all Xaa locations
  Clone ID: PAT_TA_68079.pep
LDEILQXSRFQKMYHVCMCANAPLFTGIEQLQQFSHLQQLLGLTATDSVELGHIVEPPAIRTATSILPLGWTGLPGGKSAEPLKVDIIGHGLHMCTLFQAQINGSWYSTAIETLPSTTSYSLDQEVQPTLQKMRILVGRPLKQPPNYTSEDFMVPVVTGAMNPDYGVEPFEDKGCCKGLNEVIIYGTSDFVT

SEQ ID NO: 173662 - protein, 168 aa, Triticum aestivum
  unsure (1)..(168): unsure at all Xaa locations
  Clone ID: PAT_TA_68080.pep
FGTRTSAQLFKXPSSQKKWRTTCLLAMCKELQLLTTEQLFGKEILCFHVRQCEELLFPPFKLKFAHDFKILKQLGQGSEGEVSKCSSNFSDFKCAVKEVVPSNFLIDASTTKKHSEPSEVTLMVKLNHGNIVKMFLSWNETGSNFMGLPSDATFICMMLSARTPVVLS

SEQ ID NO: 173663 - protein, 69 aa, Triticum aestivum
  unsure (1)..(69): unsure at all Xaa locations
  Clone ID: PAT_TA_68081.pep
PXPGPGXADRHRGNRGTEAWRGRDRGAAATTINQSINRAALRTSERTLTKGKNWGRGRRSGGGMGPRAE

SEQ ID NO: 173664 - protein, 175 aa, Triticum aestivum
  Clone ID: PAT_TA_68082.pep
EASRSQIVCVKFIARKRWFVAGSSDGFVHVYKYENKMENIMSFEAHSLGVCSLAVHPTKPYVLSGSRAQIKLWDWDQHWSLKCIQTSEEHWGYVCGVAFNPEDTNSFASFTDGSEDHAIQVFLPLSVSTMKYVLFSKMSSVQVWSIDSPECKFTLSGHSRNVRCLDFFTRDGRKC

SEQ ID NO: 173665 - protein, 175 aa, Triticum aestivum
  Clone ID: PAT_TA_68083.pep
MASVQAARSAEKEKAHAVCLPAPAQGHINPILDVAKLLHGRGFHVTFINTEYNHARLLRSRGASAVAGVPGFRFATIPDGLPPSEDMDVTQDGDSVCRSIEETCLGPFRRVLAELNDPASGVPPVTCIISDSVMSFSIEAARELGVPYVHFWEASAASYLGLRHYRLLVDRGLVP

SEQ ID NO: 173666 - protein, 144 aa, Triticum aestivum; identical to SEQ ID NO: 120234
  Clone ID: PAT_TA_68084.pep

SEQ ID NO: 173667 - protein, 202 aa, Triticum aestivum
  Clone ID: PAT_TA_68085.pep
MQTRGGFDVQKHGPELDIESKHANWMKASPWLIGANPRDLIMPVDGDDGFYPTGNDLKPEVVSSNRKYRAHVLVCAPSNSALDEIVLRVLQTGIRDENNNTYNPKIVRIGLKAHHSVKAVSMDYLIQQKQSGVASDGGRRGAGEQDRIRASLLDEAAIVFSTLSFSGSAIFTRMTRAFDVVIIDEAAQAVEPATLVPLVHGC

SEQ ID NO: 173668 - protein, 289 aa, Triticum aestivum
  unsure (1)..(289): unsure at all Xaa locations
  Clone ID: PAT_TA_68086.pep
AKPGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLXLRLRGGMQIFVKTLTGKTITXLEVESSDTIGQREGPXIQDXEGIXPPDQQRLXFGW

SEQ ID NO: 173669 - protein, 43 aa, Triticum aestivum
  unsure (1)..(43): unsure at all Xaa locations
  Clone ID: PAT_TA_68087.pep
GVVHNIRSSERVLVCKMGTCVQXLPQCCTXYLRILPFFFSDQV

SEQ ID NO: 173670 - protein, 153 aa, Triticum aestivum; identical to SEQ ID NO: 124505
  Clone ID: PAT_TA_68088.pep

SEQ ID NO: 173671 - protein, 133 aa, Triticum aestivum
  Clone ID: PAT_TA_68089.pep
VGTHGDVQYNVGDRAVVESGSDGAPSKNLRFLNRAAMITSASDNSGGASGPSVWRLCTVQQVEDLKSLLGVFPLWSSGIMVSVSIGVMLGMIILQALAMDRSLGPHFNIPAGAISVCSLVAFIVATPVLDRAV

SEQ ID NO: 173672 - protein, 200 aa, Triticum aestivum
  Clone ID: PAT_TA_68090.pep
MALSVEKTSSGREYKVKDLSQADFGRLELELAEVEMPGLMACRTEFGPSQPFKGARISGSLHMTIQTAVLIETLTALGAEVRWCSCNIFSTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCA

SEQ ID NO: 173673 - protein, 153 aa, Triticum aestivum
  Clone ID: PAT_TA_68091.pep
MDASAAGAISKAKKYVVGRKLGGGPRKKAVARSVKAGLQFPVGRIGRFLKKGRYAQRVGMGAPVYLASVLEYLAAELLELAGNAAKDNKKSRIIPRHLLLAIRNDQELGKLLAGVTIAHGGVLPNINPVLLPKKTAEKEPKSPKKATSSPKKA

SEQ ID NO: 173674 - protein, 47 aa, Triticum aestivum
  unsure (1)..(47): unsure at all Xaa locations
  Clone ID: PAT_TA_68092.pep
RVTSHPSPMEGNQGRKSSXGGXSNQRSRYLLIMKKAILPQTETMXSX

SEQ ID NO: 173675 - protein, 81 aa, Triticum aestivum
  unsure (1)..(81): unsure at all Xaa locations
  Clone ID: PAT_TA_68093.pep
ACKNVLHYGIGEYFTNAGMFEKVQKKTTIAIFXPNCIPCIHGNCAKVKPKSACHMVREVILKIWCXAIFSCSVKFFSGLLV

SEQ ID NO: 173676 - protein, 92 aa, Triticum aestivum
  unsure (1)..(92): unsure at all Xaa locations
  Clone ID: PAT_TA_68094.pep
GTVALRXIRKYQKSTEXXIRXXPFQRLVREIAQDFKTDLRFQSHXVLALQEAAEAYLVGLFEDTNLCAIHAKRVTIMPKDIQLARRIRGERA

SEQ ID NO: 173677 - protein, 75 aa, Triticum aestivum
  unsure (1)..(75): unsure at all Xaa locations
  Clone ID: PAT_TA_68095.pep
XXXGGXFPXXCXTXPXXXGXXXLXXKTAHFXEGXFPXNCXXARFSEGLFPLNCHPAXFSEGYFPLXCXXSXFSEG

SEQ ID NO: 173678 - protein, 135 aa, Triticum aestivum; identical to SEQ ID NO: 130416
  Clone ID: PAT_TA_68096.pep

SEQ ID NO: 173679 - protein, 40 aa, Triticum aestivum
  Clone ID: PAT_TA_68097.pep
FSITGRGTVATGRIERGTVKVGDPVDLVGIRETRNATHWC

SEQ ID NO: 173680 - protein, 66 aa, Triticum aestivum
  unsure (1)..(66): unsure at all Xaa locations
  Clone ID: PAT_TA_68098.pep
RFSPEHPSKKEEYLIGLCFHTQQSGMWLSSKXAILAAXNDANSLVSDQAVRLSTPLSLSKEKRKIR

SEQ ID NO: 173681 - protein, 31 aa, Triticum aestivum
  unsure (1)..(31): unsure at all Xaa locations
  Clone ID: PAT_TA_68099.pep
LNCNPTHFSEGXFXLNCXXXXFSXGLIXLEL

SEQ ID NO: 173682 - protein, 44 aa, Triticum aestivum
  unsure (1)..(44): unsure at all Xaa locations
  Clone ID: PAT_TA_68100.pep
LGGFXFAGKKFRGLXGXGXXXXXNRPSXXXPWKRNQXXSLRRYR

SEQ ID NO: 173683 - protein, 145 aa, Triticum aestivum
  Clone ID: PAT_TA_68101.pep
QLAFCPAITVPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDTSLGQKLASRLKIKPSM

SEQ ID NO: 173684 - protein, 191 aa, Triticum aestivum
  Clone ID: PAT_TA_68102.pep
AYVLVCFNVALAPGALMTTFLIHHGVSPLVLGVFAGSSALMGILATFMTPNLVKELGILNAGAAGLLGQSALLGAAVLVYLTGSISRRGALFTFLGLIVVSRLGHMAYSVIGLQVVQTGSPIGKAKLIGATEIAIASLAELGMMAVAVAAKDVSRFGAVAVLSAAAVAAAAWLYCAWLANSTQHLKTLFPS

SEQ ID NO: 173685 - protein, 91 aa, Triticum aestivum
  unsure (1)..(91): unsure at all Xaa locations
  Clone ID: PAT_TA_68103.pep
RDAYGARNNNRFRFKRNNRYSPPEDGSTRPESPGTAPHRVMTRTLHFVWPLLYSRLAHTTYDFTHPLCLGHXQHRHLNWTPYLSTNRGSSL

SEQ ID NO: 173686 - protein, 47 aa, Triticum aestivum
  unsure (1)..(47): unsure at all Xaa locations
  Clone ID: PAT_TA_68104.pep
YERXEVXERLTEXTAHHSAGFXDSXWXGSXYEXTVXNXALTTIXQDQ

SEQ ID NO: 173687 - protein, 152 aa, Triticum aestivum; identical to SEQ ID NO: 126262
  Clone ID: PAT_TA_68105.pep

SEQ ID NO: 173688 - protein, 98 aa, Triticum aestivum
  unsure (1)..(98): unsure at all Xaa locations
  Clone ID: PAT_TA_68106.pep
SKGYAKGRSVDXXGQKNDRFFCGKIATFVHYPHYQNPHCRRADLSASFQQAKEPFLLPRRSNVXXXKPIRPPVNGRHLTGASLSGVARSSSSRHACCG

SEQ ID NO: 173689 - protein, 100 aa, Triticum aestivum; identical to SEQ ID NO: 143758
  Clone ID: PAT_TA_68107.pep

SEQ ID NO: 173690 - protein, 84 aa, Triticum aestivum
  unsure (1)..(84): unsure at all Xaa locations
  Clone ID: PAT_TA_68108.pep
VMGTHSKLERPQHKXQIPAKHTHTHTHTIQTKARALPTTTAHHSLLWLNVNLRSKLSDVALVELDVHLQPEVHCSLVGVKAEGG

SEQ ID NO: 173691 - protein, 62 aa, Triticum aestivum
  Clone ID: PAT_TA_68109.pep
GTTRYDHGGSKVDEEASGNGFPIWQSMKIGLQIGYPRNRSMRRRKILSKFFWRVSVFIGFRP

SEQ ID NO: 173692 - protein, 122 aa, Triticum aestivum
  Clone ID: PAT_TA_68110.pep
NSWIYRRTTAKAFAKDVFINQERKLGARRRSDTVLVSTINDADQGSADVAYRTPPAPYEKSKSLGSGGSMVARLKLKGIDGRAPPCIPTIHTLLSVVVVSPSLFFVLISSSRVVNVARLGLL

SEQ ID NO: 173693 - protein, 43 aa, Triticum aestivum
  unsure (1)..(43): unsure at all Xaa locations
  Clone ID: PAT_TA_68111.pep
XGYXGCHQEXIGVLSSRMFLFXVXAFVASDSYPERAMICLSFN

SEQ ID NO: 173694 - protein, 47 aa, Triticum aestivum
  Clone ID: PAT_TA_68112.pep
SRSLHEFWERLIFLSWGEAAYFLSRPKELALCNMVRVLRSSLFLRSS

SEQ ID NO: 173695 - protein, 123 aa, Triticum aestivum
  unsure (1)..(123): unsure at all Xaa locations
  Clone ID: PAT_TA_68113.pep
FGXRLLTPLIFPANRSRRLASTSPARILTAQRLNSPSSHPSSISPHPPRTPLISLCPLRCCSSGADVSRRSEPSSRPWPPWPLELLPSLLCRAASTTAPHAHSCPQPPCTCSVLNLLPSYGYV

SEQ ID NO: 173696 - protein, 43 aa, Triticum aestivum
  Clone ID: PAT_TA_68114.pep
RTTGTATNWCSLNSIFVWCYIQTDIFHGFIVVLFCLDKAMLFM

SEQ ID NO: 173697 - protein, 59 aa, Triticum aestivum
  Clone ID: PAT_TA_68115.pep
QEVKAYIIKFVNLHVRGRAFIHYEAHPRNHQVSKSLTCGFFKFAMHPYPLHVLAILSIH

SEQ ID NO: 173698 - protein, 36 aa, Triticum aestivum
  unsure (1)..(36): unsure at all Xaa locations
  Clone ID: PAT_TA_68116.pep
APXNPTTLNYFHYCYYYSWCTYIYXRRIHDVHVTYL

SEQ ID NO: 173699 - protein, 46 aa, Triticum aestivum
  Clone ID: PAT_TA_68117.pep
HGGVIPNINSVLLPKKSPAAAEKEAKSPKKKTAAKSPKKKTAATKE

SEQ ID NO: 173700 - protein, 71 aa, Triticum aestivum
  unsure (1)..(71): unsure at all Xaa locations
  Clone ID: PAT_TA_68118.pep
TVEXLGLFXXIXSRXIXFEAMIGGXIXIWXVIIIIIXXLXXXFFXIPXFYXXXIXNXQNCXRFRLFFFCGA

SEQ ID NO: 173701 - protein, 40 aa, Triticum aestivum
  Clone ID: PAT_TA_68119.pep
FTSCLVFVHYITALITIRYSISSFHAVVDELWNRSDAAAK

SEQ ID NO: 173702 - protein, 207 aa, Triticum aestivum
  unsure (1)..(207): unsure at all Xaa locations
  Clone ID: PAT_TA_68120.pep
QPKASVVFLSFGSLGRFSAEQIKQMAAGLETSGQRFLWVVRRPTGDEHQPAGDLNTLFPEGFLHRTKERALVVMSWVPQQAVLAHGAVAGFVTHCGWNSVLEAVMAGVPMLAWPLYAEQHTNKVFLVEEMRLAVAIEGYDKEMVEAQEVAXKVRWLIESDGGRELRHRTQGAMRQAKEALDDAGESRTAFLHLTRQWKNADHNGSIN

SEQ ID NO: 173703 - protein, 153 aa, Triticum aestivum; identical to SEQ ID NO: 173481
  Clone ID: PAT_TA_68121.pep

SEQ ID NO: 173704 - protein, 147 aa, Triticum aestivum
  Clone ID: PAT_TA_68122.pep
YSKGRGGIDWRNFDGDDSSDSPYGSFGGKTSFTWYWPGEEDDDDLPNGFQWREEPRPNKSREKVWNESDVDEEEAPRRDDLKSHRISLGLPVLGPLKLDHIKSAFRASALKWHPDKHQGSSQAEAEDKFRRCVEAYNALSGAFKRSS

SEQ ID NO: 173705 - protein, 54 aa, Triticum aestivum
  unsure (1)..(54): unsure at all Xaa locations
  Clone ID: PAT_TA_68123.pep
IFCKNXMNAKASILVVFLKVLHTNFRTIDGKQFYMADPSNLDRLNFYGHQIVLV

SEQ ID NO: 173706 - protein, 211 aa, Triticum aestivum
  Clone ID: PAT_TA_68124.pep
KDSASEVETTENLCSARCRVYVRKELKRSREAAMAHRVRGYCQHRWDEIDSLNPRREERDPESFSTFKERLRYLQKTEHSRVCFGRSGIHRWGLFARRDIQEGEMVLEYRGEQVRRSVADLREAQYRVQGKDCYLFKISEEVVVDATDKGNVARLINHSCTPNFYARIMSVGHDQSRIVLIAKRNVCAGEELTYVVYDFLFFFFADGLSLC

SEQ ID NO: 173707 - protein, 169 aa, Triticum aestivum
  Clone ID: PAT_TA_68125.pep
EEFILNLSLEHLRDLVDAFCATNSIKGHNTLDYYLEAQGVITEEAYDNAKENFHSYRRYRIKEFEKLNTARVKEGHALLEDGIALIGNFRVTTDYHRLGRNDVYDIPEGATFETNPSGQYCSHCVVIIGYGVTSDGLSYYIFQNSYGKKWGDKGRIACSCLKYLYRASV

SEQ ID NO: 173708 - protein, 165 aa, Triticum aestivum
  Clone ID: PAT_TA_68126.pep
VHFLFLRLRSSVHDKRQVRQHSRPAMPGCSMPVSLDVVRCIANVQFALVLRGGAIAGVQFGTFFLQILLVYNTAVHVSHRCGAGVRLGVLLQFFIVDFPELQRLFEKKIENLWTLQFNPSLYYREVLAHLFHVFQNSIDYINACSAFGPRMWLTFESNAVHLCLT

SEQ ID NO: 173709 - protein, 107 aa, Triticum aestivum
  unsure (1)..(107): unsure at all Xaa locations
  Clone ID: PAT_TA_68127.pep
LNVNETTSTKKSLDQLSGGSPHKVLHLDIFKGTKAGHLSEDDATAKDCHPFRKARDEISLKPIEXLRKRSPPGQACSDAEIEYRRARSLREANGVLSWRSTLSRQLQ

SEQ ID NO: 173710 - protein, 94 aa, Triticum aestivum
  Clone ID: PAT_TA_68128.pep
NMSYEQLQAKDQAVGTQSRGLSDELTCYLVPFRNNCNFFSSKKNNEECAICKSNFKSQQKLIRLPCSHSYHADCITRWLKINKSCPVCNEEVFG

SEQ ID NO: 173711 - protein, 106 aa, Triticum aestivum
  Clone ID: PAT_TA_68129.pep
PLLISLSLRKKTPQPTRIPQELRSGHMLSAYQIRETYYGKSSRTSRRLDLIRTWFNPGSISPGTMRRLVTAEHCFYMVYINEVAGQMSPVRLCSLDRQNFHNIALT

SEQ ID NO: 173712 - protein, 45 aa, Triticum aestivum
  unsure (1)..(45): unsure at all Xaa locations
  Clone ID: PAT_TA_68130.pep
TANSRCTSFLVLVSFSWSKSSSSSQAICWVVWPVHYLFFFELXII

SEQ ID NO: 173713 - protein, 80 aa, Triticum aestivum
  unsure (1)..(80): unsure at all Xaa locations
  Clone ID: PAT_TA_68131.pep
MKDRIIYSVDGLHKXVQGWFRXRPKXEASRRASAWYRVTYHPDHRRPGKKQFWSFPWIVXDELLKIKESSKRRRQQVDGA

SEQ ID NO: 173714 - protein, 68 aa, Triticum aestivum
  Clone ID: PAT_TA_68132.pep
RKKGMQLRLLINTPETDRSSPKQEQPARKKEKSIDQEDAWVSQTWMKEWHGTPMSCARVVDRSFLSVT

SEQ ID NO: 173715 - protein, 174 aa, Triticum aestivum
  Clone ID: PAT_TA_68133.pep
LTDNHPPAMHYFCHRDQMVQNLVRERLKHFVPIGAGTSEGNEYSVEENLNYSRSQFGQSSGANDRWVTPNSRTSVPTDFGKRRVHAGGSQSGSGHWFTGEDGRKVYVSKNGQELTGRDAYKQYKKESGKGFRNFKKKSTVKKEGSARAKRGSSTANKASSSSTAKRSSGAKRKR

SEQ ID NO: 173716 - protein, 65 aa, Triticum aestivum
  unsure (1)..(65): unsure at all Xaa locations
  Clone ID: PAT_TA_68134.pep
HVNYSNSVCLPIFMNFFEYSVEPFADFIFVAFFTSSLFSESERGCIMSVRQXVPVXXVTFSAEDS

SEQ ID NO: 173717 - protein, 135 aa, Triticum aestivum
  Clone ID: PAT_TA_68135.pep
ITIPGALVSGNWNEYNLNPLTRIHWRAHLRGDPRCAQDLPRERHPRCRHLHRARPTQDRHRHGRRLRAQAPGSHPLRIRRLGHHQISSLIVGCSRSISLLFVLPCLFSGCTSVLGWNGNCSSLPCLVCSLDVLLY

SEQ ID NO: 173718 - protein, 42 aa, Triticum aestivum
  unsure (1)..(42): unsure at all Xaa locations
  Clone ID: PAT_TA_68136.pep
VGVLHVYXCIWFLLGXLXLXCVAEXTLFSFXMWNXSHHFSXM

SEQ ID NO: 173719 - protein, 153 aa, Triticum aestivum
  Clone ID: PAT_TA_68137.pep
IFLLETLTRVVYCIVTRNTHSAAFCVGHALFDMLGHRNFTIADHYIKDTVLVAFKDYFDVLIAAGNDIRCGPEALMTIRRVSRIEQCIPDWDSYFQRNIIIAPEATQDEDVDNEEDEVVFPKGDYDSFGGGFSGGSGGDGDAGGGVGASVAAA

SEQ ID NO: 173720 - protein, 102 aa, Triticum aestivum
  unsure (1)..(102): unsure at all Xaa locations
  Clone ID: PAT_TA_68138.pep
LVHFGFESEDCFVNYVRRVXGXXGQSKXTCSLYSRLECGSCKXKKLGRYXWTKRQRISMKKRLTIGIESFAIFHYGEMRPGHVAKMEYPECSLLEEKEAKRC

SEQ ID NO: 173721 - protein, 63 aa, Triticum aestivum
  unsure (1)..(63): unsure at all Xaa locations
  Clone ID: PAT_TA_68139.pep
XCLXQPXMXRXXQGXQEVXXRXLXXRQGXXQXXVXXRPXCPNPXVXFNXNXPKGWVFFEXXIX

SEQ ID NO: 173722 - protein, 180 aa, Triticum aestivum
  Clone ID: PAT_TA_68140.pep
AKPRRDFAAVCVVQIAQGLEQETAAGKCNFFLLIKRPEEGLLAGLWEFPSVLVDERKTDPLNRRKEMDRYLKQLVDIDVEQESNLILREDVGQHVHIFSHIRLTMHVELMVLKIKGDVGQACNKGQDSTKLKLVDESSIDSMGLTSGIRKVYNMVKAFKEKKLLEQSQMPTTKRSRRQKQ

SEQ ID NO: 173723 - protein, 163 aa, Triticum aestivum
  Clone ID: PAT_TA_68141.pep
LLIARCIRENGWQLVRITYNTLIDALANKGEVDKAMTLFDEMASDGISPDDITYGSLVMCFCRKNMAEEALELLNRTLAVGFQVKVTTFVMVIQALCRDSKAEAAADIMRVMVSEIKNTSNSFYLSIVRRVAKSGRIEEAERLLQELVDCKIVKEDSLVVLSG

SEQ ID NO: 173724 - protein, 134 aa, Triticum aestivum
  Clone ID: PAT_TA_68142.pep
LAIALVYSQVAYEIMEKGSADAGHGRFSWRNLAPRVALRTLYVAACAFVAAALPFFGDIVGVVGALGFIPLDFVLPVVMYNMALAPPKRSAVYVINVAIMALFTGVGIIGAIASVRKLVLDAGQFKLFSDHVIS

SEQ ID NO: 173725 - protein, 121 aa, Triticum aestivum
  Clone ID: PAT_TA_68143.pep
LQRNVMDNHVADRCVILEGDNRLIAPKGVADRVCLGLIPCSECSWATAVRALRVGGGVLHIHGNVNDSDEARWLDNVVESISSIATAHGLSWKVSLEHVERVKWYGPHIRHVVADVRCGSN

SEQ ID NO: 173726 - protein, 33 aa, Triticum aestivum
  Clone ID: PAT_TA_68144.pep
ADHPACYGIQGGYNRAWGNYFYYGGPGRNVHCP

SEQ ID NO: 173727 - protein, 85 aa, Triticum aestivum
  Clone ID: PAT_TA_68145.pep
NSWIYERRTTAKAFAKDVFINQERKLGARRRSDTVLVSTINDADQGSADVAYRTPPAPYEKSKSLGSGGSMVARLKLKGIDRRLQ

SEQ ID NO: 173728 - protein, 42 aa, Triticum aestivum
  unsure (1)..(42): unsure at all Xaa locations
  Clone ID: PAT_TA_68146.pep
IGVSGLSCLDKKFKNFFLVKIXKLKRKKKSXWVVKVNQFNIS

SEQ ID NO: 173729 - protein, 114 aa, Triticum aestivum
  Clone ID: PAT_TA_68147.pep
MCLSCLSYDGNVAAFAVLNNIVMVSTRTGKFSEEFKEVHSELISCLSFSINGKYLVSGGDKHVRVFHNTLGYKETIKEMKEKLKKLPTASATRERLEQQIKIANESLDKILAAA

SEQ ID NO: 173730 - protein, 47 aa, Triticum aestivum
  unsure (1)..(47): unsure at all Xaa locations
  Clone ID: PAT_TA_68148.pep
AXXHPARPPHPRGXGLGXGXRVRALSXXPTVMFRFQSLXVXLXMFPV

SEQ ID NO: 173731 - protein, 124 aa, Triticum aestivum
  unsure (1)..(124): unsure at all Xaa locations
  Clone ID: PAT_TA_68149.pep
SARTDLAKXEQYEKQLKPLPGLQGIDVKSLEKTSGARHVEQAMKVDAPEEVKKQKAKKRERSTYRPKRKDKRAQVRGAQGAVSREKHDGSAANAGATSSKPTTSAKAPEPPKGSNKSRKKKSRS

SEQ ID NO: 173732 - protein, 72 aa, Triticum aestivum
  unsure (1)..(72): unsure at all Xaa locations
  Clone ID: PAT_TA_68150.pep
RMPXXTRRXSIXRRRKRRLPXPPXLIWSSCCLLXMXCVYYCXRFGXXXXADXXLGGWXXLXMXLLLRRXXIF

SEQ ID NO: 173733 - protein, 134 aa, Triticum aestivum
  unsure (1)..(134): unsure at all Xaa locations
  Clone ID: PAT_TA_68151.pep
GLQDETSPCFLCEQEEDIVDHLLLQCAFARHVWYLCFFKVDIDLGXWQLMSMTPSHQDRLQDWWTSRRKQIQKEERKGFDSFVTLISWTLQKQRNNSVFHSGNICSVLATVEPIFAKIRQWALAGGGGVHRYCE

SEQ ID NO: 173734 - protein, 179 aa, Triticum aestivum
  unsure (1)..(179): unsure at all Xaa locations
  Clone ID: PAT_TA_68152.pep
FSIQSPRSSLSFSGWSMLSMKLSGESLTAFPGKTGGRLGVDLAEMECFKARAMQIIRKSRDPSRYLELMRIKADSLLDSGGSSERGLCSSPEIPLPLQVGTTTLVLNGAQLAAPEINITGRCHGNKPXAGSDSKAAEGQVDLGMNDAAVGVGSEGQCLLQLCANADLGIQQFMFAIQKK

SEQ ID NO: 173735 - protein, 179 aa, Triticum aestivum
  unsure (1)..(179): unsure at all Xaa locations
  Clone ID: PAT_TA_68153.pep
YDASPHMCPIKVHWXHLRPTTRDYWRVKITISNWNYRXNYSQWNLVVQHPNFDNVTTIFSFNYKALNPYGVINDTAMLWGLKYYNDLLMVAGPNGNVQSELLFRKDPSTFTFEKGWGFPRRIYFNGESCVMPQPDLYPWLPSSSPRLTKTAFLALAIVACAMVAFLYNHLVLDKYCGKS

SEQ ID NO: 173736 - protein, 137 aa, Triticum aestivum
  Clone ID: PAT_TA_68154.pep
MALSLQKEILLGFVTNKGCRQIQRRTSPGRLAAASYVASRSTGRGGCSASQWAKVRYRVLNTQWRAQLCVAYEQCYTDDGFLHDLCTMDKSNRWIVLSYKSALSKECIVQESCMHNRVQSSFGRLLPDQTRSHLKRM

SEQ ID NO: 173737 - protein, 84 aa, Triticum aestivum
  Clone ID: PAT_TA_68155.pep
NSWIYERRTTAKAFAKDVFINQERKLGARRRSDTVLVSTINDADQGSADVAYRTPPAPYEKSKSLGSGGSMVARLKLKGIDGRA

SEQ ID NO: 173738 - protein, 41 aa, Triticum aestivum
  unsure (1)..(41): unsure at all Xaa locations
  Clone ID: PAT_TA_68156.pep
IKAXTSLTLXSWPRIDTXDTRCPTTXSNRLKPMSSXLSSFX

SEQ ID NO: 173739 - protein, 37 aa, Triticum aestivum
  unsure (1)..(37): unsure at all Xaa locations
  Clone ID: PAT_TA_68157.pep
XLTSXXXCYRXSLSIFXFTCAIIPLQAKPEXAXSXYQ

SEQ ID NO: 173740 - protein, 164 aa, Triticum aestivum
  Clone ID: PAT_TA_68158.pep
MEQEKKGGSDTLLLKKSDTQCADGAAGGLADIFVKRPTKLEQAKQAAAAAAAEGNSTRVLNPAEERRRAREKELLDAWGGEGLGSSVKPHLSKIESDKAACRKTEGELKQERRRAREKELLDAWGGVGLGNSMKPHLSKIEKDKAAWRKLEEEQKQICAGTTEL

SEQ ID NO: 173741 - protein, 90 aa, Triticum aestivum
  unsure (1)..(90): unsure at all Xaa locations
  Clone ID: PAT_TA_68159.pep
ETYXIYIFKVLKQVXXDXGISSKAMSIMNSFXNDXFXKLAGESAKLARYNKKPTITSREIQTSVRLVLPGELAKXXVAXGTKAVXKFTSS

SEQ ID NO: 173742 - protein, 65 aa, Triticum aestivum
  Clone ID: PAT_TA_68160.pep
KKHTSYKLKILFYKCVILSSKHRNHFETKDEQIISYSSSATKNQVYMHMTRACIYKNGMFPYNAM

SEQ ID NO: 173743 - protein, 63 aa, Triticum aestivum
  unsure (1)..(63): unsure at all Xaa locations
  Clone ID: PAT_TA_68161.pep
XSDTSTPYXSSLRLCWVTTVFVPGKQPPDELGTGPPRSRDHXRGRRAPLLHAXRPLHSSRPPA

SEQ ID NO: 173744 - protein, 78 aa, Triticum aestivum
  unsure (1)..(78): unsure at all Xaa locations
  Clone ID: PAT_TA_68162.pep
LHMSYLLQSLANRCDIIEIAAEIDRILRPGRWXVLQDNIGMIRKMDRVLRSLHYKTAIMRRQFLVARKSFWRPDSTGS

SEQ ID NO: 173745 - protein, 86 aa, Triticum aestivum; identical to SEQ ID NO: 156121
  Clone ID: PAT_TA_68163.pep

SEQ ID NO: 173746 - protein, 43 aa, Triticum aestivum
  unsure (1)..(43): unsure at all Xaa locations
  Clone ID: PAT_TA_68164.pep
CMHCTDWMMSLVDNTPSSVXLRQSMGLGAXSXKTHXGNVHSIN

SEQ ID NO: 173747 - protein, 61 aa, Triticum aestivum
  Clone ID: PAT_TA_68165.pep
RRIRVRFRRGSLRNGYHIQGRQQARKLPNPDTEHARRKTVTAMDVVYALKRQGRTLYGFGG

SEQ ID NO: 173748 - protein, 48 aa, Triticum aestivum
  unsure (1)..(48): unsure at all Xaa locations
  Clone ID: PAT_TA_68166.pep
YKXPGHXMTLQAVAAHPWVAGAEGPVPEFVCRCGFGRRNRSDSQEAVQ

SEQ ID NO: 173749 - protein, 37 aa, Triticum aestivum
  unsure (1)..(37): unsure at all Xaa locations
  Clone ID: PAT_TA_68167.pep
VFNKIHHMSXLLNSQFXWXXXALXANXHHXSVMXRGL

SEQ ID NO: 173750 - protein, 54 aa, Triticum aestivum
  unsure (1)..(54): unsure at all Xaa locations
  Clone ID: PAT_TA_68168.pep
RXLTXXXXIYFVFHPTSXTMNXLXRLHTYIYMSVLCISVQREDIPLHFCCKQCP

SEQ ID NO: 173751 - protein, 138 aa, Triticum aestivum; identical to SEQ ID NO: 141364
  Clone ID: PAT_TA_68169.pep

SEQ ID NO: 173752 - protein, 56 aa, Triticum aestivum
  unsure (1)..(56): unsure at all Xaa locations
  Clone ID: PAT_TA_68170.pep
IFXKLAGESAKLARXNKKPXITSREIQTSVRLVLPGELAKHXVSEGTKXVXKFTSS

SEQ ID NO: 173753 - protein, 140 aa, Triticum aestivum
  Clone ID: PAT_TA_68171.pep
TTEREHPKMQRQQLQRINTDHRHECAVWLLGKGLELTCGWLTMLEVSAWPKLKWKERGLRRQKFIDKSLSALGDVIASLASETPTSHIGCTLASSEINICSMTLLKYQGNHIKEVGDNEAPRKKCTSVVFPNSGRSGSRE

SEQ ID NO: 173754 - protein, 75 aa, Triticum aestivum
  Clone ID: PAT_TA_68172.pep
SGPIPTYREQHCYPMYTRQTLLSTDQQIAGHGFSVNHNWLYDAAIICLVQIVLSSENAAPQLLTATEKSAKLALK

SEQ ID NO: 173755 - protein, 55 aa, Triticum aestivum
  unsure (1)..(55): unsure at all Xaa locations
  Clone ID: PAT_TA_68173.pep
VVLLLESCSLLLDSPSYHVLIISFISFFGLSLRGILLYFAVHHTGXSHYYIKVQR

SEQ ID NO: 173756 - protein, 117 aa, Triticum aestivum
  unsure (1)..(117): unsure at all Xaa locations
  Clone ID: PAT_TA_68174.pep
LAHPAVGXFITHSGWNSTLESICAGVPVISWPSCGDQQTNCRYQCNEWGVGLEMECHVRRDSVRGLVTELMEGDRGREMRKKAQEWKEKAAKATTKHSGSSHRNFDNLLRDVLLPRP

SEQ ID NO: 173757 - protein, 99 aa, Triticum aestivum
  unsure (1)..(99): unsure at all Xaa locations
  Clone ID: PAT_TA_68175.pep
IXIVDFIKFXVGXVVXVSGGRNSGRVGXIXNRXXHKGSXXXXHVEXAQGHQFATRLXXVFXIGKGXKPWVSLPKGKGIXLTIIEXXRKRXAAXXAAAMA

SEQ ID NO: 173758 - protein, 67 aa, Triticum aestivum
  unsure (1)..(67): unsure at all Xaa locations
  Clone ID: PAT_TA_68176.pep
MYGEXXMCAPKQAPASXYDYRLYXYXIQXREKENNKRCXRPXXSSCXXLHQIIRXIISSXDIXHPIV

SEQ ID NO: 173759 - protein, 45 aa, Triticum aestivum
  unsure (1)..(45): unsure at all Xaa locations
  Clone ID: PAT_TA_68177.pep
IKXVLVLQSCIFXVSWLCKLQLCKTSTAYITMKRWKIHNQYWWQI

SEQ ID NO: 173760 - protein, 55 aa, Triticum aestivum
  unsure (1)..(55): unsure at all Xaa locations
  Clone ID: PAT_TA_68178.pep
AXGYEAXQXXHXKXNHQLEXMPXWXHXXIXNNXXXXFIKQXVFNXAQLXHGVITS

SEQ ID NO: 173761 - protein, 119 aa, Triticum aestivum
  Clone ID: PAT_TA_68179.pep
SEIAATVAAAVAGEEHAVHKAACCTHVDKERVLSCHEAMIQATGATVPPPKTAGLRSAYSPAMSAPRSPTGVLDLDAGYLSCTSDGASTTTITMASSPPPASSGFDSSPVSRKRRKISR

SEQ ID NO: 173762 - protein, 73 aa, Triticum aestivum
  Clone ID: PAT_TA_68180.pep
SPSVMDSYHETPAQAKMSHIMSLNALHNLYYCLYTLNRFPTLFVSSWSHLFTNHAVQLLAILNKGNSCLTKLC

SEQ ID NO: 173763 - protein, 182 aa, Triticum aestivum
  Clone ID: PAT_TA_68181.pep
CSLVAFIVATPVLDRAVFPLWHKITDTPASPLQRVGLGHVVNIAGMVAAALVERRRLSGMRAHPGGTPMSVLWLLLPLGVVGAGEALHFPGNMAFYYMEFPKTLRSLATAMAPLLIAMGFYISTVFVDIVRRVTAWLPGNIDQGRLDNVYWTLAVAATLNFGYFLVCVWRYKYHIRGTRVAM

SEQ ID NO: 173764 - protein, 59 aa, Triticum aestivum
  Clone ID: PAT_TA_68182.pep
AKPWCLQFVHPSQQQLSIAGLTLRNLTYVSCTITKHAVKNKMLASSYIDLRKQEFGFLC

SEQ ID NO: 173765 - protein, 37 aa, Triticum aestivum
  unsure (1)..(37): unsure at all Xaa locations
  Clone ID: PAT_TA_68183.pep
RQQHSCNILYYITKKNGNINFCXTWAERKQHSCNSLY

SEQ ID NO: 173766 - protein, 39 aa, Triticum aestivum
  unsure (1)..(39): unsure at all Xaa locations
  Clone ID: PAT_TA_68184.pep
NMRFAKAQXKKMGRPEQIIKKRXXQKXPISKIWIILPWL

SEQ ID NO: 173767 - protein, 103 aa, Triticum aestivum; identical to SEQ ID NO: 107316
  Clone ID: PAT_TA_68185.pep

SEQ ID NO: 173768 - protein, 69 aa, Triticum aestivum
  Clone ID: PAT_TA_68186.pep
LLLRWTLKKTLPGSLLRGTRTAVYISTIDMRFFYNSTTVTILMSSLCERREGGYNLWGIATPLALTRRG

SEQ ID NO: 173769 - protein, 170 aa, Triticum aestivum
  Clone ID: PAT_TA_68187.pep
ELGVKALRIRNVHDMVPKVPGFLFNEVIFPAVLLRVADALRVPSVYTHVGVELALDHIVSPFLKPTGDLASYHNLEAHLHLLDGYRAHGQPFELGGRDPALVNKAADFLRDEHMVPPGWRQEENKGMVRTEDGRWALLQLPRDVEAHPVPDDIDIHLAALGLLVQEQDGI

SEQ ID NO: 173770 - protein, 88 aa, Triticum aestivum
  Clone ID: PAT_TA_68188.pep
MRTQRTKYMKLLKNSDPEDSFPQSGRKRPAPRGRGRARGTTTAKRGRKADTGSMPSMVMSKDDDSDEDDKPKKPPPRVTRNYGAVKRR

SEQ ID NO: 173771 - protein, 83 aa, Triticum aestivum
  Clone ID: PAT_TA_68189.pep
RASHFPAMEGVGAYLGFKAGAMPNLRDLKISTWGERAVPVGLEHLLRLEKIVLDGARTGDAIVSAFRDALSAHPNHPFVRTAF

SEQ ID NO: 173772 - protein, 166 aa, Triticum aestivum
  unsure (1)..(166): unsure at all Xaa locations
  Clone ID: PAT_TA_68190.pep
PPGNTGLDPSQTSFFQVLNIPTKINKGTVEITIPVELIKKGDKXGSVFSPEVLDLTEEDLMDKFASGVSMVASLSLAISYPTMAAAPHMFLNAYKNVLAVALETDYSYDHADKIKEYLKDPSKFAVAAPAAAASGGAAAAAPKEEEKKDEPEEESDGEMGFSLFDD

SEQ ID NO: 173773 - protein, 166 aa, Triticum aestivum
  unsure (1)..(166): unsure at all Xaa locations
  Clone ID: PAT_TA_68191.pep
NNSPFLQQQQQPPFTQXQQQPSFSQQPPISQQQQQQQQQQQPFTQQQQPPFSQQPPISQQQQPPFSQQQQPPFSQQQQIPVIHPSVLQQLNPCKVFLQQQCIPVAMQRCLARSQMLQQSICHVMQQQCCQQLRQIPEQSRHESIRAIXYSIILQQQQQQQQQQXQG

SEQ ID NO: 173774 - protein, 98 aa, Triticum aestivum
  Clone ID: PAT_TA_68192.pep
WRRFYVGLPSSVKKVSDSIFENGFLGGDAIDTYEKMKTIFGHPNGDKVESTTLMCFHQNEIIREMKANLDTNFRNVLNLSSAINGYVLSQNRKLNTID

SEQ ID NO: 173775 - protein, 117 aa, Triticum aestivum
  Clone ID: PAT_TA_68193.pep
LGIHFIDGKSLHSFPSMFLSGDSQEDTNGASSSSFFILFFSDGFNSSFVNHILSSFQMLSYASAPLNHSPLAIHLFRSVEDNSEDSCFHSQSVRVILRVLSHSSHLIQPVQSLFKIV

SEQ ID NO: 173776 - protein, 126 aa, Triticum aestivum
  Clone ID: PAT_TA_68194.pep
MLQPLSLLQEGNYRVRLSTSCLEDNEDDRLSILPDDVLLNIVERLDIADATRTTILSRRWKQIPAMLSKVVIMAGSFEPKHTTSKLTSDDIIRFNSTMLEATRSILERRARTLYTIHLLRMQFYLG

SEQ ID NO: 173777 - protein, 151 aa, Triticum aestivum
  Clone ID: PAT_TA_68195.pep
VFSHNLVHNADEEPINALEYAVFPNGSSHLSNLNMSKLAAESNSKFPTQSQHGNGHKKGSLLSPTGPVYLYQNLNGDSSNTDVPGRHAKANSRSPGSSMLNNHLNTDGEYANLLSSQRGTGYQVQPMDAVYAPYLQANPNSPLGAAGSMSP

SEQ ID NO: 173778 - protein, 117 aa, Triticum aestivum
  unsure (1)..(117): unsure at all Xaa locations
  Clone ID: PAT_TA_68196.pep
RHEATTNRPATTTTPPTTTNPPTTTTISPTTTIPPAXITPTTTISPTAIARNRNXPXQQQLPQQXMXPXTTTXPPTTTNXATADXYXPNXXXXXSXNHPNRQQFQTDCAYRNNNSNH

SEQ ID NO: 173779 - protein, 107 aa, Triticum aestivum
  Clone ID: PAT_TA_68197.pep
VFMTDYLEKTCERLEREGKGMIGEGGGSRLGLLARLEEARGGLGCARTGVICCCGGSCRLAMAGVICSCGGSCRLAMAGVICSCGGELQARPWRVKGRRPCALLPRA

SEQ ID NO: 173780 - protein, 56 aa, Triticum aestivum
  Clone ID: PAT_TA_68198.pep
FFFNMNIVLIQLYLYFISEFKQLVWAGHTRRCVTLYLSPLHRHIHRLNNGDPTIYY

SEQ ID NO: 173781 - protein, 59 aa, Triticum aestivum
  Clone ID: PAT_TA_68199.pep
CQQMTHPSTHQSNDELFNSDLDRFPKSSRVACIMFSPAGSLNYRVFSKLGLVSQLNKDD

SEQ ID NO: 173782 - protein, 85 aa, Triticum aestivum
  Clone ID: PAT_TA_68200.pep
CLAKPYRRTTSSITTMPSWCRSSPSTSPLPLLDQEGGDVPPCTCVERGGTVVRCLDRIRPRSESLCEILHRPRSCNASASRSSRV

SEQ ID NO: 173783 - protein, 191 aa, Triticum aestivum
  unsure (1)..(191): unsure at all Xaa locations
  Clone ID: PAT_TA_68201.pep
LNRPSLTSQXTFNNCVEATNADDWLMDICKHFECNNVRPEDFVKFASFRLKDQAVEWFQQYKDSKGGRVITWDEFRQDFKAHHIPQSVVESKCEEFCNLKQGSLFVYQYNIMFQKLAHFTKQDVPDEKRMIYQFRGGLREDLQLALVLFEPQKYDEFYNMALKQEAAQLKYDASKKRVRDATPSSSTQVAA

SEQ ID NO: 173784 - protein, 224 aa, Triticum aestivum
  Clone ID: PAT_TA_68202.pep
MKTLLILTILAMATTIATANMQVDPSSRVQWPQERPFPQSQQPFSQQPQQIFPQPQQTFPHQPQQAFPQPQQTFPHRPQQQFPQPQQPQQPFPQPQQPQLPFPRQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQ

SEQ ID NO: 173785 - protein, 108 aa, Triticum aestivum
  unsure (1)..(108): unsure at all Xaa locations
  Clone ID: PAT_TA_68203.pep
SCWFRRLMWCRRRRPRRRRPRGLERVPVTWWXSDSSSDESETPSSRENEEEEEENSPPPAEGGEKRKVAPTGEAEGSRKRKTPPPDYAPNAEGGKEEWPNRAKRPAKS

SEQ ID NO: 173786 - protein, 127 aa, Triticum aestivum
  Clone ID: PAT_TA_68204.pep
PGVALGILCFGFSPVPSPALLGAAVGAAPTVRAQVKGYKGAPLLLYTDRGPRAWATHKRDTLLGQAQNGARAGGVVFTAVIFRLLRFPTTRVERATWRGAHDVGDMRWAVSACMRHIVVKRQLAPSP

SEQ ID NO: 173787 - protein, 174 aa, Triticum aestivum
  unsure (1)..(174): unsure at all Xaa locations
  Clone ID: PAT_TA_68205.pep
MDYERIHDPPHRQSGGFSPAKLRAMLLGLEKHQHSGEDTSPEANDSGELDDRRSLECSTSTEMSSNSGHRSRNRAPEDDSFDSESSSSGPTTVKRAAAVSALLPPFSRPTPSKWDDAEKWISSPTANRTGRVXTAAGFAPKKTAFALPEHGACPPAAAKVVAEVPRNTGTLTDN

SEQ ID NO: 173788 - protein, 229 aa, Triticum aestivum
  unsure (1)..(229): unsure at all Xaa locations
  Clone ID: PAT_TA_68206.pep
SLLAIVATTATTAVRVXVXQLQPQNPSLQQPQEQVPLVQQQQFXGQQQTFPPQQPYPQPQPFPGQQPYPQXQLFPQXXPFPPQLPYPQPXPFPPQQPYPQPQTHHLQPQQPISQQQVQQQQQQQQQQQQQQQQQQQQQQQLLLQQQILQQXXQQQQLIXCRDVXVXLQQHXIADEXSQVLQQGSXQVLQQXCCQQLXXIPEQSRRQAIHNVDDAIILHQQQQQQQQRXQ

SEQ ID NO: 173789 - protein, 240 aa, Triticum aestivum
  unsure (1)..(240): unsure at all Xaa locations
  Clone ID: PAT_TA_68207.pep
SFAPGSSFRALPANISSSAPPANISSFAQGSSSRAPPAKITSFPLGFSSRAPPAKIISSAPDSSFHALPANVTSFAPLANISSSSPGFSFXALPANISSSXPGSSSRAPPAKITSSALGSSXRAPPVKITSSAPGSSSRAPXAKXTSSXPGSLFFALPANINSSAPPANISNSAPGSSSXAPHAKITSSALGSSSRAPPAKISSSAPGSSFXALPANISSSAPSSSSXAXXWLTSAAPLR

SEQ ID NO: 173790 - protein, 195 aa, Triticum aestivum
  Clone ID: PAT_TA_68208.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRG

SEQ ID NO: 173791 - protein, 227 aa, Triticum aestivum
  unsure (1)..(227): unsure at all Xaa locations
  Clone ID: PAT_TA_68209.pep
MKTLLILTILAMATTIATANMQVDPSSRVQWPQERPFPQSQQPFPQPQQPQQPFPQSQQPQQPFPQPQQQFPQPQQPQQSFPQQQQLMIQSFLQQQMNPCKNFLLQQCNPMSLVSSLVSIILPRSDCQVMQQQCCQQLAQIPQQLQCAAIHSVAHSIIMQQEQQQGVQILRPLFQLAQGLGIIQPQQPAQLEGIRSLVLKTLPTMCNVYVPPDCSTIXNVPYASIDA

SEQ ID NO: 173792 - protein, 208 aa, Triticum aestivum
  unsure (1)..(208): unsure at all Xaa locations
  Clone ID: PAT_TA_68210.pep
GILPQIEHYSCVIDLLGRAGKLIKIREYIRRMPMKPNTLIWRTVLVACRQWKDRDKIDMGLEASRMLLELEPQNPVNYVLASNFYAATGRWEDTAKTRAVMGGAAVKKEAGRSWVTLGDGVHTFIAGDRSHPNTKEIYEKLSVLIQKIRSAGYVPMTEFALYDLEEENKEELLNYHSEKLTVAFVLTRSSSGVPIRIMKNXGFALVPN

SEQ ID NO: 173793 - protein, 165 aa, Triticum aestivum
  Clone ID: PAT_TA_68211.pep
FEPCVIDHPVPGMGESQSIQDCSKFGAFVHRIPGAELGNVGDMMIHYTSGSTSQAGGAKMRRPLPSPRFTMYDSAMIASNKSVVEFPSDGLPDEQSLASAFGDMSLKNYTADSLTSTRDFVPVNGYYPSGPANYHSGITPPDVTLNPSLVPAIVQDDLTFCAEHV

SEQ ID NO: 173794 - protein, 66 aa, Triticum aestivum
  unsure (1)..(66): unsure at all Xaa locations
  Clone ID: PAT_TA_68212.pep
NIFLCCRKKLAFRKNYNHRDFHQPNMYVVIALFYSCSTVLSCQHXPCADPFSGRNVLCCRLXRRGV

SEQ ID NO: 173795 - protein, 52 aa, Triticum aestivum
  Clone ID: PAT_TA_68213.pep
LVCLKYYCFYVNIKTFILNHIKFEHSCHNEKNYIEIMPSSTPHQKFCFYHLP

SEQ ID NO: 173796 - protein, 210 aa, Triticum aestivum
  Clone ID: PAT_TA_68214.pep
GTQAALHSSTAVPITSGSVAATAAGAGSSVRPPAQVLSDLFDAMVVLMAEANPVDQVVHNAEIEKVKEQITQAKADLAAENARMTAERAALDAQAYRLMLDQNASHEVMKRKYRSRLPSVFEARDLFNTSGAGTSNPLEGNRAEAPRTGAPVQPRLMDLPRQNTVIPQAVSTPPGHYSNPMDNLVAAAARLEAIPIEGDSPQAVETCLVP

SEQ ID NO: 173797 - protein, 222 aa, Triticum aestivum
  Clone ID: PAT_TA_68215.pep
MKTFLIFVLLAMAMKIATAARELNPSNKELQSPQQSFSHQQQPFPPQQPYPQPQPFPSQQPYLQLQPFPQPQLPYPQPQPFRPQQPYPQPQPQYSQPQQPISQQQQQQQQQQQQQQQILQQILQQQLIPCRDVVLQQHNIAHGSSQVLQESTYQLVQQLCCQQLWQIPEQSRCQAIHNVVHAIILHQQHHHHQQQQQQQQQQPLSQVSFQQPQQQYPSGQGF

SEQ ID NO: 173798 - protein, 270 aa, Triticum aestivum
  unsure (1)..(270): unsure at all Xaa locations
  Clone ID: PAT_TA_68216.pep
MAKRLVLFAAVVIALVALTTAEGEASRQLQCERELQESSLEACRQVVDQQLAGRLPWSTGLQMRCCQQLRDVSAKCRSVAVSQVARQYEQTVVPPKGGSFYPGXYYPGQASPQQPGQGQQPGKWQEPGQGQQWYYPTSLQQPGQGQQIGKGKQGYYPTSLQQPGQGQQIGQGQQGYYPTSPQHTGQRQQPXQGQQIGQGQQPEQGQQPGQWQQGVLXNXSTSLGQGHQXGQXXQSGQGQQGXYPXXCXXXQDXGIKGXXXAXXXXAXQGX

SEQ ID NO: 173799 - protein, 121 aa, Triticum aestivum
  Clone ID: PAT_TA_68217.pep
QMQLVWTPLSKEPFNGGEPPWRCCLRRRLQCSCPMGVRIEHCRRREVELRRRCDTMSVHPHWWCRVGLSFVRGVGEDDVVPMEQVKAALWRRISRDGRGDRRSSSLEVEDRAVEPAERRDR

SEQ ID NO: 173800 - protein, 144 aa, Triticum aestivum
  unsure (1)..(144): unsure at all Xaa locations
  Clone ID: PAT_TA_68218.pep
CCQSCGRICCHGLWLLDHVVARNCCXCXNSXCXNCXXGNXCCGXCCXXXCFXXXXICCCWXIXCGCXGICXLNXXGCWGICCCWXSCCGCWEICCCENSCCGNCCWGNCCCGNCCRGDWCCWGNCCCWGNCCWGNCCELLGFDV

SEQ ID NO: 173801 - protein, 263 aa, Triticum aestivum
  Clone ID: PAT_TA_68219.pep
IFLNILFFAPFRRICKQLGKHNSYSIELCLPEQTSTARTNNNVVLRSHGPLLSFVVHAIKTDPSICSSSPKLFLNILPFLFFVGFAHNLARWSSGAAVNSQPSAADEEEEVAKGEGAADPQNTTLVGRARPMLQATTHPRLPSPRSPIPLCDPPSSIYPPLPKNLGAGLGWGSPRSSVPWPAAPPHQARPVPARCLQTPPSSQQLEPTVTGRSGSPAKRVATMACTRAMEGGEEEEVGRWRSSSRAAAGLLGRRRRRPRAEFL

SEQ ID NO: 173802 - protein, 130 aa, Triticum aestivum
  Clone ID: PAT_TA_68220.pep
VAGPTVLRLRPRAASLSAPAISAPPRCRLSSVAYSYPKLAGSFAVQRVNGSRMQYLGTLKEQVLRSSSNHDGHIKRIVSCTASDKQEPIASLTSDTPVLEDTKSNTADSPASLGSDFTERSAGKPGFISF

SEQ ID NO: 173803 - protein, 154 aa, Triticum aestivum
  Clone ID: PAT_TA_68221.pep
MVSVLRAAGGTVVESAGSNRPCSESAASTCDTLSGEADMKMCTTPRKHRVSRLRPQPQERCASPRSSMSIGTTSPSLPCSCSSSPSPSSSSSISSSYASSASTGARSSNTAAGCGGNSGPQNDGAMARDRIGSGDGDGDGGGWIGVVGLDLFSV

SEQ ID NO: 173804 - protein, 66 aa, Triticum aestivum
  Clone ID: PAT_TA_68222.pep
DRAQKSRNCTDLGRLRRMNWFLCRGVEIPQKIGRYFDHHSQGTDQAKTRQARKYQEQRNAGKQAAD

SEQ ID NO: 173805 - protein, 196 aa, Triticum aestivum
  Clone ID: PAT_TA_68223.pep
MGRKWHAVAALGMAYAVAAAVADGDKGLSFAGTVAGPEEASSPRKLASLYGTTYHHVWPPMKFGWRIVLGSFIGFFGAAFGSVGGVGGGGIFVPMLTLIIGFDPKSSAAMSKCMITGAAVSTVYCNLKLKHPTLDMPMIDYDLALLIQPMLMMGVSIGVICNVIFPEWLVTILLIILFLVTAIKAFLKGVEAWKKE

SEQ ID NO: 173806 - protein, 82 aa, Triticum aestivum
  Clone ID: PAT_TA_68224.pep
RTCSSLLDPPPLSCLSFSTTRSIEVRATLSTSSLDQIIQVIVITRSGSERVGSGRRHGWRLWCYWPRQGLCLPSTSTDVPSV

SEQ ID NO: 173807 - protein, 160 aa, Triticum aestivum
  unsure (1)..(160): unsure at all Xaa locations
  Clone ID: PAT_TA_68225.pep
PRQQFPQQQXPQQQLPXQEFSQQQXSQQPQQLPQXQQIPQQPQQFLQQQQXPQQQPPXQHQFPQQQLPQQQQIPXQQQIPQXPQQIPQQXXMXQXPKQVAPTTITRYXXFXNSNSRNRNSHKQQQLPAXTNXARNHNNXXQXQQIPQXPXXFXQQQQPPA

SEQ ID NO: 173808 - protein, 61 aa, Triticum aestivum
  unsure (1)..(61): unsure at all Xaa locations
  Clone ID: PAT_TA_68226.pep
VLLNPRSDEVVKXXACSSSSSCGCRCTVVHLSVVTSVTPAKRTVAXCXXISSQPKSCIXCK

SEQ ID NO: 173809 - protein, 62 aa, Triticum aestivum
  Clone ID: PAT_TA_68227.pep
YGQKDVMNYIYVMYEIDHVLVIGITTCMSMSMTTGRSHRSCLNLLYDLRVNVKRHVITLLYC

SEQ ID NO: 173810 - protein, 182 aa, Triticum aestivum
  unsure (1)..(182): unsure at all Xaa locations
  Clone ID: PAT_TA_68228.pep
GGGRNVGRWEDRGPRQGWRNRPCEDRWQDQPREGDWRDQPREDRPQGNAGLPPLPPQPRRNEDHHQDEGAGGFQEPRAIACILGGAQAPASQSIFKQFTREVNAVLPKLEATRPLRWSACAITFSSADQLKCTATXGVLPMLCSPIISNVQVTRTLIDGGAGLNILSVETLNNLQMPYNQLQ

SEQ ID NO: 173811 - protein, 76 aa, Triticum aestivum
  Clone ID: PAT_TA_68229.pep
HHFGRCYCSENSRNHIHDKARNYTEGEQIKDHYLGYPSYFTRLLLTGRLRYTLKDNLHLFVSVLAGHIFISCWAHL

SEQ ID NO: 173812 - protein, 68 aa, Triticum aestivum
  Clone ID: PAT_TA_68230.pep
CLTNQRAAVAESIYTSYQPNTSAKTRAMPSFTDLKSQSLGRKNGKAHRHRAAALLIRHRSCWQKEPSC

SEQ ID NO: 173813 - protein, 118 aa, Triticum aestivum
  unsure (1)..(118): unsure at all Xaa locations
  Clone ID: PAT_TA_68231.pep
QRGVLLEREDVILEAXAQVLGDGEVEAERAVGHGEAGGRLGRAQHPTHDAGWWXXCMMVVPWTGSSVAPPAHGGESVRGRRHVEIQREGVGLGAATVDPEGGVVRGGGGSRGRERVRA

SEQ ID NO: 173814 - protein, 174 aa, Triticum aestivum
  unsure (1)..(174): unsure at all Xaa locations
  Clone ID: PAT_TA_68232.pep
QQQQPPFSQQQQPPFSQQQQSXFSXQQQQPRFLQXXQPPFSXQRXXSQXQQPPFXQXQQPQFSQQQQPPYSQQQQPPYSQQQQPPFSQXQXPPFSXQQXPPFLQXQQQXPXTQQQQPXFSQXPPIXQQQQQXQXQQQPFTQQQXPXFSQQPPISQXQQPPFSQQQQPPFSQQQQ

SEQ ID NO: 173815 - protein, 85 aa, Triticum aestivum
  Clone ID: PAT_TA_68233.pep
SQMKPCKFKWHIQIKQNAQMLSSNCKTFQIGNLGCCTLQLLHQWQYGVSPCFAYGIDFVLSNMTIFRSMCIICISMHLSCFHIIS

SEQ ID NO: 173816 - protein, 197 aa, Triticum aestivum
  unsure (1)..(197): unsure at all Xaa locations
  Clone ID: PAT_TA_68234.pep
GWDTYDXFXQHDVQELNRVLCEKLEDKMKGTVVEGTIEQLFEGHHINYIECINVDYKSNRKESFYDLQLDVKGCHDVYASFDKYVEVERLEGDNKYQAEQHGLQDARKGVLFLDFPPVLQLQLKRFEYDYMRDTMVKINDRYEFPLQLDLDKDDGKYLTPDADRSIRNLYTLHSVLVHSGGVHGGHYYAFIRPTLSD

SEQ ID NO: 173817 - protein, 195 aa, Triticum aestivum; identical to SEQ ID NO: 173790
  Clone ID: PAT_TA_68235.pep

SEQ ID NO: 173818 - protein, 85 aa, Triticum aestivum
  Clone ID: PAT_TA_68236.pep
MAVSNNITACLNFLALICTILGVLLLLVALAGFVGAYWNRQGLLAAYLFAMAALITLLLALLVFAFAVTHGSGAYDVPGRAYREY

SEQ ID NO: 173819 - protein, 34 aa, Triticum aestivum
  Clone ID: PAT_TA_68237.pep
GDAISGCITWIPRSQEKGTYPEGAQKERWDEWQG

SEQ ID NO: 173820 - protein, 183 aa, Triticum aestivum
  Clone ID: PAT_TA_68238.pep
CISLLRSGAVCSYCLNLDNLPHDDSATCRSCNCCVHRHCIPAEHRTALIQPVDLENFVCVDCCPTVKVGSKNVGAESVPKLELVIREPSPAVRRKGGPVAAAKLNSPRKVVEEVRPAWKDAMALVPVGEESESKGPSDPDLPDEALALQLHLAINGSPRISRSGSASVSVLAGQGKRQGKRQN

SEQ ID NO: 173821 - protein, 206 aa, Triticum aestivum
  Clone ID: PAT_TA_68239.pep
DEGAGGFQEPHAIACLLGGAKAPASQRIFKQFAREVNVVLPKFEATRPLRWSKCAITFSSADQLKCAATAGALPILCSLVISNVQVTKTLIDGGAGLNILSVDMFNNLQVPYDQLQPTKPFSGVTDGSTTPIGQVRLPVTFGECNNYRTELIDFDVTYIRVPYNVILGYPALAKFMAVTHHGYNVLKMSGSGGIITVPCEERDAVC

SEQ ID NO: 173822 - protein, 62 aa, Triticum aestivum
  unsure (1)..(62): unsure at all Xaa locations
  Clone ID: PAT_TA_68240.pep
VNQNMFLFTAVLVSKPYINLQNRTSNNRGPSSLFKWLLNLEEVITCNTYSRHCXLGLXSRIQ

SEQ ID NO: 173823 - protein, 77 aa, Triticum aestivum
  Clone ID: PAT_TA_68241.pep
PLVPCLFGLFNRVFPGSHQVARLNSRNRDQDWNRGNSLHRELDWNRAWFSFILVKLVVWSVLIMMHVSAVVLKRFIF

SEQ ID NO: 173824 - protein, 161 aa, Triticum aestivum
  unsure (1)..(161): unsure at all Xaa locations
  Clone ID: PAT_TA_68242.pep
MHSSFIVDGETFHAHRAVLAAHSPAFRAELFNSMSKATMSSITLHDITPETFKVMLWFIYTDELPMEDEHEDSSTEMFQDLFAAADRYALDRLKIICAQKLXEKVSVDIXATILASAETYNCQELKNKCIDFFVVEENCKKAMXTYXYVLMXLKSIEIIXE

SEQ ID NO: 173825 - protein, 74 aa, Triticum aestivum
  Clone ID: PAT_TA_68243.pep
HESCLLLQVFFWQHIESCIALCAYMLLHYFGVSNDLHAATDFALLAPGVCCWHHCRWTAVGLPLLTRMDLPLGV

SEQ ID NO: 173826 - protein, 191 aa, Triticum aestivum
  unsure (1)..(191): unsure at all Xaa locations
  Clone ID: PAT_TA_68244.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSXDVKNAIIWGNHS

SEQ ID NO: 173827 - protein, 63 aa, Triticum aestivum
  Clone ID: PAT_TA_68245.pep
MKRKRTLHSWFASNSNASPISTNPPTNESTNQPPRHHILEFHPSQIFGDPADRIPIEDYVPEI

SEQ ID NO: 173828 - protein, 56 aa, Triticum aestivum
  unsure (1)..(56): unsure at all Xaa locations
  Clone ID: PAT_TA_68246.pep
QXXXQXXXPXQXXQIXQGXXPXQGXXPXQWXQGYYPXSXQQXXQGXXPXQWQQSXQ

SEQ ID NO: 173829 - protein, 136 aa, Triticum aestivum; identical to SEQ ID NO: 116005
  Clone ID: PAT_TA_68247.pep

SEQ ID NO: 173830 - protein, 216 aa, Triticum aestivum
  unsure (1)..(216): unsure at all Xaa locations
  Clone ID: PAT_TA_68248.pep
VMHGADRDIMWLQRDFRVYVCNLFDTGQASRVLQMERNSLEHLLHHFCGVTANKTYQNADWRSRPLSDEMIKYAREDTHYLLYIYDLMRLRLQRESTCENDLLLEVQKRSNDICLQLYEKELLTDKSYLHIYGLQEHELAAAQLAXVSALHQWRDYIAREQDESTGYVLPNKALIEIAKKMPTTTADLRRIVKTKYPCVEDNFDLILDIVWNATEN

SEQ ID NO: 173831 - protein, 38 aa, Triticum aestivum
  Clone ID: PAT_TA_68249.pep
GKVYLGTHEPARDSRGPTSRRVAPGTGPYLVMCPCKFG

SEQ ID NO: 173832 - protein, 191 aa, Triticum aestivum
  Clone ID: PAT_TA_68250.pep
FGTRLTLSLLARLLFRPYDTSASLHPPCLSSPSFPPSASSSNSTATATAISSLAVWDGVHFARSAECGYEYEQSFAFLPLLPASIALLSRSLFALLVPMLGYRAVLVISGHVLNNVAFVAAAAYFYRLSVLILKDSGAAYRASVLFCFNPASVFYSSLYSESLYALFSLGGLFYLFSGARTVAMIMLALSG

SEQ ID NO: 173833 - protein, 33 aa, Triticum aestivum
  unsure (1)..(33): unsure at all Xaa locations
  Clone ID: PAT_TA_68251.pep
CFKKTVFHISSNRVLLFSVSTHDAKWRNXVXQY

SEQ ID NO: 173834 - protein, 203 aa, Triticum aestivum
  unsure (1)..(203): unsure at all Xaa locations
  Clone ID: PAT_TA_68252.pep
LTNGQXPXXNNTKMDLSGNHCERDTLTTVGSVNSGIEMLTKLEEELKSCRKELAASKEVSKKLIMERNMLEQRIQRLERAKSEEKSTMQRVYEDECRKLKAHTATLEQKLESATQSLNVAESTLALRNTEVDSLQNTLKELDELREFKADVDRKNQQTAEILKRQGTQLVELESLYKQEQVLRKRYYNTIEDMKGKIRVFCRL

SEQ ID NO: 173835 - protein, 167 aa, Triticum aestivum
  Clone ID: PAT_TA_68253.pep
YFASTPWPPEASPVLLLSHGSLPPTATSTTPLSRSRPRPPPADEHQSTNQSSSERLSASNGEDERHVPFSIAVPSRQVPRASTGVWSSPAFPCTPAAAALILPGKSLAAASALGEFIDPPLQPRRALLVMVTLTAWPPQHLKAWVCLHRSPLPGPVARPCRPALCHS

SEQ ID NO: 173836 - protein, 160 aa, Triticum aestivum
  Clone ID: PAT_TA_68254.pep
MSGLWLLNGDIDRGHRAAIWYERKLEPLVTRTPKKNWMIHSGWLQRLKWAGLLPFARLVESILGEKRLAIDGSLLSCLVDRWRPETHTFYFRWGEMAPTLEDVSLLLGLPLAGHAVGPLDAPAGWERALTQRFHGVFLDAPDPVWEHHGPKYEWLLNFWI

SEQ ID NO: 173837 - protein, 175 aa, Triticum aestivum
  Clone ID: PAT_TA_68255.pep
AGSSSAKRATGRRCGDRRVRSEAEQRVLVASVAGSRRWEAGASGAHRRKRVVLDGSHRRCSIGVSGGWSPLARGSASGDGGESCRRGRRTMTRGRGGAVLGRPAREARPRRVQDGGDELAGTGAGPRWKKEVVSDGSPGRRVERRSARELCWEELVGAREGGGIDGEGWLHTGRG

SEQ ID NO: 173838 - protein, 207 aa, Triticum aestivum; identical to SEQ ID NO: 172374
  Clone ID: PAT_TA_68256.pep

SEQ ID NO: 173839 - protein, 181 aa, Triticum aestivum
  unsure (1)..(181): unsure at all Xaa locations
  Clone ID: PAT_TA_68257.pep
PMRVLVTGAAXXQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAII

SEQ ID NO: 173840 - protein, 81 aa, Triticum aestivum
  Clone ID: PAT_TA_68258.pep
TVYACKNDGQCKAQQQRNRKKCSSGHHWLVAGRRCTTRQQGPAEGMGGRRRCARWARPFVAGSRDGEWSAHCLFCFFRGVS

SEQ ID NO: 173841 - protein, 213 aa, Triticum aestivum
  Clone ID: PAT_TA_68259.pep
NFVVEEEVTSKPKRKVVAKEQQDQQSKKGTSKVKQSTVAKKLNLGEAAASKVKKTTKRKRIVHIDPHADAAVEDEDEEAPQPPPQKQKLMGDAIKAGATSKPKKSAPAKAAPAKPAAKPKRTIRNIPASEKNKDDVPPAVSDDEGPVLLKLRPKLPLHNDAHPQAEDMKARKDKGLKLWRQSDPYAVRRRTAVDPRFHTREQQDFYETVLMDK

SEQ ID NO: 173842 - protein, 140 aa, Triticum aestivum
  unsure (1)..(140): unsure at all Xaa locations
  Clone ID: PAT_TA_68260.pep
HPNNSNFPNNNXPXNNNYCNNNSPNHNKYXNXNNXPSNNXPQATAICPNNNXPNNNNXRNXNSPNHKKYPNNNKSXNNHXNXXSNNCXNNSXXXNXKNXPNSNSRNNNSTNNXYHNNNFXNNNSXNSNXXXNNXXXNXXN

SEQ ID NO: 173843 - protein, 48 aa, Triticum aestivum
  Clone ID: PAT_TA_68261.pep
WLNSLNKSRPWLISFFFNTYLVLRNTTHKPLLPMWHIIYQKNLIFVTF

SEQ ID NO: 173844 - protein, 235 aa, Triticum aestivum
  unsure (1)..(235): unsure at all Xaa locations
  Clone ID: PAT_TA_68262.pep
LQIRHEGQQGQQPXQGQQPGQGQQGQQPGQGQQPGQGQQGQQLGQGQQGYYPTSLQQSGQGQPGYYPTXLXQLGQGQXGYYPTXPXQPGQGQQPGQLQQPAQGXQPEQGQQGXQXGQGQQXQQPGXQGXQPXQGQPGYYPTYAHQSGQGQPGFYXTYSXQPXQXXQPGQGXQGHQVXQGQQAHQXGQGHQPXQGQXPGYYXTYXXQAXQGXXGFYLTLCAQXXQGXXGRYNCNQG

SEQ ID NO: 173845 - protein, 198 aa, Triticum aestivum; identical to SEQ ID NO: 173181
  Clone ID: PAT_TA_68263.pep

SEQ ID NO: 173846 - protein, 67 aa, Triticum aestivum
  Clone ID: PAT_TA_68264.pep
LSYISFIPKYHLLLALCVVTSHHPRDDLFLMLGTPRLTLYSGIDRLPIRVKLPIVPSYFALDVFLSF

SEQ ID NO: 173847 - protein, 112 aa, Triticum aestivum
  Clone ID: PAT_TA_68265.pep
VSRLAMHGKPVALSRGATERLLQAMGASFQKLLALHRTCLDKAKSRMATVDKAEADLKGHVAEAQTWYRQACEELKAAQSELARNKVELTMERADIERAQDTAKNLAAAAEA

SEQ ID NO: 173848 - protein, 125 aa, Triticum aestivum
  Clone ID: PAT_TA_68266.pep
APGGVATRWPWGCAEPPPGGCTVLRRRHPFMAADSASIAHAVLTDGFSVDIGMSTSRQRRLWHPHRWRRSAAQEHGSRRDGGRCGVSLRWRPREWPDLCLERHGNDPGCRPASAGVGAGGGCRVA

SEQ ID NO: 173849 - protein, 61 aa, Triticum aestivum
  unsure (1)..(61): unsure at all Xaa locations
  Clone ID: PAT_TA_68267.pep
SLEIVLKCIVSCGGYDPQLHRLXRRRRTARXRVSEQRTAAILGAGSXSTGGRSRIRRTHRT

SEQ ID NO: 173850 - protein, 198 aa, Triticum aestivum
  Clone ID: PAT_TA_68268.pep
GCRLPQAVGSLASVAGEAFFLPLYDLFLTYGGVFRLNFGPKSFLIVSDPDVAKHILRDNSKAYSKGILAEILEFVMGTGLIPADGEVWRVRRRAIVPALHQKYVTAMIGLFGNASDRLCQKLDKAASDGEDVEMESLFSRLTLDVIGKAVFNYDFDSLSYDNGIVEAVYVTLREAEMRSTSPIPTWEIPIWKDISPRQ

SEQ ID NO: 173851 - protein, 193 aa, Triticum aestivum
  unsure (1)..(193): unsure at all Xaa locations
  Clone ID: PAT_TA_68269.pep
AEAASRGSXSSNVLSQLAAEGQSRIVGWNLARGSGEREVVHVQEENLSADGTLVLSSSGDSAQSIVLQLVKLPLVDKIPPYTTWIFLDKNQRMADDQSIAGRRRIYYDSAGNEALICSESDEEIPQPEEEKHVFTEGEDQLIWKATQERGLSQEDLNVICQFIDASPSEIEGRSEFLFEKHEKHSEFSDKIES

SEQ ID NO: 173852 - protein, 67 aa, Triticum aestivum
  Clone ID: PAT_TA_68270.pep
GAPVARPLPPLHVLEGDAPPAHRAQGATAPRSTPATSASSRPTPGPCSYLSLDTLETFCKLVSVAHF

SEQ ID NO: 173853 - protein, 171 aa, Triticum aestivum
  unsure (1)..(171): unsure at all Xaa locations
  Clone ID: PAT_TA_68271.pep
ALSNPTAFPQQPQQPFPQPQLPFPQQSEQIIPQXPQQPFPLQPQQRFPXXXQQXFXGXXQPXXEXXXQXSPXXXQXXXXXXXQXXXXXXLRLQQRVVQXPEQPXPXLXQQXXXXDNRXATCXXRHXQQXFPQQGGXXFPXQPXXRFXXXPQRPFXQXPQQPFPLRPQQPFQ

SEQ ID NO: 173854 - protein, 194 aa, Triticum aestivum
  unsure (1)..(194): unsure at all Xaa locations
  Clone ID: PAT_TA_68272.pep
MQCPGPFSLFEEVFQLEEEERIKELRNIKERSMAKKQHVNHGWSPPPNEFMKISTDGSFHEVTSTGGWGFVIRNDLGDLIAAGSGSLEHLSNALHAEALAMLYAVNAASRIGCSXIILETDSAALKQAVSTEAYNLAELGALFQEIKHXIKSRFDDVKLNVCSRTCNVAAHTLDALGTELGNGNFNIWVGHFPE

SEQ ID NO: 173855 - protein, 266 aa, Triticum aestivum
  unsure (1)..(266): unsure at all Xaa locations
  Clone ID: PAT_TA_68273.pep
RGGNLRSKRSQGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLAXYNXQKESTLHLVXXLRGGMQIFGKXLTGKISPWRGVI

SEQ ID NO: 173856 - protein, 197 aa, Triticum aestivum
  Clone ID: PAT_TA_68274.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHSSSQYPDV

SEQ ID NO: 173857 - protein, 173 aa, Triticum aestivum
  Clone ID: PAT_TA_68275.pep
MAGLTSDSDDNDKFEWESDGEAAPSSAPTLRNLDAPGPSTLVRQNSNGWANGEATSTSLVEEYVTMGFPKDMVVKGIKEIGHNDVNALLELLLTYKALGDEGALGDCSTSGCACPNVQDDDDDDLDSDNWDNDNDTGGREHNSDSSGDEDFLKEMSAKDEKINLLVDMGFSED

SEQ ID NO: 173858 - protein, 34 aa, Triticum aestivum
  Clone ID: PAT_TA_68276.pep
FFLTRLQDVELSFTWTSILQVVEGNMTVLKINLN

SEQ ID NO: 173859 - protein, 47 aa, Triticum aestivum
  unsure (1)..(47): unsure at all Xaa locations
  Clone ID: PAT_TA_68277.pep
PKXGTTPVICSLPSYHLNDLSYLALIYDSLMSILPESIFVFFMVVFL

SEQ ID NO: 173860 - protein, 58 aa, Triticum aestivum
  unsure (1)..(58): unsure at all Xaa locations
  Clone ID: PAT_TA_68278.pep
ESMLXVIAGRKXYQWAXSPWRMPPGANERSPGKPTGPVRHPSRNGLFLKKKKREQKRP

SEQ ID NO: 173861 - protein, 146 aa, Triticum aestivum
  Clone ID: PAT_TA_68279.pep
LRRLSCIMSASHWIGRTVCFNIRWKTCLLRNTISSQQRYYRGLQETRGASFTICKGKSNLCVGIAQRLRGTSATKGFLIYSKHPINSVTATPNIYFYSSPLKNFSSPLYNVASAPVLSQSFRNFRTQENETKPVEQQEKPESYKRK

SEQ ID NO: 173862 - protein, 35 aa, Triticum aestivum
  Clone ID: PAT_TA_68280.pep
KLVTNIKSFIEKRGLPKNLVLGSCEILETAGQGAL

SEQ ID NO: 173863 - protein, 80 aa, Triticum aestivum
  unsure (1)..(80): unsure at all Xaa locations
  Clone ID: PAT_TA_68281.pep
SPTVSPRSAHTEKSFPLVSRMYSGTSAATSEAAPAGSLPTSPSPPPMPLAQGSIWPASTQIQPCGVGEGRGLCLVPNXLQ

SEQ ID NO: 173864 - protein, 127 aa, Triticum aestivum
  Clone ID: PAT_TA_68282.pep
SSQVLQESTYQLVQQLCCQQLWQIPEQSQCQAIHNVVHAIILHQQQKPQQQPSSQVSFQQPLQQYPLGQGSFRPSQQNPQARGSVQPQQLPQFEEIRNLALQTLPAMCNVYIPPYCTIAPFGIFGTN

SEQ ID NO: 173865 - protein, 42 aa, Triticum aestivum
  unsure (1)..(42): unsure at all Xaa locations
  Clone ID: PAT_TA_68283.pep
LPXRSXTRXEIRQAGEIAASKPVLLQTKFGDPKYAPLNQMWS

SEQ ID NO: 173866 - protein, 95 aa, Triticum aestivum
  unsure (1)..(95): unsure at all Xaa locations
  Clone ID: PAT_TA_68284.pep
AGEFVDALXXNITGAWSDKVQEWEECAKNQTACPDKYGSESITAACDSAYKGVTEDSTLSDEYFGSRLPVVNLRLAQGGVRLAATLNRIFGQSKA

SEQ ID NO: 173867 - protein, 193 aa, Triticum aestivum
  Clone ID: PAT_TA_68285.pep
RHEGSTLASRLPHHALQLFGSMPVRSVVTYNTMITALMRNGLVAAARELFDGMPEPDKVSWTALIDGCVKNGRHDEAIDCFHAMLLDGVEPDYVTLVAAISACAEVGVLGLGMWVHRFVTRERLEGNIRIANSLIDMYARCGQVEFARQVFDSMRKRTVVSWNSMIVGFAANGRCTDAIEHFEAMRRKGFKPD

SEQ ID NO: 173868 - protein, 140 aa, Triticum aestivum
  unsure (1)..(140): unsure at all Xaa locations
  Clone ID: PAT_TA_68286.pep
LGSCVSGGMQIFVKTLTGKTITLEVEASDSIDNVKAKIQDKEGIPPDQQRLIFAGKQLEDGXTLSDYNIQKESTLHLVLRLRGGMQIFXXTXXXXXXTLEVXXXXSIDXVKXXXQDTEXIXPXQQRLIXAGXQLDXRTLT

SEQ ID NO: 173869 - protein, 102 aa, Triticum aestivum
  Clone ID: PAT_TA_68287.pep
TRLFPGPDINPSKAPVRSGDGDGDGGCLPPPPSTKIHQRQHCLLSATRHITVEHSLLLSPGSCKQTSNLFWLAINIRYLIPYHVQNYYNWSCGRRFWLHLRV

SEQ ID NO: 173870 - protein, 90 aa, Triticum aestivum
  unsure (1)..(90): unsure at all Xaa locations
  Clone ID: PAT_TA_68288.pep
ELPRAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 173871 - protein, 107 aa, Triticum aestivum
  Clone ID: PAT_TA_68289.pep
FFPYASSRFCFELMGPRCGSTSRLYEIHGSSACPGIRASITSSVPACFKNKKFLCERPLAELNVVCTFILQSNYLDYLGQIPFFLTVLQLDSRIRIHACTASIVNCT

SEQ ID NO: 173872 - protein, 88 aa, Triticum aestivum
  unsure (1)..(88): unsure at all Xaa locations
  Clone ID: PAT_TA_68290.pep
NQTPGGGGFKVLENDYAISIQFTSCXKKSSWILTNVYGPCXSNESTKFIDWFQNIXQTHDDIDLLVVGNFNYTIYPKNRNKPRGICKI

SEQ ID NO: 173873 - protein, 58 aa, Triticum aestivum
  Clone ID: PAT_TA_68291.pep
LPLATAAPTTSLLSPLIGCATQTDRTKLSQARPSKAGERERGPGGASRQPRAVGPSGV

SEQ ID NO: 173874 - protein, 86 aa, Triticum aestivum
  unsure (1)..(86): unsure at all Xaa locations
  Clone ID: PAT_TA_68292.pep
KTDXGLTALNNYLADKSYIEGYVPSQVDVVVFAAMSAAPASKFCHALRWYNHMKSYQCKFASLPGVKKALEQCGPSAVTNXTAAAE

SEQ ID NO: 173875 - protein, 109 aa, Triticum aestivum
  Clone ID: PAT_TA_68293.pep
SHQACKIIEIQQLRQQKLASYTTGAGTKATFIPTVFHPLALQKTSKATIFMNLELLCFFALSGTILDLEQLLFIDIIASSPVLLSSQKLSSISDEQPSSPSSPYQINHP

SEQ ID NO: 173876 - protein, 177 aa, Triticum aestivum
  Clone ID: PAT_TA_68294.pep
RRHRGERAAMAISSAPVAPRRRRPTVLLMVNYAALLVGSVASSLLSRFYFEHGGQNKWVVTLVQSAGFPMLVVAVFLAGRPASVPRPFLWFSRRFLAVCLVIGGLMGVNNLLFSYSSSLLPVSTSSLLLSTQLAFTLVLAVAIVRHPLTFVNLNAVVLMTLCSVLLALRSGDAGESP

SEQ ID NO: 173877 - protein, 163 aa, Triticum aestivum
  unsure (1)..(163): unsure at all Xaa locations
  Clone ID: PAT_TA_68295.pep
MRMHSHALFVLLLCSLLVGAATAEPSRELTYKDCHPDDKAVLLAFPDSWSSSWAPDTLCCDWFAVACDRSTGRVVGFSVFQDPSFTGTIPSTIAGLTHLEDLFLHHLPGLSGPIPPAIGKLANLSRLEISWTGVSGPVPSSLXKLKKLTQLDLSFNSLSGAIP

SEQ ID NO: 173878 - protein, 205 aa, Triticum aestivum
  unsure (1)..(205): unsure at all Xaa locations
  Clone ID: PAT_TA_68296.pep
RPRSRXKEGIPXDQQSLIFAGKQXLEDGRTLADYNIQKXESTLDLVLRLGGXMQIFXKXXXGKTITLXVETPDTXDNVKAKIQDKEGIPPDQQRLIFAGKQLEDGRTLADYNIQKXESTLHLVLRLRGGMXXIFVKTLTGKTITLEVESSDTIDNVKAXXIRTREGIPPDQQRLIFAGKQLXDGRTSLLIYNIQXKESTLHPAPP

SEQ ID NO: 173879 - protein, 122 aa, Triticum aestivum
  Clone ID: PAT_TA_68297.pep
PNLFPVDQQCTSKFTAVNFRGCLPFNHCVFNQVTTPVATYPGRINPQTLFGRPCGTVCTSARGDHEFWHAMRALCWHWPRPGRLLAPTPLPLDVLALMSMSISFTASSPFSWTPLPLRPFPH

SEQ ID NO: 173880 - protein, 164 aa, Triticum aestivum
  unsure (1)..(164): unsure at all Xaa locations
  Clone ID: PAT_TA_68298.pep
CWGNCCSGDCCGRGNCCCGKCCCWGNCCCXXXCCWXNCCWGXCYCGXCCXGTXCCXXCCWGNXCFXCCMLAXCCGWXNSCCGNCCXXXXCCWGNCCCXRNCCWGDCCWGNCCCWRNCCACWGICCCWGSCCGCWAICCCGNCCCYGNSCCGNCCGGIVASSEFL

SEQ ID NO: 173881 - protein, 72 aa, Triticum aestivum
  Clone ID: PAT_TA_68299.pep
VVAHKDCREMTHTGPRDMCLYIAQGSIKFTSLHLCCATFLSSAWRKNKIALVHCRRYMSNKEPHKQAHKKCC

SEQ ID NO: 173882 - protein, 88 aa, Triticum aestivum
  Clone ID: PAT_TA_68300.pep
LSSPASNGKQLDLLYQTEGMDSMWSRSFLDQIILLMCIRIVFSQNLFSCRLTVALTLTFSFDSHSIFSVSCILLVSALQRFAPESYQV

SEQ ID NO: 173883 - protein, 64 aa, Triticum aestivum
  unsure (1)..(64): unsure at all Xaa locations
  Clone ID: PAT_TA_68301.pep
LCLLCLFIARARDLVQCMTDRLSLREGFYSEEFLGLYRGQTVSVLQVSSQPXXALMELHPLQRR

SEQ ID NO: 173884 - protein, 206 aa, Triticum aestivum
  Clone ID: PAT_TA_68302.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCCQQLFQIPEQSRCQAIHNVVHAIILHHHQQQQQQPS

SEQ ID NO: 173885 - protein, 138 aa, Triticum aestivum
  unsure (1)..(138): unsure at all Xaa locations
  Clone ID: PAT_TA_68303.pep
QAPFTLEVESXDTIDNVKAKIQDKEGIPPDQQRLIFAGKQLEDGRTLADYNIQKESTLHLVLXLXGGMXIXVKTLTGKTITLEVDSXDTIDNXKAKIQDKEGIPPDXQXLIFXGXXLEDGXTLADYNISERVHPTLLR

SEQ ID NO: 173886 - protein, 103 aa, Triticum aestivum
  unsure (1)..(103): unsure at all Xaa locations
  Clone ID: PAT_TA_68304.pep
CTLTLSIFVVELAPSRKRKQTSGIMLDRLTKSKGGRMEIHFEAGLKRPRDATESAKLVXKAAVAVRCHAHILPTWIQYRNEKDNTQFNTFLDHLSVSNVIDRN

SEQ ID NO: 173887 - protein, 122 aa, Triticum aestivum
  unsure (1)..(122): unsure at all Xaa locations
  Clone ID: PAT_TA_68305.pep
AVVHALLTWRHLLLGRKXVDIFTDHKSLKYIFTQPNLNLRQTRWVEMIQEYNPSIEYTPGKANVIADALSRKAYCNSLILKPYQPELCEAFCKFNLQIVPQGFLSNLQVSPTLEDQIRQAQL

SEQ ID NO: 173888 - protein, 87 aa, Triticum aestivum
  Clone ID: PAT_TA_68306.pep
MPVTGGATVLDDLPEWIVVEEILVRLPPKDILRCRAVRRWWHTATSTDKFMLDHHRRQPLLPILSHVVVPQKARLLFSFDAGAGQQK

SEQ ID NO: 173889 - protein, 129 aa, Triticum aestivum
  unsure (1)..(129): unsure at all Xaa locations
  Clone ID: PAT_TA_68307.pep
FYFYQPWDAGGAAPPGGDVLALKSSLAVEDHETSFLRSPDGTFSCGFHSIYSGAFTFSIWYXDSPGETVVWSANRGRPVLSRRSAVTLRKDGNMVLTDDGTVXWQTEGNLXNVQXAQLLDTGNLVLNNT

SEQ ID NO: 173890 - protein, 205 aa, Triticum aestivum
  unsure (1)..(205): unsure at all Xaa locations
  Clone ID: PAT_TA_68308.pep
QVDPSSQVQWPQQQXVPQPHQPFSQQPQQTFPQPQQTFPHQPQQQFPQPQQPQQQFLQPQQPFPQQPQQPYPQQPQQPFPQTQQPQQLFPQSQQPQQQFSQPQQQFPQPQQPQQSFPQQQPPFIQPSLQQQVNPCKNFLLQQCKPVSLVSSLWSMIWPQSDCQVMRQQCCQQLAQIPQQLQCAAIHTVIHSIIKAPFSSVVAGIG

SEQ ID NO: 173891 - protein, 69 aa, Triticum aestivum
  Clone ID: PAT_TA_68309.pep
FKFFHMGYVKSKCCFFLFRCFENQVYLVLFLSSMYFNVQCTVCRMSKLVNLEHKLMIDQGSGTAGWVRV

SEQ ID NO: 173892 - protein, 119 aa, Triticum aestivum
  unsure (1)..(119): unsure at all Xaa locations
  Clone ID: PAT_TA_68310.pep
VFDGHGGSDAASYMKKHAIRLFFKDSEFPXSNTRCLFFSESVANSVRKAFLSEDLALANESIISXLSGTTNLTSLIFGRXLLDANAGDCQAGLCRKHIAIEKCRCYRPTCEVEHDADIR

SEQ ID NO: 173893 - protein, 218 aa, Triticum aestivum
  Clone ID: PAT_TA_68311.pep
PPPPALPDDVVVEEILLRLPPDDPGCLFRASLVCKAWRNAVSHPRFRRRYIGLHRHRAPPVLGFLHDWEDGGIPDFFPTTASPFSLAAPDRRFWRPVDCRHGRALFLSDRRQETQELLLWEPITGARRGIPVPAAFRCQWPAAAVFCTADWCDHRDCAGGPFGVVFLFAGEQDRHVVTSACLYSSETGTWGKLNSRQDEFTMEFQNHSSVLVGRSLLY

SEQ ID NO: 173894 - protein, 233 aa, Triticum aestivum
  unsure (1)..(233): unsure at all Xaa locations
  Clone ID: PAT_TA_68312.pep
EDLSILALLAIVATXATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHNVAHAIIMHQQQQQQQEQQQQLQQQQQQQLHQQRQ

SEQ ID NO: 173895 - protein, 119 aa, Triticum aestivum
  Clone ID: PAT_TA_68313.pep
FMFQYFISEAKGGAAPLYRPSRDVARMEFFCGLWSMRGYVCHVRTNGHHRASGHAPAIHRSIWYDLLCFPGHAAGHMCIPELLCLCFYGEVGKVGVWLELPLCPGHVVVGQLHCELVGR

SEQ ID NO: 173896 - protein, 228 aa, Triticum aestivum
  unsure (1)..(228): unsure at all Xaa locations
  Clone ID: PAT_TA_68314.pep
GIRTRVXSPXPRRPTPARHGSFGVHLVDELLEEIFLRLPTPAALARASTTSPRFRRIITDRSFLRRFRKLHPPPLLGFADERAGFHPAEAPHSSAPLARALADTADFTYSFVPKPSNDHSWRPCNVRDGRVLLESSRYGTFRELAVCDPLSRRYVLLPPMPEHMSVQEQRPWEFRSILAPIAEEDEDETSFKVICFADYETKLDVFVFSSVTRQWCIAASPSWISLGA

SEQ ID NO: 173897 - protein, 204 aa, Triticum aestivum
  Clone ID: PAT_TA_68315.pep
THLGFVVRARERFDALPPRRTLLGRSRTCLTWLCYINLHSDDTCGDHRDSKIGFLKTKDDNQSDLEGPHRNAGPWLCSICSQQNDTSCMSCEVCGVLRDLSLYFNNTNEPEGGAKRRNKHSGVSVLARSLFTPSSPKSKAIVFSDGFRGNKNATGHMQASLGTLHKTFMTHKQRHNIVPFKFDIPSPDDMVSIGLKSSRHLRKD

SEQ ID NO: 173898 - protein, 51 aa, Triticum aestivum
  unsure (1)..(51): unsure at all Xaa locations
  Clone ID: PAT_TA_68316.pep
FLXLRPLIGCVRVINRMALAKYIYSMFFICLRILWCRIKEFFHAGKKNQKK

SEQ ID NO: 173899 - protein, 80 aa, Triticum aestivum
  Clone ID: PAT_TA_68317.pep
TAHSNACGTGGASVDPIHDHYHHYHRQRNHHQNHHNNHHHHMLLLCRRWHHYHHHHNHHHHHNNNNHHNHLQRHNHIIPL

SEQ ID NO: 173900 - protein, 75 aa, Triticum aestivum
  unsure (1)..(75): unsure at all Xaa locations
  Clone ID: PAT_TA_68318.pep
NFAXQPWXRMXAXELXCGXTLXKTNTRXCWXGXXCSSTXLWAPSITQXXXGNLERVALLHWDGXXLTFIPXVTQV

SEQ ID NO: 173901 - protein, 92 aa, Triticum aestivum
  Clone ID: PAT_TA_68319.pep
NISHRKEKRRAYLSLSPPDIPSFYTTFTYAHKLSLGPLKVCMPMTHSRMTVTVFQAKALYGHWSSEYAHYGHRIHSRGDHTVSSSRYVSVFS

SEQ ID NO: 173902 - protein, 133 aa, Triticum aestivum
  Clone ID: PAT_TA_68320.pep
MNTYMVNYIYIFVVCLVALKVKMSDRAWMYTGHTGQNKWSTEWFTKTKGFVRAAFANGQRKTWCPCLRCGNWEKRTEAEMGKHLQKSGFTPDYTVWTFHGESAQRDRAEVDRRRTDEHGTGMENMVQDFDDAQ

SEQ ID NO: 173903 - protein, 183 aa, Triticum aestivum
  unsure (1)..(183): unsure at all Xaa locations
  Clone ID: PAT_TA_68321.pep
QPTATIAVRVPVPQLQPQNPSQQQPQKQVPLVQQQQFPGQQQPFPPQQPYPQLQPFPSQQPYMQLQPFPQPQLPYXQPQLPYXQPQPFXPQQSYSQPQPQYSQPQQPISQQQQQQQQQQQQQQILXQILQQQLIPCRDVVLQQHSIAHGSSQVLQQSTYQLVQQLCCQQLWQIPEQSRCQAIH

SEQ ID NO: 173904 - protein, 111 aa, Triticum aestivum
  unsure (1)..(111): unsure at all Xaa locations
  Clone ID: PAT_TA_68322.pep
LYAETLKGMGIPMSRLSESNMSFHGVIPGKKAASLXQIALDMVFGDSKNYRKEKLTFEVVDFQSAYHAILGRPAYARFMAXPCYVYLKLKMPGPKGVITITGSRKQAEECF

SEQ ID NO: 173905 - protein, 174 aa, Triticum aestivum
  Clone ID: PAT_TA_68323.pep
GCRFTRAYCNVTQHAPSPAYTTSLVKCFSGACPPEQSMSPQSCGCAYPYQGVMYFRAPFFADVGNGTAFQELESKLWTKLELSPGSVALQDPFFNSDSYMQVQVKLFPSGGPYFNRTEVMRIGFDLSNQTFKPPKEFGPYYFIASPYPFPDRNGPASKSKGAIIGIAVGCGVLL

SEQ ID NO: 173906 - protein, 52 aa, Triticum aestivum
  Clone ID: PAT_TA_68324.pep
FGFLHDSACHFIFSPLQRPNHGLRKRCIIYLLLEFFYSQLVPKMPTEQWCNR

SEQ ID NO: 173907 - protein, 197 aa, Triticum aestivum
  unsure (1)..(197): unsure at all Xaa locations
  Clone ID: PAT_TA_68325.pep
MKTFLILALVATTATTAVRVPVPQLQPKNPSQQQPQEQVPLVQQQQFPGQQQQFPPQQPYPQPQPFPSQQPYLQLQPFPQPQPFLPQLPYPQPQSFPPQQPYPQQRPKYLQPQQPISQQQAQQQQQQQQQQQQQQQQQQQQILQQILQQQLIPCRDVVLQQHNIAHASSQVLQQSTYQLLQXLCCQQLLQIPEQSRC

SEQ ID NO: 173908 - protein, 96 aa, Triticum aestivum
  unsure (1)..(96): unsure at all Xaa locations
  Clone ID: PAT_TA_68326.pep
MKTLLILTILAMATTIATANMQVDPSGQVQWPQQQQFPQQQSPQQQQFXQQQXXQQQQLPQQQXXXXQXTYLQXXXIXQXPXXXXQXRFXXQQQWQ

SEQ ID NO: 173909 - protein, 146 aa, Triticum aestivum
  unsure (1)..(146): unsure at all Xaa locations
  Clone ID: PAT_TA_68327.pep
QVLQQSTYQLLQQLCCQQLXQIPEQSRXQAIHNXAHAIIMHQQQQQQQEQQQQLQQQQQQQLHQQRQQPSSQVXXQQPQQQYXSSQVSFQPSQLNPQAQGSVQPQQLPQFAEIRNLALQTLPAMCNVYXPPHCSTTIAPFGIFGTN

SEQ ID NO: 173910 - protein, 140 aa, Triticum aestivum
  unsure (1)..(140): unsure at all Xaa locations
  Clone ID: PAT_TA_68328.pep
XQPFXPQQPYSQLXPFXSQQPYMQLQPFXQPQLPYPQXQLPYXQPQPFRPQQSYXQPQPQYSQPQQPISQQQQQQQQQQQQQILQQILQQQLIPCRDVVLQQHSIAHGSSQVLQQSTYQLVQQLCCQQLWQXPEQSRCQA

SEQ ID NO: 173911 - protein, 56 aa, Triticum aestivum
  unsure (1)..(56): unsure at all Xaa locations
  Clone ID: PAT_TA_68329.pep
LWSNNWQMCQAAVEAVLSGKPIVQVSSEDAAADRTPPLKAYDXRHVSTSPAADGRL

SEQ ID NO: 173912 - protein, 35 aa, Triticum aestivum
  unsure (1)..(35): unsure at all Xaa locations
  Clone ID: PAT_TA_68330.pep
WPIGXRFVXPTGSKGAGXTGTNAPTRLGRPRPHEP

SEQ ID NO: 173913 - protein, 36 aa, Triticum aestivum
  unsure (1)..(36): unsure at all Xaa locations
  Clone ID: PAT_TA_68331.pep
DTADXPAXIYPXAKQQVFRXCHXRQVIXXXQFAKVP

SEQ ID NO: 173914 - protein, 35 aa, Triticum aestivum
  Clone ID: PAT_TA_68332.pep
FFLNRSSNRFLIYTTSTCLLFLQQNSKYMPFSLVP

SEQ ID NO: 173915 - protein, 109 aa, Triticum aestivum
  unsure (1)..(109): unsure at all Xaa locations
  Clone ID: PAT_TA_68333.pep
QQPFPQXQQPXWQXPQQXIPQPHXTXHHXPQQTFXQPQQTYPHXPQQQFPQXQXPQQPFSQAQQTXPQQPQXPFSQQPQQXFPQXQQPQQQFXQXQEPQQPFXQXQQQF

SEQ ID NO: 173916 - protein, 136 aa, Triticum aestivum
  unsure (1)..(136): unsure at all Xaa locations
  Clone ID: PAT_TA_68334.pep
PYXQPQPFXXQQPYLQXXPFSQPQLPYSQPQLPYSQPQLPYSQXQPFXPQQPYPQSQPQYSQPQQPISQQQQQQQQQQQQKQQQQQQQQILQQILQQQLIPCRDVVLQQHSIAYGSSQVLQQSTYQLVQQXLCCQQ

SEQ ID NO: 173917 - protein, 61 aa, Triticum aestivum
  unsure (1)..(61): unsure at all Xaa locations
  Clone ID: PAT_TA_68335.pep
FCAQMTSTXRSESANHMLKSYMPPASPMHVFVRQYMRLQFDXERDESYEEKRTMIGGAVRR

SEQ ID NO: 173918 - protein, 86 aa, Triticum aestivum
  Clone ID: PAT_TA_68336.pep
QTIIHNIITSHESKSIHHQIEIHSRKQRKASKNWIELGGSELLRGLCYRHGRIRLRHRFRSSLPTDDQLTTTNLLPRTKIERNQSN

SEQ ID NO: 173919 - protein, 77 aa, Triticum aestivum
  Clone ID: PAT_TA_68337.pep
MFPEATLCFTPFIYTLSAIAIIYTSLTTLRQIDLKKIIIYSGSPYLLSIPFLLALPIHHTDLTLPYAFFQALLPGQR

SEQ ID NO: 173920 - protein, 94 aa, Triticum aestivum
  Clone ID: PAT_TA_68338.pep
PGVLGEYTWLPSLTFIAYCKGYSNSCSLEQKSPQAIFLSYAQWEPMFELCFCNRLSLVPLTFLRTRTLRDIFLLEPDVKPDIESFKALWETSFP

SEQ ID NO: 173921 - protein, 194 aa, Triticum aestivum
  Clone ID: PAT_TA_68339.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLR

SEQ ID NO: 173922 - protein, 51 aa, Triticum aestivum
  unsure (1)..(51): unsure at all Xaa locations
  Clone ID: PAT_TA_68340.pep
DLAEXVKEXXVXHTHVQIPHXQGRRRXSXSPSXXXXAALHRXSRWSCRRLN

SEQ ID NO: 173923 - protein, 306 aa, Triticum aestivum
  unsure (1)..(306): unsure at all Xaa locations
  Clone ID: PAT_TA_68341.pep
SLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXIPPDQQRLIFAGKQLEDGRTLADYNIQKXESTLHLXLXLRGGMQIFVKTLTGKTITLEXESSDTIDNVXXKIRTRXGIPPGQQXLXFAGXQLEDGRTLAXYNIXKXXTLHL

SEQ ID NO: 173924 - protein, 69 aa, Triticum aestivum
  unsure (1)..(69): unsure at all Xaa locations
  Clone ID: PAT_TA_68342.pep
KLXKVAYKPNATTTHAKLAMPIYMGIHPSTKGGEHPQPRHMHLAGHKATHACMLRNMQPLAHTHIYQVR

SEQ ID NO: 173925 - protein, 198 aa, Triticum aestivum; identical to SEQ ID NO: 173181
  Clone ID: PAT_TA_68343.pep

SEQ ID NO: 173926 - protein, 145 aa, Triticum aestivum; identical to SEQ ID NO: 131257
  Clone ID: PAT_TA_68344.pep

SEQ ID NO: 173927 - protein, 51 aa, Triticum aestivum
  unsure (1)..(51): unsure at all Xaa locations
  Clone ID: PAT_TA_68345.pep
SSVLFLQVTPSYYALYCNSVHERMHVQSSAKHIKFPXIKTTQPGTTEKKXA

SEQ ID NO: 173928 - protein, 119 aa, Triticum aestivum
  Clone ID: PAT_TA_68346.pep
IIRTIAMAGIAYQALHMENQWRRCRATNTQKTRTGTNDCQAIITNSGTFLKRISHCQNKSRTSEANWNLPEGNGRYDYPSSYFHTVVVSKFCQHIATQINSQRLNSGRLSYFPVHVHSF

SEQ ID NO: 173929 - protein, 88 aa, Triticum aestivum
  unsure (1)..(88): unsure at all Xaa locations
  Clone ID: PAT_TA_68347.pep
NFDCCAWITLMYPFNQTDFIXSIIRQIYVNSLQETGEEGKSAIGAQVLRMMATMKEDSLAHEFKRYLNFKSYLIVLNGIHTIEXVGLH

SEQ ID NO: 173930 - protein, 49 aa, Triticum aestivum
  Clone ID: PAT_TA_68348.pep
CLDTTLFVFYLEFKQLVWAGHTRRCVTLYLSPLHRHIHRLNNGDPTIYY

SEQ ID NO: 173931 - protein, 109 aa, Triticum aestivum
  Clone ID: PAT_TA_68349.pep
CQAIHNVVHAIILHQQQQQQQQQQQQQQQQQQQQPLSQVCFQQSQQQYPSGQGSFQPSQQNPQAQGSVQPQQLPQFEEIRNLALETLPAMCNVYIPPYCTIAPVGILRY

SEQ ID NO: 173932 - protein, 44 aa, Triticum aestivum
  unsure (1)..(44): unsure at all Xaa locations
  Clone ID: PAT_TA_68350.pep
SQENFMQAXXIVGCALSXXRXXDRVFIPVGMXCCXXXXSSLLAP

SEQ ID NO: 173933 - protein, 90 aa, Triticum aestivum
  Clone ID: PAT_TA_68351.pep
ASHLGSSSGPRDAHLLALTTASRPSILATAEACLGIGTYRRRVISNRENKKEKQCQSDTHNCKLILGIINFKEKALQDFLHTPAVFVSIP

SEQ ID NO: 173934 - protein, 83 aa, Triticum aestivum
  Clone ID: PAT_TA_68352.pep
KVALTLINLLARECVMPTTVSALVADKVIFAFLPDYTHIHTYQWMLLFIKSNKQCNLDICSKMGRQAAVAAGHPRSSLFRRPA

SEQ ID NO: 173935 - protein, 35 aa, Triticum aestivum
  Clone ID: PAT_TA_68353.pep
LYLSFIPSLELAQVGVTHDGARHFICHRYNDWCIS

SEQ ID NO: 173936 - protein, 37 aa, Triticum aestivum
  unsure (1)..(37): unsure at all Xaa locations
  Clone ID: PAT_TA_68354.pep
YFXLXNXLHGGXCGXXXXGIAXXHIYHXXXRVMFXLS

SEQ ID NO: 173937 - protein, 71 aa, Triticum aestivum
  unsure (1)..(71): unsure at all Xaa locations
  Clone ID: PAT_TA_68355.pep
ALCSVTKSHYFSSLDICQQYQLGTTXYITYIASCIQRQVKWEEKLHIMCCSAMTESKDVISAVSRLVVSLF

SEQ ID NO: 173938 - protein, 49 aa, Triticum aestivum
  Clone ID: PAT_TA_68356.pep
NLNRSDSYNWLIWNAYKATSSGMNPRIKLEIVHKTDKSGKPTYRLKALV

SEQ ID NO: 173939 - protein, 72 aa, Triticum aestivum
  Clone ID: PAT_TA_68357.pep
FQQPQQQYPSSQVSFQPSQLNPQAQGSVQPQQLPQFAEIRNLALQTLPAMCNVYIPPHCSTTIAPFGIFGTN

SEQ ID NO: 173940 - protein, 138 aa, Triticum aestivum
  Clone ID: PAT_TA_68358.pep
PFHGAAKYVPELGLWFGFNATIGNTHHCLGAFDLSSWPPVEHRSWNYLDPLPDEWSTWQRHLLNLGSGKFCIATSFQNIECRTPCNSAGYPLHGLDDEMVVNDLTILTGVEVVRCGDGLKMINHKSKRLEGIEIHCVL

SEQ ID NO: 173941 - protein, 174 aa, Triticum aestivum
  Clone ID: PAT_TA_68359.pep
NFIVSNCGEVFEGVTSIVDVAGGTGTAARAIAKAFPHIKCSVLDLPNVINSISSDGTVEYIVGDMMSSIPRTDAVFLKYVLHDWKDEDCVKILTQCKKAIPKPGGKVIIVDMVVGSPSKSMFEAQVLFDLLMMVMTSGKEREEHEWGKIFKDAGFSHYKTRPVMGCMAVTELYP

SEQ ID NO: 173942 - protein, 89 aa, Triticum aestivum
  Clone ID: PAT_TA_68360.pep
QQQQQQQQQQQQQPLSQVCFQQSQQQYPSGQGSFQPSQQNPQAQGSVQPQQLPQFEEIRNLALETLPAMCNVYIPPYCTIAPVGIFGTN

SEQ ID NO: 173943 - protein, 88 aa, Triticum aestivum
  Clone ID: PAT_TA_68361.pep
PHQQQQQQQQQQPLSQVSFQQPQQQYPSGQGFFQPSQQNPQAQGSFQPQQLPQFEAIRNLALQTLPAMCNVYIPPYCTIAPFGIFGTN

SEQ ID NO: 173944 - protein, 64 aa, Triticum aestivum
  unsure (1)..(64): unsure at all Xaa locations
  Clone ID: PAT_TA_68362.pep
QYPSGQGFFQPSQQNXQXQGSFQPQQLXQFEAIRXXALQTLPAMCNVYIPPYCTIAPFGIFGTN

SEQ ID NO: 173945 - protein, 181 aa, Triticum aestivum
  Clone ID: PAT_TA_68363.pep
YVISEKTEDDTPIQVQTPSQTQGWPDGEAEVPTPENEPLERPIGSMAEKEQLQPCKSSVSPNDNIYMEAANHLWSNKRVAESVKELKEDEHFEQACALEEERIANGIDMIAHKRKKLEVKERELEFKRKKLEVRERELELQRRLEDARIMDMDISAMTGRQQQFYMSLQNEIIARRCNRSK

SEQ ID NO: 173946 - protein, 191 aa, Triticum aestivum
  unsure (1)..(191): unsure at all Xaa locations
  Clone ID: PAT_TA_68364.pep
GHWKPAKKFLRYLQWTKDHMLTXNVTXHLELIXTDSYYSRCVDPRKSIFDYLFLLAGGATSWESGKXPVIATSTMEAEFVASFEATIQSLWLWNFVSCLQIIDNTVRPLRIYWDISAVVFSKNDKYSKGAKHMDSKYLAVKENVQNQKVSVEHIDTNLTLNKGLPPKTVCGHIERMCTIDKSLNHNDCIYA

SEQ ID NO: 173947 - protein, 170 aa, Triticum aestivum
  Clone ID: PAT_TA_68365.pep
ASTGPPIQGIHQTMFERRHDRSGGCFLDAGTETTRLVPAAYTLVEEAVAHMVQQWGYKRVRDRDFLLCFREEPGIWSRIPRLRLDYEGPPTRHGEPTRAHLEIGSRRLFVKVENKQLLCFGVYPTTSRHPTVIGAMQQVDTRFIFDLRANTITIHPESCEDDTEPAPSEW

SEQ ID NO: 173948 - protein, 28 aa, Triticum aestivum
  unsure (1)..(28): unsure at all Xaa locations
  Clone ID: PAT_TA_68366.pep
IPPXRSXRALRSLKXXCKRXYXXLQREX

SEQ ID NO: 173949 - protein, 52 aa, Triticum aestivum
  unsure (1)..(52): unsure at all Xaa locations
  Clone ID: PAT_TA_68367.pep
MGSVSCDVMKGXASLSGKKSXEXXKXSGGGGGFMKMAXGFMKXEVWFXHXHA

SEQ ID NO: 173950 - protein, 97 aa, Triticum aestivum
  Clone ID: PAT_TA_68368.pep
VDNQVQSLGSAFEAESICLPFVHVGPTEEVAPAFSDGGPFVNSLYKAGRDSGSSISSCDWKFTVVSIHVWEKGTIEKWTLKYILLPCVANVSVMCHT

SEQ ID NO: 173951 - protein, 89 aa, Triticum aestivum
  Clone ID: PAT_TA_68369.pep
KKELMEIFKKNTSGQCLLALVLVATVISSSDAFGPEGGCFMPFVECNLDLCKRNCDGLIPYCKQIDGVSAQCCCSPKKLSASVDKNNRP

SEQ ID NO: 173952 - protein, 94 aa, Triticum aestivum
  Clone ID: PAT_TA_68370.pep
EGRGLDHKLESYLIPSVHAKNKQCKKRALNNNPGTVHIERACQKHEQQEQEEIHANSQHPTKTKVHKNAETRRCTMDKHQLLKGPKTKTRKEKR

SEQ ID NO: 173953 - protein, 54 aa, Triticum aestivum
  unsure (1)..(54): unsure at all Xaa locations
  Clone ID: PAT_TA_68371.pep
VTLFYSWLXPHSNRFXSCCTXLGXTEPTEAGEXLVLSSFSIYMLGLILSXDASF

SEQ ID NO: 173954 - protein, 212 aa, Triticum aestivum
  Clone ID: PAT_TA_68372.pep
ISSLDGNVQRAQPQNPWPPFSSQQPYLQLQPFPQPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCQQLWQIPEQSRCQAIHNVVHAIILHQQQQQQQQQQQQQPLSQVSFQQPQQQYPSGQGSFQPSQQNPQAQGSVQPQQLPQFEE

SEQ ID NO: 173955 - protein, 103 aa, Triticum aestivum
  unsure (1)..(103): unsure at all Xaa locations
  Clone ID: PAT_TA_68373.pep
HNVVHAIILHQQTPXHHQQQQQQQQQQPLSQVSFQQPQQQYPSGQGFFQPSQQNPQAQGSFQPQQLPQFEAIRNLALQTLPAMCNVYIPPYCTIAPFGIFGTN

SEQ ID NO: 173956 - protein, 47 aa, Triticum aestivum
  unsure (1)..(47): unsure at all Xaa locations
  Clone ID: PAT_TA_68374.pep
KKXRXXSIGGVXXXKXXKXKXAXKXXPQLLPPPPSLSRFTFLFSQWV

SEQ ID NO: 173957 - protein, 40 aa, Triticum aestivum
  unsure (1)..(40): unsure at all Xaa locations
  Clone ID: PAT_TA_68375.pep
KAIVXTDXHSLKGALCTPDXTCCNKNMCVDFVLMXXSHDG

SEQ ID NO: 173958 - protein, 135 aa, Triticum aestivum
  unsure (1)..(135): unsure at all Xaa locations
  Clone ID: PAT_TA_68376.pep
KKVXXEKTTAGKKPKAEKRAPASKEAGGEAKQRGRKKGSKAKKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 173959 - protein, 135 aa, Triticum aestivum
  Clone ID: PAT_TA_68377.pep
RAKYLYRLLRNPKIAKYLDTRRLERLPSPKTHEPITSSSTFVARTRPAGPKTPSTTTTPKGFDFVKFSFEPCTTLNMCGYTTNRQDPELLPSPRSREPLPSTLEHARSTTSTTAVARKPTSLYERETFPLHVPKV

SEQ ID NO: 173960 - protein, 55 aa, Triticum aestivum
  Clone ID: PAT_TA_68378.pep
QLRINIHTISCSAHAQNVSPSTKHNHLANQTARKAHPSTSCGKILPYHQLATQIL

SEQ ID NO: 173961 - protein, 131 aa, Triticum aestivum
  unsure (1)..(131): unsure at all Xaa locations
  Clone ID: PAT_TA_68379.pep
QPYAISGEKVCENALVAAPEAVQVKLKCDGRSSATSRLSPGDEEARSLSTXTAIHQEPLQQPLYPISTTHFYCLRSMHMTGNRDCSCPSVFLLVLLINCLSQTIASQSGVHVLLAAREAKVLQLPGWTYSS

SEQ ID NO: 173962 - protein, 26 aa, Triticum aestivum
  unsure (1)..(26): unsure at all Xaa locations
  Clone ID: PAT_TA_68380.pep
SPPRRXPRPRSGRAGELMVLRQPSCX

SEQ ID NO: 173963 - protein, 77 aa, Triticum aestivum
  unsure (1)..(77): unsure at all Xaa locations
  Clone ID: PAT_TA_68381.pep
TTNFRKWHAWMTRLLTRLHHXKRYNCGEEARSHRATMNSRAQHLGHDSFNFAYGLHRRRLQATQRRSSTQHSGSTAC

SEQ ID NO: 173964 - protein, 41 aa, Triticum aestivum
  unsure (1)..(41): unsure at all Xaa locations
  Clone ID: PAT_TA_68382.pep
KGIHVYDTXVNRDLKEKPLESQLKEPDPHRPNPRNKSITEP

SEQ ID NO: 173965 - protein, 57 aa, Triticum aestivum
  unsure (1)..(57): unsure at all Xaa locations
  Clone ID: PAT_TA_68383.pep
PTAAAVVVAXRLXKXNTRTPXRPXCRFVLHQVSSTFLXTQFXKLXSLSXXRLLRFLX

SEQ ID NO: 173966 - protein, 185 aa, Triticum aestivum
  unsure (1)..(185): unsure at all Xaa locations
  Clone ID: PAT_TA_68384.pep
FERSGQRFLWSVRMPAVATTXEKYLEGFPEPELDALLPQGFLERTNGRGLVIKSWAPQMDVLGHRATGAFVTHCGWNSVLEAIVAGVPMLCLLLEGEQRMNKVSMTEGMGVAVELEGYMTGFVKAGEVEAKVRLVIEGEEGRHLRARVAALREEAKAALEEGGPSRVAFAQFLLDVDNLGKQLGN

SEQ ID NO: 173967 - protein, 32 aa, Triticum aestivum
  unsure (1)..(32): unsure at all Xaa locations
  Clone ID: PAT_TA_68385.pep
XHDIDRCAYVTEIVLAACYKALNDQHVLLEGT

SEQ ID NO: 173968 - protein, 60 aa, Triticum aestivum
  unsure (1)..(60): unsure at all Xaa locations
  Clone ID: PAT_TA_68386.pep
XXXQAQGSVQPXHLPQFXEIRXLALQTLXXMCNVYIXPHCSTTTAPFGIFGTXEEKSSTR

SEQ ID NO: 173969 - protein, 77 aa, Triticum aestivum
  Clone ID: PAT_TA_68387.pep
EQHLARLAMCPGGWPCAFDRPVGLEEEHLAWLTMCPGGSPCVVALTSALAYDIFFFPDVQFIGMIMLCDSMYIARKK

SEQ ID NO: 173970 - protein, 123 aa, Triticum aestivum
  Clone ID: PAT_TA_68388.pep
NLCFHQLKVLDLVWIKPSGVHEHDLVFFSIFAFTSSPRTLNFSSSIASLRSSHVTLCSYVALTSNNLASSCFFFASNSFFIAIISLTAVFNTNPAPPMGICWWSSTSSEFGGATPMGASSTSS

SEQ ID NO: 173971 - protein, 35 aa, Triticum aestivum
  unsure (1)..(35): unsure at all Xaa locations
  Clone ID: PAT_TA_68389.pep
LLAQXTVRQXEVTKPGNTGSQHPPTLFIGYYTRYS

SEQ ID NO: 173972 - protein, 61 aa, Triticum aestivum
  unsure (1)..(61): unsure at all Xaa locations
  Clone ID: PAT_TA_68390.pep
XGPRXLXXPSFMLIHNCXXKSPTXPPPXXMXSTRSXPPHQXRXXXSPXXXLXLLPANLHHX

SEQ ID NO: 173973 - protein, 41 aa, Triticum aestivum
  unsure (1)..(41): unsure at all Xaa locations
  Clone ID: PAT_TA_68391.pep
XAPKASSKHPXXLNYXERTXLNXHFXGXQAXFILXALKNXA

SEQ ID NO: 173974 - protein, 62 aa, Triticum aestivum
  Clone ID: PAT_TA_68392.pep
GQGSFQPSQQNPQAQGSVQPQQLPQFAEIRNLALQTLPAMCNVYIPPHCSTTIAPFGIFGTN

SEQ ID NO: 173975 - protein, 34 aa, Triticum aestivum
  unsure (1)..(34): unsure at all Xaa locations
  Clone ID: PAT_TA_68393.pep
VTHFLLWRSDSSLXAGVEALAFXXYVCGLSRASL

SEQ ID NO: 173976 - protein, 52 aa, Triticum aestivum
  Clone ID: PAT_TA_68394.pep
MTRTTQAHSETLLAHALPNKDLTDDAWIADRGLGPLATDAAGELDVLGHDGA

SEQ ID NO: 173977 - protein, 52 aa, Triticum aestivum
  unsure (1)..(52): unsure at all Xaa locations
  Clone ID: PAT_TA_68395.pep
XRERXXXREREREREREREREREREREREREAGRRRRWHAVVFSDQWDRQQK

SEQ ID NO: 173978 - protein, 40 aa, Triticum aestivum
  Clone ID: PAT_TA_68396.pep
SRFLGFMIDNLSWAMELKCLLNVHRCLKRRTIQTLDVHHI

SEQ ID NO: 173979 - protein, 119 aa, Triticum aestivum
  unsure (1)..(119): unsure at all Xaa locations
  Clone ID: PAT_TA_68397.pep
DXMYLWELMWXMXYNPGFFSMLESNTGPPNEKDENTLKQCGKFERKKLQAAKQEEQIPLSVFVVASVIEARNKRLLGEAKGLDDVVKILNEITGSLDAKKACRGALTIQEKYLTTVKAS

SEQ ID NO: 173980 - protein, 74 aa, Triticum aestivum
  unsure (1)..(74): unsure at all Xaa locations
  Clone ID: PAT_TA_68398.pep
LLHSEHISSRAHFRIMIFGKKFELXYVNQDKGRYSGPDEQKWVKNSKFWSHCTINYVHRATCSWASGHPFLPQS

SEQ ID NO: 173981 - protein, 142 aa, Triticum aestivum
  unsure (1)..(142): unsure at all Xaa locations
  Clone ID: PAT_TA_68399.pep
ASSFDSFVXKLLGGITVPSLGASGAIMGLIGYIXSKIPESRLSIVFLPQWSFTADSALKGIATFDAVGLLVGMATKWRYMVLDHAGHLAGLLFGIWYAHAGANIFSAWYRYCRRVKDGMQGRKQIILFYFQKLLNTSFGCQM

SEQ ID NO: 173982 - protein, 58 aa, Triticum aestivum
  unsure (1)..(58): unsure at all Xaa locations
  Clone ID: PAT_TA_68400.pep
EAQPQQQLQQQLGQQPQQQQLAHGTFLQPHXIAQLXXMTSIALXTLPTMXSVNXPLYE

SEQ ID NO: 173983 - protein, 36 aa, Triticum aestivum
  unsure (1)..(36): unsure at all Xaa locations
  Clone ID: PAT_TA_68401.pep
PXRQTXKDALLSPSXRSFYACIGESXHAYQSPXEDL

SEQ ID NO: 173984 - protein, 60 aa, Triticum aestivum
  unsure (1)..(60): unsure at all Xaa locations
  Clone ID: PAT_TA_68402.pep
DAFXKNVESXTKYLLSKLKXLQFFVGXSMHXDXGVVFXYXKXGAADPXFLSXAHGLKXXK

SEQ ID NO: 173985 - protein, 52 aa, Triticum aestivum
  unsure (1)..(52): unsure at all Xaa locations
  Clone ID: PAT_TA_68403.pep
XRKVLRDNIQGITNXAIRRLARRGGXKRIXGLXYEXXRGVLXIFLXNXIXDA

SEQ ID NO: 173986 - protein, 42 aa, Triticum aestivum
  unsure (1)..(42): unsure at all Xaa locations
  Clone ID: PAT_TA_68404.pep
XRHISGRXSTLNXXSXNLXSXQXYXIXPALIXERFGXWVFLX

SEQ ID NO: 173987 - protein, 31 aa, Triticum aestivum
  Clone ID: PAT_TA_68405.pep
GNLALETLPAMCNVYIPPYCTIAPVGIFGTN

SEQ ID NO: 173988 - protein, 40 aa, Triticum aestivum
  unsure (1)..(40): unsure at all Xaa locations
  Clone ID: PAT_TA_68406.pep
WCXFAIXFLRYYYYLLVXLISSIFPMFRIKFKFVNTYFKF

SEQ ID NO: 173989 - protein, 107 aa, Triticum aestivum
  unsure (1)..(107): unsure at all Xaa locations
  Clone ID: PAT_TA_68407.pep
XRSYFSKGGQLIGEPINCCLWLSLGGKNDFPELASLLDRVGDRVEAELCSRAMHVISHHVANTLPNASEAHVRLGHFLPKKFNQTVVLQNLHCLQARIDLHVPYHAC

SEQ ID NO: 173990 - protein, 36 aa, Triticum aestivum
  unsure (1)..(36): unsure at all Xaa locations
  Clone ID: PAT_TA_68408.pep
MICDEAVMAAAPLLSSIPDRGHASXARAPSCPSWIE

SEQ ID NO: 173991 - protein, 110 aa, Triticum aestivum
  unsure (1)..(110): unsure at all Xaa locations
  Clone ID: PAT_TA_68409.pep
RDPPPXHLTFDAMGVPHPPWLSPSRASSRRCEGRHGSAAPFLLHHGRRLTLPSQQAPYKRVGPQLLRSSAILRCTWIWRFQGLHGFRIGLSFGISLDLGQANHAAAPSSS

SEQ ID NO: 173992 - protein, 35 aa, Triticum aestivum
  unsure (1)..(35): unsure at all Xaa locations
  Clone ID: PAT_TA_68410.pep
LASCFWXCLNXGPSXXPPSXADXVAFFVSFACFXA

SEQ ID NO: 173993 - protein, 62 aa, Triticum aestivum
  unsure (1)..(62): unsure at all Xaa locations
  Clone ID: PAT_TA_68411.pep
TRRAITKVKCWYKHLGMFRLTGTCDIPKYFSLNSADTSVCYKRIQEQNCYXIIRSTICGHLC

SEQ ID NO: 173994 - protein, 48 aa, Triticum aestivum
  unsure (1)..(48): unsure at all Xaa locations
  Clone ID: PAT_TA_68412.pep
YYSDLQAQFLLASSSLKFHIHLEXGHRSMCVFFDNVFIIITVCFRLRW

SEQ ID NO: 173995 - protein, 36 aa, Triticum aestivum
  unsure (1)..(36): unsure at all Xaa locations
  Clone ID: PAT_TA_68413.pep
MQMIYFLNLRRVIHSIMVDQVVVLVDNKVVFXICIX

SEQ ID NO: 173996 - protein, 125 aa, Triticum aestivum
  unsure (1)..(125): unsure at all Xaa locations
  Clone ID: PAT_TA_68414.pep
STYQLVQQLCCQQLWQIPEQSRCQAIHNVVHAIIXHQQQXQQQQXQQKQPLSQVSFQQPQQQYPSGQGSFQPSQQNPQAQGSVQPQQLPQFEEIRNLALETLXAMCNVYIPPYCTIAPVGIFGTN

SEQ ID NO: 173997 - protein, 38 aa, Triticum aestivum
  unsure (1)..(38): unsure at all Xaa locations
  Clone ID: PAT_TA_68415.pep
RRWXAAHEGRGLLXILVGVIXHXHLLLPLLXQLSRXFT

SEQ ID NO: 173998 - protein, 96 aa, Triticum aestivum
  Clone ID: PAT_TA_68416.pep
HIYVPRSSLSSFSLSVAIVQPSTFVTPSLTIPMSIRCRFGCIYVDDFGWLWSFWYQKNSAGNIALASFVEHFITGLGEILTTSGCTTESLATMPPW

SEQ ID NO: 173999 - protein, 71 aa, Triticum aestivum
  Clone ID: PAT_TA_68417.pep
TSNAKAHGGQESANAHAGNSSATKSKSEPTTPTQPKTLVLQDTLKTFVWVTEILELESIAGARSNYTRISF

SEQ ID NO: 174000 - protein, 76 aa, Triticum aestivum
  unsure (1)..(76): unsure at all Xaa locations
  Clone ID: PAT_TA_68418.pep
SCXXRXXXXTXVXLXXXSXFAIGRRRPHTTTRLLLGTVXRFAIRRLRRPTTSRRGRSAPPSGAAQSLPTPSPTREK

SEQ ID NO: 174001 - protein, 50 aa, Triticum aestivum
  unsure (1)..(50): unsure at all Xaa locations
  Clone ID: PAT_TA_68419.pep
XASGQXNGGKGXAXRDTAAXQCVGWRGATHXRLASDRXLCSLHGAWACMH

SEQ ID NO: 174002 - protein, 78 aa, Triticum aestivum
  unsure (1)..(78): unsure at all Xaa locations
  Clone ID: PAT_TA_68420.pep
PTPXPXXTHPTPXPEHKPPTPXXTHPTPXYHPXADXXMXQXPXTDPQXFXKLLPXIXKNPXFXKFPPAKEDTKPRIAT

SEQ ID NO: 174003 - protein, 61 aa, Triticum aestivum
  unsure (1)..(61): unsure at all Xaa locations
  Clone ID: PAT_TA_68421.pep
FMVSXXXTSLLFMMRCMRGNCLVLRHSXXRFTMCITELRVQNNSHVLRVYQASXSXXXVCC

SEQ ID NO: 174004 - protein, 92 aa, Triticum aestivum
  unsure (1)..(92): unsure at all Xaa locations
  Clone ID: PAT_TA_68422.pep
ENIIQLPGQYDYFTLGAXEGFLFLGATSEDQLDIDEDSPVWLSKTDWDVDYFSLDVKTSELAKVCRRRREFFHYEDVYWYFGFPPSLSKPSI

SEQ ID NO: 174005 - protein, 63 aa, Triticum aestivum
  unsure (1)..(63): unsure at all Xaa locations
  Clone ID: PAT_TA_68423.pep
KISRLSNLYXNNLYPRRPHKFTSLPTLIXILATYRVFFSLMIIDYSKYRKNDCLCYLFVGNLR

SEQ ID NO: 174006 - protein, 47 aa, Triticum aestivum
  unsure (1)..(47): unsure at all Xaa locations
  Clone ID: PAT_TA_68424.pep
YVIMXXGTRXMXAXXLXXXLXXAXWXVPSRERAXSSAPCPLMXSXMH

SEQ ID NO: 174007 - protein, 37 aa, Triticum aestivum
  Clone ID: PAT_TA_68425.pep
TIQYIAHFFWERIYTPRVGASIFLWFSLTEYYTSSAP

SEQ ID NO: 174008 - protein, 94 aa, Triticum aestivum
  Clone ID: PAT_TA_68426.pep
ETYGFYNLYSWKHGFTIRYYGKSRLNVRKTKCIKEVFCGWLGEESGAAVVAGGRRLLHPSVGRAPASSHQAWLGVLTMKHSTWYAFRSASSARR

SEQ ID NO: 174009 - protein, 71 aa, Triticum aestivum
  unsure (1)..(71): unsure at all Xaa locations
  Clone ID: PAT_TA_68427.pep
XTAXRAAAAPTXTSXPWRSHFRTEXPRPSARTRKGTPPDMSTSRSLALDXXXNRKKXDNVIIPRPGFSSAF

SEQ ID NO: 174010 - protein, 126 aa, Triticum aestivum
  unsure (1)..(126): unsure at all Xaa locations
  Clone ID: PAT_TA_68428.pep
QSTYQLVXQLCCQQLWQIPEQSRCQAIHNVVHAIILHQQQQQQQQQQQQQPLSQVSFQQPQQQYPSGQGSFQPSQQNPQAQGSVQPQQLPQFEKIRNLALETLPAMCNVYIPPYCTIAPVGFFGTN

SEQ ID NO: 174011 - protein, 105 aa, Triticum aestivum
  unsure (1)..(105): unsure at all Xaa locations
  Clone ID: PAT_TA_68429.pep
QQPGQXXQSXQVQQGYYXISLQQPGQGXQGXXPTSPQQSGQXQXPGHEQQPGQXLQPGQGQQGYYPTSSQQSGQGHQSGXGNKGTYPTSLWHPXQGHTRTRASRL

SEQ ID NO: 174012 - protein, 101 aa, Triticum aestivum
  unsure (1)..(101): unsure at all Xaa locations
  Clone ID: PAT_TA_68430.pep
XXXXXGXXXRXXXVWXXXXXXKXXXXXXXXXXXXEXXXKQXXYXIRXKWVPCXEFSKVGFIFXEHNASXGYYDXRYXTMWKLPMXGCTDAXQXINEXEEVN

SEQ ID NO: 174013 - protein, 61 aa, Triticum aestivum
  unsure (1)..(61): unsure at all Xaa locations
  Clone ID: PAT_TA_68431.pep
CVSRRXSCVVSHXKVADXCXWXAXXXXRCXCLCLFVGFGVFLFDSRVSSXCFKKGSLIXIV

SEQ ID NO: 174014 - protein, 77 aa, Triticum aestivum
  unsure (1)..(77): unsure at all Xaa locations
  Clone ID: PAT_TA_68432.pep
QPLSQVSXXQPQXQYPSGQGSFQPSQQNPQAQGSVQPQQLPQFEEIRNLALETLPAMCNVYIPPYCTIAPVGFFGTN

SEQ ID NO: 174015 - protein, 61 aa, Triticum aestivum
  Clone ID: PAT_TA_68433.pep
GIFPLQNVYVRKVKILKAPKFDLGKLMEVHGDYKEDVGVKLDRPADGDEVIPGAEEVAAAE

SEQ ID NO: 174016 - protein, 98 aa, Triticum aestivum
  unsure (1)..(98): unsure at all Xaa locations
  Clone ID: PAT_TA_68434.pep
LGELVLVSSNYKYFGRREYLSIQCKDEEFXQGYXLLXPMVIISSKVKSXRRKXLDXQNXFLYSKVLXXTXRXIFFFAGLHLYQLYACVVVPKPXAIIX

SEQ ID NO: 174017 - protein, 104 aa, Triticum aestivum
  unsure (1)..(104): unsure at all Xaa locations
  Clone ID: PAT_TA_68435.pep
ARLPRAHEEEAGDELQELHGGGHGRLGGARSGRGGAGRMDPGGRRRIWPVEVPWRRSNLQGELEQWAWGSMVLALCSWREGGKEIREREREGREKRQWSGGVTX

SEQ ID NO: 174018 - protein, 60 aa, Triticum aestivum
  Clone ID: PAT_TA_68436.pep
PQPQSQCQSNSPPSAASPVSTMSSCFQSRKHPRDGDEERDTKGNGKVWVPKTIRIDDVDE

SEQ ID NO: 174019 - protein, 213 aa, Triticum aestivum
  unsure (1)..(213): unsure at all Xaa locations
  Clone ID: PAT_TA_68437.pep
KKPVHANXKKRHARAKPNKETSATAPSHVAXNASSSPGTPVFXSLDPYSPSGHIRRNGTSPATLPGSQNFXSLDPYSPSGHIRRNGTSPATSFSRQVGELRPAAAXAAAGTSNLCSLXMXQPLLPSHXVAHQGHRNQPPPRAGCSCTHLLTPQVHPPATILLPPSSPWSDSNSLSATMCTLSPLVALVFNCTNDTKIGTCIVTYDVLSMSNIR

SEQ ID NO: 174020 - protein, 41 aa, Triticum aestivum
  unsure (1)..(41): unsure at all Xaa locations
  Clone ID: PAT_TA_68438.pep
LXYFHLXYCCYXXLXYXGLXILVTSSXFYFIVLRXIYLYLX

SEQ ID NO: 174021 - protein, 47 aa, Triticum aestivum
  unsure (1)..(47): unsure at all Xaa locations
  Clone ID: PAT_TA_68439.pep
HXPRLALXTPYAXXXTLDLISXXRCXLNYFCSSKXPGXTXXDXSXIN

SEQ ID NO: 174022 - protein, 40 aa, Triticum aestivum
  unsure (1)..(40): unsure at all Xaa locations
  Clone ID: PAT_TA_68440.pep
PLSMPXVXAFPXCRCLLHCXVLDLDLLLLKNSSRSISLLF

SEQ ID NO: 174023 - protein, 49 aa, Triticum aestivum
  unsure (1)..(49): unsure at all Xaa locations
  Clone ID: PAT_TA_68441.pep
LTSMDPALXSANTLLAKTQQDDDDDVHMQXSIHPPKERFYNMHDRXLLX

SEQ ID NO: 174024 - protein, 68 aa, Triticum aestivum
  unsure (1)..(68): unsure at all Xaa locations
  Clone ID: PAT_TA_68442.pep
CKTXASGGTERRGPPVIDLSTISSSSSASYLQCRRRRVPVSVSLESCVSFGPVVFLIASSSVALSGVN

SEQ ID NO: 174025 - protein, 103 aa, Triticum aestivum
  unsure (1)..(103): unsure at all Xaa locations
  Clone ID: PAT_TA_68443.pep
MSGRGKGGKGLGKGGAKRHRKVLRDNIQGITKPAIRRLARRXGVKRISGLIYEETRGVLKIFLENVIRDAVXYTEHXRRKTVTAMDVVYALKRQXRTXYGFGG

SEQ ID NO: 174026 - protein, 213 aa, Triticum aestivum
  Clone ID: PAT_TA_68444.pep
RRLAPPPPPANRSPRLATHPPTFSPPPQSNTRLYHPVGDRQPADRQPWQRPPRTSTTTTKRKKKSVDGLSKRGVCYLSRVPPHMNPSHVRQIFSKYGEVQRIYLVPEGQGHRKHSNVKAKAYSEGWVEFAKKSVAKRVANLLNGEQIGGKKRSSFYYDIWNIKYLRKFKWDDLVGEIAEKTHIREQKLTLEITAAKKQRDHYLSNAEKSRTQK

SEQ ID NO: 174027 - protein, 89 aa, Triticum aestivum
  Clone ID: PAT_TA_68445.pep
VHIMLVPTVQRRWDPWSVATNQLLPRVSLIHLALRPGLPKAAGKVNGRSPPAAAVGAGRAGGDLGVVGVGVLPVSGLGNLRACCLPWMW

SEQ ID NO: 174028 - protein, 231 aa, Triticum aestivum
  Clone ID: PAT_TA_68446.pep
VPIGRPDMLKPKFPNVDELEDDRDRPTVGLRWVVGACTYRSAPARCYEHFTNEFDLLTDDQVVWSPYRDDRVKTLHLAPICTQDSHLWLTQAPLVFFFMVEVYTPERVMRQFGLHQECPPPFRDTSVELHWCCRGKVRSDWADKHKSFVDMWEVKEQHVIMEERPYDHANYMDYLRWYRRLTRIRLCTPRISNGHQDGASVRTATADDEDSLRASKLRYTPRAHLIHSVTD

SEQ ID NO: 174029 - protein, 186 aa, Triticum aestivum
  Clone ID: PAT_TA_68447.pep
MDRLKTSARLMIVSDLDHTMVDHHDSENLSLLRFNALWESNYRHDSLLVFSTGRSPVLYKKLREEKPMLTPDITIMSVGTEITYGNLMVPDAGWVEILNQKWDRSIVIEESKKFPELTLQAETELRPHKVSFYVEKDKAQAVSKALMECFEKHGLDVKIIYSGGMDLDILPQGAGKGQALAYLLKK

SEQ ID NO: 174030 - protein, 120 aa, Triticum aestivum
  unsure (1)..(120): unsure at all Xaa locations
  Clone ID: PAT_TA_68448.pep
ESQXAAAAPCVRTYCYPSPFLPGWPVPPPAPHLHPPRVAIESQSNPDSSRPRSPSVTASDDFLDTYFFFFFGLFTICIALCVCRMLARSPALPVPYLTATETAAASSAFFQPVRCDALPT

SEQ ID NO: 174031 - protein, 41 aa, Triticum aestivum; identical to SEQ ID NO: 133945
  Clone ID: PAT_TA_68449.pep

SEQ ID NO: 174032 - protein, 64 aa, Triticum aestivum
  Clone ID: PAT_TA_68450.pep
FGTRATRRQVEILYEGDEKTDAGSRKLLHTKGFRFLDRAALTTEDTNSKLATCSKTRDQWKLCT

SEQ ID NO: 174033 - protein, 151 aa, Triticum aestivum
  Clone ID: PAT_TA_68451.pep
MESYLEENFGGVKGKNSSEEALRRWRKLCSVVKNPKRRFRFTANLDKRGEAQAIKHANHEKLRVAVLVSKAALQFIHGLKLRSEYVVPEEVKAAGFQICADELGSIVEGHDSKKLIIHGAVAGIAAKLATSPTDGLDTAEDSMQRRQDIYG

SEQ ID NO: 174034 - protein, 115 aa, Triticum aestivum
  Clone ID: PAT_TA_68452.pep
RHEGRLGVVAGSAPSPSFPYTGIKQPAAWRCRPGSGGRWTRSWSWARRSSRSTTPASSSSSDVATLLSHTSTLPTHAIISGAKMIWCLQRSLLLHFLREKPSQAIWMHLHSTDST

SEQ ID NO: 174035 - protein, 132 aa, Triticum aestivum
  Clone ID: PAT_TA_68453.pep
SRESAAPVADSSKTKLKPFFWDKVTATDQAMVWDQIKAGSFQFNEEMIESLFGCKPVDKSNDSKKEPAKEAPQVVRILDAKKAQNLSISLKALSVTAQDVHTAVTEGHDLPADLITTLLRWTPTSDEELKLR

SEQ ID NO: 174036 - protein, 40 aa, Triticum aestivum
  unsure (1)..(40): unsure at all Xaa locations
  Clone ID: PAT_TA_68454.pep
XTATATMVSTLRPCRKSMAPFXPRGCXFCXSPSRRLGAAS

SEQ ID NO: 174037 - protein, 111 aa, Triticum aestivum
  Clone ID: PAT_TA_68455.pep
DNSLLDVDQLLQSVSETSQIVGRLSVSTNQGLPFKEVASQCEALLIGKEKKLSAFMSAHLQEVGTGMPKSSEPDSPIAGIILNTDDDQCYSNFCKLPVLNPYDKFLPSAGC

SEQ ID NO: 174038 - protein, 50 aa, Triticum aestivum
  unsure (1)..(50): unsure at all Xaa locations
  Clone ID: PAT_TA_68456.pep
AXNSARGXYMLFXLQKHHASKRLSNGKMHLPGCFFVVVFKVLLVHLALCL

SEQ ID NO: 174039 - protein, 126 aa, Triticum aestivum
  Clone ID: PAT_TA_68457.pep
NVYLWEKGFGIRYGKSRLNVNRTKCMQEIVCGCAGKPIVENTRSCQCECAALIRFLLPARAVSSADAQIYAVDAKAWHVLGHHHHRVLGAHQNQFSLVKQEAMQLGRMTCCHLNTSTTEAVRRHQN

SEQ ID NO: 174040 - protein, 167 aa, Triticum aestivum
  unsure (1)..(167): unsure at all Xaa locations
  Clone ID: PAT_TA_68458.pep
MWLLCNPSLLQSIKHPTTVCAKWAKNYRIRIGKVSDQTESNPSRVPTLEASMRAYADKKAGTIVHPVLGTSFDLVEEPYEFYNITHGILCFGVRCAKSRLNVHRKKCIQEIVCMCVGKPLQSNSRSTLCGFTAMMRVLXKMIRDXGWYVCKHRAEHNQTFCQLYGEI

SEQ ID NO: 174041 - protein, 103 aa, Triticum aestivum
  Clone ID: PAT_TA_68459.pep
MAWTRYHASSTHPPSIPARRRPKSGADDAPFPPWVLLDDRAYLAGESNHTTAVSRTRHGDQIQATFFLADPPLVSYFAVSCAAELGCEPRVLYTEANLVLLVS

SEQ ID NO: 174042 - protein, 60 aa, Triticum aestivum
  Clone ID: PAT_TA_68460.pep
RIIRRKCQDCNCMYTKTRGLISGTCFGSSSRCECNRRLLYEKVCYSMISEVSCHLGHKLD

SEQ ID NO: 174043 - protein, 138 aa, Triticum aestivum
  Clone ID: PAT_TA_68461.pep
SVGLIQHINIVKLIGFCCEGDHRLLVYEHMLNGSLEGHLFEKSSSPVLDWNTRYQIALGVAKGLCYLHESCHKCIIHCDIKPGNILVDASFVPKIADFGLAAFVGRDFSRVMTTFRGTAGYLAPEWLSGVAITPKIDV

SEQ ID NO: 174044 - protein, 37 aa, Triticum aestivum
  unsure (1)..(37): unsure at all Xaa locations
  Clone ID: PAT_TA_68462.pep
KLQLGVKAHANXKSQEPGINLFFPSKKTSWCLLPIIV

SEQ ID NO: 174045 - protein, 61 aa, Triticum aestivum
  Clone ID: PAT_TA_68463.pep
TNANVHSNKLVVTKLLLKVCSIMEMGILVLLLNFVQLCKRMGTRCRFLTSQNQTEGIQFWW

SEQ ID NO: 174046 - protein, 128 aa, Triticum aestivum
  Clone ID: PAT_TA_68464.pep
VAAGGRLECTMQNIADNFMNTYSYRCSKGIESELDTFIVYNERKKVTSSAKRKLKSEDRSLHQTPEGSLLDIMRNAHDLLSSCSIEVPEVKDNNEYLHSGLPFIIFLHPALGPFWDIVKQKFIGGSIS

SEQ ID NO: 174047 - protein, 69 aa, Triticum aestivum
  unsure (1)..(69): unsure at all Xaa locations
  Clone ID: PAT_TA_68465.pep
DQSKTSSIAILPIGFSSSKFISFFFAXFLPGSSSVEYIDYGRVEERNNNWCNQSSILELKQKFSSSKKK

SEQ ID NO: 174048 - protein, 134 aa, Triticum aestivum
  unsure (1)..(134): unsure at all Xaa locations
  Clone ID: PAT_TA_68466.pep
RXAMSMDEIIDECKTFFFAGHDTTSHLLTWAIFLLGTHPEWQQKLREEVLRECGSTGTPLHGDTLNKLKLTTMVLYETLRLYGAVIMIARQAMADTELGGVEIPKGTITMIPTAMMHRDEEVWGADAGEFKPDR

SEQ ID NO: 174049 - protein, 136 aa, Triticum aestivum
  unsure (1)..(136): unsure at all Xaa locations
  Clone ID: PAT_TA_68467.pep
MFGFGHHGHHGQNPPAHAPAAAGGNQPTFKIFCKADEGYCLSVRDGNVVLAPSNPRDEHQHWFKDMRFSXHPVKLVPYNANYQDESVLWTESRDVGAGFRCIRMVNNIYLNFDALHGDKEHGGVRDGTSLVLWKWC

SEQ ID NO: 174050 - protein, 112 aa, Triticum aestivum
  unsure (1)..(112): unsure at all Xaa locations
  Clone ID: PAT_TA_68468.pep
PXPNILGLRAGHHLRXXXXXKXEXAPXNXRKTGXXXXSXXPXHTRKEXXHRGXXXXGXPRGKXXXXXGATKGXGASXXGXXXXXXXMXXGXEXXXXXXXXNXNRXGXXXXKK

SEQ ID NO: 174051 - protein, 109 aa, Triticum aestivum
  unsure (1)..(109): unsure at all Xaa locations
  Clone ID: PAT_TA_68469.pep
MPVTGQECPPQEAKPVKGKSPVDKTLSGASDLLKLLPTGTVMAFQALAPSFTNHGVCHTANGYLVLALIGACALSCVLLSFTDSLVGSDGKLYYGIXTFRSFYPFNFAG

SEQ ID NO: 174052 - protein, 186 aa, Triticum aestivum
  Clone ID: PAT_TA_68470.pep
EGNLQNLSVTHMEKGMHTKQADNTSHSELLRECLDIWRRRRLRKESSAEAKKLDQTGTAGHEWSASSCSSESDDENVNASESASGNSESAAENDTELENSQKCRGATSLDGVQNRGEGRAMINTEQPLRCLSGTNYNKSSAKQGLKCNLEVLQEPHPGEIMQQKEENKLPCCLPSTVHPNGMIQTS

SEQ ID NO: 174053 - protein, 52 aa, Triticum aestivum
  unsure (1)..(52): unsure at all Xaa locations
  Clone ID: PAT_TA_68471.pep
NTRXPNGRXXPPXXNXKXHEXKGXPXEXAXKXXPEHARSQXPXXGXEKPRKG

SEQ ID NO: 174054 - protein, 156 aa, Triticum aestivum
  Clone ID: PAT_TA_68472.pep
AIPIQQKQAAFAASKLGVASSGKNKIFVGGDAQQYKIFDPSSDFILMWNRIFLFSSFLALFIDPLYFYVPKIVYGDTYSCVGTDRHLTIIITFFRSIADLLYVVHIIMKFRTAFVKTSSTLRVFGRGDLVTDPKEIAWKYLRSDFAIDVVAALPLP

SEQ ID NO: 174055 - protein, 84 aa, Triticum aestivum
  Clone ID: PAT_TA_68473.pep
CKEYIKSFLAAIPIRELQGDIKRGTVASTPLHHRLQIEFHYTEAVPAEVAPPPQALAIEAPFEFSWPEPPPAMELALAPAVAVA

SEQ ID NO: 174056 - protein, 190 aa, Triticum aestivum
  unsure (1)..(190): unsure at all Xaa locations
  Clone ID: PAT_TA_68474.pep
MRRKEAKVALGSKMKRAMEDERFTAARTDPRFRQMRRKEAKVAIDSRFTPMLTDPMFDSSLVDKRGRRRKKSAGENPILHYYLNEEAGDEKDKDKTEQEELICEEEDHALEQESPSSDDEEDGHDQYFVGCDVAHHLMSRHDDTHVIDKETHRLAXVVNMDWDHIKAVDLYMVMTSCIPEGGRVLSVSIY

SEQ ID NO: 174057 - protein, 145 aa, Triticum aestivum
  Clone ID: PAT_TA_68475.pep
HEGLLPAPPPLVFSGELCTTGPAVAGAVGGMTTASRLSYKNATVALCAINVLAVALLLRSHFSSWPRIAGGHRFDSAQLRYIWESEELRRAMEPVDLIRRVKEIEQEAYGEPGMSATQEGTAAVDLSKRLKDLRQGNDGSSQRAL

SEQ ID NO: 174058 - protein, 108 aa, Triticum aestivum
  unsure (1)..(108): unsure at all Xaa locations
  Clone ID: PAT_TA_68476.pep
AXNSARGNVVNEEGHFPAETVSSEGPLDMEIHHGGEAEDHQFTEETEMVPVEAPESGEATEEAEEIHQSSEETEMVPVDSPVPQEAAVEDLEVGFTCHADTAIEKENE

SEQ ID NO: 174059 - protein, 129 aa, Triticum aestivum
  Clone ID: PAT_TA_68477.pep
QGSLPRRSQPSPFALPRRHSSQQSRHMLIAHSRLTIIPKPTTRNFFSQSMVKQSIPTSPQCSSTMHERSLDMISDDKIAAVRATNWLARSTLANTFRVKSVTFLCRELLDQAGRSTGGEHGRSRGLGES

SEQ ID NO: 174060 - protein, 203 aa, Triticum aestivum
  Clone ID: PAT_TA_68478.pep
KEMEKLKSLIDDLNLKYIQNMNDFTKFLLLSEEELAGMPLEFLKDLEETDGKRKVLLTGYYVTPILEHCKVGSTRKQIAVAYGQKGGNQNVAILEKLVQIRHRLARLLGYSNYSDFAIEPRMPMTSRKVLEFLEEMSEQLSDLANRELTVLKELKMKEEGDAQFGMEDLLYYMKRGEQHKVDLDIGEIKRYFPVKLVISGMLK

SEQ ID NO: 174061 - protein, 165 aa, Triticum aestivum
  Clone ID: PAT_TA_68479.pep
MEPTGCGKMVKPYKLPGSIFKMLYPHQREGLKWLWVLHCRGTGGILGDDMGLGKTMQVSAFLAGLFHCRLIKRVLVVAPKTLLTHWTKELSVVGLKHKIRDYSGASVNVRNSELQYAFKEGGILLTTYDIVRNNYKLIRGDFYNGNVEGKYDKLIRGDSYNDTDE

SEQ ID NO: 174062 - protein, 212 aa, Triticum aestivum
  Clone ID: PAT_TA_68480.pep
IIILIITTTTAGGGVGLLLWRRELTHHHEIKEIVSIWLIIIQKLPKPVVSWLPGHGKVLLVGADLHKIHDRPHPAPRTLTRPRPGVGARLARLARTWRTSEEPRNPREENNTRRGKGSPRCRRPAWIRNQIWLPRNASRRRPSSPEGNLWILGSVGGRRRRTQRFCRWKRSGISAAIGGEESAWKRENLKQSSPGWRREEEEEEGRAEQAPR

SEQ ID NO: 174063 - protein, 213 aa, Triticum aestivum
  Clone ID: PAT_TA_68481.pep
RHEAPATLSAELLRLLSAAPAWTHDLARAVSSTLSAAPPPSPDVVLSVLRSLQNTSLAGPFFLLASSASSPHSLPPEAYNAVLPFLSHDLAALDKVLEEMSLLGYGLPNPACATLVSTLVRSRRLVDAFHAIGIMRRLKFRPALSAYTVLIGALAEARQPERALELLRQMQEVGYEVGVPLFTTLVRTLAREGRVEGALMLVDEVKGRCLEPD

SEQ ID NO: 174064 - protein, 208 aa, Triticum aestivum
  unsure (1)..(208): unsure at all Xaa locations
  Clone ID: PAT_TA_68482.pep
TTWEHVSQYLAQLGEAGSIEELKVRLFPLSLTGTTFSWFAALPHGSILLWSQLEQKFHDHFYSGDNELKLSHLTSVRQKHDESVTDYVKRFRDIKNRCYSLVITEKDLADLVLNGLKTHIKEKLETYEFLSINQVLQKALAQESRSKVVHMSTTDRPRMHMVEHNDDNSDDEVDVYTTEFVXSSKAKPYMCNALKPIRKNRDEEVRFT

SEQ ID NO: 174065 - protein, 187 aa, Triticum aestivum
  Clone ID: PAT_TA_68483.pep
MATQARELPPKQELPRDDGDDYEDDWESDGDDAAGGSGGLLCLFCSARFDSDGPLFAHCGSVHGFDFHKLVRELGLDFYGCIKLINFVRSKVAENKCWSCAEISQLEGKVPWAEDSYLKPFMEDDSLLHSLSIFDDEEDEDCGMPVVTGECSVGNGRSGELQGNGLNTIIDDCSDISARFEKAVTTE

SEQ ID NO: 174066 - protein, 102 aa, Triticum aestivum
  Clone ID: PAT_TA_68484.pep
MGLLGMMGDSFGCSATGERLVSAARDGDIQEARALLELNPRLARYSTFGIRNTPLHYSAAKGHHEIVSLLIESGVDINLRNCRGQTALMQACLYGHWKVVQI

SEQ ID NO: 174067 - protein, 99 aa, Triticum aestivum
  Clone ID: PAT_TA_68485.pep
ERERERERERERERERERERERSVGRAETFDFVRTGSCLTRTARRSCSGGAAAAGATPSPPTPRSRRPTPSRVCRRPSAPPRRPPRASPGACAAPCPAR

SEQ ID NO: 174068 - protein, 196 aa, Triticum aestivum
  Clone ID: PAT_TA_68486.pep
DRATFSTLVDAWCASGKLREAQAFLDDMSSRGFRPPVRGRDLLVDGLVRAGRLEEAKAFALRITKEGVLPDVATFNSLAQALCDAGDVEFAVGLLADASSRGMCPDISTYKVMLPAVAKAGRIEEAFRLFYAAIEDGHRPFPSLYAAIVKALCKAGRFADAFAFFGDMKSKGHPPNRPVYVMLVKMCVRGGRFLDA

SEQ ID NO: 174069 - protein, 180 aa, Triticum aestivum
  Clone ID: PAT_TA_68487.pep
MDRTSNFMPTPDQDVLDIQPLRTLAPMFPAPLGVNTFNVPNTTPPLIFVTSAGQFPGGVGAPGHPAFRSFAAAFGAQDAYGGQPASSGGQHDGGGHPASSRRQDGGGGQATTFADKYAANGGQTAANGATNLGASADSPIDVIPISAYRPTPPPVIPLDDDDDDNEHFTGNQTSASGRKI

SEQ ID NO: 174070 - protein, 51 aa, Triticum aestivum
  unsure (1)..(51): unsure at all Xaa locations
  Clone ID: PAT_TA_68488.pep
PFFSRTTARPPDAAAAAAXEMAXRIACXLXRRSSPTLXXLRSYTHVRNYSS

SEQ ID NO: 174071 - protein, 182 aa, Triticum aestivum
  Clone ID: PAT_TA_68489.pep
SMAATLVMVAVVLVVVVATSSMPVARGEDLEKDDASTSCPGEYSKLCGKDPTCIAMVETACRTDADSVESIKGMFAELAKVGGDSKGFAFTEWPWGHVALCAAVNEHGACPGNKTVEELAGEHCINDLSVTCLDPICHDGASRGVLPYSREILLHQGHPRRQESHRGEVEMLQGLLRAEEEG

SEQ ID NO: 174072 - protein, 82 aa, Triticum aestivum
  Clone ID: PAT_TA_68490.pep
RHEVRLRTSPSSLSLAQQHHPLPALPPDAEVSFRVSSLSSWSSDLAACGHNAAGSNQPIGARRRSSGPRRSSSSALSLSLNL

SEQ ID NO: 174073 - protein, 149 aa, Triticum aestivum
  Clone ID: PAT_TA_68491.pep
RRRKAIAWGEEEPALLHPLLSRRLVSQDAARSLTILLSPLHRPPPLPMRLCSSGDAHLLLDLRLFTPLSNSLLCSPGYPPTAGDQGNGGRGAAPQRTGRGGPFLTLERANGAAAPVFTVAAGEGGGARTAAVRPSAVLRNKDDWGWTRC

SEQ ID NO: 174074 - protein, 179 aa, Triticum aestivum
  Clone ID: PAT_TA_68492.pep
QATTASPHTVQQQQQLRQFSYSQQQLGQFSYSQQQQQFGQLPYDQQQLSSSSLAQQLQQQQLSSTGQAQQLQQQQLSTASKIQQQGQGQISSASQSQQQHESPSDSAAAADSQSSSQEVHHQQLLVGSSPETTSSVQNVPLLWTIGLNLPPHIEESNLCFMFRKIPEHVLKVGKRGTQF

SEQ ID NO: 174075 - protein, 111 aa, Triticum aestivum
  unsure (1)..(111): unsure at all Xaa locations
  Clone ID: PAT_TA_68493.pep
VWPPLPRHXTHGRPGTGVLQGHLPGQRGRIISEYLRIHGAKMDWRGATRAWYDPVAPPRAHHVGIWAHQLQPCGYSTGKNSHIYQKKPRKIKEAFRDMEKPPPPPVLPLKI

SEQ ID NO: 174076 - protein, 148 aa, Triticum aestivum
  Clone ID: PAT_TA_68494.pep
MAQTPPIPRVSLGTQGLEVSKLGFGCMGLTGSYNSPVEDDAGVAVITHAFRRGVTFFDTSDVYGPHANEILLGKVQVATKFGIQRDAQGKSTICGRPEYVRACCEASLHRLGVDHIDLYYQHRIDTTIPIEDTIGELKKLVEEGKVKY

SEQ ID NO: 174077 - protein, 128 aa, Triticum aestivum
  Clone ID: PAT_TA_68495.pep
APSRRRRRPQPSHRRCRTRHPVAADSPPPRPLPQSPLTTQQQHWQHPTNPDHHCRRATQPATTLLECLPSPPLYFARFLPRAGFLPKTMEPVVLRMRWVSAMVLVCSSDEIVSAMLLVCSSDERRTSR

SEQ ID NO: 174078 - protein, 193 aa, Triticum aestivum
  unsure (1)..(193): unsure at all Xaa locations
  Clone ID: PAT_TA_68496.pep
VEEFETQWQEMIEXYQVHHIKYFNDMWENRKKFILVYFKDKFFPFIQTTTRSEGTNSLFKKGVGAKFGATSFLKEYDRILDVVHDREEECDHVCRNKKVAQKAFWSKYNIERQAHELHNIGIFRKFQFKMADTTRMHVFEQEKDKYYIVTQAENDPMKELRKRLYLVQVGLKEEEYSCIXCCALQKEXLLCPR

SEQ ID NO: 174079 - protein, 217 aa, Triticum aestivum
  Clone ID: PAT_TA_68497.pep
RLKLFGPNKLEEKKESKLLKFLGFMWNPLSWVMEIAAIIAIALANGGGRPPDWQDFVGIVTLLFINSTISYIEEANAGDAAAALMAGLAPKTKLLRDGSWEERDAAILVPGDIISIKLGDIIPADARLLEGDALKIDQSALTGESMPVNKYAGQEVFSGSTVKQGELEAVVIATGVHTFFGKAAHLVDSTNNVGHFQQVLTAIGNFCIISIAAGMLV

SEQ ID NO: 174080 - protein, 184 aa, Triticum aestivum
  Clone ID: PAT_TA_68498.pep
MSGPRSSAAPPLDDDDLLAEILLRLPPQPSSLPRASTVCKFWRSLASDPCFSRRFRAHHRRNPPLLGCLVHDFCQVRFQPTLERPNRVPLPSFPVPIAAGGRFRILGCRHGLVLILHDSQKQLLVWDPVTGDQHSLDIPRGFAEKTWIHAAVRRAPRDFHHFQVVLVGNSDIQSTQAVASVYLS

SEQ ID NO: 174081 - protein, 104 aa, Triticum aestivum
  unsure (1)..(104): unsure at all Xaa locations
  Clone ID: PAT_TA_68499.pep
MAAAGDAGEKKMITLKSSDGEEFEVEEAVAMESQTIRHMIEDDCADNGIPLPNVNSKILSKXIEYCNKHVQAKPADXAXDAGAXTARAEDLKNWDAEXVKVDQA

SEQ ID NO: 174082 - protein, 77 aa, Triticum aestivum
  Clone ID: PAT_TA_68500.pep
KRAGAIVHTGVSELQEASMCTRQSCTGGSNEMHQERKKDEHKIWSLLTNPDDTRLIAQKCTTRGVYDGHVCLLCRLL

SEQ ID NO: 174083 - protein, 136 aa, Triticum aestivum
  unsure (1)..(136): unsure at all Xaa locations
  Clone ID: PAT_TA_68501.pep
ARTAISHPQPHPPPTPTPPSSPPSFSPWRRPHRGLLDPRRRRAGPPRSAPSPQPPSPQGGGXDGAATIELTPSTSSXGRRAPSPQPPPPPLXGRRGLTGSPPCNLPRVPLXGLPLHGAPTPPPPPWMDHLKLYMEI

SEQ ID NO: 174084 - protein, 198 aa, Triticum aestivum
  Clone ID: PAT_TA_68502.pep
MAGNMLANYVQVYVMLPLDVVSVDNKFEKGDEIRAQLKKLTEAGVDGVMIDVWWGLVEGKGPKAYDWSAYKQVFDLVHEAGLKLQAIMSFHQCGGNVGDVVNIPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYL

SEQ ID NO: 174085 - protein, 136 aa, Triticum aestivum
  Clone ID: PAT_TA_68503.pep
PSLHLIPDLKAQRFCKALVNVKLENTMDSQINSPYGSLTRQQQQQMQQLRHQQLLQQQQQKQLQQQHVLQLQQHHQQQQQQQQQLQQHHHHQQQQLQQHHHHQQQQLQQHLGMSGNQSAQAQLAQQFKQASQSMNS

SEQ ID NO: 174086 - protein, 153 aa, Triticum aestivum
  Clone ID: PAT_TA_68504.pep
MMKRSHTTVLDDLPEWIVIEEILVWLPPKDLFRCRAVCKLWRSATSTDKFMLDNCRRQPLLPVITQDIPGQEGVRFVVFRDKSVGADQKLCPIIQHSKFHNLLGACDGFLILFSESDFWICNPATRKCAILPQPRVPSSSAGVPRIYIAGFYQ

SEQ ID NO: 174087 - protein, 216 aa, Triticum aestivum
  unsure (1)..(216): unsure at all Xaa locations
  Clone ID: PAT_TA_68505.pep
LTTGXKATLLCGLLPYMQRYIYKTHRDAYINFQQNEIMKLSNLQIIVVEKLFHKYMLKGHESSSKKRFKCHCLLQGNILYATQEADSHSLFLETSRIFFDGSPDLHFANFLHMVKTMAISGTSAEQVESFVVNNQNVPALPEEEAVWSFSSSFVPEFVPDQGVDSKPVETSSACVLNIHKQHQRSDGTVSSWPPNNWRTAPDFRTSRRSQHGPLQD

SEQ ID NO: 174088 - protein, 119 aa, Triticum aestivum
  Clone ID: PAT_TA_68506.pep
TLSSPPSLGPPARLMCRTAEAAVAARVSGTGVQLLRPDTIIYKCEWWINATMAEASIPGKNTSPGSCVELLRRPSQPECPTLASSCCVQILLSIYVSGGSTRLWPKRQYPEKTPLLSCW

SEQ ID NO: 174089 - protein, 169 aa, Triticum aestivum
  Clone ID: PAT_TA_68507.pep
DGIISLEANCRGTKGSKVKYELDKKTGMIKVDRILYSSVVYPHNYGFVPRTLCEDGDPIDVLVLMQEPVIPGCFLRAKAIGLMPMIDQGEKDDKLIAVCVDDPEYRHLNDLKELSPHRLAEIRRFFEDYKKNENKEVAVNDFLPPETAQAAIKHSMDLYAEYILQSLRN

SEQ ID NO: 174090 - protein, 140 aa, Triticum aestivum
  Clone ID: PAT_TA_68508.pep
PVLQMLLHNYKRCSKCAISDQVLQMRSYASNGIIGIFSTSHLKVTLSISGWTNGTKPIAPHYTIKLCNSCTCGIYIYFSLLRPSTCSYAVMPELSCFYDISSSLCCNLMPGKSFYRRFSFRAHSVWRKFWRIPMGFSSYV

SEQ ID NO: 174091 - protein, 124 aa, Triticum aestivum
  Clone ID: PAT_TA_68509.pep
LGMTRRPTAPAGPPSSRGIPSSRANAAASPTAAAGACGPASRSCMRVNMVFKLQYEQTILQYRFIQDLLESLRELSYQCVVVTACISSGARRATRVGPSCWDVLAWLVLCRCRPSGAGGPDECM

SEQ ID NO: 174092 - protein, 177 aa, Triticum aestivum
  unsure (1)..(177): unsure at all Xaa locations
  Clone ID: PAT_TA_68510.pep
SATRAAADPSRHVFHVVTAPMYLPAFRVWFARRPPPLGVHVQLIAYSDFPFLNASSSPVFRQIEAGKRDVTLVDYLRFYLPDMFPALQRVVLLEDDVVVQKDLAALWHVDLDGKVNGAVEMCFGGFRRYRKYLNFTQAIVRDRFSPSACAWEYGVNVFXLEAWRRDGCTELFHQYRS

SEQ ID NO: 174093 - protein, 167 aa, Triticum aestivum
  Clone ID: PAT_TA_68511.pep
EGEPHASGEYSFAVAQANERLEDQGQVVTSQASTFVGVYDGHGGPEASRFLSSRLFPNLHKFASEQGGMSIDAIKKAFHATEEEFLHLVKGTWLKRPKIASVGSCCLVGAIANNKLYVANLGDSRAVLGHRGPNGRGVVAERLSNDHNVADEAVRKELIQQHPDDSQ

SEQ ID NO: 174094 - protein, 89 aa, Triticum aestivum; identical to SEQ ID NO: 173274
  unsure (1)..(89): unsure at all Xaa locations
  Clone ID: PAT_TA_68512.pep

SEQ ID NO: 174095 - protein, 90 aa, Triticum aestivum
  unsure (1)..(90): unsure at all Xaa locations
  Clone ID: PAT_TA_68513.pep
KKXGGGGGVXAPAIGSRRSEIGALSSSGRRTPSLPPSSRHEHPKPPGPEAASRFNRIDTPPSASRKITDRNRQRRPLRSPTHPLEMKAFV

SEQ ID NO: 174096 - protein, 128 aa, Triticum aestivum
  Clone ID: PAT_TA_68514.pep
MELCTASVSISPHRPSLSTSSRQVPYTRYTGSRSCISRRTKRFSLYVINAASTNAPLSSRTLPTQTNGAAAKGMPSKKPNSALEQLDIERGVCVPFRKYSPEMVRSKVLGSSGSVLSLASRGVEIIWK

SEQ ID NO: 174097 - protein, 166 aa, Triticum aestivum
  Clone ID: PAT_TA_68515.pep
GQLEAANGKLVKELAEAKASAKQAAQSYEMERKAREMMEDACEELTKEVEEDQAEVELLRRECLGMREEMEEERRMLQMAEVWREERVQMKLSDAKLALEHKYSQLNRLQAEMESFLRKDGKSIDANNSTLREARMISEAASSVRLRGVILVLRLVPATVQWRERA

SEQ ID NO: 174098 - protein, 169 aa, Triticum aestivum
  Clone ID: PAT_TA_68516.pep
KETTCSYYKARTRKKATSPCRATLLLQPPPPLGRKSARTAAAAALSTSEDEHPGGSLPFPPPGPQIQIQIKTSHLASEPKKRQRLLRRPCSSQPPSHWGPKRARTTQPRCRPALPDNNWRDWANLDDGPLGLIAELVLAYDVADYLRFRAVCCPWRRCSVDPRAHGGLD

SEQ ID NO: 174099 - protein, 172 aa, Triticum aestivum
  Clone ID: PAT_TA_68517.pep
SANVKHGSNNCPVCRTEWKELPFRGPLVAAIPQGSARINPVNGQQNGGHMTLLRPLPRARSSGRLHHVTCLLPDTDRSVFNDDEPLDLCEATDDHQQGCSRTVEITTHPEFTEIPESTSERSFTVLIHLKAPLAQNLHVPGDDSSPNTGRAPVDLITVLDVSGSMAGTKLAL

SEQ ID NO: 174100 - protein, 114 aa, Triticum aestivum
  Clone ID: PAT_TA_68518.pep
GLRASSAHHLFDGMPHTSRAEKSSKSCNEDRISALPDDVLHHVLGFLRADEAVHTSLLAKRWRYLWKSMRRLRINEMGRWGTSTGGVFLTKFVSCLLLLRDPGSTLDEVEIKYD

SEQ ID NO: 174101 - protein, 73 aa, Triticum aestivum
  Clone ID: PAT_TA_68519.pep
FKHLRVFHCPLVQEINLNYGLTTLEYKYEGPSIPIAPPVTLTNLSIESSDVCSALAYISTELPSTVRRLEMLS

SEQ ID NO: 174102 - protein, 138 aa, Triticum aestivum
  Clone ID: PAT_TA_68520.pep
MPSGGAGVLLLALLSAAAAVANAAVSYDHRAVVINGQRRILMSGSIHYPRSTPEMWPDLIQKAKDGGLDVIQTYVFWNGHEPARGQYYFADRYDLVRFVKLAKQAGLYVHLRIGPYVCAEWNFGGFPVWLKYVPGISF

SEQ ID NO: 174103 - protein, 189 aa, Triticum aestivum
  Clone ID: PAT_TA_68521.pep
NGDLLDFVYIDEVQDLTMTQIALLKYVCRNFKEGFLFAGDTAQTIARGIDFRFEDIRSLFYTAFLSETEAFNQGRQHGKQVKLSDMFQLTQNFRTHCGILYMAQSIMSLLYFFFPSSVDKLNPETGLVYGEAPVLLESDNDENAIMTIFGEIKSKHGSMHGFGAEQVILVRDDATKKQIVDLVGKQALV

SEQ ID NO: 174104 - protein, 118 aa, Triticum aestivum
  unsure (1)..(118): unsure at all Xaa locations
  Clone ID: PAT_TA_68522.pep
KMFHMMIYMYKKAGDYTQARKLFAQMPERGXPQSTVTFNSLMSFEADYKEVSSIYDQMQRAGLKPDVXSYSLLIKAYGKARREDEALAXFEEMLDAGIRPTRKSYNILXDAFAVSGLV

SEQ ID NO: 174105 - protein, 66 aa, Triticum aestivum
  Clone ID: PAT_TA_68523.pep
RARGDWWLGFTVRTPRSMRIPSFRTQRTRETHRKTGPVRKGGPPVIHLCRRAQCADKRVAGFFTAP

SEQ ID NO: 174106 - protein, 172 aa, Triticum aestivum
  Clone ID: PAT_TA_68524.pep
MDSPQIPDDLFPEIFLRVPDPADLVRISAACASFRSLVACRSFLRRYRKRHAQPLVGFFDNQRVFHPAEPPYPSASAAKAVALAADFSFPFLRAPASAWHIFQIRDGRVLLGRDPYDFEELVVCDPLHRRHLLLPRIPALDEWLPSATTGGIGWQIFLLGGGDDDDEEAAEE

SEQ ID NO: 174107 - protein, 187 aa, Triticum aestivum
  unsure (1)..(187): unsure at all Xaa locations
  Clone ID: PAT_TA_68525.pep
XIISGQXIPEGYILMQNKMTAKKNVTPSEGSSTNQKVYDEYCPILLTQCNSREYDKFXTFDDALDEFYSKIESQRVNQQHKAKEDSAVHRLNKIKLDQENRVHTLRKEADHCITMAELIEYNLEDVDAAIKAVRVSLANGMSWEALARMIKDEKKAGNPVAGLIDKLSFEKNCITLLLSNNLDDMDE

SEQ ID NO: 174108 - protein, 101 aa, Triticum aestivum
  Clone ID: PAT_TA_68526.pep
PPCSATTTCKDYQLLGFLLTSPETFEEGHHVLMLQPFRPFRFGAIINRTTAAMSEHPCLATSSSATTGKDDPLLGFFLHYWWSPNGHRHSPSALVETPIGW

SEQ ID NO: 174109 - protein, 103 aa, Triticum aestivum
  Clone ID: PAT_TA_68527.pep
MPRSSLISHKQREQSNTLFAHSWRNNSSLDDIGPRCEPSSHPFGLCKTRAAAFGYPCEDHMVTTEDGYILSLKRIPHGVSNSTKNTTRIPVLLFHGLMVDSVS

SEQ ID NO: 174110 - protein, 215 aa, Triticum aestivum
  Clone ID: PAT_TA_68528.pep
FGTRQSWEKTVDCYSPGQGLMPASFKIRTIPLDENNEAFEEILDPDFGESAIGRVAPVDSGLWWIILLRAYCKITGDYSLQERVDVQTGIKLILSLCLSDGFDMFPTLLVTDGSCMIDRRMGIHGHPLEIQALFYSALRCSREMIVMNEGSKHLLRAINNRLSALSFHIREYYWVDMNKINEIYRYKTEEYSHDATNKFNIYPEQIPSWLVDWIP

SEQ ID NO: 174111 - protein, 161 aa, Triticum aestivum
  Clone ID: PAT_TA_68529.pep
VRRRTGSEEMAVTMASVSTGVMNSLLGKLATLMGDEYRKIKGVRNKVASLLDEFSSMSALLVKLAGMDELDVQAREWRDQVREMSYDIEDCVDDFMRDLGQKCATTGFLKKTAERLKKLRVRHQMANMIHRIETRVSEVHDRRTRYKIDEYAPSSGIVAVD

SEQ ID NO: 174112 - protein, 230 aa, Triticum aestivum
  unsure (1)..(230): unsure at all Xaa locations
  Clone ID: PAT_TA_68530.pep
EEIVCGCSGKPEAENSRSCRCECPALIRLLRAADNSWYITEHRENHNHSMSLTMGEKVHRPSHKHIDVYTKDLIKQLRKNNVNLGKVYSIIGCFFGSVEKVPFTKRTLRNICGKISQEQADDDVRKTLEVFADIXSGDPGFTYRVVADDTSKVKNLMWANGSSRMQYRFFGDVVTFDTTYSTNLYDMPFGLLVGVNNHFQSIILAGVLMCDEQQESFEWVFAEFLRMMGG

SEQ ID NO: 174113 - protein, 214 aa, Triticum aestivum
  Clone ID: PAT_TA_68531.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENVNSQPFMRW

SEQ ID NO: 174114 - protein, 194 aa, Triticum aestivum; identical to SEQ ID NO: 173921
  Clone ID: PAT_TA_68532.pep

SEQ ID NO: 174115 - protein, 107 aa, Triticum aestivum
  Clone ID: PAT_TA_68533.pep
MASCFPCLSARKKEVPRSAPANPHTSSVPGTVARTFSFEELAAATRNFSDACRIVGREDGLYKGFLKSINQVVAIKLQHAVDPSGSSEQDNGEFLALALMMSGLRHP

SEQ ID NO: 174116 - protein, 210 aa, Triticum aestivum
  Clone ID: PAT_TA_68534.pep
RLRQTLAFVVPVVEMLRRLPSPPKPHQVLAIIISPTRELSSQIYNVAQPFFATLKGVSSILLVGGLDIQVELKKVEEEGANILVGTPGKLFDIMERLDTLEYKHLEILILDEADRLLDMGFQKQVTSIISKLPKLRRTGLFSATQTEAVEELAKAGLRNPVRVQVKTEAKDGAQQDLGPSKTPLGLRLEYMICEPAKKSSQLVDFLVQNT

SEQ ID NO: 174117 - protein, 138 aa, Triticum aestivum
  unsure (1)..(138): unsure at all Xaa locations
  Clone ID: PAT_TA_68535.pep
EMGRGIEAWLARTIRKXDNHLLGVCQTFSEESYLTVIDAFALMGDIGGMAEKMQSFFLQEVLSRTHIDLKEMLEEEVGNNTXRNRFTYSDLCVQVPESKLRPCLLKTLESIFSLMRSYYAIMSFCPEAKNNTSQSASG

SEQ ID NO: 174118 - protein, 153 aa, Triticum aestivum
  unsure (1)..(153): unsure at all Xaa locations
  Clone ID: PAT_TA_68536.pep
MLIFVKTLTGKTFTLEVESSDTIDNVKAKIXDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 174119 - protein, 36 aa, Triticum aestivum
  Clone ID: PAT_TA_68537.pep
FFLLWFYSYRAALHPLSGLHTAVSHDITGNNYSTKH

SEQ ID NO: 174120 - protein, 84 aa, Triticum aestivum
  unsure (1)..(84): unsure at all Xaa locations
  Clone ID: PAT_TA_68538.pep
RRSCFGAEATTASSSRXRLHGTLLLCYPSLTRQGSGAAGFLERRGGPGSSAGSRRRKEHAGGYFWRSVVDLLFFACSHECFFRR

SEQ ID NO: 174121 - protein, 151 aa, Triticum aestivum
  Clone ID: PAT_TA_68539.pep
SFLLLSFLSRLLNYQVCQVSNGKWIDGLQFSSLFWPPPHDVQQKQAQILAYVEYFGQFTSDSEQFPEDVAQLIQSCYPSKEKRLVDEVLATFVLHHPEHGHAVVHPILSRIIDGTLSYDSHGSPFNSFISLFTQSSEKEYSEQWALACGEI

SEQ ID NO: 174122 - protein, 175 aa, Triticum aestivum
  unsure (1)..(175): unsure at all Xaa locations
  Clone ID: PAT_TA_68540.pep
EEFXQSCRVARCFVDRGVGCDCGFSVGVLGLALMQVKGAQFTKEAGSRSNVIIQVRSLIDAMRANPVASKGPVKAANPSAPTASECPYCFNGTATLVNCVSDCTPAASANSDLYNWVDRLNKAAPRSMGTGPKATVTWEPTLGMYAITATWSGGAMDGGASKVSDNVSYTLNYLP

SEQ ID NO: 174123 - protein, 292 aa, Triticum aestivum
  unsure (1)..(292): unsure at all Xaa locations
  Clone ID: PAT_TA_68541.pep
ARRILLPRRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTVTLEVESSXDTIDNVKAKIQDKEGIPXRDQQRLIFAGKQLEDGRTLADYNIQKESTLHLVXRLRGGMQIFXKTLTGXTITLEVESXXXTIDNXKAQXQDXEGIPXDQQGLIFAGKQX

SEQ ID NO: 174124 - protein, 42 aa, Triticum aestivum
  Clone ID: PAT_TA_68542.pep
CIRSCIKRLVFHDFRGDRSEIAFLKFFFEGALVLKEVVLVLA

SEQ ID NO: 174125 - protein, 80 aa, Triticum aestivum
  unsure (1)..(80): unsure at all Xaa locations
  Clone ID: PAT_TA_68543.pep
NPNTVTDRGLFSSSKDDAADKKKKQEEKTEEEEGGGXFIDKVKDFIHDIGEKIEEAVGFGKPSADVARXHVPHIGLHRAD

SEQ ID NO: 174126 - protein, 103 aa, Triticum aestivum
  Clone ID: PAT_TA_68544.pep
TVFISHLPLRLPLLFPLPFSLLSFSLSLICSLSLASKVQAHGAGSNRAPQLSPFAHRSPPLPETLTAAPHAPSHLPPCPSLSLSSARGPPPSPFTCRLVPLQS

SEQ ID NO: 174127 - protein, 177 aa, Triticum aestivum
  Clone ID: PAT_TA_68545.pep
MTKTMPRDSSASGALVPSDSAAMAAAATAATTAAAGKLPFPLLTRTNYAAWAMRMKYLLRANGAWGAVDREASSEVDKGKEEMAMTIISQSIDDSTLLRVAEKETAADVWAALRSMHVGVERVREARVQSLRSEFDGLKMGDAESVDDFAARFTTLVGRIRELGDAMEEKYVVKKLL

SEQ ID NO: 174128 - protein, 96 aa, Triticum aestivum
  Clone ID: PAT_TA_68546.pep
MASANTGGFRLVRCPKCLNILPEPANVSVYQCGGCNTTLRAKIRVSDAQNVATKQVRQDSGDYSVVPSVSNGVSTKQVRQDSGNYSVVTSVSNGVS

SEQ ID NO: 174129 - protein, 214 aa, Triticum aestivum; identical to SEQ ID NO: 174113
  Clone ID: PAT_TA_68547.pep

SEQ ID NO: 174130 - protein, 70 aa, Triticum aestivum
  unsure (1)..(70): unsure at all Xaa locations
  Clone ID: PAT_TA_68548.pep
GHATCHFLAIDIFNGKKXEDIXPSSXHNCDXPHVDRQDYQLXIDITDDGYVSLLTESGNTKDDLKLPTDD

SEQ ID NO: 174131 - protein, 70 aa, Triticum aestivum
  Clone ID: PAT_TA_68549.pep
LGMTQQMEKINPEKHTKIFLELLVLLEESKLKQENQKMRKKYLHMKAPNKQEEESRNIFGFSFNTTTNLN

SEQ ID NO: 174132 - protein, 170 aa, Triticum aestivum
  Clone ID: PAT_TA_68550.pep
MALLPLLGSPSFPFPASRPARPSRRKCGPAARMNFRCSAEERAPVRNSGISKHVLSCLAASLLFISPPSQAVPADTFARPSLCQVAVVAAIDKGAVPLKFDAPSDDAMMMMTKGMTAKNFDPVRYSGRWFEVASRKGGFAGQGQEDCHCTQGVYTFDEKAGAIKVETFCV

SEQ ID NO: 174133 - protein, 142 aa, Triticum aestivum
  Clone ID: PAT_TA_68551.pep
TLVHGGSPRCNGVSRGGATMGGESRGGATVDLQRRLSVLSCSARCCNVASSALPVLPCKWLVLQWSFTDDCRCYDAALAGDPELRCSAQCCNGARFPAASSAPMERCRAGVGAAMKTLWSAVGGALLRCRRGGGVWLLLRAG

SEQ ID NO: 174134 - protein, 129 aa, Triticum aestivum
  Clone ID: PAT_TA_68552.pep
TSSSSPPVTATAAASIGSSRRPLMLGASTTSRPSPSHCTSNKTSSTPFRAMACARSPVRHACKASSLEAACSRLCTSTVHLPCSSCETYRNPRPRPPTRVSSPRAQSFTPCTSSPVAAAATQAYACRWW

SEQ ID NO: 174135 - protein, 32 aa, Triticum aestivum
  unsure (1)..(32): unsure at all Xaa locations
  Clone ID: PAT_TA_68553.pep
IAVVFQCLVCEGSRXQHPLYLGAGSXVCLPGT

SEQ ID NO: 174136 - protein, 212 aa, Triticum aestivum
  unsure (1)..(212): unsure at all Xaa locations
  Clone ID: PAT_TA_68554.pep
RNSARGPIPYRDSXLTRILQSSLGGNARTAIICTMSPAHCHVEQSRNTLLFANCAKNVVTNAQVNVVMSDKALVKHLQRELTRLENELKFPGSASCPTHAEVLKEKDEQIKKLEEQLKELMEEKDTVQSELENFRKVASDDHLNCLKARRWDAHSRSSESLPRNMSEDALSCSDTYDLVDQDLLIDAQPGLFPRRPSNHVFDSIDECQENLV

SEQ ID NO: 174137 - protein, 192 aa, Triticum aestivum
  Clone ID: PAT_TA_68555.pep
LGICTESDYEAFDSSQDHYIMAFEVALMRYLRLDEDLIADYMFIKMNLGSKLGNLAIMRFTGEASTFLFNTLANMLFTSLRYDLNFSESICFAGDDMCANTELRKSMRFESFLKKLRLKAKVEMTSKPTFCGWNLCPDGIYKKPQLVADRFNFAKEKGILKDCIDNYAIEVSFAYRLKDQLHLYMDEDEMTN

SEQ ID NO: 174138 - protein, 117 aa, Triticum aestivum
  Clone ID: PAT_TA_68556.pep
MNLHNTCQQEQLSGSNSARLQTFWTICPACDTKYQYHHASAQKTVRCQNCSKAFIAHVLTDQHVPTGPEQSVWKNAGVFSEIRLLQKFKPGQIWALYSDIDKYPNCYAFIEKVELEN

SEQ ID NO: 174139 - protein, 183 aa, Triticum aestivum
  Clone ID: PAT_TA_68557.pep
MGSRGGRTMNRDKRYDSFKTFSGKLERQITHLAGGGVPVSTPEEEEFAQGQGEAVSGDNVDRFFAALEGPELDKLKSSEELALPADKKWPFLLRFPISAFGMCLGVSSQAILYKTIATAAPTEFLHVNPKVNLVLWFISVGLMSIITAAYAFKIIFFFEAVRREYYHPIRVNFFFAPWIACLF

SEQ ID NO: 174140 - protein, 154 aa, Triticum aestivum
  Clone ID: PAT_TA_68558.pep
VRCDIGASTVLVVAVVAAVCVVSFKGNGGDKGDGELTTSVKSVKAFCQPMDYKETCEAELTKVGGNATSPTELAKAIFEVTSEKIRKAISESATLEELKSDPRTSGALENCKELLEYAIEDLKTTFDRLGGFEMTDFNKAAADLKTWLSAALTY

SEQ ID NO: 174141 - protein, 208 aa, Triticum aestivum
  unsure (1)..(208): unsure at all Xaa locations
  Clone ID: PAT_TA_68559.pep
MAASVETRRRSHPPPTMNNNQRSHRIHHPTVWGDFFLXFRPFTPTQCLSMKNKAEVMKEELRATIVDSGSADLPRKLELVDTLQQLGLDYHYGKEINDLLCGIHDTGDEDRDLHTAALGFYLLRKQGFNVSPDVFLKFIDAEGKITCNDTRSLLGMYNAAHVRTHGEETLSSVIAYTKDHLLRVVEQQTISPPILLEEVRRTLETPLF

SEQ ID NO: 174142 - protein, 114 aa, Triticum aestivum
  Clone ID: PAT_TA_68560.pep
RRASTAWNSDLPAPFLIPAPHPPLLHAHHKDHATLLSYGGDLRLIQTHGARQQRIQKIATPKLTWLRVEDVRALGKGGHGNTSALPFVVAGHDDLDKLVAVAVAVREARLHTSS

SEQ ID NO: 174143 - protein, 105 aa, Triticum aestivum
  unsure (1)..(105): unsure at all Xaa locations
  Clone ID: PAT_TA_68561.pep
RGGRGGRAAVVSTLRRRHRCPHLPPPSPVLASSSAVAVAVAVSSAAPPPPFLVCLPAPWPSRSPPWLHLRSSSCSPSPSLPQREREREREREREREREREREREX

SEQ ID NO: 174144 - protein, 34 aa, Triticum aestivum
  unsure (1)..(34): unsure at all Xaa locations
  Clone ID: PAT_TA_68562.pep
SYKKAGREQADGTFYINXQQTDVGSASASSNPLT

SEQ ID NO: 174145 - protein, 182 aa, Triticum aestivum
  Clone ID: PAT_TA_68563.pep
ANSARGGNALQACVSTDLGVTASQCAVDERKKILNKYLSKRQSRPASGRPAKIISRQALAERRKRGDGGRFLASDGPLPLERRSKRLEKQNLQNEKKPESKEDEIVEAEQDPETEVVAGPGGEPKVGMVFLNEDKAYEFYVSYAGTAGFNVRKGCSEKTANNVTKSRAYVCSKEGFRPKSFT

SEQ ID NO: 174146 - protein, 151 aa, Triticum aestivum
  unsure (1)..(151): unsure at all Xaa locations
  Clone ID: PAT_TA_68564.pep
IFLATSVTRPRADVAYCIYALSRRLSKTKNWTVGVLPPCLLLHGLMREGDPTFKEEFLAHSHKRNLLHMARFKDDSSPLAWDCSAWVRTYXLFLEERLECFRNLKYDIETERPMRSPQHSAMAHSRTRTLPCLDLMEHLPSLQQLLFRLMG

SEQ ID NO: 174147 - protein, 96 aa, Triticum aestivum; identical to SEQ ID NO: 117442
  unsure (1)..(96): unsure at all Xaa locations
  Clone ID: PAT_TA_68565.pep

SEQ ID NO: 174148 - protein, 155 aa, Triticum aestivum
  Clone ID: PAT_TA_68566.pep
MPVISPLPFSLLPAPAAPAASRARWNSFPHHRLLRGMCSNGFDSTNCLRMEEVEPNLSPFLHKLFKEWDDCKARGLFHHNITTCETKVLPGEHNFVATLIEGRDQKKRPTEFGMNQVLQPFHSDKFNFTKVKPEEVIFRFQETENDSAQYFDGAP

SEQ ID NO: 174149 - protein, 153 aa, Triticum aestivum
  Clone ID: PAT_TA_68567.pep
TPSSFLISSSSKEERRRCSSKIGKKQGYHLWPDRRKKLLALFLLLHSLEVLLFSTTWPSSSSSTPLPKTKNPNSRNSENHGGEGKKTRREVLPERGHPTHYRLLLRRIIARYSKRERGNSRRLRVIPPAPALPPPPQSEQGPGERNAIDENPR

SEQ ID NO: 174150 - protein, 125 aa, Triticum aestivum
  Clone ID: PAT_TA_68568.pep
MKGAQDRKQKKKQELQVLAPFPGCLGRVINMFDLSNGVVATKMLTDKAHRDVSPAGKDRSGGLKMAGNQFPSHMEDKHRDSQQRRSSPTKRSNSPTNRSGVSPVKMLMEQDMWREGAPDDEPLNV

SEQ ID NO: 174151 - protein, 182 aa, Triticum aestivum
  Clone ID: PAT_TA_68569.pep
RHEAELMQLFGLIYNFIRKYVLRMKEDTEFVPSFPYHTEVPKVLLFGLLGFTCSVLAPLILPFLLVYFFLGYVVYRNQLLNVYRTRYDTGGLYWPIIHNTVIFSLVLTQIICLGIFGLKVSPVAAGFTIPLIIFTLLFNQYCRTRLLPLFSTFPAQNLIDMDREDEVSGRMEHIHHGLHTAY

SEQ ID NO: 174152 - protein, 103 aa, Triticum aestivum; identical to SEQ ID NO: 107316
  Clone ID: PAT_TA_68570.pep

SEQ ID NO: 174153 - protein, 135 aa, Triticum aestivum
  Clone ID: PAT_TA_68571.pep
MSFTSTDEGNSGDSSDSLPPPPPPKKAKVKNDDRLLCTMTRVLDRLAEAIEKCSRRDTDVPDDLWANMKSLPGFEQEHLAHYYAYLCENAHVARAFDKLSVPHKTIWVNRYIKNHLSALVPTMVGLGYGNTYSLR

SEQ ID NO: 174154 - protein, 100 aa, Triticum aestivum
  unsure (1)..(100): unsure at all Xaa locations
  Clone ID: PAT_TA_68572.pep
AAVKRLDQAIQVGAQRNMSYTLGISTXMVDLESAGSRKLESKVDRKKLEXAERKIAAKQNKKMFKTVEYEASRLINQPDDAESYEEXYMAVNPLQLGSNS

SEQ ID NO: 174155 - protein, 178 aa, Triticum aestivum
  Clone ID: PAT_TA_68573.pep
MERVEVDADFVVAGNWKLHGELCKKLYTVVHEVSIAIPALESTKPGSNSGLLALSSLRIAVDKAKNLLQYCSECSKLYLALTAECVLTKFEKARCALLESLHQLEETLPEAINSQIPEIANELENSVFALDQAEKQVGDQVKQIIQNEKKSNGFLDDNELEFFRQTILRAGITSSAAA

SEQ ID NO: 174156 - protein, 160 aa, Triticum aestivum
  Clone ID: PAT_TA_68574.pep
MFMAQEEPGLALGLSLGSGAGHHHHQLPQPKEAVPLEPYLSLSLAGAGAVKREEEERALIYCSAASSAADDLVEGYNSSGGGSRKKLRLTKDQTALLEDHFKEQSTLSHKQKASLARQLNLRPRQVEVWFQNRRARTKLKQTEVDCKLLKRCCETLTEEN

SEQ ID NO: 174157 - protein, 221 aa, Triticum aestivum
  unsure (1)..(221): unsure at all Xaa locations
  Clone ID: PAT_TA_68575.pep
GTRAAATPVSYXSRELMQLIHEHLVGSGLAATAAMLQKEADLAPLPSTAAVLPVHQPAALEPSSVQVQQQWPSGRVQGFLSDKTMIAADQAGQRSDSVVPSSKKKALVFSSSFSKRNQPFVSFSGNRASNSLKSPVPAGNVDGMTCSASAANTGDVETSHKTPMPLPLKRKLADMEFSSASAAKRPAIMDQASQSPVFQTPAPTRRGLSVAVDSPTAAFHP

SEQ ID NO: 174158 - protein, 38 aa, Triticum aestivum
  unsure (1)..(38): unsure at all Xaa locations
  Clone ID: PAT_TA_68576.pep
FFFEKHFSFPLLMATRRYHHIRHTTSTMTRTTQAQXXN

SEQ ID NO: 174159 - protein, 90 aa, Triticum aestivum; identical to SEQ ID NO: 173870
  unsure (1)..(90): unsure at all Xaa locations
  Clone ID: PAT_TA_68577.pep

SEQ ID NO: 174160 - protein, 214 aa, Triticum aestivum
  Clone ID: PAT_TA_68578.pep
EVALERGIPSTLGVLGTRRLPYPSRSFELAHCSRCRIDWLQRDGILLLEVDRVLRPGGYFVYSSPEAYAHHDPANRKIWKQMSNLAQRMCWRIASKEGQTVIWVKPLTNGCYMRREPRALPPMCAHDDDPDAAWNVLMKACITPYSKRVNKAKGAELLPWPQRLTAPPPRLEEIGISSKNFSEDNEIWNSRVAQYWKLMKSEIQKYSFRNVMDM

SEQ ID NO: 174161 - protein, 42 aa, Triticum aestivum
  unsure (1)..(42): unsure at all Xaa locations
  Clone ID: PAT_TA_68579.pep
FFSRMAXAPTXXSTXPXPWPKPXRLAGHXXLXRPHGXVRLPX

SEQ ID NO: 174162 - protein, 190 aa, Triticum aestivum
  unsure (1)..(190): unsure at all Xaa locations
  Clone ID: PAT_TA_68580.pep
SARGQDAXEVFHRQPRRNVQMDVGCFNNIIGKLCEKGMLAEAEKLFEEMESKSVLPDVYTYTFLVDLCFKEGRVDDTIQYFYKMADGREHGPKFNIGFFNRMFEGLSQAGRIDDALKVYGRMSDKEIKPNTTTFEILVNALCKEGELDRALDLVRDMARSGVVATPEFREXVGEIFKNADRHEEIEKAFE

SEQ ID NO: 174163 - protein, 49 aa, Triticum aestivum
  Clone ID: PAT_TA_68581.pep
RSSEHMTSHHGYVTRSASSGVATKLHRPDIRPKPGYPEATEQWKTRTNG

SEQ ID NO: 174164 - protein, 150 aa, Triticum aestivum
  Clone ID: PAT_TA_68582.pep
RRPRAGYGSYDFWKNEGGGKGGGPAPRVEDFSFKNRPAQPPTSPQASSPSFSPKQQASAPVEVAEDPPTRLIGNFLRKQKAAGAELSLDLDLEMDDIGRSSHPSLSNSRERETPRVSFKNRQSSSSSSSDSDTAGGRRRAGDDGIRNTST

SEQ ID NO: 174165 - protein, 168 aa, Triticum aestivum
  unsure (1)..(168): unsure at all Xaa locations
  Clone ID: PAT_TA_68583.pep
KTVPHRIIKEDARHVCFSERFRGIFNKASEQALLTSAQVAIVGLMPGGKAFSFGDSSIDVVVNHFRVGDGAADNNWLQTLRRQHGEVRTELAERKKRMKSADEALLQEHAVGTTRQRXVELDVSNMGYEDMAVFATVLIQEQAAGRTNQVLMEVFHVHISRNLQVPPP

SEQ ID NO: 174166 - protein, 40 aa, Triticum aestivum
  unsure (1)..(40): unsure at all Xaa locations
  Clone ID: PAT_TA_68584.pep
XXXXXXXXVXGXXXXEPXLLLVXDLAXPGDXLAQLGELLV

SEQ ID NO: 174167 - protein, 195 aa, Triticum aestivum
  unsure (1)..(195): unsure at all Xaa locations
  Clone ID: PAT_TA_68585.pep
ILLLLGQSPXIAGAAAEFAYGLIPQIFAYAANFPIQKFLQAQSIVAPSAYILTASMALHVAMSWVAVYRLGLGLLGASLTLSLTWWVLVAGQFAYIVLSPRCRETWTGFTWAAFADLAGFAKLSAASAVMLALEVWYFQVLILLAGMLPDPQIALDSLTVCTSIQSWVFMISVGFNAAASVRVGNELGAGNPRSA

SEQ ID NO: 174168 - protein, 44 aa, Triticum aestivum
  unsure (1)..(44): unsure at all Xaa locations
  Clone ID: PAT_TA_68586.pep
VVRMQLAAHYVHKQSXSLSGPSVAISPEDGCSLEFFPKRXNKSV

SEQ ID NO: 174169 - protein, 41 aa, Triticum aestivum
  Clone ID: PAT_TA_68587.pep
RGVHSHAASLRSNISRSYPERVIQNFRGQPTLHSNTPAANT

SEQ ID NO: 174170 - protein, 148 aa, Triticum aestivum
  Clone ID: PAT_TA_68588.pep
SCSSSRRRPYRSGLREAAAVHDRRGQRAHALRIKLEAVGWVMVRFLRRHSLDKSNSHTHLRKEEEESNSCIESDTAEMQEPGGNGGGGCSPAAQRPDGASLPSRTRRAALRFGRDEGEIREAAAWRGHVRDRERRAVGSSAVQRHHQP

SEQ ID NO: 174171 - protein, 42 aa, Triticum aestivum
  Clone ID: PAT_TA_68589.pep
RRLHRHCPPRSNFYTSESARISSRRSRFDPRRASDLTNESST

SEQ ID NO: 174172 - protein, 111 aa, Triticum aestivum
  Clone ID: PAT_TA_68590.pep
AYFYLLNETDKFSLVDLCDDQNMDTLAQHKKLGILAPTSNQDNGVLLVLTAIPNPSEGKTAILNKLYGLLFLLFSLTSIHVFCSTLGIYNSNSTDEYVVVLALLHSKLSML

SEQ ID NO: 174173 - protein, 160 aa, Triticum aestivum
  Clone ID: PAT_TA_68591.pep
MCNFCSIVCWINYCPTNIWMVGPCLSSRTYNKAIREVQKPLEDITDSLKVSGVRALDSVERNVRQASRALTNGRSLILSGLAESKRANGEKTLDKLAVGLEELQRIIEDRNRNAVAPKQKELLNYVGTVEEDMVDGFPYEVPEEYNNMPLLKGRATVDMT

SEQ ID NO: 174174 - protein, 116 aa, Triticum aestivum
  unsure (1)..(116): unsure at all Xaa locations
  Clone ID: PAT_TA_68592.pep
RGAAGLLLXLCRPSPLPFAALLYPPAPNLLWHYPQPPAAVPRSIQAPPRGGRSSSPAIRRPPPLPSLLIFFFFSGQPSPSSNPAEFAGGRTSAVRMCYTRGKHRKEDVSMQHNPKV

SEQ ID NO: 174175 - protein, 209 aa, Triticum aestivum
  unsure (1)..(209): unsure at all Xaa locations
  Clone ID: PAT_TA_68593.pep
SGATAPTHVEDRRREGMDLSLLVVGGEAYCGQIRSMERQLSGGGQIEELQNTVHPLLEFLTDREKGVDAAQFNEVVGRAHGNGRGTRPGGGPAGLRGQARSVGPLGGMPQVAEAVGRAIRVGSEARLLAGSGAGRRLGRDGQIRPTAEEHPWRHPWRLWVPRADKGCCLGSGQQPWRRALQESGVHRPCNACRRGRASLGXSXWRSXRA

SEQ ID NO: 174176 - protein, 74 aa, Triticum aestivum
  unsure (1)..(74): unsure at all Xaa locations
  Clone ID: PAT_TA_68594.pep
LCSXXPAQRRFDTRQRKXRSLDXVILLMISASSGSGRSSIEYRSCTTWATSRLCRRSGSEEPTSPGRSAPAGEG

SEQ ID NO: 174177 - protein, 172 aa, Triticum aestivum
  Clone ID: PAT_TA_68595.pep
MTHQFQLEGNEWLSKLYEVRAQWAPAYVKDFFWAGMSVTDRTDSATDYFDGWLTSDTSVKMFVEQYEAAVRTKLEKETYEDLHSSQMRPQLMTGLPVEEQAAKMYTMEIFQTFLNELGRSFHCNYSILDRSDSVVTYIVSEHVNQTKVDYKVAYDNAEDDIWCFCRLFQFKG

SEQ ID NO: 174178 - protein, 179 aa, Triticum aestivum
  Clone ID: PAT_TA_68596.pep
MEENHPGIKWSSTATHRKNNTPYELSSLHHRSVGIHENDGDDASQFNKRRSSTLSDYSMKDVRNVIQTSTDELLLPKLDSTKIEHIQRSSAWHSAPLAFALLPALGGIFFTNGSGFVTDILLLGLAAIFLNWSVRLPWDWYHAARYIQYSDDDSIGVLPIPEDDKNKEISQSATSMGHV

SEQ ID NO: 174179 - protein, 215 aa, Triticum aestivum
  unsure (1)..(215): unsure at all Xaa locations
  Clone ID: PAT_TA_68597.pep
GTRRIRLSKTKQDLDXREEAIRKAYVRQQGIEKALKKASRDLALRVKQISDLKLLVEGQDRTIARSQALLSQKVTEVENLKRDMFKKNEEADLMRSEIRSKEKLLLTANQAIAQQEATVRELQSEIKRKTMDIARSNESRKTNEEKLKVAEQELEKQSLGWLAAQQELKELAQLAFKDTDDIKGIITDFKRVRSLLDAVRSELISSKDAFASSRR

SEQ ID NO: 174180 - protein, 177 aa, Triticum aestivum
  Clone ID: PAT_TA_68598.pep
GYLCTQPSQFRWIGSLVNLQKLRLQLERIRHEDLCILGALPALLTLGLDGMNDQSSCEDRRLTVSPEAGFRCLRVFTYMVQEDRMMDLMFTARCMPKLEKLEIIFSGNIENESLSSAGAFDFGIENLSSLVTFRCELDCRGIKGSTIDAAKASVERIVSTHPNNHLNLIFDDGILRL

SEQ ID NO: 174181 - protein, 126 aa, Triticum aestivum
  Clone ID: PAT_TA_68599.pep
QFLEFHNILPRAQEFKVLESFKNNYSTYQNIYMKFTGSNCISPKPFDLSATISVTNGFNYRICALDQVSLCQFWFCNNFFYCQQILCLASSFPLIWPVSSSPTCKQARKVSRALTQKQHYCRRRRQ

SEQ ID NO: 174182 - protein, 62 aa, Triticum aestivum
  Clone ID: PAT_TA_68600.pep
NQCKPYGVLPLCSAACIFFQMHIYLFELDKRAIVDIKQFNLLLLLSWSLSTPYLVPSFFCST

SEQ ID NO: 174183 - protein, 220 aa, Triticum aestivum
  unsure (1)..(220): unsure at all Xaa locations
  Clone ID: PAT_TA_68601.pep
GLTPPHCRQXSVPSEXDDASEWGVDFSDPSIAYDEGFIALQHRSTKQEVYYNPQTMALFLHPQEHHDMPDGTTLEFHTLSPGEDQRPPRVVSVRHDYSRPWARVAVFSSDTMEWQIFPETAALLPEGFRRTTRTLVDGFICWQCESVGGASLSEYILVLNTDTFQFSLIDLPPPLRVVYPEFKIGQTKNGRLCIVNEKECTLSVWILTDSDDGVQRFVLH

SEQ ID NO: 174184 - protein, 121 aa, Triticum aestivum
  Clone ID: PAT_TA_68602.pep
LPPVTCFAAFSPSRPCRLSLPPVLRLACSKAEEERGHGGLILLDTGCDKRRRSSLPSICKQELPYWTLPSPTGYLSRSPPPSRRHPRLRPHRNPNRLPRSTLDGKTHKIRVGMRVAEGRTM

SEQ ID NO: 174185 - protein, 182 aa, Triticum aestivum
  unsure (1)..(182): unsure at all Xaa locations
  Clone ID: PAT_TA_68603.pep
IGTLRDQIKERQVVHVTLGQDGTHDLVAVSGTGAEGVGQDQEFPNFIHDFASSSRTRSRSATIPEAQDVELDVVASLRKGRGAAAVEARGSKVGEARPYPPSCLARKRRRPPGFGEAFSRRAALLPSLWLPFSCLLPSMAVPWLGCALRPQPCEAAAVAAAGAAARRRVEVMXRGSLGDGGG

SEQ ID NO: 174186 - protein, 205 aa, Triticum aestivum
  Clone ID: PAT_TA_68604.pep
LAGMNVAAGPKLAAAVTNAGGLGVLGGIGYTPEMLREQIDELKSFLTDKNAPFGVDLLIPQVGGSARKTNYDYTKGKLDELISIIIESGSKLFVSAVGVPPKRVVDRLHSAGVLYMNMIGHPKHVRKCLDLGVDIICAQGGEGGGHTGDVPTTVLIPAVVAMCKGKTSPMTGKPVQVVAAGGIYNGQTVAAALMMGANAVWVGTR

SEQ ID NO: 174187 - protein, 35 aa, Triticum aestivum
  unsure (1)..(35): unsure at all Xaa locations
  Clone ID: PAT_TA_68605.pep
SKWXVQLLSXQQIHXXLXCRTPRXDXSAQARLYDH

SEQ ID NO: 174188 - protein, 198 aa, Triticum aestivum
  Clone ID: PAT_TA_68606.pep
GPAACCRHLAEAQADTRTHTSSLPPSPSPAIAELGYAARSRRRQGWPGGMSEPATQCRGNGGGGEGGAGGMRTVECLRGRLLAERVASKAAKEEADQLAARLDELEKRLSDEVKIRDRAERRLRRAIKRLESLKILDVGSSIGSLSSNSNACSGQQAAPETEESNGPAVSLSTVDSVLSDPRAGGEDKGWDGESVKGS

SEQ ID NO: 174189 - protein, 83 aa, Triticum aestivum
  unsure (1)..(83): unsure at all Xaa locations
  Clone ID: PAT_TA_68607.pep
PASSSPXSSPSXPPPPARPTATTXSASPTPSPTPTPTPTPTDMYGAKPNNTNMNNGXGLNNDXCRRRGLRQLQQRXRGGEELL

SEQ ID NO: 174190 - protein, 136 aa, Triticum aestivum
  Clone ID: PAT_TA_68608.pep
PRPPASSPPWSAPSSSSVLTCSTLSTPAAKRTARPRSNSARAPPYRRNPAASAANNSGAYKSSTLMGRVPYARVTSTLKGSNEHMVRYEEVRREKVHGPPSTMCAAAGTGNHGQILGSGTSIKQWLIPRHVKIKDI

SEQ ID NO: 174191 - protein, 160 aa, Triticum aestivum
  Clone ID: PAT_TA_68609.pep
MDEENSLLHFLDDTPSSHYRRTCGGYSSQNDGDDHSDTSDADPSNARDRLETLLNQPANKFCADCGTPDPKWAALPFGAFICIKCSGTHRSLGVHISKVISVNLDEWTDEEVNCLANSGGNATVNTKYEAFLPENYKKPRQDFATEDRAVFIRKKYELQQ

SEQ ID NO: 174192 - protein, 218 aa, Triticum aestivum
  Clone ID: PAT_TA_68610.pep
MKGRTLFKSPLPSNHVSDASSSAGAGATHRLYQVWRGRNKFLCGGRCIFGPDANSIYLSVSLIMTPLALFVAFVSFRLAELMGKPLGPFIPRTAMAVGAFDLIVLVLTSGRDPGIVPRNTKPPDPEDLQLDGMASPMAGAPSSGTLPPTRDVYVNGMVVKVKYCHTCMLYRPPRCSHCSVCNNCVERFDHHCPWVGQCIGKRNYRFFFMFISSTTFLC

SEQ ID NO: 174193 - protein, 119 aa, Triticum aestivum
  Clone ID: PAT_TA_68611.pep
RTLRRLFKVDAADYMLSLCGDQALRELSSPGKSGSFFYLTSNDQYMIKTMKKAEVKIFLKMLRAYYNHVRSFENTLVTKFFGLHCVKLAGANQKKVRFVIMGNLFCSDHFIHRRFDLKG

SEQ ID NO: 174194 - protein, 56 aa, Triticum aestivum
  Clone ID: PAT_TA_68612.pep
LFYANIQLNHLGIERFMEYPVHPLSSEYVFTFVSTSVLCSISFFYLWSLDYLASVL

SEQ ID NO: 174195 - protein, 118 aa, Triticum aestivum
  Clone ID: PAT_TA_68613.pep
MRDFPSCFGESGVQIADAASSSSSAGKGAAQNLVTCLYQTQLAGRPCVVSVTWSKSLMGQGLSVAVDALSGQSLCKADIKPWLFSKKKGSKTLDADGAKVDIFWDLSAARFGAGPEPL

SEQ ID NO: 174196 - protein, 254 aa, Triticum aestivum
  unsure (1)..(254): unsure at all Xaa locations
  Clone ID: PAT_TA_68614.pep
APTNGTNKSPSRSRLRSTPAPPPPVLPHRPKMQIFVKTLTGKTITLEVESSDTIDNVKAKIQDKEGIPPDQQRLIFAGKQLEDGRTLADYNIQKESTLHLVLRLRGGMQIFXKTLTGKTITLEVESSDTIDNVKAKIQDKEGXPPDQQRLIFAGKQLEDGXTLADYNIQKESTLHLXXRLRXGGMQIFXKTLTGKTITLXGEXFGTPIDNVQGRKIQDKEGXSPRTXXGXIFAGKQVXETXRTLADYNIPEGGP

SEQ ID NO: 174197 - protein, 179 aa, Triticum aestivum
  Clone ID: PAT_TA_68615.pep
MDARPRRASSSPAAATAAAALSLLLLFPMFLGGMTALQKHAAFFDRDKDGVVTFSETYAAFRALGFGFASSTLSATFINGVLGPQTRPENDTARMSIYIENIHKGIHGSDSGAYDSQGRFVPDKFDAAFAKHGKTVPDALTSAEVDELIAANRQPSDYAGWAGASAEWKLLYSIGKDED

SEQ ID NO: 174198 - protein, 167 aa, Triticum aestivum
  unsure (1)..(167): unsure at all Xaa locations
  Clone ID: PAT_TA_68616.pep
HQAKTLSVIHTWGGYTIRVLSPLATVTALCLFHGEKGLALVNADRMTTYILXGWFGTLVLDGRWLLRALGSTWTYALLVDKQQDQEEEGKQVRPLLGRRTFWYNFNLPRWVKHACRRAGRQLWYFPRCLLVSLDPSRLSLRSGPSGHRLLSGSSVGQRNLLHECSTP

SEQ ID NO: 174199 - protein, 131 aa, Triticum aestivum
  Clone ID: PAT_TA_68617.pep
NKDVWTPLNLTLLHRPDRITEKRKTDGRRIDGDNAGRRRSDREPAVPMWLGVVIICPTGGLNRARAYRRVIETQPAHEGSLAVARKRRNCAGGGERRRDDGRRFEVLRRNLGKLDFLSLFLYGSNTTWRRT

SEQ ID NO: 174200 - protein, 62 aa, Triticum aestivum
  unsure (1)..(62): unsure at all Xaa locations
  Clone ID: PAT_TA_68618.pep
MPPATSAPDAPVAEGDAEAPPVPTYRSLAAPVSNPVDKFALLPAFLKVRGLXXEHIDSFNYF

SEQ ID NO: 174201 - protein, 161 aa, Triticum aestivum
  Clone ID: PAT_TA_68619.pep
MAEGAPDDETLELTPTWILAIVCALMVVISMAAERGLHYLGKKLKRNNQKQLYEAVLKVKEELMLLGFISLLLTVCQGMIEEICIPPDWRMHMLPCKRQEVAPAKEHLVATQIIGRIGRRLLSKDATGAETCRQKGKIHLMSLESVHQLHEFIFVLAITHV

SEQ ID NO: 174202 - protein, 40 aa, Triticum aestivum
  Clone ID: PAT_TA_68620.pep
ICLLPSLDVVAVSQAPSPESNPNSPSPVTTMVGPYPTIES

SEQ ID NO: 174203 - protein, 250 aa, Triticum aestivum
  unsure (1)..(250): unsure at all Xaa locations
  Clone ID: PAT_TA_68621.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLADYNIQKESTLHLVLRLRGXMQIFVKTLTGKTITLEVESSDTIDNVKXXIXDKEXXPPDQQXLIFAGKQLXDXXTLAXDYXIXKEXXLHLVLRXXGGXAXFNPHRASPGFKGYGGGAP

SEQ ID NO: 174204 - protein, 174 aa, Triticum aestivum
  Clone ID: PAT_TA_68622.pep
EFGTRPHRHIFPFVVSPSPPPPPPPPPACSACENPSFPISSLHPPPLPHPHSAASSPLPRPPFLRTPLDSPSRSTSSTPAASPGPRRSRPPPSSPTSSPLPTPTPSSPSSPASASPAPMPPPSSPKTRFSSAPAWREPWSPSSTGSPASACRALTSPASSRSSAATSAADPSSP

SEQ ID NO: 174205 - protein, 61 aa, Triticum aestivum
  Clone ID: PAT_TA_68623.pep
TVVVRSQRRRRMDLGKRVEMRDLAAGKEDEHRDGERAFEEALLREHAVSTDMGSLDWRWMK

SEQ ID NO: 174206 - protein, 156 aa, Triticum aestivum
  Clone ID: PAT_TA_68624.pep
RNSARGPLTNRAARLLSSKRTLPRFSLLSSPLFPLGGLLNKMLRSCWNLHRVSRSAHESFLMARNIAAHSQTNRPSHLPWAWGNAFSYCTSSNTLGEQFAFIKGKDGAEIMKEPKLVNVRSADIYPNSSHRDGSIYKNSILQSIGHVTKRDERFSH

SEQ ID NO: 174207 - protein, 142 aa, Triticum aestivum
  Clone ID: PAT_TA_68625.pep
QRLVRDSSQISRTLLQIAPKSSPMCTLVAAAPKRDVPLPPPPPPPPPTTAPSLLYLTMSSPPSSGPSVPSRPCSPPPPHTRRRSPYLLTGGACFFRPTPPLGQVKDVFFVKRRCGSGKEQQNELCSRMILKLLDLKREDVAM

SEQ ID NO: 174208 - protein, 67 aa, Triticum aestivum
  Clone ID: PAT_TA_68626.pep
RERGFGRRAAAALRYFFPFLEWAPAYRLGTFKSDLIAGITIASLAIPQGISYAKLANLPPILGLYSS

SEQ ID NO: 174209 - protein, 188 aa, Triticum aestivum
  Clone ID: PAT_TA_68627.pep
MAAPAEPGEIEGYLGLRDVRVKLDLGKARGRGEEGAGAGAGGGFAVCFWLYLSGSARPSPVILHQITAGDGNKLPFLALSEGNKLLLFPLLRLHKQAPSSSNSSPWTDTTYISAVNECPLEHWIHIGCEVTENVMRLHIDGDLVAEAHLCSLSSQPDNQDDAYQVCLLGNNSKVDGYVYNVQVLSMLG

SEQ ID NO: 174210 - protein, 70 aa, Triticum aestivum
  Clone ID: PAT_TA_68628.pep
RRCVHDWRLQRGILLSNMGGSMILGLAPLCFRRYTDSTCFFAFPFFFVCVYEKTLFGCVHLSYAEAGCST

SEQ ID NO: 174211 - protein, 167 aa, Triticum aestivum
  unsure (1)..(167): unsure at all Xaa locations
  Clone ID: PAT_TA_68629.pep
MAALGRIAGPVPFKDVVQKEEDEHPPEEYADIISTLPGITTGFGQLLCYQGVWLRPWMVPGVISVQQRLVPRPDDVLLASPPKCGTTWLKALSLATMARATYAPTSADHPLFRLNPHDCVPHLEALFGAVQEAKLEALPSRRLMHTHMHHSLLPPSXADCKIVYICR

SEQ ID NO: 174212 - protein, 34 aa, Triticum aestivum
  unsure (1)..(34): unsure at all Xaa locations
  Clone ID: PAT_TA_68630.pep
FTPIHILYYTGSDQXVYLLVLYINSILQTNVLLA

SEQ ID NO: 174213 - protein, 202 aa, Triticum aestivum
  Clone ID: PAT_TA_68631.pep
SSSDLMLSCEGFQKHGYEFPTTHVSHRLLYTTGAESCLSDNGNATAAKDSLSNNLDLKNDDSLGNIPCYDDFLPLEDDSGDTLTHDDAIGIIQRVSPMEYIKRLLLKRSALSISSAELGVNTKLSMIPESSRDFRHSGDLCWHEYYHMSEVSQTVLPPKRYTQCEPLTAVRCFHEPQAMLQVFSIKLKAYLQAIGSSVDVYG

SEQ ID NO: 174214 - protein, 114 aa, Triticum aestivum
  Clone ID: PAT_TA_68632.pep
VKCHLRPAPGLMSEMFPQSSLDKSNSTGSPARQVLPAAMPASWPIEEIMPVSCTWWCRLGSGYILVRLYINNSAMTERSSVQNIYAGTKFCYCSDHSCQEKGAQFARFRAICHS

SEQ ID NO: 174215 - protein, 200 aa, Triticum aestivum
  Clone ID: PAT_TA_68633.pep
MPLLRWFHDFPYTHHLLLMGLLPATVAAIFLTMKLRPCTAYLIDYACFKGSTNCRVPISTFIEHMHLTPFLDGRSIKFMTRLLERSGIGNESNLPPTIHYIPVYRSLMEARAEAELVVFSAIDDLFAKTGAAPDAVSILVVNCSVFAPVPSISDMIVSRYKLHHDIRCLNLSGMGCSAGVTAVGLATRLLQATRRQHGAQ

SEQ ID NO: 174216 - protein, 137 aa, Triticum aestivum
  unsure (1)..(137): unsure at all Xaa locations
  Clone ID: PAT_TA_68634.pep
MDPPPVADPGQTKDKGVGSKGEMDLPVADPGPVRDEGELLQCPFCNSEAVYKLAQFLLPGLAAVCVDGTTGDLFRSPSDVAVDLRKEMVDSITQRSETFIXDVEAEQNADNEMSDDPYEIVSIFMDDFSRTKRNIIG

SEQ ID NO: 174217 - protein, 103 aa, Triticum aestivum
  unsure (1)..(103): unsure at all Xaa locations
  Clone ID: PAT_TA_68635.pep
ARLLHPASLPPLLLAALLLLLFRSALFAGTLRLSSFADRDPALRSLLLRLSPPAQPSPPAPQHHLPRRRSPFTSTSSSLSDDDFLVGPFDPVSSAPSSRRNAX

SEQ ID NO: 174218 - protein, 176 aa, Triticum aestivum
  Clone ID: PAT_TA_68636.pep
KVQHPNIVTLRAYYWSFDEKLLIYDYISNGSLSSAIHGKPGTMTFTPLTWNARLKIMKGVANGMSFLHEFSPKKYVHGDLRPNNVLLGKDMEPYISDFGLGRLANIAGGAAPSSQSDRIGVEKAQSLQPDSSMSPLVSKEGSCYQAPEALKTLKPSQKWDVYSYGVILLEMITGRS

SEQ ID NO: 174219 - protein, 148 aa, Triticum aestivum
  Clone ID: PAT_TA_68637.pep
MSGAYGGSNGGESRAPNEAVVVRAPKEAVVVGAPPSEMEMAGAMGVVHKVAAQPAQSTASKMKGKVKETFFPDDPFRSFKGQPLRAQWVLAARYLFPVLEWLPGYSLSLFKSDLVAGLTIASLAIPQGISYAKLANLPPIIGLYSSFV

SEQ ID NO: 174220 - protein, 175 aa, Triticum aestivum
  Clone ID: PAT_TA_68638.pep
MKRSPPPPPPQPSPSSSPACSLSPSPSSPSSSDSSSIAIPRKRARTQKAGSAKAKAAPKRAKKDASRSSKESDASANGAAAAGKRSSIYRGVTRHRWTGRFEAHLWDKNCFTSIQNKKKGRQVYLGAYDTEEAAARAYDLAALKYWGPETTLNFTVDEYAKERSEMEGVSREEYL

SEQ ID NO: 174221 - protein, 132 aa, Triticum aestivum
  Clone ID: PAT_TA_68639.pep
FFSSISCCSSPSNQSIRGMLLLNSLSSPAHADRLCQLTVPSLALTSSGHRRCCSGLVELSVPHRPHHQCSNRRPRRPEFGRGRRPVGSRRLRDPATGTCQNNRALLICASKHTCQSDLIDTRIHCLPPPSSP

SEQ ID NO: 174222 - protein, 84 aa, Triticum aestivum
  Clone ID: PAT_TA_68640.pep
RRIRVRFRRGSLRNGYHIQGRQQARKLPNPDTGRTPTPTTPKSPPARPAPTAAAGGERPLTLPAAFGRPGLKARWINETRGVVD

SEQ ID NO: 174223 - protein, 163 aa, Triticum aestivum
  unsure (1)..(163): unsure at all Xaa locations
  Clone ID: PAT_TA_68641.pep
PHWNHQHTALLRSRPWWPSWGTWWPSWATWRRSSRPSQRSSWGAAPPTCPLRPVIPKNTCPPRLTAAAGTELAGASSSSPVMIAHSTKXALQAALPFFTHAILLDRAFAHCPRFPTAAPRGSPGRVSVPVWLIIRKDQLSIIGLVSLYLTNYLILRRLIKQRF

SEQ ID NO: 174224 - protein, 142 aa, Triticum aestivum
  Clone ID: PAT_TA_68642.pep
SDGVHCSAASFSPDQIASFAASQVDYILGSNPMGMSYMVGFGGAFPRRIHHRAASIPSIEVLSRRVPCNEGFSSWLPTSDPNPNVHVGAIVGGPDENDQFGDNRGDSAHSEPATYINAAFVGACAAAMGQSQKPASPTLSSY

SEQ ID NO: 174225 - protein, 119 aa, Triticum aestivum
  Clone ID: PAT_TA_68643.pep
MPHRLVDEVSMNEVIVFKVDVERQKLVELRDIGDHALFLGLNTTVCVPTNDFKVFKPNCAYLTNEASLYNPMLQKDLGICNIKERSMQNLGEARPKLSSWLHLPTPIGITPMNILVIHV

SEQ ID NO: 174226 - protein, 160 aa, Triticum aestivum
  Clone ID: PAT_TA_68644.pep
RDVMDFLDCKLENVNPGHEVVKFYLFYERRRRAEVENFEPYLASLKAACDPSGVHVEPTGFEHSLCDGVDGMRSIYGDKQGKQFRVWIDRVLPTQISSNTWLVKFNKWELSGEERNCCITTVIISSKDAAVASDGFTWMHVHQTWSQEETNLKDNSTIIF

SEQ ID NO: 174227 - protein, 86 aa, Triticum aestivum
  Clone ID: PAT_TA_68645.pep
SSRWQTAPHRWGLGSSTSLPCGFERAGMAPVKVYRRQLAREDRYPASGSSFLCCPIGSIDIKVVSTDSVSVYLQRYYIACSDFVAL

SEQ ID NO: 174228 - protein, 70 aa, Triticum aestivum
  unsure (1)..(70): unsure at all Xaa locations
  Clone ID: PAT_TA_68646.pep
PRKLGVSQNQSWSCCPALPSGLGSRASELAEGRGRIAVTGTAACPLSPVLPLPPVSCWQRLLWRPKXPRL

SEQ ID NO: 174229 - protein, 78 aa, Triticum aestivum
  unsure (1)..(78): unsure at all Xaa locations
  Clone ID: PAT_TA_68647.pep
LESXYRYFLRGATERXLXLXRSEDXSASSSSLKMSDLECFSLDVKTLQLESICRLKHHILRAHIYTNFPXSLSSQYNM

SEQ ID NO: 174230 - protein, 85 aa, Triticum aestivum
  Clone ID: PAT_TA_68648.pep
GPRELPSLLAFLRRSTDFTPTHEIPLSSVSPQVNWFREHSATFWRLSLSTRFTAYVPFTPSHSEEHLPPPVLPRLLARELAGASS

SEQ ID NO: 174231 - protein, 140 aa, Triticum aestivum
  unsure (1)..(140): unsure at all Xaa locations
  Clone ID: PAT_TA_68649.pep
GDELWAARYIXXRITEIAGVVVSFDPKPIPGEWNGAGAHTNYSTKXMRSEGGYEVIKKAIQKLEARHMEHIXRHETADINTFVWGVANRGASVRVGRDTEKXGKGYFEDRRPASNMDPYVVTSMIAETTILSKAGLSNGK

SEQ ID NO: 174232 - protein, 58 aa, Triticum aestivum
  unsure (1)..(58): unsure at all Xaa locations
  Clone ID: PAT_TA_68650.pep
KQSTLXYEGTRHIHXPKQNSMNFXSLDYAGAVVXGHRRQILXVKRGXGGVTEVLSRXD

SEQ ID NO: 174233 - protein, 170 aa, Triticum aestivum
  Clone ID: PAT_TA_68651.pep
CKLDTQRICSVSNLNFQIRAILKSVSKVCFGRVGASVLPVTSTAASGASRRLPRRLWKISSLRKSGALVTLTSADRTEPRPLFWLLIWCFAATCARASSCPFLCWCCKTIRTLRGTLCWILASTFVLDFSHCPHQIFHSIHLVNLYTVCEIRIFTPHRVEHLYGLCCIIS

SEQ ID NO: 174234 - protein, 145 aa, Triticum aestivum
  unsure (1)..(145): unsure at all Xaa locations
  Clone ID: PAT_TA_68652.pep
NKDRLALLLXGNKSDVEQRHDQDMEVTFNMELKDFSRCILERKGIETKTIWEMHQGKMKEKQKGRKRWPKDDDDYSNKDSADDFLDEKLFEEAKPMKKPKVKAKGKGXDKAPEEHYEPEATKEPEEVRETARMLVADCDLDVSVE

SEQ ID NO: 174235 - protein, 102 aa, Triticum aestivum
  Clone ID: PAT_TA_68653.pep
QHRLDTPIANHRLAVAARRLARCSGGPSKQICPQRFHWPLGSGSWLQHNKLLVPANKFSGSSNNMDPAKNQKMGWWQKSKTVAAKNTDDGSKKLKLGFSSKL

SEQ ID NO: 174236 - protein, 55 aa, Triticum aestivum
  unsure (1)..(55): unsure at all Xaa locations
  Clone ID: PAT_TA_68654.pep
XGPPXVXXSSLSCXFVCCVXXFQEMFFSAAARAXFXLFXTCRAIXARTCXXXXRV

SEQ ID NO: 174237 - protein, 130 aa, Triticum aestivum
  unsure (1)..(130): unsure at all Xaa locations
  Clone ID: PAT_TA_68655.pep
ACFLQEKNNXSESMKCKTMLYLIINPLPQLLEFAFLSGVISHRIIADLLISKHFCIPPFCSRARTLTNTAVTVVCRQKAGHRTGGKFLPQITGKFLSSAVVCSGDTIACNQLVNVEPPHARLFWPHDVTT

SEQ ID NO: 174238 - protein, 159 aa, Triticum aestivum
  unsure (1)..(159): unsure at all Xaa locations
  Clone ID: PAT_TA_68656.pep
FGLGKKPEDFXKYQAFELIHARWAMLGAAGFIIPEALNKFGANCGXPEAVWFKTGALLLDGNTLNYFGNSIPINLILAVVAEVVLVGGAEYYRITNGLEFDDKLHPGGPFDPLGLATDPDQAYVTGEGPFENLCAHLSDPFGNNLLTVISGAAERVPSL

SEQ ID NO: 174239 - protein, 91 aa, Triticum aestivum
  unsure (1)..(91): unsure at all Xaa locations
  Clone ID: PAT_TA_68657.pep
KXXXXXXPPXKKKXXPPPPPPCVRATHHAGAPSHPVVTPGIRTTYKTSELATPSPLWSSTIDLSTAAECCLICRLHCVFVDXSYFFHFCTV

SEQ ID NO: 174240 - protein, 124 aa, Triticum aestivum
  Clone ID: PAT_TA_68658.pep
LMRSTALQLSQKLLFLPSTTVQCYTSRKHLPYNHLVQNNIYFHPRSTLKPHPAASLSGSFLMNYTINVLLPPLQPSCNLVICVMPLSLVKCSLHFFNGGLGQLNSHVKHLIGIFLHLGEPAKVE

SEQ ID NO: 174241 - protein, 51 aa, Triticum aestivum
  unsure (1)..(51): unsure at all Xaa locations
  Clone ID: PAT_TA_68659.pep
XXXPXXNPXXKKKNVEIVLLCSKLLLLVQSVHVNVVNICAIXHTPYXKGKX

SEQ ID NO: 174242 - protein, 121 aa, Triticum aestivum
  Clone ID: PAT_TA_68660.pep
IVAQALSVLHLLWHPEPAQDEAAAAAYVPAMHTRRSILHDRCGEQAAGHLRRQHEPRLPRSSMLLSRPGHVGTMIFIWILTSNRSLNSFHRYSRSQHKQQQNEMNTCMHSISFFKRREDSS

SEQ ID NO: 174243 - protein, 33 aa, Triticum aestivum
  unsure (1)..(33): unsure at all Xaa locations
  Clone ID: PAT_TA_68661.pep
DKAPIYGEXLEELGLXKAQTKLPFNAFGTMAMA

SEQ ID NO: 174244 - protein, 188 aa, Triticum aestivum
  unsure (1)..(188): unsure at all Xaa locations
  Clone ID: PAT_TA_68662.pep
GRHHGFSCQIQPPSARSGAQLAARTISATXPCLTATRDAAMLPSSAPAPPAAQGVVPQMQLGCRSPCSSGAAFSPFHSPCRLGRKGAMPEERAHGGGRREQVQFTPPKEARSATELPRPMPAILASSCSSTGPPMALPRRPATGSLASSDGHHSALSFLSTCVHSHSSLAAPPAACAVHSMRGEVLLL

SEQ ID NO: 174245 - protein, 94 aa, Triticum aestivum
  unsure (1)..(94): unsure at all Xaa locations
  Clone ID: PAT_TA_68663.pep
VAANGLAGNWVVSTXGLNLCLALLAGFLPNTDMYSVLLCDAMGEYDAGRGHNTPLQFLLFTSRCRRASAGSIVHASCYLECIILNFFTLALFSN

SEQ ID NO: 174246 - protein, 132 aa, Triticum aestivum
  Clone ID: PAT_TA_68664.pep
EPQPPLSPDLPQSLPPPLTPSFFLSPPPPSLSPPRATMPRMRRGRRWGTKGVGAALVPSAASARTCPRPCGGGHTGPSRPRVGRQTSTPPSCPSTSSSTSGSHARPCHSTGGELLHGSINRIPADPDPSASI

SEQ ID NO: 174247 - protein, 94 aa, Triticum aestivum
  Clone ID: PAT_TA_68665.pep
SMCVLAAQPKQPNISSVGLAAVSWNLIISSHQLASAAWFHRVFFAYSAVFFCNLDEEDQYTKLFSMVTSYMCLFSFCVYSFQFFYHDSVTKEIA

SEQ ID NO: 174248 - protein, 205 aa, Triticum aestivum
  Clone ID: PAT_TA_68666.pep
PSTAKILTTGNMTRPACVYSSETGAWGELTVMHGEFYMHFTYSSSVLVGESLLYFMTDGGLILEYDMAMHGLTWFKAPYSCYSKGIPSYILMPAEDGGLGLVEELDPHLKLWSREMTDARWIPSRIINLGSLSLNGAQMGATCPVHVLGFAEGANVIVVTTAAGLFRVQVQSEEITRVCDDHGYGNLIPVVGFYTPMPQVAAAEA

SEQ ID NO: 174249 - protein, 124 aa, Triticum aestivum
  Clone ID: PAT_TA_68667.pep
NSWIYERRTTAKAFAKDVFINQERKLGARRRSDTVLVSTINDADQGSADVAYRTPPAPYEKSKSLGSGGSMVARPRRSPRPSAPRPPRRAAKSPPLDLVRWRCVLVVLGVFVFRVCTKRTPRPP

SEQ ID NO: 174250 - protein, 35 aa, Triticum aestivum
  unsure (1)..(35): unsure at all Xaa locations
  Clone ID: PAT_TA_68668.pep
NVYKSFVSEYPXIVSIEDPFDQDDWVHYAKMTEEC

SEQ ID NO: 174251 - protein, 71 aa, Triticum aestivum
  Clone ID: PAT_TA_68669.pep
VGFTKVHKLMEVWKIFKLLKIWKTYNEVGGVIMPYVLFVESGDCFAHFGCGTSRNLCTHFVVLLHFCSRHI

SEQ ID NO: 174252 - protein, 32 aa, Triticum aestivum
  unsure (1)..(32): unsure at all Xaa locations
  Clone ID: PAT_TA_68670.pep
LERXXFSTXRSYTYIXIYMNKCSHXISLRESE

SEQ ID NO: 174253 - protein, 72 aa, Triticum aestivum
  Clone ID: PAT_TA_68671.pep
IGYPSIVGFAEGNNVVLLWMSAGVFMVQFESLQFKKLFESHEWCCFYPLEGVYTAGTDIGGGNDEAKLLHNT

SEQ ID NO: 174254 - protein, 42 aa, Triticum aestivum
  unsure (1)..(42): unsure at all Xaa locations
  Clone ID: PAT_TA_68672.pep
VEXHLATCHRXXXRXXLSIRHVCISALXFMXVVMGCNYPXGI

SEQ ID NO: 174255 - protein, 94 aa, Triticum aestivum
  Clone ID: PAT_TA_68673.pep
PPWMPVGEGSRGIRDGDAWDDPAIVHAGEASACTIGLASSESRHGWGCPSGGWKETTTSCHRTISTLAGGLDIQPHRIDAPSKLQLNLKKQENN

SEQ ID NO: 174256 - protein, 55 aa, Triticum aestivum
  Clone ID: PAT_TA_68674.pep
GSMYNKSMPVRLHACIACECLDLAFDTVFNLLLFPSLNILHITMLCIQCIYVVRP

SEQ ID NO: 174257 - protein, 98 aa, Triticum aestivum
  Clone ID: PAT_TA_68675.pep
LLPPSHSILLDGGSIFYFKCYSLSRPFHSSSTTTLTTASEKSRRVLSRGTKIRCSTTPRANAALALPLHLLFPAAVSEFPNPHSPFHLPCLSLFYIVP

SEQ ID NO: 174258 - protein, 63 aa, Triticum aestivum
  unsure (1)..(63): unsure at all Xaa locations
  Clone ID: PAT_TA_68676.pep
GCTTXSRLQXKSPHRHRHLNLLQQSESTSSTXYLXHLXILHPPVLCSAXPVYSIYERKYQVGG

SEQ ID NO: 174259 - protein, 85 aa, Triticum aestivum
  Clone ID: PAT_TA_68677.pep
KCFIIIVSAEWKDAKETYFYPNISRPIDLKGELNLKEYVALIYHHERYSGTYNLKVRNSSKILFSHKDLCLTLIHSIVEIPILIF

SEQ ID NO: 174260 - protein, 129 aa, Triticum aestivum
  Clone ID: PAT_TA_68678.pep
SSRRFKLYVPNFLTAFEHFCIHAGGSAVIDEVQRSLGLSNKHVEPSRMTLHRFGNVSSSSVWYELAYIEAKGRMHDGDRVWMIGFGSGFKCNSAVWECIVPAPNSNGPWAGCIHRYPVQIKSPKARPHQ

SEQ ID NO: 174261 - protein, 67 aa, Triticum aestivum
  unsure (1)..(67): unsure at all Xaa locations
  Clone ID: PAT_TA_68679.pep
RAXKSSRTSXRXAPAXAPAPSRSSXPXXASSRXARPPVAVVVIAXCVPCRXVDLNNXXVCRVFPRSV

SEQ ID NO: 174262 - protein, 146 aa, Triticum aestivum
  unsure (1)..(146): unsure at all Xaa locations
  Clone ID: PAT_TA_68680.pep
XTTXXFGAXRRRXAXIAXXXXXPGKHCCSXQSGSRCAKAPWDQXTXTATAAXEXKXRPXGSNLQSHRXXXAXTGSSRIHRXQXPTGSHXIRRXQTSTRXPXMLETXPGRGXGXKDLIPFXXSRHRXIFLSMAQTLTKLXKTXKXGA

SEQ ID NO: 174263 - protein, 61 aa, Triticum aestivum
  unsure (1)..(61): unsure at all Xaa locations
  Clone ID: PAT_TA_68681.pep
SYIHPIPSSXSYLLIIIIIIIXKQNKSKGAPTMHGIITTTAAGAPVRSPSMILFFPCFPFF

SEQ ID NO: 174264 - protein, 177 aa, Triticum aestivum
  Clone ID: PAT_TA_68682.pep
MEFNAEPTDARSMSFVGTHEYLAPEIIRGEGHGSAVDWWTFGIFLYELLHGMTPFKGNGNRATLSNVVEQPLRFPESPPVSNVARDLIRGLLTKDPQKRIATKRGATEIKQHPFFEGVNWALVRSAHPPSVPDPVDFRQYLGKEKKAAERGLGNVPSSLSAGAVAAAKTGSGQFEYF

SEQ ID NO: 174265 - protein, 48 aa, Triticum aestivum
  unsure (1)..(48): unsure at all Xaa locations
  Clone ID: PAT_TA_68683.pep
CIXXATDXXHIRARFVXXCCYMNMXIHILLGAXNKDKWXRXTQSNVXS

SEQ ID NO: 174266 - protein, 62 aa, Triticum aestivum
  Clone ID: PAT_TA_68684.pep
VVARYKGQRRIADAGFKNPRWVDGELLILDGKFIRDGPVIAFFYWTSNLHLFEFFRRLSLPD

SEQ ID NO: 174267 - protein, 129 aa, Triticum aestivum
  unsure (1)..(129): unsure at all Xaa locations
  Clone ID: PAT_TA_68685.pep
LSRAKNLXLIAHPGMFIFRRDLRWCPTFSKLKTLLLNEWSVEPDFRALVCMLEHSPVLENLTLQFSKQEEPTCSVEVEENPGLMEKPAAISGHLKIIKVKCEEVDGRVCKVLNFLSTFGIEITIQRTKG

SEQ ID NO: 174268 - protein, 75 aa, Triticum aestivum; identical to SEQ ID NO: 116116
  Clone ID: PAT_TA_68686.pep

SEQ ID NO: 174269 - protein, 154 aa, Triticum aestivum
  Clone ID: PAT_TA_68687.pep
FQEVYGGVRCNLKDAVQLAGLTWEGRAHCGLDDARNTARLLALLMHQGFKFSITNSLVWQQPAPQAITCQPSPSPDRSPDLTLLQQHKAKEMLGSHVHAHPYAGKAAGQVCFCGAPSRPNTVRKPGPMQGRHFYGCGNWTVTRRAICTFFAWAS

SEQ ID NO: 174270 - protein, 143 aa, Triticum aestivum
  Clone ID: PAT_TA_68688.pep
LQSAIKFNGGGHVNHSIFWKNLKPISEGGGEAPHGKLGWAIDEDFGSIEKLIKKMNAEGAALQGSGWVWLALDKEAKRLSVETTPNQDPLVTKGSNLHPLLGIDVWEHAYYLQYKNVRPDYLTNIWKVVNWKYAGEEYEKVLA

SEQ ID NO: 174271 - protein, 42 aa, Triticum aestivum
  Clone ID: PAT_TA_68689.pep
EAQEHADMSNMFFLETSAKTADNINQLFEEIAKRLPRSTPPS

SEQ ID NO: 174272 - protein, 184 aa, Triticum aestivum
  Clone ID: PAT_TA_68690.pep
SHPSQKQNAEAHPSCQQRAPAIRWFYSHGTKRVSPMQATVCRWGSTPRATATAAHFLPRPLPFLDFFLPLCFCAALCEVEAAATASSFNGSTSLLPAVSGSLSEHPVRSTTPSVCGWTFLMSSSLMDALAEDTKLMTVCSLFSPSPHIEYRSSRVRQAVFSIPAMHSSNSLRMRLISSNSCASS

SEQ ID NO: 174273 - protein, 114 aa, Triticum aestivum
  unsure (1)..(114): unsure at all Xaa locations
  Clone ID: PAT_TA_68691.pep
DTDEFVTVLLHIXKMSNEEYLPEAFKYFDKDGNGYIEMEELMEALGDDELGPDEQVIKDIIRDVDTDEDGRISYQEFQVMMRSGSDWRNASRRYSRANFSNLSHQLNLSQKLCQ

SEQ ID NO: 174274 - protein, 173 aa, Triticum aestivum
  unsure (1)..(173): unsure at all Xaa locations
  Clone ID: PAT_TA_68692.pep
MGFNKYVLMVVXAEGEVWKTIPVQYGRRSSTIGVSQGCLHYVVASTVSVNDSNEILGSGITLWCLKDRDSKELVLKRSANINELMGMIGEKYRVAEIHPDCDTVFLMSSGGDTLVAYDMQHQKVDCILNLEKGITKPKRFLPYVPLFSESCRWAVALPQATPVLPPRTVSSFG

SEQ ID NO: 174275 - protein, 49 aa, Triticum aestivum
  unsure (1)..(49): unsure at all Xaa locations
  Clone ID: PAT_TA_68693.pep
XFFSVXVTSSGCCCFRFPPGXRXXAVCRVVWVVLLAXLXSYXACCVGRT

SEQ ID NO: 174276 - protein, 33 aa, Triticum aestivum
  unsure (1)..(33): unsure at all Xaa locations
  Clone ID: PAT_TA_68694.pep
ISXRLXXKLLAPICMXRALIIARKXINSQSLCT

SEQ ID NO: 174277 - protein, 45 aa, Triticum aestivum
  unsure (1)..(45): unsure at all Xaa locations
  Clone ID: PAT_TA_68695.pep
XPXAYVSXASDXKGSSYXYSLSNMSKXXPXMMLPDXXRWFGXRPA

SEQ ID NO: 174278 - protein, 97 aa, Triticum aestivum
  unsure (1)..(97): unsure at all Xaa locations
  Clone ID: PAT_TA_68696.pep
XTSAAAAPPASXAPARASSSSPATPPPPEPDHHHPPFFTYLFYLSRYLLYCIIYYPSFLPPSLPPSLTCNALQCKCVSSTHIHSVYLLRSNLCKKSI

SEQ ID NO: 174279 - protein, 190 aa, Triticum aestivum
  Clone ID: PAT_TA_68697.pep
ALQYIHHDCESPIVHCDLKPSNILLDYDMTARLGDFGIARFYIKSKSAAAGGLSSMGTMTLKGTIGYIAPEYAGGSYLSTSGDVYSFGIVLLEMLTGRRPTDPMFCEGLDIVNFVRRNFPDQILHILDASLREECQDCSQDNLEEENEVHRCLLSLLKVALSCASQDPNERINMREAATELHAIDASFVS

SEQ ID NO: 174280 - protein, 94 aa, Triticum aestivum
  Clone ID: PAT_TA_68698.pep
SETKIYGQVVVDDSDYKRLVDHLLNLDFSNIERAVSSSKRWINEVRYAARPETEAEWGQKFTGTKETQVPSMASKTCVSTLNDALVRKKPKNKA

SEQ ID NO: 174281 - protein, 159 aa, Triticum aestivum
  Clone ID: PAT_TA_68699.pep
LIHLELQIEKCPEERVIITGSGTAFQTLKHLKFSCPKLLLAFEAGAVPRLQRLELRFSIKGWQQGSSACLPAGIKHLPPGFTEVSPMQFDHFRERLNGRDAAAAKSALRNAFACVGITMVRISGGDAVPKATTTCSTNNIIPDELATLGATTKISDYSS

SEQ ID NO: 174282 - protein, 34 aa, Triticum aestivum
  unsure (1)..(34): unsure at all Xaa locations
  Clone ID: PAT_TA_68700.pep
QHGVWQLXSQDSFRSENWSTDPQGRXVGXLHXGT

SEQ ID NO: 174283 - protein, 179 aa, Triticum aestivum
  unsure (1)..(179): unsure at all Xaa locations
  Clone ID: PAT_TA_68701.pep
QQRHLLKLVRPQCHRLSSGRMDRARRTPPEHLLPPPSCPLPERANKSPNDLLEQLAPRLARLHRAEPNQLYSSSFPXMPPKERPLPDPQDRRLNHSIETSSSCHCFQAQQRLVPSPESFDAPALRDEHFVKVVTRXAAASPSAFILVSASYAIQGSQLMHLLAXSKFELHGARAPHAWX

SEQ ID NO: 174284 - protein, 144 aa, Triticum aestivum
  Clone ID: PAT_TA_68702.pep
FQLTHPRIDRIAEFPLASSEDPLYPIMNLLPPSITDKSITKDKCTFQVLRGDSESYTNTRDLNLLSIDNNQVGSSSDLRLKRFDTTSYRQRAEALEGLLEFSAQLLQQERFQELGILLKPFGPGKASPRETAIWLSKSFKETGL

SEQ ID NO: 174285 - protein, 135 aa, Triticum aestivum
  unsure (1)..(135): unsure at all Xaa locations
  Clone ID: PAT_TA_68703.pep
EYLGEFRDXNXGNGAXTYADXTVANXEXTVAAIRSMDSSTXXMYXVGRRPXEAGXPXTSALEDWMESPXLGPIGDMLVXSDXSMGVSVLVVQXDPVRQYXXNANVHPATGLAGYXTIPAXSAANXWSSGXVGXGA

SEQ ID NO: 174286 - protein, 38 aa, Triticum aestivum
  unsure (1)..(38): unsure at all Xaa locations
  Clone ID: PAT_TA_68704.pep
LXNMDGQXMNLGIXQKVXKXLXKYXIRRIICLISPLVT

SEQ ID NO: 174287 - protein, 107 aa, Triticum aestivum
  unsure (1)..(107): unsure at all Xaa locations
  Clone ID: PAT_TA_68705.pep
SXPGVXPVXSGGIHVWHMPALTEIFGXDSVLQFGGGTLGHPXXNAPGAAANRVALEACVQARNEGRDLAREGNEIIRAACKWSPELAAACEVWKAYQIRVAQPVYYI

SEQ ID NO: 174288 - protein, 38 aa, Triticum aestivum
  unsure (1)..(38): unsure at all Xaa locations
  Clone ID: PAT_TA_68706.pep
VQVMVQQTEITEGXITARQICKTRXNXTGRCSCHVEAL

SEQ ID NO: 174289 - protein, 165 aa, Triticum aestivum
  unsure (1)..(165): unsure at all Xaa locations
  Clone ID: PAT_TA_68707.pep
IPCTFYXSACSNYQPLTSTSFKQGDDPFWSKKPPQEKPEKPERPTRPKTRVVKRPANRNKTTSSSDPAADEDVGNPDLEVELDSLGLFFTRLIDNDHCQDDTEVSHADAVEVIALSSDSIPLPSLKIRWANRKVKLANGIQLAQAQPHRCLDVGKVEVEAYKSPA

SEQ ID NO: 174290 - protein, 175 aa, Triticum aestivum
  Clone ID: PAT_TA_68708.pep
EYMHDKGVLYRCVKSSNILLGEGYHPKLSQYGLAEHDQLSAPAAITGGTWGTMAPETVMTGKLFPGSSVYGFGVVLLEMITGRRATDSPQDVEDRHLVTWARTMLKDRSQFRRMADPALQGRYPSLDLQEALEVASVCIHKDHATRPPIGTVVTALSRLAYDVDPPESSHHAAPN

SEQ ID NO: 174291 - protein, 43 aa, Triticum aestivum
  unsure (1)..(43): unsure at all Xaa locations
  Clone ID: PAT_TA_68709.pep
SPXXHRXARSPXXPXQLXHDRPYIKXQXSFVNXDXALGFPFSI

SEQ ID NO: 174292 - protein, 106 aa, Triticum aestivum
  unsure (1)..(106): unsure at all Xaa locations
  Clone ID: PAT_TA_68710.pep
FGVQPPINPSIKISAAISAVAGVSVPASATVKEARPXXKSKXDKVDGDTKXPAAASGLDSRSAASGSATLLTSENAVAGGYAAFAQQKRKEAEERRTSDYKSDRRS

SEQ ID NO: 174293 - protein, 103 aa, Triticum aestivum
  Clone ID: PAT_TA_68711.pep
ILVIFWYFIAGDTKCRVAISNFYFDMAGCSSSTYLVYALLSTYQQEDKLNASPWQSRAAVNVLVLPDLKLLNGSVVIYYTYSDRGHLFIFQQVNKILFRRPLI

SEQ ID NO: 174294 - protein, 35 aa, Triticum aestivum
  unsure (1)..(35): unsure at all Xaa locations
  Clone ID: PAT_TA_68712.pep
AVCAMRRCXAAXXCRXMRVAEVDAAQVLNHPRHQV

SEQ ID NO: 174295 - protein, 48 aa, Triticum aestivum
  Clone ID: PAT_TA_68713.pep
GGRRDKSEVQCYNCRKLGHFAWECPEKKENEEEKALLGQYVDDEPALL

SEQ ID NO: 174296 - protein, 77 aa, Triticum aestivum
  Clone ID: PAT_TA_68714.pep
RPVPAGHGAGGTGPARGVRQLLLQHTHQRRERHARHGVRRRRWRAAAQRRLISYHRPAGPIYMYRPDLSMAIKLNRL

SEQ ID NO: 174297 - protein, 73 aa, Triticum aestivum
  Clone ID: PAT_TA_68715.pep
LEKRERSHAGLHLLKLCMVPINKVRVHETTHNYFRLRSDNINDHGILFSRKGSTIRMLDLGNNNIIHTSISET

SEQ ID NO: 174298 - protein, 180 aa, Triticum aestivum
  Clone ID: PAT_TA_68716.pep
AGAIKVETFCVHGSPDGYITGIRGKVQCLSQEDMAGAETDLEREEMISSKCFLRFPTLPFIPKLPYDVLATDYDNYAVVSGAKDTSFIQIYSRTPNPGPEFIEKYKSYAAGFGYDPSKIKDTPQDCEVSSDQLAEMMSMPGMDQALTNQFPDLKLKSSVAFDPFTSVTQTLKKLAEVYFK

SEQ ID NO: 174299 - protein, 134 aa, Triticum aestivum
  Clone ID: PAT_TA_68717.pep
HPRTAGASSVLHWSIPEHRQCCYVASSGRWSIIGATLEHPIASPMLVCSILGPSEHHRCCNGASRSVAGVAMEHRQAVEASLVLRWSIAGPPKHQRYFMGMVAVALLRQPGAATMSSPALQPWPLCGELVGVLL

SEQ ID NO: 174300 - protein, 134 aa, Triticum aestivum
  Clone ID: PAT_TA_68718.pep
ADVPSSWDATWPCLFLEMTPSLESLHINIASCKEKPGEEISWQPSKLGLHNLREFVVAGFQGTKRQICLVNLVVGACTALRHVAMFKNGHARGKGLWDWEMVTQQQSWTDEEKDYTLKQIMDGVSSSAVQLVFG

SEQ ID NO: 174301 - protein, 222 aa, Triticum aestivum
  unsure (1)..(222): unsure at all Xaa locations
  Clone ID: PAT_TA_68719.pep
PSSSKDXRTLADXXIQKESTXHLFLRLEEGMQIFVKTLTAKTITLEVESSDXIDNLKAKIQXXREGIPXYQQRLIFAGKQLEKXXXALAXYXIXKEXXXHLVLXFRGGMXXFVKTLTGXKXITLEVEXSNXIXNVKAKIQDKEGIPPXQQRLIFAGKQLEDDRTLADYNIQKEXSXLHXVLRLPWWYSNCPDVGPAAVSACVLVRIKYRWFDPSAPHGCVET

SEQ ID NO: 174302 - protein, 187 aa, Triticum aestivum
  Clone ID: PAT_TA_68720.pep
PFGLGKKPEDFAKYQAFELIHARWAMLGAAGFIIPEALNKFGANCGPEAVWFKTGALLLDGNTLNYFGNSIPINLILAVVAEVVLVGGAEYYRITNGLEFDDKLHPGGPFDPLGLATDPDQAALLKVKEIKNGRLAMFSMLGFFIQAYVLRRRREGAQPVSWPFIARPPPSVADDQLRARDAAACAV

SEQ ID NO: 174303 - protein, 61 aa, Triticum aestivum
  unsure (1)..(61): unsure at all Xaa locations
  Clone ID: PAT_TA_68721.pep
YGSNLNXRIPLTLEDLSRHPLQPNLHRPLRPXPRVGVFSSLLQKEIAXNWSEXCGTQYRLQ

SEQ ID NO: 174304 - protein, 159 aa, Triticum aestivum
  unsure (1)..(159): unsure at all Xaa locations
  Clone ID: PAT_TA_68722.pep
IIELWHECHISIVHRTYFFLLFNGDHTDHIYMEVEHRRLXFIKHSSIADGEPNATVASSLKSLRNERDMLYRQMVRKLSGAEKESLYSKWGIDRSSKQRRLQLSRLIWTQTDMEHVRESAELVSKMVQHLERGQAIKEMFGLSFSLNLRSGKSFSWGGS

SEQ ID NO: 174305 - protein, 186 aa, Triticum aestivum
  Clone ID: PAT_TA_68723.pep
NYKPMTDSVASEGQLSEVAEAFTAIGVTDAEMPVVALQIARRAADSSSSNVQNFEELASTAKEISLTDLLTAIRNVTTLRRFCAFYAPDVWNSMLLEDSPPANWDKKGFLFSERFAAFDFFYGVESKAAHYTDGLVRDPSDAERLANHSIMEVKMFRIEDAKSTSAGTVAEVTGGKARERPSLNIH

SEQ ID NO: 174306 - protein, 29 aa, Triticum aestivum
  unsure (1)..(29): unsure at all Xaa locations
  Clone ID: PAT_TA_68724.pep
LHNVSIXVXLITDIHINARDYLLXVPQAT

SEQ ID NO: 174307 - protein, 159 aa, Triticum aestivum
  Clone ID: PAT_TA_68725.pep
VAAPSVASMAWAKIVDEFGVGAKLAYFIAMFLYASLAVRINFFRGFMFSLSWWAYTFPMTGAAIASIRYATVVDNAFTKALCVGLSLLATLTVTGLFATTMVHALVYHDLFPNDIAIAITDRKMKPIMELQESGKDDDSRSGSSKDVEAGATAAVAPEA

SEQ ID NO: 174308 - protein, 193 aa, Triticum aestivum
  Clone ID: PAT_TA_68726.pep
NKHADYVKKLLIDATKCYYNEAKWREETDTPVTVEEHLRFSVPSCCCMHVACLAFVIIGASRDAIEWGMTYPKIMRASCVIGRVINDVASHEREQEQCSDERSVMSTVEACMEENKYTAKEDAYRKLGELIEESWMDIIEELLKPATARPTTPLLEAVVNSTRMLDFLYKDQDAYTDPRALKVVVDSIYVNSI

SEQ ID NO: 174309 - protein, 120 aa, Triticum aestivum
  Clone ID: PAT_TA_68727.pep
MVLVAWGGHIQRGWRSVDLAPPIPAAHGSRCLREELGLLAGDLTILPATSPSPAHLQKIGCVHNSDVMELMRGLINQLSELISWLGTQDLGPRSLGLSHNLSRYKLKFSPKKFQVRTCRI

SEQ ID NO: 174310 - protein, 57 aa, Triticum aestivum
  Clone ID: PAT_TA_68728.pep
WDPYLNLVVTNVLLVVSCNKPFLTYVHMYIYLCILCYVFICIHVCICLLKNHTKNQN

SEQ ID NO: 174311 - protein, 154 aa, Triticum aestivum; identical to SEQ ID NO: 125480
  Clone ID: PAT_TA_68729.pep

SEQ ID NO: 174312 - protein, 165 aa, Triticum aestivum
  unsure (1)..(165): unsure at all Xaa locations
  Clone ID: PAT_TA_68730.pep
FQAYYLKVQYPSRKGAXTKKLTVVGNGVSISQLVRYPVSGFAFEGGASLEDLSQVVSDACIFLQENNXPFNVLISESGKRLFLLLQCYAEKQASGKASQEFLDMRINPAVWELSGHLVLKRRKDYDEASAATLCGFLVEASLSEAEFQELKKCVLEFLASASPEK

SEQ ID NO: 174313 - protein, 124 aa, Triticum aestivum
  unsure (1)..(124): unsure at all Xaa locations
  Clone ID: PAT_TA_68731.pep
NSFVQDFELDGQNWYFGVYPRGNQYSXNCLSLYLHLDGSEKLPHKYGKLVELTLSILDQKHGKHFIRKCPGLVVFAGKSHWGWSDFIPLETFMNPERGYLVESCCIIKAEITIFGSSDACRLMA

SEQ ID NO: 174314 - protein, 94 aa, Triticum aestivum
  Clone ID: PAT_TA_68732.pep
STLQMADVGVEASVRTTTSSSSTLLATAFRCGHCLLLDRASATCSTFIARASSDTLEGLHQASITVPDCLSICVFSHSMYLYHMKSKCNGLMYW

SEQ ID NO: 174315 - protein, 41 aa, Triticum aestivum
  unsure (1)..(41): unsure at all Xaa locations
  Clone ID: PAT_TA_68733.pep
DLQPXAAPGGSKQDXXVAGASSEPSGTXSHKNAGAEXVGAD

SEQ ID NO: 174316 - protein, 147 aa, Triticum aestivum
  Clone ID: PAT_TA_68734.pep
VLLVKIYKGLLKQVLQNHRADHGADLKRLQPSRVGGGGGGLHHLPLEDHLQKKVPLDDFTGWILVEYRPVPYDPPNFIGRGVTGGIIIVIFALRTTCPTPWVSGQFRCPSELRERLVDGIKEKPLFRPPFPRLDLHCLVIRQLLKQL

SEQ ID NO: 174317 - protein, 45 aa, Triticum aestivum
  unsure (1)..(45): unsure at all Xaa locations
  Clone ID: PAT_TA_68735.pep
RKSFMLXSIXGMFHHKKQESMXMAVPXHNMSQALXCIFQLLTHVH

SEQ ID NO: 174318 - protein, 89 aa, Triticum aestivum
  Clone ID: PAT_TA_68736.pep
QLIINALNMNNTKNTYTAVKALRCIHEQAEATLNMNYRTFTVSYLPENKIFLSFKKFNQILLLSCLHEQAEATLKHVLQTETWVETEAI

SEQ ID NO: 174319 - protein, 94 aa, Triticum aestivum
  unsure (1)..(94): unsure at all Xaa locations
  Clone ID: PAT_TA_68737.pep
FXYGTEGVVFCMDHNIGMQLIFICVILYMLXDAMVWYDNWRWRMSHAECRVRQACQDEPGRQSNFMFDVLXDAVLSSLGHCAILLLGRLLVCTT

SEQ ID NO: 174320 - protein, 115 aa, Triticum aestivum
  unsure (1)..(115): unsure at all Xaa locations
  Clone ID: PAT_TA_68738.pep
LGAFGITGMTGLXKMELLXGGQKSXVAFACLSLQNPHILVLDEPSNHLDIEXMDALSTALRQFQGGVLMVSHDXTMLQTXCXSLWXCDXGXVEKFPGDVQAXKKRISAQADSSGV

SEQ ID NO: 174321 - protein, 73 aa, Triticum aestivum
  Clone ID: PAT_TA_68739.pep
NEYLYTVVNRCGDEPMMINSNYGCIFCMHGVMASKLRIWWRRSCVWWQGGRRRGQAVHRCRKGKRRPPWRRTE

SEQ ID NO: 174322 - protein, 60 aa, Triticum aestivum
  Clone ID: PAT_TA_68740.pep
LALLLLLVEISLICQIILIKKKAALIMQVLQLTPEQIAMLPEEQRKSILILKEQITGGRQ

SEQ ID NO: 174323 - protein, 150 aa, Triticum aestivum
  unsure (1)..(150): unsure at all Xaa locations
  Clone ID: PAT_TA_68741.pep
MIHPKKLAQLVKKCQRMLAAGAGARRRHASADDECCSTASVAADEGHCVMYTTDGARFEVPLAYLGTTVFAELLRMSEEEFGFTSGGDGGRIMLPCDATVXEYVLCLVRKEASEEVEKAFLSSIAGHCHNYNASCMAPSMGITRQFALCT

SEQ ID NO: 174324 - protein, 99 aa, Triticum aestivum
  unsure (1)..(99): unsure at all Xaa locations
  Clone ID: PAT_TA_68742.pep
YLTTXXRYQTAVQQQQRANLKQPPXKPYRRTXAPSTTLPLKKYRXGSXGTEPGFDPASSPXDPSGHQPSTDKXLPSFXQGELLPPPPILXVXSDXMRRD

SEQ ID NO: 174325 - protein, 61 aa, Triticum aestivum
  unsure (1)..(61): unsure at all Xaa locations
  Clone ID: PAT_TA_68743.pep
GIFGLEPXVAKKLVTLTVFDSHVVWGLSSLRWLSAKCWSTLTRRSKLIMLISYVAIVWETX

SEQ ID NO: 174326 - protein, 33 aa, Triticum aestivum
  unsure (1)..(33): unsure at all Xaa locations
  Clone ID: PAT_TA_68744.pep
PLSSDLMWSVFNVGKASEDSRNHLDIIAAXTTH

SEQ ID NO: 174327 - protein, 41 aa, Triticum aestivum
  unsure (1)..(41): unsure at all Xaa locations
  Clone ID: PAT_TA_68745.pep
LTSDIXLSHTYIFNRXXXTTYIYMMYLXKNPFIFNYIHQLY

SEQ ID NO: 174328 - protein, 117 aa, Triticum aestivum
  Clone ID: PAT_TA_68746.pep
MIDPRPCLLLLSRGSRDSPELLLGHVHPGGELRHRRQHGHQHQLYLHPGGEPVPPCASRRRQYHHLHLRAGSEHLCWMHRHLHLVNACMCCCYRTQGCRIFEHMHPALVILATPMLR

SEQ ID NO: 174329 - protein, 188 aa, Triticum aestivum
  Clone ID: PAT_TA_68747.pep
GNTIIKAGARVSPSTMVPSVGILALEVRFGVRNHAKMVPNVLRCFPNVETLHIKSAKTDRSTGKLNLKFWHECGVIECIRSRIKLLVFHDFRGGRAEIAFLKYFFETALVLKKVVILFAVGFSSTTEEAQSKLSSLGSVKRASETSTVLVTVPSDPEVGSIRSFKIGSGFSADDPFANGFAKSHLDEI

SEQ ID NO: 174330 - protein, 129 aa, Triticum aestivum
  unsure (1)..(129): unsure at all Xaa locations
  Clone ID: PAT_TA_68748.pep
WMTTQINRMARSNVQANKHDVFSRGSSFPSCQQYFQFCRCRGEARTGGQDSCQVLQQQFSTGANFASSRSRGRYIKGNTLVLEQPRMLADLMVCFALITFVVVFPGSFFAQLWQFQCPQFLQIIAXQQV

SEQ ID NO: 174331 - protein, 183 aa, Triticum aestivum
  unsure (1)..(183): unsure at all Xaa locations
  Clone ID: PAT_TA_68749.pep
GTQGCSRRVQEEIRTAVGRKERVQSEDMSKLTYLRMVVKXTXRLRIPAALLVPRETLRKIQIAGYDIPAKTRVIVNAWAIARDPNVWKDPEEFYPERFEDTDIDFNGAHFELLPFGSGRRICPGMDMGVANVEFILANILYCFNWELPPGMNIEDLSMEEEGALTIRKKTPLMLVLTRYTAYQ

SEQ ID NO: 174332 - protein, 49 aa, Triticum aestivum
  unsure (1)..(49): unsure at all Xaa locations
  Clone ID: PAT_TA_68750.pep
GXIXYGGXKAFGXKKEVKTEAGXAPAAAPAHSTSSELYFLTTICFKYVV

SEQ ID NO: 174333 - protein, 152 aa, Triticum aestivum
  unsure (1)..(152): unsure at all Xaa locations
  Clone ID: PAT_TA_68751.pep
GNSLGMVTQXLPGEDGELEQSRKQMLARLDVLMGGRVAEELLVGETGVTSGPFSDLSQATQLAMDMVTKYGMSKRVGLLSYDDGGRAATMSGSMAALVDEEVKALLDKAYSNAKTILTAHSRELHVLANALLQHGTLSGDQIKKIVSAGRWF

SEQ ID NO: 174334 - protein, 87 aa, Triticum aestivum
  unsure (1)..(87): unsure at all Xaa locations
  Clone ID: PAT_TA_68752.pep
RGRPEAVLXQAPQXEEDDAQEEXVPAARGGGQAQELTCPAATHAAAARSLAHGVALQQGGVTRXDIWRSICLCCLLIQLSCCMSAVL

SEQ ID NO: 174335 - protein, 120 aa, Triticum aestivum
  unsure (1)..(120): unsure at all Xaa locations
  Clone ID: PAT_TA_68753.pep
GRGITATPPARHLAGAHQEDRQETKHLQPACLTWRLAPAGHSGGRCPSQLPTPRTPVQHATAPSTVVPAPHALQWILVKGFRLYSFQLPDTNAPGIVIYCHYLPVSGLGNLRACCLXWMW

SEQ ID NO: 174336 - protein, 85 aa, Triticum aestivum
  Clone ID: PAT_TA_68754.pep
ATTHLHLSSSSSFSSSFSIYVKCTTQKASEHHHEWHHPCSGASQLFFTVQDLPHRPQMTAPTFTILKIYMPIYPYESCLLLLLLY

SEQ ID NO: 174337 - protein, 97 aa, Triticum aestivum
  unsure (1)..(97): unsure at all Xaa locations
  Clone ID: PAT_TA_68755.pep
RGNGTGXGESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 174338 - protein, 59 aa, Triticum aestivum
  unsure (1)..(59): unsure at all Xaa locations
  Clone ID: PAT_TA_68756.pep
LLXRYIVTGXXKTKAAPXAFHLFVVLNTTXPLTIVQLFPHKQWRHTKYVXIYSFPFFFE

SEQ ID NO: 174339 - protein, 138 aa, Triticum aestivum
  Clone ID: PAT_TA_68757.pep
FINQERKLGARRRSDTIHISAAAPSIHQHHHRLLPPLHPHRRHQHHSASRTSRPCCSSSSPTPCCCSFFPRLAAAPSSLALLLLLHFSTRTSCSSPQSLLLLFSKPLTLLLFLFFATPLLLSSPQNCCCTFSLIPLFS

SEQ ID NO: 174340 - protein, 103 aa, Triticum aestivum
  unsure (1)..(103): unsure at all Xaa locations
  Clone ID: PAT_TA_68758.pep
SIVSSKHHQLLITDSPRALKQXIEAKRQQAKSSADLQQQRWQGGVGEGQVKPDERVLQVVRRVSFLCAGTPKSSRPSRCWSYIGWWEDIAASHPWWSVVTLVA

SEQ ID NO: 174341 - protein, 89 aa, Triticum aestivum
  Clone ID: PAT_TA_68759.pep
ESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 174342 - protein, 54 aa, Triticum aestivum
  Clone ID: PAT_TA_68760.pep
TLSLFCVNCENLFCLPGPFLNYLNHTVLVLRTRGVFLFKKHVLGPTASQAVLKM

SEQ ID NO: 174343 - protein, 150 aa, Triticum aestivum
  unsure (1)..(150): unsure at all Xaa locations
  Clone ID: PAT_TA_68761.pep
MLPPVLSRQISELGIYPAVDPLDSTSXRMLSPHVLGEAHYNTARGVQKVLQNYKNLQDIIAILGMDELSEDDKLTVARARKIQRFLSQPFHVAEVFTGAPGKYVELKEGVQSFQGVLDGKYDDLSEQAFYMVGGIEEVIAKAEKIAKENA

SEQ ID NO: 174344 - protein, 161 aa, Triticum aestivum
  Clone ID: PAT_TA_68762.pep
YRKDVTLKTIKEISRRLEEVEARNLTLHKTSSEFTVIEKQLNLISSEIRKSLHSEIDTLNRAVRRYEKRASIQTIQTESRLQELESRLQDTISIAAIAAKATTSQRIHTHQLTTAIIKWAATTLIFPFQAFNSLVRLPGKFMISSTQVGKYMMPQQEKPKK

SEQ ID NO: 174345 - protein, 165 aa, Triticum aestivum
  Clone ID: PAT_TA_68763.pep
DVGMVEFVGLIKVDIIRGTDLAVRDVMSSDPYVMIMLGHQSMKTKVIKNTLNPIWNERLMLSIPEPVPPLKVQVFDKDTFTSDDRMGEAEVDIQPLISAAREYQSSIITESTQICTFLASENSILAKDSIISIVDGKVEQEIALRLQNVEHGELEIKLECVPLSQ

SEQ ID NO: 174346 - protein, 137 aa, Triticum aestivum
  Clone ID: PAT_TA_68764.pep
TALPPYDPTQTKIERASPACARVDHPSHGLELPPMRSAGNAVARRGDVGHDRLRVFRHLLASLKPPATEDVVPRLLVRRAIHAIGGRIVYVAEVGGADAGALDAVSSSEVKARLAHVEAEAGLGVEALLGRRQHAEG

SEQ ID NO: 174347 - protein, 60 aa, Triticum aestivum
  unsure (1)..(60): unsure at all Xaa locations
  Clone ID: PAT_TA_68765.pep
MHTRYDSRLHETNTXKEXCIRKTARRASQGLDACXLITSXFPCRFSMARLXSKPLXNKAH

SEQ ID NO: 174348 - protein, 88 aa, Triticum aestivum
  unsure (1)..(88): unsure at all Xaa locations
  Clone ID: PAT_TA_68766.pep
WTRMGRKESGAKEEEHRGRRRTTTWGREGLDWSALLLLIVGVNFFDTTDLYREIGDANLSHARPCTSACLLSKICSICAASSGQTXTK

SEQ ID NO: 174349 - protein, 34 aa, Triticum aestivum
  unsure (1)..(34): unsure at all Xaa locations
  Clone ID: PAT_TA_68767.pep
MINQXTHHSXSSNPFQRPAYXAARLSFSRAGIFX

SEQ ID NO: 174350 - protein, 53 aa, Triticum aestivum
  unsure (1)..(53): unsure at all Xaa locations
  Clone ID: PAT_TA_68768.pep
MWRXXXTLXSPPRPPWRARQARRLXGHQGRHQVXLXLGSSCISXCVSFLFPVX

SEQ ID NO: 174351 - protein, 130 aa, Triticum aestivum
  unsure (1)..(130): unsure at all Xaa locations
  Clone ID: PAT_TA_68769.pep
EXTTAGXKPKAEKRXPASKEAGGEAKQRGRKKGSKAXKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 174352 - protein, 191 aa, Triticum aestivum
  unsure (1)..(191): unsure at all Xaa locations
  Clone ID: PAT_TA_68770.pep
LPXDVRRVIYLDSDVIVADDIRTLFSVDLAGHVVGAPEYCHANFTNYFTDTFWMDRALSGTFHGRRPCYFNTGVMVMDVDQWRTGGYTRRVEGWMAVQKQKRIYHLGSLPPFLLVLAGDIQAVDHRWNQHGLGGDNVKGRCRGLHPGPISLLHWXGKGKPWHRLDARRPCTVDYLWAPYDLYRPSSPVLEE

SEQ ID NO: 174353 - protein, 29 aa, Triticum aestivum
  unsure (1)..(29): unsure at all Xaa locations
  Clone ID: PAT_TA_68771.pep
ERAQWSSSSSRSXLFVVRXIKXCISSHLE

SEQ ID NO: 174354 - protein, 153 aa, Triticum aestivum
  unsure (1)..(153): unsure at all Xaa locations
  Clone ID: PAT_TA_68772.pep
CRPQGTNIAAFSPGPAPCCGAWPRLRCGAPRELVVADIHNRRPTGRLKKHRCAGDTHHVQEQSTLALSLSLAKGNKVERKWCSRRSIEHLGRALFGAGHPNRRCARPGPAAAGCGPVVLEDLLLHILRARHGHGHGRKRWXTXGSSTXXEVGH

SEQ ID NO: 174355 - protein, 45 aa, Triticum aestivum
  unsure (1)..(45): unsure at all Xaa locations
  Clone ID: PAT_TA_68773.pep
TGQHHIFSSNYNYAKLLFVLIYSLLVDFFVCTSMTACXMNTNLLM

SEQ ID NO: 174356 - protein, 37 aa, Triticum aestivum
  unsure (1)..(37): unsure at all Xaa locations
  Clone ID: PAT_TA_68774.pep
APGAVRQLHRLQATGXRGVWQGLXYXLKQXPMYEGLL

SEQ ID NO: 174357 - protein, 88 aa, Triticum aestivum
  unsure (1)..(88): unsure at all Xaa locations
  Clone ID: PAT_TA_68775.pep
LGRAVLXAVGRGAWRNXLXLHANXLHNVXLLXSSGXXLLTTSLNGSKKKNQLWRPLGKRKDSKVARVMLSTEAALSLMLYPSYLAPLL

SEQ ID NO: 174358 - protein, 198 aa, Triticum aestivum
  unsure (1)..(198): unsure at all Xaa locations
  Clone ID: PAT_TA_68776.pep
DIKASNVLLDSQMNGRLGDFGLARLYDHGTVSKTTHVVGTMGYLAPELIRTGKATPLTDVFAFGVFLLEVACGRRPINSTKDITELVLVDWVLEHHRNGSILDVVDPHLMGNFNPEDLEECTEDCFLCPXARPSMRKVMQYLDRDQSIPDMSAYMSYNRIAMMQNEGFDSYIMSYPSSNMNICVVSGESSVSILEEGR

SEQ ID NO: 174359 - protein, 174 aa, Triticum aestivum
  Clone ID: PAT_TA_68777.pep
QNAFEIAFFFWILTTYGFNSCIMGHVGFIVPRLVIGVIIQLLCSYCTLPLYAVVTQMGSFYKKEIFNKHVQQGVLSWAQKAKMKKALEKSNGTAESTSTVDSAGPSTKIEMMKPATREGNDDSAGPSTKIEMMKPATREGNDDSAGPSTKIEMMKPATREGNDDGEIIEWSRVV

SEQ ID NO: 174360 - protein, 135 aa, Triticum aestivum
  Clone ID: PAT_TA_68778.pep
KKTIRWSDTEVAIALSKAPVLLRKSKDLLRRRSEFLLSELGLEPAYIAHRPVILYYSLEGRLRPRHYVLKFLKETGLADRDWSFYNVVTRTEKDFVDKYICPHKEAAPHLAEDYATACKGQVPTNFRFLLQPKVG

SEQ ID NO: 174361 - protein, 113 aa, Triticum aestivum
  Clone ID: PAT_TA_68779.pep
LLVKRWRQLNRIHLAKADLQRQKVAYANLQKDKGWAREREDSSTSKMVLACILAISSVAGTTCSSPLLIPKDTTYTKVREISPLFQGSLELEEIDPVPIRHVFSARSNSPTQI

SEQ ID NO: 174362 - protein, 127 aa, Triticum aestivum
  Clone ID: PAT_TA_68780.pep
RAENPNDKIGIKYADGSHTVVSYRGTPLCSGKLPTFFQGHNNVTMLEISMEGRHGFGSGLQEALEESEKAGNVPLDVYVTVPVQLQLDTYDLHQIKVNVHAALVVDSISPKKPPTIKSATYQGNVEF

SEQ ID NO: 174363 - protein, 181 aa, Triticum aestivum
  Clone ID: PAT_TA_68781.pep
KGFQTLSSYYLQEAEWFHRNYMPRFQEQVNVSVITSGSTMLSVGLLVGMDVEANNEAFEWAIGCTDVVMACGKVTRFMDDLAAFKRGKNKMDVPSSLECYINEHHVTSEVAITVLDGLVEDAWKTINRERFVCTTLLPIVNRVINLTTSMSVLFHDGGDGYTYNKDSEGMIEKLFAKPIPL

SEQ ID NO: 174364 - protein, 92 aa, Triticum aestivum
  Clone ID: PAT_TA_68782.pep
SVDWIHCVSTATYLSNKKFIFYLLYLLRIYFYTLIICFYVCSWKWISLAKATMRPHATLEGFVKDTQADAVWKMYKLLEVGRSTSCWRIIYM

SEQ ID NO: 174365 - protein, 54 aa, Triticum aestivum
  Clone ID: PAT_TA_68783.pep
SLDRLASTHNTYKYQITSASFTTTYDPEFIKYYKLNSTWLTYSIITAERWHNKR

SEQ ID NO: 174366 - protein, 30 aa, Triticum aestivum
  Clone ID: PAT_TA_68784.pep
QTSVRLVLPGELAKHAVSEGTKAVTKFTSS

SEQ ID NO: 174367 - protein, 120 aa, Triticum aestivum
  Clone ID: PAT_TA_68785.pep
LSKDKINSLWGCTAPAWIEGLITTEEAENALRSSRELLKKPGTFVLRFPTTRSWPHPDAGSLVVTYVGSDNSIHHRLLSLDVSDARAGSLQDLLLQEPELLQLGRVDRLPTAMKYYSSVL

SEQ ID NO: 174368 - protein, 172 aa, Triticum aestivum
  Clone ID: PAT_TA_68786.pep
PDGCREPKDMLVSMWHFIMAAGGDAFPFSDLFEFACEGKNPHGPIWDHILGYSRSSKASPDRVLFLRYEEMLLDPVSSVRELALFLGVPFTAAEEAAGLPMDICKLCSIDTMKDLEVNNTGVAGQFVEVPHKSFFRKGVVGDWANHMTPEMARHIDAIVEDKLRGSGLGFTR

SEQ ID NO: 174369 - protein, 136 aa, Triticum aestivum
  Clone ID: PAT_TA_68787.pep
PEDGDHTEEKLSQSGEEDGDDHESSGSEDEFYKDIKRQRTEKRLGKEQSTPATELEEESEGDGKRKISRQIEKNRGLTRSRNKNLKNPRKKYRIKSDKQSKRRQGQVRSAKKPSGPYGGELSGINANVSRSVRFKS

SEQ ID NO: 174370 - protein, 37 aa, Triticum aestivum
  unsure (1)..(37): unsure at all Xaa locations
  Clone ID: PAT_TA_68788.pep
SGEIFNYSREYDXLSILWLKKIAEXCFRTKLFXXXFF

SEQ ID NO: 174371 - protein, 156 aa, Triticum aestivum
  Clone ID: PAT_TA_68789.pep
ILPLAEQLLFALHAAASFVWSKLPIDTKRVFSPYVPDFRKAFDHFCIHTGGPTAIDGVQRILELSDEHVEPARMTLYRFGNTSSSSVWYELAYVEAKGRMSKADRVWMIGFGSGFECVSAVWECIRPADDPDKAWAECIHRYPAGEHSRAPEIIEC

SEQ ID NO: 174372 - protein, 106 aa, Triticum aestivum
  Clone ID: PAT_TA_68790.pep
TSSRACASSSKPGQHFWVDGYICSLCGFELPPCFEEERQEHSDFHLAEMLQQEEAVDNTARLSKERLAERPCSTTTTPTPKKKLKSSKEGKHIPIDSFFLKCNKKL

SEQ ID NO: 174373 - protein, 213 aa, Triticum aestivum
  unsure (1)..(213): unsure at all Xaa locations
  Clone ID: PAT_TA_68791.pep
SITAPGTSPXTPNGIHITRSKDVQVKDCVIKTGDDCVSIENGTHNLFVSKVVCGPGHGISIGSLGDDNSRAEVSGITIDSVQLYGTTNGARIKTWQGGSGYAKDITFQNMVMDNVQNPIIIDQNYCDSAKPCNRGQGSAVEVSNVVFKNIRGTTVSKDAIKLSCSHSISCSDIVLENINLKMEGGKGDTESTCQNAKWQESGTVIPQPCQFQN

SEQ ID NO: 174374 - protein, 86 aa, Triticum aestivum
  Clone ID: PAT_TA_68792.pep
RLIMVTFGGKVLGGFLHSFAEVYFMVVWLMFYFAARCKESRLEVYFIPLSAHSCRKTGLGGVDLCSSLDLLICAWMIYDPHEGERT

SEQ ID NO: 174375 - protein, 132 aa, Triticum aestivum
  Clone ID: PAT_TA_68793.pep
PPTPQFEHFASFLSFRGRSPLCGQVMLLCPPARMCSLAPHAPPARMCSLAPHAPPAPAYCHFGLFAFCTQVIVWRLAHLVVGRPALRYLSRAFRTMKLPITLPSVSIQTSVVSCMPCNRFFAFPLAWLNSVF

SEQ ID NO: 174376 - protein, 63 aa, Triticum aestivum
  Clone ID: PAT_TA_68794.pep
TAATSMKNSEIILKFLYYKIVSYDMLLTGSPPPVEHHLYILIPNEIVVIVHAYYFFLPKHIVK

SEQ ID NO: 174377 - protein, 138 aa, Triticum aestivum
  Clone ID: PAT_TA_68795.pep
APLDRGDDGVPPVGRAAAASDRHTAAAAYAFSRTSPNPVPVQSRRRKQGIPPDLAAAAIKGSRRIAARSRRNCMPSGAACRARRSLLCPTAPCSASLRRASGHAEQRRGPVRRQDLSGRPHLSCGLSIPTARVCTYDT

SEQ ID NO: 174378 - protein, 233 aa, Triticum aestivum
  unsure (1)..(233): unsure at all Xaa locations
  Clone ID: PAT_TA_68796.pep
EGITLHLVLRLRGGMQIFXKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXPPDQQRLIFAGKQLEDGXTLADYNIQKESTLHLVLRLRGGMQIFVKTLTGXTITLEVESSDTIXDNXKAKXPXQGGXFPPDHXRLXFXXGKQLXDGXXXTTFEVHPF

SEQ ID NO: 174379 - protein, 212 aa, Triticum aestivum
  Clone ID: PAT_TA_68797.pep
GTREGPRPPDPATYSAIPFRCRRGDDRATELSFLFRMASTAEVVLSIKDSFLALPTKTGDRALEEVEKNISSLRQVLSGDGEAGANQEQVLQIALEICKEGVLSLFVQNLPSLGWGVRKDLVICWCILLGQKVDENYCCVKYIEDHVELLDFLVVCYKKSDLALNCGIMVRECIKHPTLAKYILESNSFELFFEYVELPNFDIASDALNTFK

SEQ ID NO: 174380 - protein, 96 aa, Triticum aestivum; identical to SEQ ID NO: 117442
  unsure (1)..(96): unsure at all Xaa locations
  Clone ID: PAT_TA_68798.pep

SEQ ID NO: 174381 - protein, 58 aa, Triticum aestivum
  Clone ID: PAT_TA_68799.pep
VVERVERQVLLLLFDREINTAAAAAVCVCLSFHFFFPFCSQMFFLLLIVVEKFGLHIL

SEQ ID NO: 174382 - protein, 173 aa, Triticum aestivum
  Clone ID: PAT_TA_68800.pep
DLRCEGLLPLLTRGQLSNLKVKGSPNFFGGWDPNPMRGMTESKLQNLETDDIEGLLDAPVLCSLLSSSLTSLDFIGNHETTRFTKEQEEAFQRLTSLQELWFWGCDKLEHLPAGLNKLTNLKRLWIWWCPALRSLPNGGLPSSLRELDVNRCDNEELTKQCRRLMGTIPKIIL

SEQ ID NO: 174383 - protein, 59 aa, Triticum aestivum
  Clone ID: PAT_TA_68801.pep
ESLSDSMHDFGHGMSSMLIFALNLLKCHDIVSHYGFVCYELASTFHVLTWHVMPDFRKV

SEQ ID NO: 174384 - protein, 118 aa, Triticum aestivum
  unsure (1)..(118): unsure at all Xaa locations
  Clone ID: PAT_TA_68802.pep
AXNSARGRVTVRDRISVRPSAFDRLLGPGAPASDNSNQAANGDRGLVAASRTDPPMIGVDGKDKEEKVLVSTPHLPASEIVVGPGAGLMVETETCVVAQNFEERGVPLQGDREQSNSP

SEQ ID NO: 174385 - protein, 194 aa, Triticum aestivum
  Clone ID: PAT_TA_68803.pep
SQHSGHRRRISSQGGHSNGGGGSSGRVSDAPQPHQQAVAARVRRLPRSVGRRRPRVCTTNGVGTSRRSRGLAIAPLALVARDGGGSRWGGGGGDGDLIRERGRDLGGLIRERRGDLVADTRSTRAPRSGQLDGAARIEARTRVLARKPAVTPWPRSRLVDLGDEGEGRGCVAETRSAVVGGGGDGGNRGRGRKA

SEQ ID NO: 174386 - protein, 139 aa, Triticum aestivum
  unsure (1)..(139): unsure at all Xaa locations
  Clone ID: PAT_TA_68804.pep
IAFTKVPVILSSYNFIYRTFNNFTQPTHVFLYWRMKIHFVHPMMKIYFVQSMMTIPWRMTTHFVHPKVDDPCASGKKRYTPATLDSAEHGRGWNCACVGCYMNRKNFQPRRVSGLRGYSYCLSAGEGRRGAGEXXGEXL

SEQ ID NO: 174387 - protein, 120 aa, Triticum aestivum
  Clone ID: PAT_TA_68805.pep
GKLVDIMLSEKEGSTNIMVVAVVGVGGIGKTTLAHKVFNDEALNNVFEKTIWLSINKDFDEVELLRTIITQAGGVHGGNKALAVLQPILVTTLKGKKLFLVLDDVWNHGVWDDVLKTPLA

SEQ ID NO: 174388 - protein, 205 aa, Triticum aestivum
  Clone ID: PAT_TA_68806.pep
ANSARGQFLKLVQSFGMYAIVRIGPFIQGEWNHGALPYWLREIPHIIFRANNEPYKREMEKFVRFIVQMLKDENMFASQGGHVILAQIENEYGNIKKDHITEGDKYLEWAGEMAISTNIGVPWIMCKQSTAPGVVIPTCNGRHCGDTWIMKDENKPRLWTENWTAQFRAFGNDLAQRSAEDIAYSVLRFFAKGGTLVNYYMYYGG

SEQ ID NO: 174389 - protein, 86 aa, Triticum aestivum
  unsure (1)..(86): unsure at all Xaa locations
  Clone ID: PAT_TA_68807.pep
LSTNYAEDTNTGRCSSSTFLTSWERCYCPYHGLVDHHFTSTGPSPTSAPASRRRRPHRGTPRASSRSAPWPPGPTASRTXPDXPGT

SEQ ID NO: 174390 - protein, 99 aa, Triticum aestivum
  Clone ID: PAT_TA_68808.pep
GTRGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 174391 - protein, 215 aa, Triticum aestivum
  unsure (1)..(215): unsure at all Xaa locations
  Clone ID: PAT_TA_68809.pep
GNHKQXTKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENVNSQPFMRWR

SEQ ID NO: 174392 - protein, 40 aa, Triticum aestivum
  Clone ID: PAT_TA_68810.pep
GRITYTYVETKGIPLQPLILHFWPPQVAFSNASPTTISNL

SEQ ID NO: 174393 - protein, 87 aa, Triticum aestivum
  unsure (1)..(87): unsure at all Xaa locations
  Clone ID: PAT_TA_68811.pep
QAVVTMLDVGKKIKKTPIXVGNCTXFAVNRMFFPYTQAALLLVDHGMDVDKIDQACIEFGMPXGPFXMTDLVGFDVALATGMQYLEN

SEQ ID NO: 174394 - protein, 226 aa, Triticum aestivum
  Clone ID: PAT_TA_68812.pep
MSLQPIGGNATLRNKTEVIYAGGPDVHGVPATPTELVWLPDRNTPDLVYYQSVYEAKMGWKVQVVDGGLSDMYNNSVLLDDQQVTLFWTLSTDSISIAARGEKKSGYLAVAFGSGMLNSYAYVGWVGNDGVGRVKTYWIDGKSAAGIHSTSENLTYVRCKSEDGVITFEFTRPLKPSCTGKVECKNIIDPTTPLKVVWAMGASWSGDDLTDSNMHSVTSSRPIRVL

SEQ ID NO: 174395 - protein, 197 aa, Triticum aestivum
  Clone ID: PAT_TA_68813.pep
PSSRLVRWFSGAMRDLRRSHGRVQKLLGDIIVERKNMKENASASAGTKDNEDLLDVLLRLQNEDTLSFPLTSEIIGTVIFDIFAAATDTTAATLEWAMAELIRNPKVMARAKLEVRQSLAQGQPTVTSTDLGNLQYLRMVIKETLRLHPPVPLIRRATQDKCQVMGYHIPKGIHVMINVFAVGRDPSHWGEDAAEFR

SEQ ID NO: 174396 - protein, 233 aa, Triticum aestivum
  Clone ID: PAT_TA_68814.pep
PHGLANFRCPQCGVDLAVDLSKLQNFLTAASNGAPPASVPVPPTFLPVLPPGTPQLPQLVAVTTTVPIGLPTTEPPEEINEVAIDVERDEDEGGTVGETFTDYRPPKLSLGLPHPDPVVETSSLSAVQPPEPTYELNIMDELDQTKTLSCLQIETIVYACQRHLHHLPTGDRAGFFVGDGAGVGKGRTIAGLIWENWQQGRHKAVWVSVGSDLKYDARRDLDDVGAKCVQVHP

SEQ ID NO: 174397 - protein, 212 aa, Triticum aestivum
  Clone ID: PAT_TA_68815.pep
QKVVDILVKVVESEGSTLASIAMESLGHIGLRCALPSISRNSSAAGVLTVLHERLTKPLSENDTKAIQKILVSLGHISWNELSFSHLKIALDLIFSLARSKVEDVLFASGEALSFIWGEVPVTADVILETNFVSLSQATNFLTGDAPLLDSRNFGKRSSCEEARTTAQEEIINKLFDTLIYSSRKEERCAGTVCLVSLTMYCGRHPKILELL

SEQ ID NO: 174398 - protein, 177 aa, Triticum aestivum
  Clone ID: PAT_TA_68816.pep
AVGVPAAVPRTPLSRAREGAGGCILDLPSTAAAAAARYPALVPRGGAGCFTGTVFDVVSRGGIRGGEGTLWLSGDAMASSGLRHGCLVSVSLISSSSNSLDEFPLDSLFEECTRFFDLDVDNDLISNEAGGNFVTAKVFPSCEVQKNGIKLSWDLACILQWFFIVLGSSHCKISIGR

SEQ ID NO: 174399 - protein, 114 aa, Triticum aestivum
  Clone ID: PAT_TA_68817.pep
ASHQLSMMMMASHHHRRHHTDSSCGSFAPPSSHNGTAWPPSSFLHCRPSSRMESIVPKPTPSQRRSPWTILLWMTSSRHRPPHHHHLAASHRNRPPAASRRQRPPPHADVLHVT

SEQ ID NO: 174400 - protein, 196 aa, Triticum aestivum
  Clone ID: PAT_TA_68818.pep
RNSARGAPPAAGGGAAADCRVSYTQGLYVFHVMRADGLTALCMTDDDATAASGRRIPFAFLEDIHGKFVKTYGRAALTALAYAMNDEFSRVLSKQMDYYSNDPNADCITRMKGEMDQVRSIMIDNIDKVLERGDRLEMLVDKTTTMQGNTMRFKRQARRFRNTVWWRNVKLTAAVILILLAIIYIVLAYMCHGFTL

SEQ ID NO: 174401 - protein, 168 aa, Triticum aestivum
  Clone ID: PAT_TA_68819.pep
ANWCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNVSLQNLLTYPFVKEGVSNGTLKLVGGHYDFVSGKFETWEQ

SEQ ID NO: 174402 - protein, 182 aa, Triticum aestivum
  unsure (1)..(182): unsure at all Xaa locations
  Clone ID: PAT_TA_68820.pep
GIRHEAAPCESDLTRVPPTPLASSSSSPSPSRSPSPPPCPPPPLISPYSGAPSHXPPHPSAHGFRRNHSRPPPLLSSPRFLQISRSGVGEANTSADATEMDEAATGAGEPWVAERRKGGTLSCISRKAILLVARAMQAATSASECRSLAAGALVPVVQEPGSGSVGARTTVSQVKTWECIWN

SEQ ID NO: 174403 - protein, 35 aa, Triticum aestivum
  Clone ID: PAT_TA_68821.pep
FFFSQSIIILATEWQYNSLATSCNVVKVQYYKYFQ

SEQ ID NO: 174404 - protein, 44 aa, Triticum aestivum
  unsure (1)..(44): unsure at all Xaa locations
  Clone ID: PAT_TA_68822.pep
MADWGPVIAATVLFVLLTPGLLCTLPGRGRVAEFGSMHTSGLSX

SEQ ID NO: 174405 - protein, 144 aa, Triticum aestivum
  Clone ID: PAT_TA_68823.pep
TDASSDRRRLLRPLILCRPMVSTPEALLLVGCCPHGCELSPLLLFCPTGSPPTALPSSVAALYAHSRNCGTRRRFSALEDQGKALLCIGSGILSLPMIGSGEICHLLLSSMCSSSTSPRMATKTSRRPLPHSCLPRELTLSPCR

SEQ ID NO: 174406 - protein, 276 aa, Triticum aestivum
  unsure (1)..(276): unsure at all Xaa locations
  Clone ID: PAT_TA_68824.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRXIFAGKQLEDGRTLADYNIQKESTLHLVXRLRGGMQIXVKTLTGKTITLEVESSDTIDNVKAKIQDKXGXXPPDQQRLIFAGKQLGXXAGPXADYNIQXEXTXFTLVLGLXXGMQIXXEXPHXGRPSLWEGXSSETXXNXKAKIQDRXXFXPDQQXLI

SEQ ID NO: 174407 - protein, 166 aa, Triticum aestivum
  Clone ID: PAT_TA_68825.pep
EFGTRLYPPRLPPLLIPILKLSSSESSPSLSPAVLLAGVDLLRPIAGDSACRSWSGPPFRKKMSDEGSCAADTGDEKLLTDSEDSAQSGVRPLPQAPTSCMSIKHVVEVIQTFNEYKRFLVKSIGFGGMLDLQMLQKLNFKFSAWTMSKVSTTCGPSSWLRTKCCH

SEQ ID NO: 174408 - protein, 67 aa, Triticum aestivum
  unsure (1)..(67): unsure at all Xaa locations
  Clone ID: PAT_TA_68826.pep
MGAGEEDAAAAWKEAKEXRIMXSXRXRPLNGRESGDSSDWEXISPTTVMFXSTVPDXAMFPTAYTYX

SEQ ID NO: 174409 - protein, 138 aa, Triticum aestivum
  unsure (1)..(138): unsure at all Xaa locations
  Clone ID: PAT_TA_68827.pep
QSLERRCLDVDAVQEGDLALHIQLLQRRGSDDDVLVLTDKKIIPEPEHAQPRTAGEQVREDGAAAREGEPLQRREPLPAAWLVGEGEIQPLQLHRXGAREAGHDHFDVLEWRVFPDGEAELHWQERRGGVEQIGDAXR

SEQ ID NO: 174410 - protein, 71 aa, Triticum aestivum
  unsure (1)..(71): unsure at all Xaa locations
  Clone ID: PAT_TA_68828.pep
DLNFLDYLMAHTWITNSFAWPRSGWMWTPHAPAEDPMRAGGAVNRHMGSCQRRSCREXVQGKAPXPPPPHG

SEQ ID NO: 174411 - protein, 58 aa, Triticum aestivum
  Clone ID: PAT_TA_68829.pep
AQKLHPVNLHSLKMILMEHPDETLSVAYPFKPRHRGAKGKGREIKSRVGEGLEIAMDG

SEQ ID NO: 174412 - protein, 57 aa, Triticum aestivum
  unsure (1)..(57): unsure at all Xaa locations
  Clone ID: PAT_TA_68830.pep
PGIKHQVPARSXAHGEEGTSGTGRAESGQGKRTASARLAIGLVPVRSVSEGVERVVA

SEQ ID NO: 174413 - protein, 82 aa, Triticum aestivum
  unsure (1)..(82): unsure at all Xaa locations
  Clone ID: PAT_TA_68831.pep
MRRFNPFGGKVQTGVEGRTIDVRNVKITVRNAIAQGGFSCVYLACDALHSSKQYALKHIICNDSESLDLVMKEIQXMNLLKG

SEQ ID NO: 174414 - protein, 79 aa, Triticum aestivum
  unsure (1)..(79): unsure at all Xaa locations
  Clone ID: PAT_TA_68832.pep
GRXLARSAVMRVSPGLSSFAADTARAGESLRPLLEFAKDKVGGEGAAAATEVRLMATAGLRLLXESVREAILVSCRNAL

SEQ ID NO: 174415 - protein, 73 aa, Triticum aestivum
  unsure (1)..(73): unsure at all Xaa locations
  Clone ID: PAT_TA_68833.pep
TVSATLNRTVSSGISGASYYTGTFNTVNRSPDGSYVAVSSRXNFFLTWEXGQLYXXXHNRAVARRIQNMGWRA

SEQ ID NO: 174416 - protein, 98 aa, Triticum aestivum
  Clone ID: PAT_TA_68834.pep
MATNGGGGRCAGSDLNFVESVAHSTLRRSPTALPRSPTAPVLGFLATVDISPATERSSTSKVAASSSPPPMTFFHGRQHHWPRSGRQILHRATTSPLA

SEQ ID NO: 174417 - protein, 225 aa, Triticum aestivum
  unsure (1)..(225): unsure at all Xaa locations
  Clone ID: PAT_TA_68835.pep
GGLLKWYNEKMEAPHEQLCLQMCFKDQHQFREALLNLHITQGRNFKYHRNSDQRIIVECNQKHCNFFMVAAVIKGETTFVIKKMRIKHTCPISTETTRVSAKWLAQKYESLFRSDLTTGIQTLIDACMEKYGVDVPKSMAYRAKNLAIDDVLGDHKKQYPRLKDYAQTVMDTNPGRRVVVTTVTPTPTEKIPHPGPRFHAMFYCINGAREGFLKGCRPFIXVDGC

SEQ ID NO: 174418 - protein, 206 aa, Triticum aestivum
  Clone ID: PAT_TA_68836.pep
LKEKKKKGVVADPDDEDEDDSDDESDEDEAVAAASRRVDRRVLQVIRRIRSGDSAIFDKDAKVYSSSSEDEDDAEGEPKEGKKAKKERPLYLKDVNAQHLLEEGPEFAAQAGRGSKYDRIAYNELQREGLKEFLEAEKKALGDGDDEEDDLFKAKQAEGDGGDSEEDEDEKQTEELLVEVFGDDDKLDENEKFLKNYILNRPYLEP

SEQ ID NO: 174419 - protein, 216 aa, Triticum aestivum
  Clone ID: PAT_TA_68837.pep
PRCRFGTGSRLLILLLCFIIVIFSGEAAPTTLVTSLPGFDGALPFRLETGYVTVDDEHGSELFYYFIESEGDPRRDPVLLWLTGGDRCSVLSALLFEMGPLRFVIEPYDSAAGTVPRLHYHPYSWTKAASVLFVDSPVGAGFSFSRDPRGYDVGEVSSSLQLKMFLTKWFTQHPDFLSNHFYVGGDSYAGKYAPIVTQKISEDIEAGVKPTINLKG

SEQ ID NO: 174420 - protein, 180 aa, Triticum aestivum
  unsure (1)..(180): unsure at all Xaa locations
  Clone ID: PAT_TA_68838.pep
RASNTPSLQHHHARXARSRACVDTRATLAPAASLILLPQTATAPSLSTGPRTRSPSTSPTSLLLPFFSSLTSAAALASSLNLFAAAPLPRPNYCCYSFSPMKLLQLHSPAPPLLILCSEPQDAAATSSSLNPNSTVCCSSFFAAASSSHAPCCFSPHAPAAAPFPIFLLFSLSLSLSLSL

SEQ ID NO: 174421 - protein, 33 aa, Triticum aestivum
  Clone ID: PAT_TA_68839.pep
GLKATNVYTSATSRPVELSLRKISTSLFPPLKH

SEQ ID NO: 174422 - protein, 61 aa, Triticum aestivum
  unsure (1)..(61): unsure at all Xaa locations
  Clone ID: PAT_TA_68840.pep
LLARTSCSMGPTTTTTDALVFQVPTAPRYRRACGIKLPQNQHRRSCIATPAVSMPAASQLX

SEQ ID NO: 174423 - protein, 96 aa, Triticum aestivum
  Clone ID: PAT_TA_68841.pep
MGGSTNVKEWWPAVFMVLVQIFTTGLVLLTKVVVDSGSLAWTLLTYRFFLGAILTVPLAMFFEKGRLKELKLKAFIWIFTSALVGFTIPGLYYIGL

SEQ ID NO: 174424 - protein, 65 aa, Triticum aestivum
  unsure (1)..(65): unsure at all Xaa locations
  Clone ID: PAT_TA_68842.pep
APCSINIQQFLWRLAHESXSLRVELDQICPVCNRFDEDGGDLFFKCKPVRKIWQELGIEEVRQQC

SEQ ID NO: 174425 - protein, 89 aa, Triticum aestivum
  unsure (1)..(89): unsure at all Xaa locations
  Clone ID: PAT_TA_68843.pep
RNSXRGFDVLLYLAFXHLDPSSERTRTRHVRNGXSRLWFLGXFVLELAFCEFFLQRYPRESPGPMRERVFALIGKKXLPKWIKAASLHN

SEQ ID NO: 174426 - protein, 71 aa, Triticum aestivum
  unsure (1)..(71): unsure at all Xaa locations
  Clone ID: PAT_TA_68844.pep
GFGGRFGDQIGGSLEPQGRCRSMMRWCLRSKLHDWAAGAVPDRSIMLHTYIVQFVAGSVIPNXFDFGSTLA

SEQ ID NO: 174427 - protein, 84 aa, Triticum aestivum
  Clone ID: PAT_TA_68845.pep
MDSEHWISRLAAAKRFYAAQLGHIDDMSGMGMEEVDMDMEDDLGSLCVHLEEDHPYEPHPAPCPICSEKITRDMLNHITMHHGY

SEQ ID NO: 174428 - protein, 82 aa, Triticum aestivum
  Clone ID: PAT_TA_68846.pep
GFHATCKMFSIGQQHITCGALGLLPTSYRHKIYNFVMPSLLLLEGGYSMWFFAPIFYLYALRKSSLCFVDGILILSCVPIYN

SEQ ID NO: 174429 - protein, 46 aa, Triticum aestivum
  unsure (1)..(46): unsure at all Xaa locations
  Clone ID: PAT_TA_68847.pep
TLLEATKVPLSSWTFIYSQNSLXFLLNRIFFRITPTMALLRCNTLF

SEQ ID NO: 174430 - protein, 103 aa, Triticum aestivum
  Clone ID: PAT_TA_68848.pep
TCFLHITALRMNKMLSTDCLGTQEFHTFHKTTEILEDSQPQEIAFHETALGSTLVDHQNVHSTAAVSAVDIGMAEVSLLHGESDTSATGLLPVSFLSCSPRSM

SEQ ID NO: 174431 - protein, 122 aa, Triticum aestivum
  Clone ID: PAT_TA_68849.pep
MSVQAEGAAGAERIAPRDSLYGDAEKVSDDKHHGFAAGWWQTLQLAFQSIGVVYGDVGTSPLYVYSSTFPGGIRHPDDLLGVLSLILYTLVLLPMLKYVFIVLYANDNGDGGTFALYSLISR

SEQ ID NO: 174432 - protein, 147 aa, Triticum aestivum
  Clone ID: PAT_TA_68850.pep
MKVTAFLPGVCGLALLLLLPLHAAGVESRGPLGGYHWYTMFMFGDSFADTGNLPRTSCRSSLSRQWHYPYGTFNGSRSGNPLGRFSNYLVQPDIIARMLGRLVGPPAYKRMVKHYCDPSGMSFAVGGSGVFEVPENLTTLSKQIDNF

SEQ ID NO: 174433 - protein, 204 aa, Triticum aestivum
  Clone ID: PAT_TA_68851.pep
GASAGASGGSKMDGSSQLSSSGSRYLLKTEMDSTPLPNERRERHGGLDKERVLVKGNKAHISEDMQPGTLSPVTKGKATRAPRTSSLVGIHSSSTLLRSAGGIDEWEEAPCTNKASPLGSTTNRKRPMAATASSPPVAWVGQRPQKMSRTRRANVVSPVSNFDEPVSEGSPVDVAVRPALETPGLLLPRGAASNNSQAASRMDN

SEQ ID NO: 174434 - protein, 79 aa, Triticum aestivum
  unsure (1)..(79): unsure at all Xaa locations
  Clone ID: PAT_TA_68852.pep
CRXIYISDIXHTRETFWXXRIXIGQPIYLPIADSVNVTXPVIISNGITTLGAKPDTAPCNANIRYGVVLKWGNIVMYHP

SEQ ID NO: 174435 - protein, 77 aa, Triticum aestivum
  unsure (1)..(77): unsure at all Xaa locations
  Clone ID: PAT_TA_68853.pep
IRSNXXKHRYLGGAGDGXGXLLPTARGASSQAVHAVQPGHSSRRRSDRLRGAEVREDSRRRRRLLRARQVXXPXQDP

SEQ ID NO: 174436 - protein, 84 aa, Triticum aestivum
  Clone ID: PAT_TA_68854.pep
EVQGSSRWKPALCVILVELFNTGTILLGKVALDGGMFVFSLLCYRSILAAIFIMPFALFFESGKWRELDMKTLGWLFINAFIGY

SEQ ID NO: 174437 - protein, 39 aa, Triticum aestivum
  unsure (1)..(39): unsure at all Xaa locations
  Clone ID: PAT_TA_68855.pep
KDCRFLLNINLRGARVRPACDGXACALXELXXLLLLSXQ

SEQ ID NO: 174438 - protein, 305 aa, Triticum aestivum
  unsure (1)..(305): unsure at all Xaa locations
  Clone ID: PAT_TA_68856.pep
DEERLIFAGXXLEDGRTLADYNXQKESTLHLVLRLRGGMQIFVKTLTGKTITLEVESSDTIDNVKAKIQDKEGIPPDQXRLIFAGKQLEDGRTLADYNXQKESTLHLVLRLRGGMQIFVKTLTGKTITLEVESSDTIDNVKAKIQDKEGIPPDQXRLIFAGKQXLEDGRTLADYNXQKESTLHLVLRXRGGMQIFXXTLTXKTITLEVESSXTHXXNVKAXIQDKXGIXPDQQXLIXAGKXLEDXRTLADYIIXXESTLXLXLRXRXGXXIFXXTLTGKNIXLXVEXXXXFXXXRAXIXDXEGXP

SEQ ID NO: 174439 - protein, 195 aa, Triticum aestivum
  Clone ID: PAT_TA_68857.pep
KLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENVNSQPFMRWR

SEQ ID NO: 174440 - protein, 215 aa, Triticum aestivum
  unsure (1)..(215): unsure at all Xaa locations
  Clone ID: PAT_TA_68858.pep
GIRTRVPGRAVWXSFDWPTDTLLPSQTLXKDKKLVAGYYALYYDNDNVLRLLYDGPEIASIYWPNPDHNVFDNGRTNYNSSRIGVLDDTGVFLSSDNLRVEASDLGAAGVKRRLTIEQDGNVRIYSLNAAGGWTVTWAAVKQPCSVHGLCGKNALCEYQPSPRCSCAPGYEMVDRRDWRKGCKPXRSASPPAPPTCSEAPASERFTFVQVAATDF

SEQ ID NO: 174441 - protein, 147 aa, Triticum aestivum
  Clone ID: PAT_TA_68859.pep
LSTSLSLSLNPCTHMSISLSSLLCLANTLSTQSSWLLASCCSSTHHTHYHGPPQERPGVQAGHWIVHPRHGQHHLGELPLTGRLPSRAAALQHQPRFMASPTAVSSPANLPHVTLYLARSVLLLDPGLPRYALAALLVARTAVTATP

SEQ ID NO: 174442 - protein, 199 aa, Triticum aestivum
  unsure (1)..(199): unsure at all Xaa locations
  Clone ID: PAT_TA_68860.pep
GQALFTAECSHMFHFHCISSSVKHGNYVCPVCRAKWKEIPFNRSLSSIVPRGRSGLNVNQARLPQQDAYMALLRQVPTRQREAPALHTSEPVEFNDDEPLQLMEAADNCDVRSSKTVEMKTYSEFSAIPQSSSQDDFAVLIHLKAPCANPEQITSRPVNAXSVGYPTSRAPVDLVTLLDVSGSMAGTKLALLKRAMGFV

SEQ ID NO: 174443 - protein, 74 aa, Triticum aestivum
  unsure (1)..(74): unsure at all Xaa locations
  Clone ID: PAT_TA_68861.pep
LAVYDELIGPXERRHGDLGPQPPALHARRNARRGPPAPQAPSLRLLRRDSRRRPRRRARRGHWERFPLPHPRHR

SEQ ID NO: 174444 - protein, 34 aa, Triticum aestivum
  unsure (1)..(34): unsure at all Xaa locations
  Clone ID: PAT_TA_68862.pep
TFLXXGMLLAMIXLLRDDXTQHGNWDYGDTKCTG

SEQ ID NO: 174445 - protein, 103 aa, Triticum aestivum
  Clone ID: PAT_TA_68863.pep
LMSADDHLPSAAAPPSPLSSLLLPPLLPSLFSLRHIPSLLQGQIHGPVIHEVTAAWWSRGTARRERRGSQGRRSGRRSGGSDSRPEDLARRWISSVANLLVLR

SEQ ID NO: 174446 - protein, 189 aa, Triticum aestivum
  Clone ID: PAT_TA_68864.pep
SHRADKPCGLAFAADQFDADHPKERASRSSLFNWWYFSMAIGISVAVAVVSYIQENVGWGIGFGMLCAIMLCAFAVFLSGTPTYRLYAPTPGAESPFARLGRSLVGLGRSSSFFHTKGYQDEDVAAKSEEARGVLRLLPIWAACLAYGVAYAQIMTLFNKQGRTLDRRVFGGLELPPAALQTLGPASIL

SEQ ID NO: 174447 - protein, 118 aa, Triticum aestivum
  Clone ID: PAT_TA_68865.pep
APLHRWPLRHVAVISQGVHTSHGPAGDRTVSLHIPFPVLTPHLPLCGRGDGTVGEMGQQAPSSLPAAFPDHHRPPLSLALPAISGAPIPRSPPPVSPCYKCSLLPRALSLLTLAACLS

SEQ ID NO: 174448 - protein, 36 aa, Triticum aestivum
  unsure (1)..(36): unsure at all Xaa locations
  Clone ID: PAT_TA_68866.pep
RCKPPRHLSDXXGFVSXEAGLEEREAXSEVPRRHFR

SEQ ID NO: 174449 - protein, 141 aa, Triticum aestivum
  unsure (1)..(141): unsure at all Xaa locations
  Clone ID: PAT_TA_68867.pep
QFQFTVIMGGVCSRKRSQLVEDDDDSLQTPTRFSKTSSLKWLLLTLPRSSSDISRKGPGKGPGRCPTLMELCVAKVCKDISKYSTFAMLPSDLSQQVFDELVDSNCLTEESLETFRDCALHXKDICLGEYPGVKDAWMEVV

SEQ ID NO: 174450 - protein, 107 aa, Triticum aestivum
  Clone ID: PAT_TA_68868.pep
AATGGEDVPPRRDHRRPRALPRHQHDQPILVLGRERHAHVPSPASTSGDGRASQVSFYAVKSGYPELNPQLPVAPTDPAAAESHHWIRAPSEWGDRPPDCAGSETRG

SEQ ID NO: 174451 - protein, 144 aa, Triticum aestivum
  unsure (1)..(144): unsure at all Xaa locations
  Clone ID: PAT_TA_68869.pep
LXXVPDXXXGXSHAEQXNXWXRQLVEAXXQRTKHWSELGCCTSSSSGWWCPSDGDLHTWMQRRRSRHVFDHHLLMVSYDEEGSXWVVVAGCEAGVAGSDSSRGRMARHGGSSEMSAHRQLGRGRSSKRQAQXXSWKXAXVAXGG

SEQ ID NO: 174452 - protein, 108 aa, Triticum aestivum
  Clone ID: PAT_TA_68870.pep
ERFGLARDVLAGMVLDGGGRVSVASVRGSAPVTTDTTSSELAWPRVGAGSPAAVGSLVSRVPPSSPGLASDTGVSASYDGGADPDSGTDVGLGVDGVSSLFLSWLSAL

SEQ ID NO: 174453 - protein, 76 aa, Triticum aestivum
  Clone ID: PAT_TA_68871.pep
MSSLERAVSEDAGDARGLLENFQVELVAVVPPADHLVIVVLLFVIGHEQDVGTNLVQTAADGLQESCGCSIVRPYP

SEQ ID NO: 174454 - protein, 74 aa, Triticum aestivum
  unsure (1)..(74): unsure at all Xaa locations
  Clone ID: PAT_TA_68872.pep
PALLCYICSPPWYTLLPPIHPSIHQPPLLASHPHYSPPSPTTTTAAAAMASNNTTNAGXEVSNXITDXNDHLAT

SEQ ID NO: 174455 - protein, 159 aa, Triticum aestivum
  unsure (1)..(159): unsure at all Xaa locations
  Clone ID: PAT_TA_68873.pep
TKXFLPRRTGDLVITYDVVQAYPTSYLALVTLENNAKLGRLDNWRLSWEWRRGEFIYSMKGAHPLEVDVNECIYGAPGQYYQSLDFSQVLNCEKKPVILDLPLSRYNDTQMGKIEHCCRNGTILPXSMDAAQSKSAFQMQVFKMPPDTNRTKLXPPANF

SEQ ID NO: 174456 - protein, 87 aa, Triticum aestivum
  Clone ID: PAT_TA_68874.pep
TRSTSSYKYAHFIIVSLVVVDYLVNIIPFLGHCMKNKNTYITELLVIFYRKLVQLGASNVLSSISLQLPLITRCWVFSSMKLLFSLI

SEQ ID NO: 174457 - protein, 159 aa, Triticum aestivum
  Clone ID: PAT_TA_68875.pep
SQPGPQRRGGIPPCAGCHIKDEKNHTTPSKTAATPCGSRTGPPASPTTKNLATVDAPRMAMAGPCGCAEEEGAHARLRTASAPRTQPRDASAAAPKPDPLSNGSSRGEDGAGGQIRQARAPPTEGLASPDEERPATALLGHARTSSASLRWRRSSRIWI

SEQ ID NO: 174458 - protein, 71 aa, Triticum aestivum
  Clone ID: PAT_TA_68876.pep
YFEQQLLERCQSEPCASGTGEGGTFVVTICRALSSFSLGLNQLLFDIHLRNLDIHDHPMTLPIICQENKEQ

SEQ ID NO: 174459 - protein, 143 aa, Triticum aestivum
  Clone ID: PAT_TA_68877.pep
FFPSKISRLKQFHHPSVADAKMSNCLLLMSSVTLQLPSPVQPSTCNSTGHSSGCPRVWLRHGPPAVNGDASGRSRCASSQGGGRGSNKCERRRLHPSGRCKRRMTGWEWRDRADGEEALEDERLGGWQREGCEVRRGSRSDLV

SEQ ID NO: 174460 - protein, 71 aa, Triticum aestivum
  unsure (1)..(71): unsure at all Xaa locations
  Clone ID: PAT_TA_68878.pep
CVFLSCLHPGHRSWYTFLTRSNGASRPDPVILMPPAAAAAECYVTLPTPLDVLNPHQDDAWITESTRGXPR

SEQ ID NO: 174461 - protein, 65 aa, Triticum aestivum
  unsure (1)..(65): unsure at all Xaa locations
  Clone ID: PAT_TA_68879.pep
HEVSLACPGXSSLFRYALMAFVIQSQEKIDRKMGMLEMLGWSQDDVLTAVRKMPCILTMSEERMQ

SEQ ID NO: 174462 - protein, 201 aa, Triticum aestivum
  unsure (1)..(201): unsure at all Xaa locations
  Clone ID: PAT_TA_68880.pep
MPVYKDLHFNHDLSATKKLQAGVDLVARLVGVTLGPKGRNVVLANKYGPPKIVNDGETVLKEVELEDPLENLGVKLVRQAGARTNDIAGDGCTTSIILAQGLIAEGMKVLAAGMNPVQIARGIGRTADALVSELKLMSREIEDHEIAHVAXAVSAGNDYAVGNMISDAFKRVGREGMVRIENGRSTVNSLEVVEGMQFERG

SEQ ID NO: 174463 - protein, 214 aa, Triticum aestivum; identical to SEQ ID NO: 174113
  Clone ID: PAT_TA_68881.pep

SEQ ID NO: 174464 - protein, 74 aa, Triticum aestivum
  Clone ID: PAT_TA_68882.pep
MGKTRGMGAGRKLKTHRRNQRWADKAYKKSLRNGYHIQGRQQARKLPNPDTGRYARVQLVKNGKKIAAFVPNDG

SEQ ID NO: 174465 - protein, 142 aa, Triticum aestivum
  Clone ID: PAT_TA_68883.pep
MADASAGNNAGSTSNAEVQIQIPVGPPKAEPGAPSKNSGAKNWRWWMMVSVDVFFVVAGQTSTTLLGRYYYHQGGSSKWISTFVQTAGFPILFLALLCFPKSSGGGGANGDGPVAKVAVIYVVLGLVIAADDMMYAGGLKYL

SEQ ID NO: 174466 - protein, 162 aa, Triticum aestivum
  unsure (1)..(162): unsure at all Xaa locations
  Clone ID: PAT_TA_68884.pep
APTVMASSAXSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIA

SEQ ID NO: 174467 - protein, 83 aa, Triticum aestivum
  Clone ID: PAT_TA_68885.pep
CATLLNLFLKPFLLCRCNCIHKLKHRQKDWCALRLRLRLITMTGHWCARTQLMAKDTRKKVKKERPPTRRCGAGRRGSPAGRR

SEQ ID NO: 174468 - protein, 70 aa, Triticum aestivum
  Clone ID: PAT_TA_68886.pep
MEPPFAKENILLLKAVSRVRSYYGGPEYVCPVCHASFWFLEGCKTYAAGGGRLPVYSGCCKGGKVSLPSF

SEQ ID NO: 174469 - protein, 208 aa, Triticum aestivum
  Clone ID: PAT_TA_68887.pep
ELFLEAALGLYCGKVNKPDRLKALLLLARSIEADPSTVILWVFYLHIYYQKDEGLGKDDMFSHAVQHNVYSYELWLMYINSRLRFDDRLDAYNDALSMLCQMPADTDNELKDRSAFILDIFLQMIYFLCMSGNVDKAISRIYGILPAATADCSGEKLLSDAISCLTVSDRCIFWISCLYISIYRKLPEEICDQLEFPKDIPRMLVWHP

SEQ ID NO: 174470 - protein, 44 aa, Triticum aestivum
  Clone ID: PAT_TA_68888.pep
VRRGELHDLPVVPTGRSLPGATLVRLHLPAASGAERSRGFSRGR

SEQ ID NO: 174471 - protein, 176 aa, Triticum aestivum
  Clone ID: PAT_TA_68889.pep
EEGGEEELMLIGASFFLVGAILNCAAVNIYMLVIGRIFLGFAVGFTNQSAPVYLAEIAPARWRGAFTSIFHFFLNVGMFVADLVNYRANTIPGWGWRLSLGVGIIPAVVILVGAVFIPDSPNSLVLRGKVDEARHSLRRIRGPAADVDVELKDIMRAAEEGGRHKSGAFRRILLRE

SEQ ID NO: 174472 - protein, 185 aa, Triticum aestivum
  unsure (1)..(185): unsure at all Xaa locations
  Clone ID: PAT_TA_68890.pep
REGISIIPIVGLGGLGKSTLAEXVFVDKRVNDFEVRAWVHVSKEFDLRKIGSAILKSINSSINLDNCSLQFLQENLKKELAGRRYLIVLDDLWEEDGDKLERLKQMLQHGRKGSRVIVTTRNQSVVNKLSTGVLAHQRKFCPVPNSDQINLFVLSTDECWEVMKQTAFGPDDDKSDLEEIGREIA

SEQ ID NO: 174473 - protein, 154 aa, Triticum aestivum
  Clone ID: PAT_TA_68891.pep
RNSDEGSSSEEGGGDPGTAGMQGYSDTINSASRVVWLGSLVFFNLRSAGKKALYGSLWVLAAAKLVQRFVTVELGKRSFAYGKNPQLIASYMTQMLKLQGEAAGSDVLKGCNYAVIGEEELKKKAGPKGYKLDELEKAISEADSSVVTVGKIWA

SEQ ID NO: 174474 - protein, 139 aa, Triticum aestivum
  Clone ID: PAT_TA_68892.pep
GNNRSVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQL

SEQ ID NO: 174475 - protein, 269 aa, Triticum aestivum
  unsure (1)..(269): unsure at all Xaa locations
  Clone ID: PAT_TA_68893.pep
MQIFVKTLTGKTITLEVESSDTIDNVKAKIQDKEGIPPDXQRLIFAGKQLEDGRTLADYNIQKESTLHLVLRLRGGMQIFVKTLTGKTITLEVESSDTXDNVKAKIQDKEGIPPDQQRLIFAGKQLEDGRTLADYNIQXESTLHLVLXLRGGMQIFVKTLTGKTITLEVESSDTIDNXKARIXDKEGXIXPDQXRLIFCWQAAWRTAAPLADYNIQKEXTLHLXLRLRXGMXIFGKTLXGKNITLEVEXSDTIDNXRXXSXEXEGISPD

SEQ ID NO: 174476 - protein, 51 aa, Triticum aestivum
  Clone ID: PAT_TA_68894.pep
GHPILSVLSTYGRSRTWTHMVMTPRSTSTGSPLPSNSAKMSPSRLKCQGCA

SEQ ID NO: 174477 - protein, 167 aa, Triticum aestivum
  Clone ID: PAT_TA_68895.pep
SARGEISQRRDGSWYGSWGICFTYATWFAVEGLVSVGRTFKNSAAIRKACEFLLSKELPSGGWGESYLSSHDEVYTNLKGNRPHGTHTAWAMLTLIDAGQAERDPMPLHRAAKVLLNLQLDDGEFPQQEIIGVFLQTAMASYSQHRNVFPIWALTEYRRRVLLAGKK

SEQ ID NO: 174478 - protein, 197 aa, Triticum aestivum
  Clone ID: PAT_TA_68896.pep
GRDLCTQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLR

SEQ ID NO: 174479 - protein, 144 aa, Triticum aestivum
  Clone ID: PAT_TA_68897.pep
MNPQRKRIPKIEPFKHRVEVDPKFFDKSWKKLDDAIREIYNHNASGLSFEELYRTAYNMVLHKHGGRLYDKLAENLKGHLREMGKLVEAAQGGLFLEELQRRWADHIKALQMIRDILMYMDRTFIPSSKKTPVFEHGLELWRDI

SEQ ID NO: 174480 - protein, 216 aa, Triticum aestivum
  Clone ID: PAT_TA_68898.pep
GDWKQPHHHHQGDETGDLMKPDSEYPPGLLRGGAPATNRRQFQKAIPAPVMSFRQPTADTPMPHHQAQLRFHGRHGGSRPPFNSPGSNPSAADGVASRNQQRSTAIGAAVSRSAVGVYAPTRSIRNPKSTLMTMFYDGAVNVFDVPVDKAQEIMVLAGRASVSSPPSAVQKPDFPAPANTSGFPVPGARKIIIQKPGETMAPHVSVISSPIPVVSQ

SEQ ID NO: 174481 - protein, 103 aa, Triticum aestivum; identical to SEQ ID NO: 107316
  Clone ID: PAT_TA_68899.pep

SEQ ID NO: 174482 - protein, 43 aa, Triticum aestivum
  unsure (1)..(43): unsure at all Xaa locations
  Clone ID: PAT_TA_68900.pep
RERKXLLGYLLLPFLSGKRLILKQPGRSPXRSLLLFLGTTMRX

SEQ ID NO: 174483 - protein, 66 aa, Triticum aestivum
  Clone ID: PAT_TA_68901.pep
LPPDRRSSARASSSPPPRPSDRGGGARRNPSSRRLVAPLLRGNGKWEDEEKGERGPDLAWRNAETG

SEQ ID NO: 174484 - protein, 271 aa, Triticum aestivum
  unsure (1)..(271): unsure at all Xaa locations
  Clone ID: PAT_TA_68902.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIXVKTLTGKTITLEVESSDTXDXNVXAKIQDKEGIPXDQQRLIFAGXSSWRTAAPLADYNIQXEXTLHLVXXXRXGMQXFGKTLXGKTXPLRXESSEHXXXXKGXIQDKXGISPDXX

SEQ ID NO: 174485 - protein, 75 aa, Triticum aestivum
  unsure (1)..(75): unsure at all Xaa locations
  Clone ID: PAT_TA_68903.pep
MATCQAPTSAPELSSSXGRSAXEVRSLKVHSEXERRRRERINTHLATLRRMIPDANQMDXATLLACVVNQVKELK

SEQ ID NO: 174486 - protein, 205 aa, Triticum aestivum
  Clone ID: PAT_TA_68904.pep
GIRRDALIRPLIEIAWLSAPPNPSPWHCRLAAAEAAGGSTIGAGVYVLVGTVAREHAGPALAVSFLIAGIAAALSAFCYAELASRCPSAGSAYHYSYICIGEGVAWLIGWSLVLEYTLGGSAVARGISPNLALFFGGPDSLPWILARHQLPWFDVIVDPCAAALVLAVTALLCLGIKESSYVQAIVTIMNACVMLFVIIAGCYIG

SEQ ID NO: 174487 - protein, 281 aa, Triticum aestivum
  unsure (1)..(281): unsure at all Xaa locations
  Clone ID: PAT_TA_68905.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAXKIQDKXEGIPPDQQRLIFAGKQLEDGRTLADYNIQKESTLHLVLRXRXGGMQIFVKTLTGKTITLEVESSDTIDNXRGPKSRTXRAFPPDQQXXXFAGKQ

SEQ ID NO: 174488 - protein, 168 aa, Triticum aestivum
  Clone ID: PAT_TA_68906.pep
MVARGSGAEEAPPPTQQRLVFAYYITGHGFGHATRALEVVRHLIGAGHEVHVVTAAPEFVFTTEIDSPSLHIRRVLLDCGAVQADALTVDRLASLEKYHQTAVVPREAILRTEVEWLHSIKADLVVSDVVPVACRAAADAGIRSVCVTNFSWDFIYAEYVVAAGNHHR

SEQ ID NO: 174489 - protein, 220 aa, Triticum aestivum
  unsure (1)..(220): unsure at all Xaa locations
  Clone ID: PAT_TA_68907.pep
LGMXIFFXQKNAHVPYRNSKLTQVLQTSLGGHAKTLMFVQVNPDVSSYTETLSTLKFAERVSGVELGVARTNKEGKEVKDVRELMDQLSMLKDTISKKDDEIEQLQLLNTSTSKLKSNRQADHILKHSSSSPGITSLGKVSSVGSGAASDLDNFSDTSDRQSEAGSMLSIEPEVSGLGDVESDGRLSDASDGGNSTGAETDSSVSSVVDQGQEKASSAAK

SEQ ID NO: 174490 - protein, 143 aa, Triticum aestivum
  Clone ID: PAT_TA_68908.pep
QSQNSAPSCRGDEDLSLSHSLICAAPPSAPGAVVVERREPEQVLKALASTIARCRWPQHGEETGTRNLVQTALPPPVSTQNNRSKSPPPSPPTCSPCRPGVHLRHGSAVRKQSSTREHGRRQRRPDQGAGASPAMRRSTAPKP

SEQ ID NO: 174491 - protein, 56 aa, Triticum aestivum
  Clone ID: PAT_TA_68909.pep
GSGILNASPDHGLEASLNRDYGTKCVALYYFEPQMLLSKFPFQAFSCRDILCVKKD

SEQ ID NO: 174492 - protein, 171 aa, Triticum aestivum; identical to SEQ ID NO: 141856
  Clone ID: PAT_TA_68910.pep

SEQ ID NO: 174493 - protein, 112 aa, Triticum aestivum
  Clone ID: PAT_TA_68911.pep
LSLPRLSCSFSALVFLSPSQPAAPLRRSTLLQLLLPHHRWLLLLHLRRLLFFHLLPVESLLLLRCFTCLLNKLDPRGAPAPPRLHVACFYFWSNGRNGSCFSHSSSSGAAQA

SEQ ID NO: 174494 - protein, 180 aa, Triticum aestivum
  Clone ID: PAT_TA_68912.pep
LAVRSTMGATASRSAPMTCDDLPVLWYSKLVRSRRVLNVGKVFFDGLVCNVEILPMCFDKDGLANVLIVSVGVMLDRHLRSFAGTHVSLEILDATGQHTVFHKDSDQEEDSFYWLTMYVRRCELEASSCVSASDRLTIRCTLEKKQQVTKRPHLLGILFKPNAVQEPPQVAMDGSHTLTV

SEQ ID NO: 174495 - protein, 215 aa, Triticum aestivum
  unsure (1)..(215): unsure at all Xaa locations
  Clone ID: PAT_TA_68913.pep
CRFGTRRRRVCFGAQPPLCSAAWPLASPAAVGKPAHPRVGPSLLTYPPPPSSRASRPRRRPRRHRPPSVPAPAQPTSTXATPSVSPSRCFGAQPPLCSAAWPLASPAAVGKPAHPRVGPSLLTYPPPPSSRASRPRRRPRRHRPPSVPAPAQPTSTXATPSVSPSRCFGAQPPLWSAAWPLAYRLQGGSRLIHADPPSLHLLLPALRSPPPYGVP

SEQ ID NO: 174496 - protein, 92 aa, Triticum aestivum
  unsure (1)..(92): unsure at all Xaa locations
  Clone ID: PAT_TA_68914.pep
RERERERERERERERERERERERERERXIXXHTXRARXXSLSRAXETHXXXSXPPLLSLPPRARCSYGPPPPGGAYVGSESLSLSLLSLSLS

SEQ ID NO: 174497 - protein, 91 aa, Triticum aestivum
  Clone ID: PAT_TA_68915.pep
APAPLLPPQLHFSCFQKLQQLPAGLRNLTSLKELMIYDCPAISSLPKDGLPKSLQKLWVSNCGNQELIQQCRGLKDIMHDILINTIATCMT

SEQ ID NO: 174498 - protein, 137 aa, Triticum aestivum
  Clone ID: PAT_TA_68916.pep
MPIKSQGCAHTEEGGGVSTSKKTSLESNSDREDSPPPSDDLPRILRKRLLPRGYPLPSKFAGGIRLVNTFELCFGKLDGYNEEHTSIKLLALSVCRSIVSLASFKGKNTILGTIIEHTPPSMRILTSASLIRSSEED

SEQ ID NO: 174499 - protein, 197 aa, Triticum aestivum
  unsure (1)..(197): unsure at all Xaa locations
  Clone ID: PAT_TA_68917.pep
MAGSWRAAALAVAMVCLVASSCVLGFPEEDLVGRLPGQPVVGFRQFAGYVDVDVKAGRSLFYYFAEAQDHAVGRPLTLWLNGGPGCSSVGGGAFTELGPFYPRGDGRGLRLNKKSWNKVSNLLFVESPAGVGWSYSNTSSDYNTGDARTGKPMRSCXHRRMPFPEYRSSSLLLSGESYAGHYIPQLTDVLLTHNEKS

SEQ ID NO: 174500 - protein, 210 aa, Triticum aestivum
  unsure (1)..(210): unsure at all Xaa locations
  Clone ID: PAT_TA_68918.pep
SARGLHXKEAXPIVHRDLKPANILLDKNYVGKIGDAGFAKVISDLVPDWQTEYTDTIVAGTMYYMDPEYQQTGTVRPKSDLFGLGVIILQMLTGKHPNGLIVSVENAIKSRSLPYILDRTQTDWPVAEAEMLAKLGLRCTALKCRDRPDLESEVLPELEEILHRVSSIVNMRNPNSRAPGHFICPITQGLMDDPYVAADGHTYEHHAIKD

SEQ ID NO: 174501 - protein, 166 aa, Triticum aestivum
  Clone ID: PAT_TA_68919.pep
TRRLLPLRHLLLLLDRLLLLLLRLRLLLLLLVPLLFAAANGYPSTCGNATCGNLTIAYPFWLNSSSASSCGYRGLGLACEGNTTLTLPAQSHHRYRVADIDYDMRSVFLVDDAEAPFNTTGCQHLHFNFTTDGGLQLTQSDSNITFFYNCKKNASWPFAEELIGCP

SEQ ID NO: 174502 - protein, 140 aa, Triticum aestivum
  Clone ID: PAT_TA_68920.pep
MAKKEGPCGHCGVTSTPLWRNGPPDKPVLCNACGSRWRIRGTLVNYTPAHRREDTGASEARPDKLKLKGQKQPKKRPNRSIVKDEPWSDQNFWKMGNADTSNRSGSGSAVSYSESCAPYGSIDASEIAGSAQSHALESLV

SEQ ID NO: 174503 - protein, 173 aa, Triticum aestivum
  Clone ID: PAT_TA_68921.pep
MSSLGNFSRRLCDSCFDGETQTKIKLWLRWLLRYAFPALIVSAGSLLLILHFIITPQVKAYVEDARLDSFAFAGTRASFSAYNFSTSVALTVRNLNGAMAITYTRPLVATFLFHDRRLYNVTVADKGHRHRPLKREAHLLHTGGEGPYVLDAAAVEEFNKQNATGVFEVEVRL

SEQ ID NO: 174504 - protein, 78 aa, Triticum aestivum
  Clone ID: PAT_TA_68922.pep
QGESRALSPLLPLLLPPAPTSHLPFTHTHTHTHTQLRQERPLRLPVPQLSPAGPCMLHPPYLMHACMHDWLFEVPPRT

SEQ ID NO: 174505 - protein, 72 aa, Triticum aestivum
  Clone ID: PAT_TA_68923.pep
PSPPSPPPLHMSTDQGPAWWRMAMGTRRRIRIREGKKGRMMAAKRRNKQPIERGNMALGTAERERTRGPTDS

SEQ ID NO: 174506 - protein, 195 aa, Triticum aestivum
  Clone ID: PAT_TA_68924.pep
SPSPMMVAPAGAPVRGKDREREREIVNQRSRTKNGKKREGEGGRRARRRQRARWRPYYSGAGHGRGSGQRRSTAKSRQRRDRAEEVPMALDLASCRSGRDGDLDAGERWRRGFGEAAEFLRRPWRLACSLLQLYREKERDVRGGSRGREGEGKEQGRSGYGLGGWHRLGSEEQRRSARCVGLTMGIWEDPEVEEA

SEQ ID NO: 174507 - protein, 86 aa, Triticum aestivum
  unsure (1)..(86): unsure at all Xaa locations
  Clone ID: PAT_TA_68925.pep
SKTTELQIEKTIFHRITSKQNWKLKLDRHKQITTCILLLARELDLDLITGDSHPIYRDARWIYRTSNTTNISTVRIFIFXGQISNP

SEQ ID NO: 174508 - protein, 206 aa, Triticum aestivum
  unsure (1)..(206): unsure at all Xaa locations
  Clone ID: PAT_TA_68926.pep
EAVCTXNLTPWLKLLPCRDKAGIASLLYRPSVYKGYYHSQKLKLKSSQSLGIILDQTLTVVLQPNTVSGKQLHSTGGQLQPSWSMEHLFSKKLSGKCLVSKSSRVFVEIEKGIVDNVHKAGSDVSWNNDLFVLSTAPDRSLKELDNLEVQSSSLYEYDVNNYNNDKPLNVGITWKLPLIWSCTRAPYHASRFLMGSGNERGSIAMS

SEQ ID NO: 174509 - protein, 191 aa, Triticum aestivum
  Clone ID: PAT_TA_68927.pep
MIAAFLSDSYITRFRTMLLFGPFMFLGYGLLALQAYLPSLRPPACNIEAELNSCEVVHGWNATLLYTALYMTAFGDGFIRVCLPSLGADQFDHEDPSESRQQSSFFNWYTFGISFGGFVGLILIVGIENYKGWDIGLGVCAILILLGLLIVAAGFPFYCNQVPQGSPLTRILQVLVVAFRNRKLELPEKLE

SEQ ID NO: 174510 - protein, 160 aa, Triticum aestivum
  Clone ID: PAT_TA_68928.pep
SIVRRDVQENDEEAVRVKEQSILELGTLLAKTGQAAELGGLLKFVRPFLISISKAKAARLVRSLLDLFLDMEAATGQEVELCLECIEWAKAEKRTFLRQALEARLISLYFDTKRYQEALALGTQLLQELKKMDDKALLVEVQLLESKTYHALSNLPKARA

SEQ ID NO: 174511 - protein, 36 aa, Triticum aestivum
  unsure (1)..(36): unsure at all Xaa locations
  Clone ID: PAT_TA_68929.pep
MASVSELACIYSALILHDDEVTVTADKLNALIKXAG

SEQ ID NO: 174512 - protein, 210 aa, Triticum aestivum
  unsure (1)..(210): unsure at all Xaa locations
  Clone ID: PAT_TA_68930.pep
LPVPSPPHAEXEQSPARRPLPMACPRVPDPATATSPRHVPRHRRSCSARPALEPSFPRLHLRRISRHCKPLPRLCFIRAGWRTRLCSPASSSCACADDLHLQPLPASKPRWRTSSSPGSSSPAPSLAAACVRPPLAAAGAGPPRRGSASTSSLLLPVISMALSSPSRRAFWPLHIAVDPRRPPPVQGLSLKILDAPSSTTPHKFLLERVR

SEQ ID NO: 174513 - protein, 180 aa, Triticum aestivum
  unsure (1)..(180): unsure at all Xaa locations
  Clone ID: PAT_TA_68931.pep
LRDLQXEEVVANGLGCAKDTADTSLELEGESEVASVVVEVEGVVVKDGEGDLHDGHTVVVPSSDEEAKPPAKEGTNEAIPAEVVKEGISEQIVQDNESVKVDVSSVTHQSVNSEAPVVEPKGDHILQVEDAAGDGNTAVSDVKVVMLEMNAADSVQTPDLKSASEDRSVPLHANSSDQVE

SEQ ID NO: 174514 - protein, 73 aa, Triticum aestivum
  Clone ID: PAT_TA_68932.pep
QRRAHGRETLVISPEPPQNPSATGKRAAPPDLLPRFRHRSNQPPSVLAGRQIWQATEPPLHASPAARRCSQPA

SEQ ID NO: 174515 - protein, 130 aa, Triticum aestivum
  Clone ID: PAT_TA_68933.pep
VYTLNVDPKSIMYRRRPESDVTAAQMMSLQSSRVLLLHVPVLLLLRDSCGAALLILASRRCCIMQSLKRGSEPSPSALTCLYVHVHPAMSARPDPEKEAQQTQFCCHYAVWGKLLLKSNRILYLLYQINN

SEQ ID NO: 174516 - protein, 43 aa, Triticum aestivum
  Clone ID: PAT_TA_68934.pep
FFLYTALLTTYSSTSSSTIYLYLHQLLTMMCCCKLYTALLTLV

SEQ ID NO: 174517 - protein, 152 aa, Triticum aestivum
  Clone ID: PAT_TA_68935.pep
MAVWLARRAVRRLASELRSHGPWPWPLSSSTVPVLGVPSGDQSRGFCSVRRFAGDSAAVEEPENGLAAGDLQVSKELALKMYSNMVTLQIMDTIFYEAQRQGRISFYLTSNGEEAINIASAAALSAQDIVLPQYREPGVLLWRGFTLQEFAN

SEQ ID NO: 174518 - protein, 154 aa, Triticum aestivum
  Clone ID: PAT_TA_68936.pep
MLSQFNSSLWVQEGDVHEHQGLGHDQAALMGQEAGNDHNQHLLPMPSGGGGGFRAPPMLDDDSWYFHPLTPTTPTMPALPSRVKEELASSAAQEPCVEVKLREGRVVNIRMMCSRRPGVVHSSLKALEGLGLDVQQAVISYFNDFTLDVFKAEC

SEQ ID NO: 174519 - protein, 215 aa, Triticum aestivum
  Clone ID: PAT_TA_68937.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENVNSQPFMRWR

SEQ ID NO: 174520 - protein, 207 aa, Triticum aestivum
  Clone ID: PAT_TA_68938.pep
LNLNIRRVVFYSLSKYNGDKMVPVAASQVKQIAGRAGRRGSVYPDGLTTTFLLDDLDYLIQCLQQPFEEAQKIGLFPCFEQVEMFASQFPNLTFTDLLDKFRDNCRIDKTYFMCQQDSIKKVANMLERVQGLSLKDRYNFCFAPVNIRDPKAMYHLLRFATHYSQSRRVSIAMGMPKGSARNDTELLDLETKHQVLSMYLWLSHHFE

SEQ ID NO: 174521 - protein, 134 aa, Triticum aestivum
  Clone ID: PAT_TA_68939.pep
MLDSLISHDPKVLTEKKPDEIIASGVVESLQNFLRKCIIAVLSYGPMPKHIAFIMDGNRRYAKSRSIKQGTGHSVGFAALMASLIYCYEMGVKYITVYAFSIDNFKRDPSEVKTLMELMEEKINELLENKNVIN

SEQ ID NO: 174522 - protein, 38 aa, Triticum aestivum
  Clone ID: PAT_TA_68940.pep
FFLINRQIPQAFLASWLIRARIQQLQQAISYYNDSLVP

SEQ ID NO: 174523 - protein, 153 aa, Triticum aestivum
  unsure (1)..(153): unsure at all Xaa locations
  Clone ID: PAT_TA_68941.pep
AALAGLILKNALDAKEQHRKNELFQRWLALDAGVKAQVKALLLQTLSSPVASARSTSSQVIAKIAGIEIPQKQWPELIGSLLSNIHQVQPNVKQATLETLGYLCEEVSPEAVDQDQVNKILTAVVQGMNASEGNSEVRLAATRALYNALGFAX

SEQ ID NO: 174524 - protein, 150 aa, Triticum aestivum
  Clone ID: PAT_TA_68942.pep
MAPRAYLLDWDTRYRIAFGAAEGLRYLHSDCKPKVIHRDIKSNNILLDEMMEAHVGDFGLAKIIDISNSRTMSAVAGSYGYIAPEYAFTMKVTEKCDIYSFGVVLLELVTGQCAIQPLEKGGDLVNLVRRTMNSMTPNSQVFDSRLDLNS

SEQ ID NO: 174525 - protein, 47 aa, Triticum aestivum
  unsure (1)..(47): unsure at all Xaa locations
  Clone ID: PAT_TA_68943.pep
YKGFEGLXTIXVDVGGGVGATVGAIVXAYPAIKGINLDLPHVISEAP

SEQ ID NO: 174526 - protein, 34 aa, Triticum aestivum
  unsure (1)..(34): unsure at all Xaa locations
  Clone ID: PAT_TA_68944.pep
XDAILMKWILHDWSDDHCXTLXKNCYNALAAHWQ

SEQ ID NO: 174527 - protein, 65 aa, Triticum aestivum
  unsure (1)..(65): unsure at all Xaa locations
  Clone ID: PAT_TA_68945.pep
LKXEQMPVCLFSYFAFHFLLKNSLSNYTCFENNLHILMSTSNLASAFLAIGEKHDYLNNSKTEKE

SEQ ID NO: 174528 - protein, 205 aa, Triticum aestivum
  Clone ID: PAT_TA_68946.pep
RHEGCTDMELVKQMFTVRTDVFQKDYLNPSLDSVFGNGVIFANGQDWKRRRKFVHPAFNQETIKSMSAIAWDCTRQTMERWCVQLRGQQQAEIDMRYDSDEIAMGVIAQVMLGKDHEEAREVFIAGREQLKIAAYASADPPLPGFRYLPTRRNRRMWQLDKLVTSKISPIMKARLASSVYEDDLLGQMLQQQACRSGSGAETLST

SEQ ID NO: 174529 - protein, 209 aa, Triticum aestivum
  Clone ID: PAT_TA_68947.pep
LLFLLLPLLYVLRLRRNTRKQPHADGLKAYPIIGTLPHFVKNQDCLVEWSAGVVARCPTHTMVFDFKGLGLMAGAITANPANVEYIVKTNFQNYPKGEFVVSAMADFLGHGIFNSDGDQWLSQRKAASYEFSKRSLRNFVVSTVRFEVVERLLPLLSRAELEGLTLDMQDVLERFAFDNICCVAFDEDPACLTDDGLGLNGRAEFMHAL

SEQ ID NO: 174530 - protein, 118 aa, Triticum aestivum
  Clone ID: PAT_TA_68948.pep
VSLARLLFPSPPRSREPVPCYSFPHHRMLDPNSPLSMTTLSSGPNRAEDPLRSDEVMDTSGSGGEYPTPSPSDLPSNIEKLREVGPSVVTIEFLLPLLPTNQLYMGRIQFLWLRIMTV

SEQ ID NO: 174531 - protein, 121 aa, Triticum aestivum
  Clone ID: PAT_TA_68949.pep
MSLWDRAASLAPKISSTSTPAPTLLSIDVENQVQDQPRHGSMSSPVLPLPTAAPPLLPIIQLDGESGYLRWKESVLLRLHTIGVADVLTEERPPDEKTAAGKQWAHMDALCRGHILATLSD

SEQ ID NO: 174532 - protein, 215 aa, Triticum aestivum
  unsure (1)..(215): unsure at all Xaa locations
  Clone ID: PAT_TA_68950.pep
SARGNSLTWXAVKTMAILAEMKANDPDFNYTVQVDGESRVKTLMWVTSRGFDQYRCFGDAITFDTTYRTNLYDMPFGLFVGVNYHFQSIIFGGAMMRDEKEDRFKWIFKEFIRMVGGKHPQTILTDQARAMELAIEAELPNTVHHWCKWHVLKKAKESMGVLWSKNSDFKMEFHKLVHHMITEEEFEAGWQQMLERYSLKKHPFLTQIYEVHHKW

SEQ ID NO: 174533 - protein, 189 aa, Triticum aestivum; identical to SEQ ID NO: 171981
  Clone ID: PAT_TA_68951.pep

SEQ ID NO: 174534 - protein, 121 aa, Triticum aestivum
  unsure (1)..(121): unsure at all Xaa locations
  Clone ID: PAT_TA_68952.pep
ESSPATGGEEALAALIPPCAGSVPVPDAAHHGHGERPMDGATDNRQGGGLGRGERPWARDDAKTVGQNRGSGSISLGHSGETAMDVGRRRGRGDWIDFSCLSGETAIGATGSGXLDRGDVR

SEQ ID NO: 174535 - protein, 35 aa, Triticum aestivum
  Clone ID: PAT_TA_68953.pep
VKPTASGVGEGEEEKVQGQERSDHLHFLRHLCLAS

SEQ ID NO: 174536 - protein, 206 aa, Triticum aestivum
  Clone ID: PAT_TA_68954.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENV

SEQ ID NO: 174537 - protein, 183 aa, Triticum aestivum
  Clone ID: PAT_TA_68955.pep
MAKTQREIREVLGEDRAVITNSDLAELHYMRMIIKEVLRLHPPGPLVHRMSREDCTIMGYDIPKGTDVYINIFAISRDPRHWNKPEEFRPERFDNNNVNYKGAYFEFIPFGSGRRQCPGIHFSSSVTEMVLTNFLYHFDWMLPDGHNLASLDMSEKFGLAVTKSHDLKLRAIPHMLSKAMSSK

SEQ ID NO: 174538 - protein, 41 aa, Triticum aestivum
  unsure (1)..(41): unsure at all Xaa locations
  Clone ID: PAT_TA_68956.pep
ILNLFXLGXAXXKILGEXXKXTAPESQSIXTRTLICXESTV

SEQ ID NO: 174539 - protein, 39 aa, Triticum aestivum
  unsure (1)..(39): unsure at all Xaa locations
  Clone ID: PAT_TA_68957.pep
NFFRXIHNMHTSSSNCVGLVLVTAAVCHVRDSRRRITYS

SEQ ID NO: 174540 - protein, 36 aa, Triticum aestivum
  unsure (1)..(36): unsure at all Xaa locations
  Clone ID: PAT_TA_68958.pep
XFFFFERRIGPRSLHLDASLNLCSHKPLLVSSKLTV

SEQ ID NO: 174541 - protein, 58 aa, Triticum aestivum; identical to SEQ ID NO: 174381
  Clone ID: PAT_TA_68959.pep

SEQ ID NO: 174542 - protein, 113 aa, Triticum aestivum
  Clone ID: PAT_TA_68960.pep
MATYDEAKQVLLMWTPLEEGFQLHLMSSCIAGTAGTLVAPIDMIKTRLMLQRESKGARVYRNGFHCAYQVVLTEGVKSLYKGGFATFARLGPQTAITFVACEKLRELAGMSAI

SEQ ID NO: 174543 - protein, 158 aa, Triticum aestivum
  Clone ID: PAT_TA_68961.pep
LDAVVNLLKCFLRLEWLHVTFQLREVINNVRSYDPLDPIECLELHLKKVVLKNYDGLCGSSINFAKFFVLNAKGLKEMKITLPYHRQHKWFANQLSMLRVNSRASRDARIEMRCGSREYFTHIRCTHDLSMDNPFDLPHRGCLKCEEKGLGDAVYTFN

SEQ ID NO: 174544 - protein, 166 aa, Triticum aestivum
  Clone ID: PAT_TA_68962.pep
SERSGVSPLLPGNRGCLRCSRILRYLKSCPGKGILFSNHGHLRIEGYTDADWAGCLDDRRSTSGYCMFVGGNLVSWRSKRQSVVARSTAEAEFRSMASGLCETMWLRILLSELGLYDSAPLQLYCGNQATINLVNNPVHHDRTKHIEIDRHFIREKLEQGALHMAL

SEQ ID NO: 174545 - protein, 73 aa, Triticum aestivum
  unsure (1)..(73): unsure at all Xaa locations
  Clone ID: PAT_TA_68963.pep
VASGXIHVWHMXALTXIFGXDSVXQFGGXTLGHPWXNAPGAAANRXALEAXXQARXEGRXLAREGNEIIRAAC

SEQ ID NO: 174546 - protein, 57 aa, Triticum aestivum
  Clone ID: PAT_TA_68964.pep
GSIPTKPMVVETFATYPPLGRFAVRDMRQTVAVGVIKGVEKKDPTGAKVTKAAIKKK

SEQ ID NO: 174547 - protein, 128 aa, Triticum aestivum
  Clone ID: PAT_TA_68965.pep
VAGRGLIVGWCDQEAVLEHRATGGFLTHCGWNSTLESLRAGVPMVCWPFFAEQVTNCRYACDEWGVGIEMARQAGREEVQAAVRELMGDRAMRRKAAEWKEKAEKAVTVGGSSHGNLERFIQEIARVK

SEQ ID NO: 174548 - protein, 98 aa, Triticum aestivum
  Clone ID: PAT_TA_68966.pep
GHRAFGFVTFSDEGVADKVADKSHEILGCKVTVDIAAPPRGDSSGRFADPMPGMELPAPSYGSMRPFGMFCGNLGSDRGYGPSGGGSRSRTDGRHRPY

SEQ ID NO: 174549 - protein, 252 aa, Triticum aestivum
  Clone ID: PAT_TA_68967.pep
APLTLGIETVGGVMTKLIPRNTVIPTKKSQVFTTYQDQQTTVSIQVFEGERSMTKDCRLLGKFDLSGIPPAPRGTPQIEVTFEVDANGILSQEEIDRMVKEAEEFAEEDKKVKERIDARNQLETYVYNMKNTVGDKDKLADKLESEEKEKVEEALKEALEWLDENQTAEKEDYEEKLKEVEAVCNPIVSAVYQRSGGAPGGEGADGGVDDEDHDELLLVCWPSCRELSLLLLLLPSDVFSFCYYIAGGFASE

SEQ ID NO: 174550 - protein, 54 aa, Triticum aestivum
  unsure (1)..(54): unsure at all Xaa locations
  Clone ID: PAT_TA_68968.pep
RXKNPRTTFFIRQIGRPSRGHRWLXICKXRSPLVXKGLSFGSGQPIEPCSSAPP

SEQ ID NO: 174551 - protein, 36 aa, Triticum aestivum
  unsure (1)..(36): unsure at all Xaa locations
  Clone ID: PAT_TA_68969.pep
XRERERERERERERERDQQETSILLLIHVNFVLPNA

SEQ ID NO: 174552 - protein, 109 aa, Triticum aestivum
  unsure (1)..(109): unsure at all Xaa locations
  Clone ID: PAT_TA_68970.pep
XRDPSHWGEDAAEFRPERFERNDAIHVDYSSGTQMEFVPFGFGRRQCPGALFATTTIELVLANLLYRFDWSIPGGASSETLDMNEVFGLIVHCRSNLCVQAATCHPQLH

SEQ ID NO: 174553 - protein, 82 aa, Triticum aestivum
  unsure (1)..(82): unsure at all Xaa locations
  Clone ID: PAT_TA_68971.pep
XRWATAAAHAPSRSSSPTAASSRSARXPVAXVVIAPCVPCRVVDLNKRVVCRVLPLVRPMXSFRGWFRRVLGGLLWAAXFCX

SEQ ID NO: 174554 - protein, 48 aa, Triticum aestivum
  unsure (1)..(48): unsure at all Xaa locations
  Clone ID: PAT_TA_68972.pep
AXXLMXIYXXXEKXSXWREXESXCXLSGXRNQSIXFISXRNLRSTXHX

SEQ ID NO: 174555 - protein, 119 aa, Triticum aestivum
  Clone ID: PAT_TA_68973.pep
FREVPKYQNERLNTSGEKWLIAFILVTFQHVSPMTYRAAQIPRSPVLVTRTTASTNENTSARALIPTRPHVQTVSTRTRTSTHKFCTHFILSTFNLLFPYLICRSFLPGIEVVENIRLS

SEQ ID NO: 174556 - protein, 44 aa, Triticum aestivum
  unsure (1)..(44): unsure at all Xaa locations
  Clone ID: PAT_TA_68974.pep
XSIPLFQXVYHYKISTTRSGRHPGKRMKLMTCTTSFHQQPKINK

SEQ ID NO: 174557 - protein, 142 aa, Triticum aestivum
  Clone ID: PAT_TA_68975.pep
CMHKSWPLTHTANYLAGSPSSSSSCSRSRSSFIMSCRFSRRSGISPSPHIFVKASPDSLLPLILILQSLTRITRDHLTTPSRRCTPCRGPTPSQRRRPSPCPLAARGGHLLTWTTLSQRRSPRRLRQAASHRNFCWLHTNFP

SEQ ID NO: 174558 - protein, 53 aa, Triticum aestivum
  unsure (1)..(53): unsure at all Xaa locations
  Clone ID: PAT_TA_68976.pep
RXIXTXNXTXVCRACXNTIVLSXQCYHQYQKNCTRLSIVSSSCXCISTKHXPK

SEQ ID NO: 174559 - protein, 32 aa, Triticum aestivum
  unsure (1)..(32): unsure at all Xaa locations
  Clone ID: PAT_TA_68977.pep
VILFDIXRXXXYXXFVSVPGCLXXHLXLXVLL

SEQ ID NO: 174560 - protein, 91 aa, Triticum aestivum
  unsure (1)..(91): unsure at all Xaa locations
  Clone ID: PAT_TA_68978.pep
NSAVSRIPYLPASAISNYVQGNTTQWSGRQCVDHSCSVIHRCHPPMPSTSPAVSRLSLRHRFSSHPPQRASVVLHSILLPTXETTVRKGLX

SEQ ID NO: 174561 - protein, 79 aa, Triticum aestivum
  unsure (1)..(79): unsure at all Xaa locations
  Clone ID: PAT_TA_68979.pep
ILYVVRKSTNNQTXKAWSLSLSCSDNDNLGVNLKKQQFKCTLSLSPCVCVCVFLLSTVCVLFYPCSVFFNHFLLYILCQ

SEQ ID NO: 174562 - protein, 103 aa, Triticum aestivum
  unsure (1)..(103): unsure at all Xaa locations
  Clone ID: PAT_TA_68980.pep
GEQMICILCKLHGSXDMKSEKPKARTYNPKALYEMGTNKLRHVGLDCFVSCIRNAGPTPSHRRRSRIPLKPSTVPCGKVLRSCPVASSIHARHRSWFSKCLAW

SEQ ID NO: 174563 - protein, 208 aa, Triticum aestivum
  unsure (1)..(208): unsure at all Xaa locations
  Clone ID: PAT_TA_68981.pep
EGAKEVALSVVSGINSXIFAYGQTSSGKTYTMTGITEYSVMDIYDYIEKHPEREFMLKFSAIEIYNEAVRDLLSHDTTPLRLLDDPEKGTTVEKLTEETLRDKDHLRDLLGMCEAQREIGETALNEASSRSHQILRLTIESSVKQYLGRGKSSTLVSCVNFVDLAGSERASQTASAGMRLKEGSHINRSLLTLGKVVRQLRFVWFVFF

SEQ ID NO: 174564 - protein, 49 aa, Triticum aestivum
  Clone ID: PAT_TA_68982.pep
CAATGKQTEATVFNTNYFMLVSFHLKALGKTGLSKSDELSTARAAIPTA

SEQ ID NO: 174565 - protein, 69 aa, Triticum aestivum
  Clone ID: PAT_TA_68983.pep
HHMEADDLQQQRLQEGSDTQAPPSPDSTTKARIKVFTLNNSLNISEQCLQQGNDIENIAIARYDHSGLS

SEQ ID NO: 174566 - protein, 67 aa, Triticum aestivum
  Clone ID: PAT_TA_68984.pep
GISPSTTRCAILVVGFTLEPSAGLIKKCEPKADDNGFQRPTFAQLNRTLGVQSNGDVTNGRTGKMFT

SEQ ID NO: 174567 - protein, 23 aa, Triticum aestivum
  Clone ID: PAT_TA_68985.pep
RKGRWQLDIARSNQVSLPHYRRR

SEQ ID NO: 174568 - protein, 49 aa, Triticum aestivum
  unsure (1)..(49): unsure at all Xaa locations
  Clone ID: PAT_TA_68986.pep
QSLCAVQDPXDHARNQXVLHQPKMKXFSLCCDSLLVTVVVKCXPIXSIQ

SEQ ID NO: 174569 - protein, 139 aa, Triticum aestivum
  unsure (1)..(139): unsure at all Xaa locations
  Clone ID: PAT_TA_68987.pep
MASSQPSSLTTQLPRSLTLTQLSSNRSIHRCSSPKAPAMETAMEAGDDPAFVAEGTVTSIRLAVASNQEIVKAQPMKEEFPVTHPSQLAGNPALGLPLQLGHCDSCGATDXAKCEGDSLAPLCFIPTVGKITLFETQIV

SEQ ID NO: 174570 - protein, 68 aa, Triticum aestivum
  Clone ID: PAT_TA_68988.pep
WTCLGDKVASPFQSSHHTSMSHQTTISHIVQDFISIMSINNASTCRIETCKWIMVTEGLWIRKFLELH

SEQ ID NO: 174571 - protein, 64 aa, Triticum aestivum
  unsure (1)..(64): unsure at all Xaa locations
  Clone ID: PAT_TA_68989.pep
EXQXALLIDPLXSQHPEIVSVYFFXRLAWPXEEWXXXXALGFRFXQXIXPRFRXIXXTHSVSVV

SEQ ID NO: 174572 - protein, 158 aa, Triticum aestivum
  Clone ID: PAT_TA_68990.pep
FRGEDLKKCMDNAAYAYSEHKFNIAMNDLRDECEQAWEWLCQIPKKTWARHAFDTNCKTDLVVNNLSEVFNKYVLDVRKKPIRTMCDGIKDKQMVRWHRNRESGKKARWDITPHYSEKLEVEKERCWERERYILCPKAIWSLHIYCSLYIYCYSTFWW

SEQ ID NO: 174573 - protein, 40 aa, Triticum aestivum
  Clone ID: PAT_TA_68991.pep
HIINIVIHISKSWLLILHHVCGNLGSAKSSESFPHNLRVL

SEQ ID NO: 174574 - protein, 193 aa, Triticum aestivum
  Clone ID: PAT_TA_68992.pep
EIYDSHILDKKCNYLSPTPNDETTQGRILQQETGALKHPPPRFPVDCHSYITYLIYVWANNNIIREKLGIKEGSMGEWVRCHEKDLPFTHDIESSIKYHRNITSKGYRALVYSGDHDAVVPFLGTQSWVRSLNFSIMDEWRAWHLDGQSAGFTIAYTNNMTFATVKGGGHTAPSYQPERCLAMLRRWISNEPL

SEQ ID NO: 174575 - protein, 44 aa, Triticum aestivum
  unsure (1)..(44): unsure at all Xaa locations
  Clone ID: PAT_TA_68993.pep
TLHSTRYDTSEDYRNLRERERERERERERERERERERERXXQRX

SEQ ID NO: 174576 - protein, 96 aa, Triticum aestivum
  Clone ID: PAT_TA_68994.pep
VEMSVVQKKIWGFLTRRMLGLGNRPIMHIAAVRLVSHYLSTSSLSRNRGTMHAAPTVELQAQLPARRQRLGHHRSCDATTVGAAMQRASTPPELRC

SEQ ID NO: 174577 - protein, 58 aa, Triticum aestivum
  Clone ID: PAT_TA_68995.pep
IVLHFVQRCVHSRFEFVFGAFSLFLLTRKAQEHIHNHGARDRPLPTYFAWLSKHFQLF

SEQ ID NO: 174578 - protein, 62 aa, Triticum aestivum
  unsure (1)..(62): unsure at all Xaa locations
  Clone ID: PAT_TA_68996.pep
MKLKGIDGGPHKRWSMWFNSMQSEEPYQGLTCRESSXKRGVPSGTRTQVVHSCLIWIQLMVE

SEQ ID NO: 174579 - protein, 46 aa, Triticum aestivum
  unsure (1)..(46): unsure at all Xaa locations
  Clone ID: PAT_TA_68997.pep
PTXGGVXSTRAXKNRGTMPCHHMGRGTSXXREARXSGRKELYXXMT

SEQ ID NO: 174580 - protein, 67 aa, Triticum aestivum
  Clone ID: PAT_TA_68998.pep
EVQLAGCPCRSSRAQDLPTIWRFVVLPRFQGVGMLLPFYWADTCTAETLVYPLSEYFMNLLFSIARP

SEQ ID NO: 174581 - protein, 45 aa, Triticum aestivum
  unsure (1)..(45): unsure at all Xaa locations
  Clone ID: PAT_TA_68999.pep
GHQFATRLANVFSIGKDXKSWVSLPKGKGIKLTIIEEARKRIAAA

SEQ ID NO: 174582 - protein, 69 aa, Triticum aestivum
  Clone ID: PAT_TA_69000.pep
SKRKMNWHPPNVGVFEKIAFQVEWRWDPEELRSLQVSIHVEFFWGEFFRGQELDYSYCQYHLESVTMNN

SEQ ID NO: 174583 - protein, 48 aa, Triticum aestivum
  unsure (1)..(48): unsure at all Xaa locations
  Clone ID: PAT_TA_69001.pep
YTCMHLSCMPXLHASLFIYCNQLHIYLLRRVRXXCGVYDGIDPAKNNI

SEQ ID NO: 174584 - protein, 55 aa, Triticum aestivum
  unsure (1)..(55): unsure at all Xaa locations
  Clone ID: PAT_TA_69002.pep
FVWRLLISTRSYRIMVQSGSSFAISCLSSSSLDRSVXGHLVAEIKSLMIDRVFIP

SEQ ID NO: 174585 - protein, 57 aa, Triticum aestivum
  unsure (1)..(57): unsure at all Xaa locations
  Clone ID: PAT_TA_69003.pep
HVRIKYCIYVSRICRQEVKFDXHRRPKLRXMXCTNVCVGAWKALVLSAXIPXFNLXP

SEQ ID NO: 174586 - protein, 36 aa, Triticum aestivum
  unsure (1)..(36): unsure at all Xaa locations
  Clone ID: PAT_TA_69004.pep
XGXRVHAXLHHRGQGRRRQXXXRGQGVXXGLGXPKQ

SEQ ID NO: 174587 - protein, 36 aa, Triticum aestivum
  Clone ID: PAT_TA_69005.pep
LSLEVCWTGNVMVSRDVHFYRAKTLNHHHDTGFLSV

SEQ ID NO: 174588 - protein, 101 aa, Triticum aestivum
  unsure (1)..(101): unsure at all Xaa locations
  Clone ID: PAT_TA_69006.pep
WYYSXSANRFGXMXSVXMFGNFXQXLXQSYGAFEVYCNGXLVXSKLXEQRFXSEFELRELIGNRLSDSQIGKNLEKDLVLDDVESTHDHLVSTFFFFFLLH

SEQ ID NO: 174589 - protein, 94 aa, Triticum aestivum
  Clone ID: PAT_TA_69007.pep
DPKSRGKQPRSYAKVPKQSLSGKGSDRAMTTRRWAWKQPSFEESVIAHWSSSMAPKMSQGSSDSPTLWLPSRNGCFLEKNIMMVAWWGSLWIVL

SEQ ID NO: 174590 - protein, 115 aa, Triticum aestivum
  unsure (1)..(115): unsure at all Xaa locations
  Clone ID: PAT_TA_69008.pep
TFDSEGLICGYKGTIVGHLYKDNVLLKVHSRHGICCLQSVLILPCTPCLTQQQGGNCNPKKEMPFPLSVTSMHAFKRRRPQSPSFLGCVIISDLLSNVLRSYVXXLESHXYKKXH

SEQ ID NO: 174591 - protein, 70 aa, Triticum aestivum
  Clone ID: PAT_TA_69009.pep
YLLSGLSSHSWQRATTRGDSTDSSSLVYSYQTPSMVQMLQRSQNHCPSPQIPRPQIIVPTRSFMQKPQPR

SEQ ID NO: 174592 - protein, 40 aa, Triticum aestivum
  unsure (1)..(40): unsure at all Xaa locations
  Clone ID: PAT_TA_69010.pep
QKKKXNYAITRITSTLTNPYSMLVTKTSRRQQTLPTKVLE

SEQ ID NO: 174593 - protein, 33 aa, Triticum aestivum
  unsure (1)..(33): unsure at all Xaa locations
  Clone ID: PAT_TA_69011.pep
GVGFMQFVQAVKHMLANGVELDIVDASXERAFQ

SEQ ID NO: 174594 - protein, 117 aa, Triticum aestivum
  unsure (1)..(117): unsure at all Xaa locations
  Clone ID: PAT_TA_69012.pep
SAHRCLRLLPVVFVTAPTIKNIKNDVRKAMLDQLGLAHETWNERYPGLLVYVGQSRTKVFAYLKDRIWQRIQWWKEKMLSKARKEILIMACAQAIPTFAMXSFDLTKGLCENAFFYM

SEQ ID NO: 174595 - protein, 88 aa, Triticum aestivum
  Clone ID: PAT_TA_69013.pep
SDKFPNPTLRPFPCLVSILLPLFATHLAWSSLFFRPAPAYSLRNLPRRAPTFVREKGRSNMFCSPLILSVPKLHKEFLHTHVYICMYT

SEQ ID NO: 174596 - protein, 94 aa, Triticum aestivum
  Clone ID: PAT_TA_69014.pep
IFPRSQNSCLRFARYGQEFWDGGSSYVIWRYHTSRSTLVLVAVYACLGVRQSTEREARFFLHKQRPPYSNLHLGVANLTLNRSCFGTAEQGKLM

SEQ ID NO: 174597 - protein, 91 aa, Triticum aestivum
  Clone ID: PAT_TA_69015.pep
LEEREEEREGKQALGEEPALARAPRHFVRVKGGPYNKKVVHSSNQLLYILAIRWAIDDMAMAYSQQLAILLTMLLICMNNQYSGVVFSFTS

SEQ ID NO: 174598 - protein, 96 aa, Triticum aestivum
  Clone ID: PAT_TA_69016.pep
FTVLFVPSRPPLANPLDHLTWQLLVLAAALRDAAACASSTGSHLVRSGAGARSHHYGEVRPRPTASSLGESSRAGRKKADGSEQHAIRYLVVLSSA

SEQ ID NO: 174599 - protein, 69 aa, Triticum aestivum
  unsure (1)..(69): unsure at all Xaa locations
  Clone ID: PAT_TA_69017.pep
WKSVCNCNSGHQTSAWFTSTMQNSEQPQKVLEITKILSNKNIEFLKLLLVSHGAPISTPFLPLKIXSLN

SEQ ID NO: 174600 - protein, 158 aa, Triticum aestivum
  Clone ID: PAT_TA_69018.pep
DETASGSPSSSSSSSSSDTDSSDSDSDTDSGSSDSGSEHSGGSDSDSDSDEIVDSPAPAITPPTCEQLARALERQRKEATSRAREKARQELLHMEKTAMPDDTLHREDLKRLGIDEYNTAKPSNLLRQIGLYLKVDEDWKQQRRQSFHEDLEEGEIRS

SEQ ID NO: 174601 - protein, 119 aa, Triticum aestivum
  unsure (1)..(119): unsure at all Xaa locations
  Clone ID: PAT_TA_69019.pep
LSGRYNGFPSSDVGRRRQNQGKXHYQTDNGGLXSSQTHXXYSSSTPVPSSASWVGHQRQSPIAAEHGLQCDNAKVASCLDWTYCEILKQVSLVKVLYIILPFHHNMAPMHQRNVGRRAS

SEQ ID NO: 174602 - protein, 65 aa, Triticum aestivum
  unsure (1)..(65): unsure at all Xaa locations
  Clone ID: PAT_TA_69020.pep
NGVINIKMCTHQGMPRVSSLASVACTSSSSLGPSVXGELACNILLLVFAASGDQWXKIDXCNDSR

SEQ ID NO: 174603 - protein, 149 aa, Triticum aestivum
  Clone ID: PAT_TA_69021.pep
VEYAKSRITTNASTTSTLNSRQQQKTQQQKQKQKYKKHKKEQQQHEGQVGQVQGKQRKLEGKQLYLNQPRPCVTKLPTPTGPSARSLSPVIPNVTQIGPIGHRPFDLMPAIPLPFLPGIQGGPVAANVVPTRHNPFQQNPLYRHPSFHP

SEQ ID NO: 174604 - protein, 122 aa, Triticum aestivum
  unsure (1)..(122): unsure at all Xaa locations
  Clone ID: PAT_TA_69022.pep
RVTDHGTSFLRXFKNLESLEVCGXGSITDAGVKNIKDLKALTLXNLSQNGKLTDKTLELISGLTALICLNVSNSRVSNTGLRHLKALQNLRSLTLDSCRVTANEMKKLRVTALPNLISVRPE

SEQ ID NO: 174605 - protein, 119 aa, Triticum aestivum
  Clone ID: PAT_TA_69023.pep
MSTYFSASSMESLSSSSSILPTRWSKSSSSAASKAKGVCSMATDSDLSCASESKSMVSGCLIGGEVDCTASPSSISPSSFSSSEASTRCSTSSSSATGRGTRGLFCTACAQAKLWNAGA

SEQ ID NO: 174606 - protein, 124 aa, Triticum aestivum
  Clone ID: PAT_TA_69024.pep
LGWADLARDPVHVTLYAVLLLMGCALISATWFGIRVYSRKYVARLLGRQIPVTPAQPGSIPRNRWKRHVAMIALLVGLCVGALTLMAGFIGVPGSGTGIMLVVTVVCSYFERRAGDQAADAFGL

SEQ ID NO: 174607 - protein, 102 aa, Triticum aestivum
  unsure (1)..(102): unsure at all Xaa locations
  Clone ID: PAT_TA_69025.pep
GNDADLWLHLPWKTLAHLPWKTLTCQEVVVASRDRRRSSSRFKRPSLDLVVASRDRRPARSSLPGMGMPSPNEAKSGSQIWVVHLEGFGCIHGKNPTXYGKV

SEQ ID NO: 174608 - protein, 76 aa, Triticum aestivum
  unsure (1)..(76): unsure at all Xaa locations
  Clone ID: PAT_TA_69026.pep
IPRGETKLXRXTDNAGEAPLXHQQRSNASPXELHCSLTTRRCXRXNSIEAPLMLHCSLXRRFIAAPTVTXKLQHSX

SEQ ID NO: 174609 - protein, 59 aa, Triticum aestivum
  unsure (1)..(59): unsure at all Xaa locations
  Clone ID: PAT_TA_69027.pep
LLGXGXLFEKGVXFDXRXXLFXXLRXRLRXLXHFXXXXRXVNRXRVRXXRXRRFXLXXG

SEQ ID NO: 174610 - protein, 74 aa, Triticum aestivum
  Clone ID: PAT_TA_69028.pep
WFFSSGVLYCGPCSKFLPIGAAQSVLILKFGFLFHSFFHLISWRLVFLVICGYDPIRVSTSYLDLHSPGILLLS

SEQ ID NO: 174611 - protein, 135 aa, Triticum aestivum
  unsure (1)..(135): unsure at all Xaa locations
  Clone ID: PAT_TA_69029.pep
RTRLANDXKASKGGGDRQFNGLVDVYRKTLKSDGIAGLYRGFNISXCVGIIVYRGLASYPIDTVRRRMMMTSGEAVKYKSSLDAFQQILAKEGAKSLFKGAGANILRAIAGAGVLSGYDQLQILFFGKKYGSGGA

SEQ ID NO: 174612 - protein, 242 aa, Triticum aestivum
  unsure (1)..(242): unsure at all Xaa locations
  Clone ID: PAT_TA_69030.pep
IPKLXDVKFAGGTKARKCTLILTEGDSAKLLVMNALGTIGRDYYGVYPLNGKIMNVNGRTPAQVWESSKVQTIMRIMGLKFERKYSVVDGLRYGRIMIMMDQDVDGSHIKGLIINLFLECWPSLLKVEGFLQQFITPIIRLSRNSESIFFYSMIEYKLWNERHEGEAGNWTVKYYKGLGTSTTADAAKYFRHMRKHTRNFIWRGVEDSTSIKLAFDRKSAALRKEWMKIGFEFQYHITLKNA

SEQ ID NO: 174613 - protein, 50 aa, Triticum aestivum
  unsure (1)..(50): unsure at all Xaa locations
  Clone ID: PAT_TA_69031.pep
MMVLQRQTPYGDXGLXXVPIXTGEEEXYPTEXEPSPEEMAFLKSLGWKED

SEQ ID NO: 174614 - protein, 86 aa, Triticum aestivum
  unsure (1)..(86): unsure at all Xaa locations
  Clone ID: PAT_TA_69032.pep
XLLXQXSPTKLNXPXKIXPVXXRRCXXNRIXHQXTXXVFQXXFXXXVFRXPXXALKXYSNTTIXXHAPRLSMXRVXFSIXSFQVXT

SEQ ID NO: 174615 - protein, 34 aa, Triticum aestivum
  unsure (1)..(34): unsure at all Xaa locations
  Clone ID: PAT_TA_69033.pep
YNVNXMCTXWSMHLXKFGLPXLYSSLVWFMCVCV

SEQ ID NO: 174616 - protein, 110 aa, Triticum aestivum
  Clone ID: PAT_TA_69034.pep
YMFGDEVRTYPSEKANLPIAKVLFEDQQWQLEENAEKLSKVLAAEAKPVLAEEEVLQAMQETSNLAKIVDTHCREMYKCIQDELLPLLLEPMTIAPYRPDGPDKAKDLPA

SEQ ID NO: 174617 - protein, 40 aa, Triticum aestivum
  unsure (1)..(40): unsure at all Xaa locations
  Clone ID: PAT_TA_69035.pep
LPGHVLRIGRFLRXEYFQMECNCXSTHVDRTKASKQXSQG

SEQ ID NO: 174618 - protein, 130 aa, Triticum aestivum
  Clone ID: PAT_TA_69036.pep
GNAGVVRVEDMDAEVFKALLRFTYAGLLPETFKEDAVVCQHLLVAADRYGMGRLKLICEQKLCEYIDIGTAATILTLAEQHRCEGLKKACFDFLAAPPNLREVVATDGFQHLIASCPSLMVELMAMSPTH

SEQ ID NO: 174619 - protein, 51 aa, Triticum aestivum
  unsure (1)..(51): unsure at all Xaa locations
  Clone ID: PAT_TA_69037.pep
TSALLPVLAQQLKQDAASLVXFLCIVIGLXYRIYIVEYIFXXLLVRRHCCI

SEQ ID NO: 174620 - protein, 94 aa, Triticum aestivum
  Clone ID: PAT_TA_69038.pep
AYTGGGDSSSNSNGTGTGTWTCGNVEPLPHMDMFRDDAEPYPFDPTKFSPWHQQQPPDDDRGSAVFPIRSLSRDLPESCFELARGALEDEFDFM

SEQ ID NO: 174621 - protein, 80 aa, Triticum aestivum
  unsure (1)..(80): unsure at all Xaa locations
  Clone ID: PAT_TA_69039.pep
LDRQRAIDVRQGRRGTRMVRVXNILDLAGEREXREFLSFXGEIEHVDISPDVVATXRTAYATFKDXRALEITLLLSWGES

SEQ ID NO: 174622 - protein, 112 aa, Triticum aestivum
  Clone ID: PAT_TA_69040.pep
VGLEEEFGKVIKLNLILLRCNHDKTNLSFTIFILICCQDCWLFLLLASFIRTTQTSATAAAAACPIESPPCSYCWLLPITSAADMAMLAYLWSVYNWHQKKLLQCNDQLGNL

SEQ ID NO: 174623 - protein, 61 aa, Triticum aestivum
  unsure (1)..(61): unsure at all Xaa locations
  Clone ID: PAT_TA_69041.pep
IYSYSXXYIHGTGMQLQYXKLXVXEEXIPXTXXARSCHGXXXSAAPPPFQATRQRSKDTXP

SEQ ID NO: 174624 - protein, 71 aa, Triticum aestivum
  Clone ID: PAT_TA_69042.pep
WPGMAAVQRIKPAMATASFQCVRNLLLSTHSFTYCSCILSMYVVHAIAVNFAHTVFVKRQKGLYQPSKKIA

SEQ ID NO: 174625 - protein, 161 aa, Triticum aestivum
  Clone ID: PAT_TA_69043.pep
KQGRTWKFSAGVRRVALELMEAILEGLGLGKHYQHEEFENGLQLLQVNCYPKEPEGESAIGLAPHSDHGFLTILLASCPGLEVLDRSSDTWRVVQQPRHALHVHVGDCMEVLSNGRVKTAVHRAVLNHGEARISMASIHSFAMHEKVSVAKELVDEQDPPE

SEQ ID NO: 174626 - protein, 31 aa, Triticum aestivum
  unsure (1)..(31): unsure at all Xaa locations
  Clone ID: PAT_TA_69044.pep
RPRXRRSCVSKXLMXKDIQKCGVSRSRKSXR

SEQ ID NO: 174627 - protein, 47 aa, Triticum aestivum
  unsure (1)..(47): unsure at all Xaa locations
  Clone ID: PAT_TA_69045.pep
NILSPSGIIXGEMDVXRHILXLXTSIFVHFCDKYFHMEGTKYFASLE

SEQ ID NO: 174628 - protein, 184 aa, Triticum aestivum
  Clone ID: PAT_TA_69046.pep
FPCLVDKIPSVHAVFVFMSIKNLPIPRVALPERFIFRRVGPAEHRMFRCVARYGYTDQIEGTKEFSAFLIEGLKLFVHDEAAFSCPHTDNGGDNNNNNDDNDARRLEQAVVAEEEKRFIDAEVERGVVYLMGEAEVAAAPGSSGLKRIVVNYVYTFLRKNLSESHKALSIPKDQLLKVGITYEI

SEQ ID NO: 174629 - protein, 140 aa, Triticum aestivum
  Clone ID: PAT_TA_69047.pep
LHPVGCTPWLTRPTNYTVCDSRANMGVDLHNGHLSINLRKSKNVHILDLATAFSNIVNPAPGKGSRLAKRFEHKLTPCCESFDPEGYCGQLSKNSERLYTVCKNPDQYFYWDSVHPTQAGWEAVMKQLQKPMLKFLTKEH

SEQ ID NO: 174630 - protein, 83 aa, Triticum aestivum
  Clone ID: PAT_TA_69048.pep
PVAKLVMLECSAQVSDLGANWKDRFPSSLYQTSNVLSSRLARVHMMTPFIFDEGIGISLGEIVTMLFEMVLLNYRWKAWHGGT

SEQ ID NO: 174631 - protein, 146 aa, Triticum aestivum
  unsure (1)..(146): unsure at all Xaa locations
  Clone ID: PAT_TA_69049.pep
WRAPTXTSPRSXIHLVCPWSWSGTAPRFTCLXSSRSSTSTSSRSRYAPACCRRRQMGFPTTTRQEDHSSAGGNGGVRTARRACQWXRCLHRPNLLCSGAREVGHFAGNKALCHLDIXXQCPFFFESQCPFLGXTISSTSVRCIGPK

SEQ ID NO: 174632 - protein, 48 aa, Triticum aestivum
  unsure (1)..(48): unsure at all Xaa locations
  Clone ID: PAT_TA_69050.pep
SSXXAXMHCASCSPLAGSPCYXTLCTPFAAAASNTXXAVXNXLDALLF

SEQ ID NO: 174633 - protein, 131 aa, Triticum aestivum
  Clone ID: PAT_TA_69051.pep
GNEVKLYERHVDKLFTMFGHKEPKIDYYVCTINKTFAKPGQGMYFQVEYTEGELHKYNHEDDDTLSLKLVDGTMTYDTRFILGTGKRATIATNWSWFRHHANIHEGEICVFHFKRKAVRRLSRTVHHVYTQ

SEQ ID NO: 174634 - protein, 135 aa, Triticum aestivum
  Clone ID: PAT_TA_69052.pep
LDELRLHVPAASPCLQVQVLASCSSIFAYRGLSAERIADPCLHIHAPWMCAIWHDAQHAIETTGSLLSTSGTYTRTSLHCSVTVVCFISRLRHFVPQEDNSSFRIGGQPYYPFMSDDHYFRLFETKHYTNWSCGM

SEQ ID NO: 174635 - protein, 140 aa, Triticum aestivum
  unsure (1)..(140): unsure at all Xaa locations
  Clone ID: PAT_TA_69053.pep
ECXXVXVXXXVCVXXCXXXCXXXCVMXCVSXCVCXCVXVCMXVCVXVXXXVXVCVCVCXXVCVCVCVCVCVCVCVCVCVCVCVCVCVCVCVCVCVCVCCVCXXXXXXXXXXXXXXXXXEXXXVXXXXXXSVXXCAXXMXX

SEQ ID NO: 174636 - protein, 111 aa, Triticum aestivum
  unsure (1)..(111): unsure at all Xaa locations
  Clone ID: PAT_TA_69054.pep
NIKHIQPHHTSSSSTSSSRTPQTNNTSTQYSSSTKSMGRSRRKQELNSLTETRASGGGVWASFLVRRAARNTFFWLAVPVTVTLSHALVPRSXHVHVMHALKPEHHQPRLT

SEQ ID NO: 174637 - protein, 43 aa, Triticum aestivum
  unsure (1)..(43): unsure at all Xaa locations
  Clone ID: PAT_TA_69055.pep
HMFLRQLLLDTTPXVAYKKIAHXNKACSELNCLYXQVQQXLQR

SEQ ID NO: 174638 - protein, 94 aa, Triticum aestivum
  Clone ID: PAT_TA_69056.pep
AMPKLQRLDLSWMKDESATPTGIEHLLALERIGVRFRSSTESEKEKRGVSHQERYQHASQPCSHYNRCMIILGNSLEQQLGRDWKPILFLGARR

SEQ ID NO: 174639 - protein, 25 aa, Triticum aestivum
  Clone ID: PAT_TA_69057.pep
IVLTTTTYSSHYPKPRARISFCLSW

SEQ ID NO: 174640 - protein, 72 aa, Triticum aestivum
  unsure (1)..(72): unsure at all Xaa locations
  Clone ID: PAT_TA_69058.pep
CHRKVRHLTITTNNLLKLXMDLALQLSHPSDHHFLQQVRTILFFEDFGDSDDXLEVLVEIFSITKSVRVLGL

SEQ ID NO: 174641 - protein, 72 aa, Triticum aestivum
  Clone ID: PAT_TA_69059.pep
ISLSMELLSALRRWHKISYAGRSAKKHQEGLLGWYRGQMHPRIGPLRIMVCFPPFVYHRHRGLASIYYDIFV

SEQ ID NO: 174642 - protein, 169 aa, Triticum aestivum
  Clone ID: PAT_TA_69060.pep
HLTVHITSRVCHAHEHPRLNVLPSRLPGTLVRPQLTWIGGFLSRNFLSASQHVVSLLPHRRVRRSPPPPAAPPLLSAAYGRERGSTLPLSLVRSSSATPQTQTRDSIAAIRSSTAPMTRAQTAVATCLSYAAPWMRATERESPAPPSASPLLAHGSERGAPWPPAALLC

SEQ ID NO: 174643 - protein, 227 aa, Triticum aestivum
  Clone ID: PAT_TA_69061.pep
KEGTYKGKKFNAICHFFGYQARGAMPSKFDCDYAYVLGHVCYHILAAGLNGYMATVTNLKSPLNKWRCGAAPISSMMTVKGWSRGPATTQIGKPAVHMASVDLRGKAYEMLRQNSSSCLLEEHSEAWVLSGCSQGGAECHVFRDGDTGYHDFLFYWPAPTLRAKHLSGLRIYYAFPGSLLLHLMVGIRDSDLVIPWFILFLVFRRVLLSFLALIAYAGVLFGEAQLE

SEQ ID NO: 174644 - protein, 71 aa, Triticum aestivum
  unsure (1)..(71): unsure at all Xaa locations
  Clone ID: PAT_TA_69062.pep
LWXTSSSTXXAFTRXXMSSGMXKSRTAPVVVGGWASXXCQXLVFPXLIAVSVPXYXSPYALKPMYGFSHPG

SEQ ID NO: 174645 - protein, 73 aa, Triticum aestivum
  unsure (1)..(73): unsure at all Xaa locations
  Clone ID: PAT_TA_69063.pep
PAPSRXSSPTXASSRSXRXPVAVVVIAPCVPCRVVDLNKRVVCRVFPWSVXXDLRXWFRRVLGALFGPLDAAS

SEQ ID NO: 174646 - protein, 168 aa, Triticum aestivum
  Clone ID: PAT_TA_69064.pep
SNQHILESADSALEDNCSKEVGGLTKSSMRSLKRPYESQQQSFTDAEVRGGTMRLASSRSRAMASCQLRRSAFLPKSGNATGAAAAPLNLFMLAPDKLSSMLNPSDKDSDQDSLLLEVPRNARHPEAELLLCCPPPSQLSSVTVTAASPPSNHSPGSASDQLRNRHQW

SEQ ID NO: 174647 - protein, 53 aa, Triticum aestivum
  unsure (1)..(53): unsure at all Xaa locations
  Clone ID: PAT_TA_69065.pep
FDXKXLVXCXKNVFTFEKNIELYKLVIKLMDKVFLQYARLILKSEWRGYLYTV

SEQ ID NO: 174648 - protein, 42 aa, Triticum aestivum
  unsure (1)..(42): unsure at all Xaa locations
  Clone ID: PAT_TA_69066.pep
RLPRLTTGRRXLLPPHRSAVRCRGREXXRXIXSXCRVHLQAS

SEQ ID NO: 174649 - protein, 32 aa, Triticum aestivum
  unsure (1)..(32): unsure at all Xaa locations
  Clone ID: PAT_TA_69067.pep
PGIHXIAGXGIGTSVHARKXQLTGKIARYSLI

SEQ ID NO: 174650 - protein, 60 aa, Triticum aestivum
  Clone ID: PAT_TA_69068.pep
FFVHIQANKKAPPCDHHRRLVYNGGSSSSSKFSNPFLQLGFPTDRMQQQQHTPLLFTYYP

SEQ ID NO: 174651 - protein, 82 aa, Triticum aestivum
  unsure (1)..(82): unsure at all Xaa locations
  Clone ID: PAT_TA_69069.pep
KCSCFXTHSSVASLVFSPFLLFYILVRTTEKGRKRATNQIFSSLFIISSYLTFGVTKNPLSKYTFLHVQYCLCNKKCIHLAI

SEQ ID NO: 174652 - protein, 199 aa, Triticum aestivum
  unsure (1)..(199): unsure at all Xaa locations
  Clone ID: PAT_TA_69070.pep
FLDKACINSGQSGAWSVCSLRKVEEIKIILRVLPLFVSSIIGYISNVILFTFTVQQGTMTNTRLXFLVPFLRRRTGYVGGVTHLQRIDVTSFTGLLEFFNSEAPRGMKSIATALFWCALGLASLLATTLVEIVNKATRHGHQRGWLEGTSLNNSHLDLFYWAVAVVGLLGLCNYLYWAKKYVYQHNPRIVETSVDQDSP

SEQ ID NO: 174653 - protein, 162 aa, Triticum aestivum
  Clone ID: PAT_TA_69071.pep
VYKIGGIGTVPVGRVETGVIKPGMVVTFGPTGLTTEVKSVEMHHESLLEALPGDNVGNGYAPVLDCHTSHIAVKFAELVTKIDRRSGKELEALPKFLKNGDAGIVKMIPTKPMVVETFATYPPLGRFAVRDMRQTVAVGVIKGVEKKDPTGAKVTKAAIKKK

SEQ ID NO: 174654 - protein, 68 aa, Triticum aestivum
  unsure (1)..(68): unsure at all Xaa locations
  Clone ID: PAT_TA_69072.pep
RIAXYMXNKXXIEXSLVPXMCXNLYREXXXTMSGXKLMXYXXXYXXFHXSXHGKLPYXKXXPDXVXXN

SEQ ID NO: 174655 - protein, 52 aa, Triticum aestivum
  unsure (1)..(52): unsure at all Xaa locations
  Clone ID: PAT_TA_69073.pep
KKKFEQLXDLMASINXQPTKKLKRKGGKKXGTVLKXXAFTIXGRLTNDLKAM

SEQ ID NO: 174656 - protein, 44 aa, Triticum aestivum
  unsure (1)..(44): unsure at all Xaa locations
  Clone ID: PAT_TA_69074.pep
QVEEVXKEYXXAYVRIIXLDNMXQXQCVSFIAFKPPGCEESGKX

SEQ ID NO: 174657 - protein, 41 aa, Triticum aestivum
  unsure (1)..(41): unsure at all Xaa locations
  Clone ID: PAT_TA_69075.pep
GFGKXXYFKNIXVVYSXNNXKXPHGMXTFTEQSNCYYVQNG

SEQ ID NO: 174658 - protein, 67 aa, Triticum aestivum
  unsure (1)..(67): unsure at all Xaa locations
  Clone ID: PAT_TA_69076.pep
IXXIXKXNFXFRXXMISINLXXKKGXNRFIKTXXYXHFXXEXADFXWXVXKPXKFDKAXAVKNHWWL

SEQ ID NO: 174659 - protein, 54 aa, Triticum aestivum
  unsure (1)..(54): unsure at all Xaa locations
  Clone ID: PAT_TA_69077.pep
SEAGKCTTSIFTVYSVYSIDISLAYLLCKTTSINISDFTIAIQMTVYIHVKFXA

SEQ ID NO: 174660 - protein, 156 aa, Triticum aestivum
  unsure (1)..(156): unsure at all Xaa locations
  Clone ID: PAT_TA_69078.pep
DVRCETKTKDNVFVTVVASIQYRXLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAVRDIATQIRDGLLQGQSASDN

SEQ ID NO: 174661 - protein, 57 aa, Triticum aestivum
  unsure (1)..(57): unsure at all Xaa locations
  Clone ID: PAT_TA_69079.pep
XXGWVXIRFXXXNPGVWFMHXHLXVHXTXGXRMAWQVQXXSXPSXKXXXXPSXMPKC

SEQ ID NO: 174662 - protein, 114 aa, Triticum aestivum
  Clone ID: PAT_TA_69080.pep
RDHTLIFFTVQLVVVLLGMLVYRFYGDELREMFGYEQHPYAFYALAILAVILVGLLYGFFIAIICGQRITERHYHVLAKQELTKEYIVEDLEGADPVADLDPSHVTELRTLGLY

SEQ ID NO: 174663 - protein, 103 aa, Triticum aestivum
  unsure (1)..(103): unsure at all Xaa locations
  Clone ID: PAT_TA_69081.pep
DKXAXXLVXXFXKCXXDPXXWDKMXEXGXXXIYXKXXXXXYXXRXMTLTXVYGXXKYVSNLXRXXTRXYLXMXYAXKYRSXXAAVPLAXTATTSVQWGRRREG

SEQ ID NO: 174664 - protein, 177 aa, Triticum aestivum
  Clone ID: PAT_TA_69082.pep
SFVAAAAASLCRNAGSPCPLLSAVGPPKAGSFPVRPASLYRSHRILWIELAGCLSGSSRSSLWIRSPLGCYSSNDLTPPAAPRWTSLPAAGLRLLQLLAAGSRRQTALLAGFCRSARCQLTVPACCCLSPRPAVVVCCGSPCYSRVTAGAIERRRSSTILLVSVGSGPDTCIMGSMR

SEQ ID NO: 174665 - protein, 151 aa, Triticum aestivum
  unsure (1)..(151): unsure at all Xaa locations
  Clone ID: PAT_TA_69083.pep
KLKLLNMLLLETLRLYCPITFIQRKTXSGTILANIEVPKGTIMSIPLLMLHRDKEVWGPDADEFNPMRFQNGVSVDTKLSRSLLAFSYGPRVCAGQNFAMVEVQIVIATILRSFSFSLSPTYVHKPSNFVTLLPRYGLPLIVRNLQQLTTG

SEQ ID NO: 174666 - protein, 155 aa, Triticum aestivum
  Clone ID: PAT_TA_69084.pep
LREMHYLHAAVTESMRLYPPVAMDSRCCKHDDVLPDGTFVGKGWQVSYSAYAMARLEEIWGEDCAEYRPERWLDEEGAFRPESSFKYPVFHAGPRMCLGKEMAYIQMKSIAACVLERFSFQFIGGESRPGVVFSVTLRMEGGLPMQVKKRGALSS

SEQ ID NO: 174667 - protein, 170 aa, Triticum aestivum
  Clone ID: PAT_TA_69085.pep
LGEFAKEQKYQYDVVYAIATMAATKLHPDSTVLLNEPFGSLGIYEGHITTPNCTASTLQNSVVSESKRYFKLSCMYMDHMLTLDNIDDEEGHQSSRVLGAPVIGYDSKMIGIVCSVATSGDLKYAIHVEHMIKPIEDMCDKHSKEILHSKKIWLDWEGKLKKVYTAVQKA

SEQ ID NO: 174668 - protein, 52 aa, Triticum aestivum
  unsure (1)..(52): unsure at all Xaa locations
  Clone ID: PAT_TA_69086.pep
EDXXVPXHXXKNIXQYIKQMXXTXKVLLVXXXDIXXKLXLATKNLXXVNVIP

SEQ ID NO: 174669 - protein, 142 aa, Triticum aestivum
  Clone ID: PAT_TA_69087.pep
NILLGKNMTPKISGFDLSVDSTEGMDPIAMRRGTLEYMPPEYIDSGIISNKFDVFSLGSIIIRMMDGHGGPYRYSEMSPNQFIEYVSENWKKRLEKLSEHSSYEMDILQVQACVEIAFRCLEADRNKRPSIEEIICELGLRQ

SEQ ID NO: 174670 - protein, 43 aa, Triticum aestivum
  Clone ID: PAT_TA_69088.pep
FTPGVENMLSTMPSNHAVSKSTQCYCFVHRREVCLRKRSMLPA

SEQ ID NO: 174671 - protein, 164 aa, Triticum aestivum
  unsure (1)..(164): unsure at all Xaa locations
  Clone ID: PAT_TA_69089.pep
MPSKKLIATCWAGKMPAPQYLAECDSEVLVIGYSDGFFTHPLVYRLSDLILXRAVPVTSIGDNVLFIDERILSVSSKVLPNIVGDSIVTVHPTELYLAERHLNSDTWLQAADGRIANCHLSRPYSLIYHIFTCCHRASWNKGTILYQFKNQNNWKVKRKWRQGA

SEQ ID NO: 174672 - protein, 143 aa, Triticum aestivum
  unsure (1)..(143): unsure at all Xaa locations
  Clone ID: PAT_TA_69090.pep
MAGTDSXSASSRQSSFNSLAKDLELPLEQGCLTIVVLGASGDLAKKKTFPALYHLFEQGFLQSGEVHIVGYARTNLSDDGLRGRIRAYERLILDTIRGDQQHFVRRDELKAAWQIFTPLLHDIDAGKLKAVSYKPGSRGPKEA

SEQ ID NO: 174673 - protein, 99 aa, Triticum aestivum
  Clone ID: PAT_TA_69091.pep
GCLCTLPCHASLNRTCIILDCASCHVHVVVVYYVVCSFPVLFLRVGSGNVVFVRNRSSTSVCLLHGRVLLPCGISDAGPDDSAPGDALEFKWDFDEDSQ

SEQ ID NO: 174674 - protein, 199 aa, Triticum aestivum
  unsure (1)..(199): unsure at all Xaa locations
  Clone ID: PAT_TA_69092.pep
RSLKCMKLLIKAGADVNCNGSMLTPLLLATMHGGYTNFIKLLLKAGPDPNIPDDEQRHLQRRKALIKSKADTAFKQKEYKIATKIYDLAIAHGESATLYANRSVCKLLIGDGEGALSDALMCXMLRPDWAKACYRQAAAHMLLKEYEQARDALLDAHNLDPGNAEIEGELQKARELMKNPPGECEQCTDSGDATCASFH

SEQ ID NO: 174675 - protein, 81 aa, Triticum aestivum
  unsure (1)..(81): unsure at all Xaa locations
  Clone ID: PAT_TA_69093.pep
VINIGKVTDNNFSLSXEVHCHLILPSCYSIVDITDFKAYCLYGRNVIRGSYDLKLIFSELQCKFKTCYHQILLLKSRNQYV

SEQ ID NO: 174676 - protein, 79 aa, Triticum aestivum
  Clone ID: PAT_TA_69094.pep
GGNMCLLQAARAMQAGGELEKKASSDIKKVQLGRTWQKLYICKWRFRHSSMNSYRIPTRTCVIPNCDNDLSTHEQSFLY

SEQ ID NO: 174677 - protein, 79 aa, Triticum aestivum
  Clone ID: PAT_TA_69095.pep
MANSEYEYVKREFEFDRRLPASNWIVVRIDGCHFHRFSKIHAFEKPNDENALRLMNACATSMLEKFPDIVFAYGVSDEY

SEQ ID NO: 174678 - protein, 85 aa, Triticum aestivum
  Clone ID: PAT_TA_69096.pep
FCKNGGYQTDPWSMRSSLSGATLLVWLQAEETLLIKKICAAAIAFFSFWSLVHLQMCGPHSLLLDCSTLLLWLIIIAISAAHDDG

SEQ ID NO: 174679 - protein, 220 aa, Triticum aestivum
  unsure (1)..(220): unsure at all Xaa locations
  Clone ID: PAT_TA_69097.pep
ASSSYQAXAALAKALVTFYPLAGRIGDDGDGRAEVNCGNQGVLFVVARSEDLTVADFHGRPSSKLRRLFVPRMEPPSIVCGVQLTFFKCGGVAIGLAVHHFVVDGSSTSHFTRTWAAISRTGDMSAVEAEPPCHDRFLLRPRSPPAVHPDALSVFCPMVNLCESSGVPLRSEAFLVSKDQLEALKQACGGRAVSTFCALTAHIWKCVSATRPMPPDATTR

SEQ ID NO: 174680 - protein, 127 aa, Triticum aestivum
  Clone ID: PAT_TA_69098.pep
EYLSSSRHKAARSCYKIPPRASTSADRSEQVVAEICRVWEEECGPVVYARRGRWTQDPACVILSLLLGLPVLWRGKGNLLRKISTRRDQEGRTGGLRNRQRQGRRRWGCVSFVLCGCPPLPAIVYSP

SEQ ID NO: 174681 - protein, 45 aa, Triticum aestivum
  Clone ID: PAT_TA_69099.pep
MQQRQEWVGDWVRSNDTLVRALPILVGGASLLAVLLNRAVSGIAA

SEQ ID NO: 174682 - protein, 155 aa, Triticum aestivum
  unsure (1)..(155): unsure at all Xaa locations
  Clone ID: PAT_TA_69100.pep
PVTRVSSPXIXFLKSLSGKVRSDIKLIFRFLREDLVEPTTKRTYGELLKDLKAIKAFASGILVPKQFIWPQNKDMYLEPSTSLVKDAHALGLEVYASGFANDDPCMSYNYSYDPSAEILQYIDNSDFSVDGVLTDNPPTASGAIGTYPYNLALRF

SEQ ID NO: 174683 - protein, 109 aa, Triticum aestivum
  Clone ID: PAT_TA_69101.pep
APSMPPRPQHLEPPGTTSLSSAARVPTGHLHDRVARVDEFAEIHTLTQPHVPPPRKKNQEKRSDMWIWDSVRISFPDGAQRRRPSPAANRKKWRMCMRSLVGIVREERR

SEQ ID NO: 174684 - protein, 135 aa, Triticum aestivum
  unsure (1)..(135): unsure at all Xaa locations
  Clone ID: PAT_TA_69102.pep
HIGTRSEHHSPKNNMDVVVKREETRREASDGEWPTAGGGVSMRAGLLLHPPASYLFPVASAMATAESCLSSSPPLPCSFTSTPDSANLRPIWNQAPPTATYTTDRRNARWKGSVVEKQQQWWSRSSRRRRGXMRQ

SEQ ID NO: 174685 - protein, 109 aa, Triticum aestivum
  Clone ID: PAT_TA_69103.pep
RKGRPATRRRKDTQAPEARMTSAGVGSRRKISATSSSGIGSEAISWKPCRDGSRRGDEWRRWSRMPGSTRGSSLVLPWSAAPPPIPPPVVRSSAWKPILVGSIGEQSRA

SEQ ID NO: 174686 - protein, 101 aa, Triticum aestivum
  unsure (1)..(101): unsure at all Xaa locations
  Clone ID: PAT_TA_69104.pep
GSDFPRGGDVHGLWWCEKETQQATAMRERRELEREGGXRAGEEAWTMRVSRRRRGRRGGRVARLELLGASGAAALGKGWXLPDEEFKGEEVGGSGRIPMSL

SEQ ID NO: 174687 - protein, 38 aa, Triticum aestivum
  unsure (1)..(38): unsure at all Xaa locations
  Clone ID: PAT_TA_69105.pep
RHEDYSMFCFNXIKTWMIICSNSYSDDLPGAVMPSKKK

SEQ ID NO: 174688 - protein, 120 aa, Triticum aestivum
  Clone ID: PAT_TA_69106.pep
QGEARLPPACVSKVLDDEDLLSEIIVRVGFPTSLVRAAAVCRRWLSHASDGAFLRRFRELHPPRLLGFYIAERDYPASERFFPMLHLPPELAAVVRRASFRPDAYDGAHAHVVGCSNGSV

SEQ ID NO: 174689 - protein, 128 aa, Triticum aestivum
  Clone ID: PAT_TA_69107.pep
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAAAEREAAKPAKKKESG

SEQ ID NO: 174690 - protein, 106 aa, Triticum aestivum
  Clone ID: PAT_TA_69108.pep
LQIRHEDSVTPHILNYGRVDQATKSLKFPLSRPCEAGAQCFLSYGKHPGSHLITFYGFLPREDNPYDVIPLDLDTSVHEEDGTAQSVSTSVTTHMVRGGHGCADHE

SEQ ID NO: 174691 - protein, 81 aa, Triticum aestivum
  Clone ID: PAT_TA_69109.pep
GNTRCTSKVFQQLHKFDHQSITARIKVFDRTAIIKVIHSFVSLRPLDNHAIQYDLLSLLQLLFIVYFSHFNQKVGLVPQYY

SEQ ID NO: 174692 - protein, 87 aa, Triticum aestivum
  Clone ID: PAT_TA_69110.pep
GQTIYQANYNYCFRIRVQDTCKLLQTCNLCVMWERGFTIANALSCQLRGSAIQQLGLWLSCRFSFFSALFTKCKLAIKSGNLLPPPP

SEQ ID NO: 174693 - protein, 195 aa, Triticum aestivum
  unsure (1)..(195): unsure at all Xaa locations
  Clone ID: PAT_TA_69111.pep
HVTXRVMGTFGYMAPEYASSGKLTEKSDVFSFGVVLLELITGRKPVDASNPLGDESLVEWARPLLTQALETGNVGELLDPRLDKNFNEVELFHMIEAAAACIRHSAPRRPRMSQVVRALDSLTDVDLTNGVQPGMSEMFNAPNTAEIRLFQRMAFGSQDFTTDFTQSSSWNSSPSGRRRRRLWWAEAPAVATVVV

SEQ ID NO: 174694 - protein, 55 aa, Triticum aestivum
  Clone ID: PAT_TA_69112.pep
YESRDGQRHLRKTFEPNSSSIWPSSFFLRKSSTTEREREEAPCSCCSVVARTRPS

SEQ ID NO: 174695 - protein, 196 aa, Triticum aestivum
  Clone ID: PAT_TA_69113.pep
DAVSDTALRIVASMKRDWMQTGRKPSGLCGAALYIAALSHGYNYTKSNIVAVVHVCEATLTKRLIEFENTDSGSLTIEDFLAKADEEPVSKFSPISGEVLCKHKDKAVEHFAHGLCEKCYNKFTKLSGGLEGGADPPAFQRAEKQRLEAAKKAEEAAANKEAMLGESICEIQNSDAEHNITSTTEDSVGDKSATIG

SEQ ID NO: 174696 - protein, 57 aa, Triticum aestivum
  unsure (1)..(57): unsure at all Xaa locations
  Clone ID: PAT_TA_69114.pep
VVVXVXAVNXLLLLIXLXVLTLXVHIHHLXRRLFGGXRGSLDAGDXRRTLVTFNRRL

SEQ ID NO: 174697 - protein, 164 aa, Triticum aestivum
  Clone ID: PAT_TA_69115.pep
RGRMVSAFLSHLFSEIADYSFTANMETELDNVSAGSTEWKGLLTDYWERFSKYCADASQWDVRKVERMLEEKFLPILFPDLDTDSRICPSCSEGTLRFKVSRYGEGYFIGCDRHPKCKYIARTLSDEDDENETSEETPKSFEPRLLGVKPDTDEKVFLKQGPYG

SEQ ID NO: 174698 - protein, 70 aa, Triticum aestivum
  Clone ID: PAT_TA_69116.pep
GVSHMDYSLRTMSTTSYRAMITMQLLLPKLNRTTLIFDLPLQLPATSSHRIRSEPTPAKSEIYQSNTPPS

SEQ ID NO: 174699 - protein, 75 aa, Triticum aestivum
  unsure (1)..(75): unsure at all Xaa locations
  Clone ID: PAT_TA_69117.pep
HLSPCHLHLIAMPAISYNFFVSADLIASARLLHTLAYIIDTYCYWYIIITSRSKKDRAKNVEEEDQVMPRAEXPA

SEQ ID NO: 174700 - protein, 129 aa, Triticum aestivum
  unsure (1)..(129): unsure at all Xaa locations
  Clone ID: PAT_TA_69118.pep
RHEALAYRQXIIEENVRLAYALQTAHQERSMFISSLLPILSEYENLRPPVPDAQSIVGNLKVLFRHLQEQLMLTEEKVKESQYQINPWQNELPNKASLPVQSPNNPLGKVSNKGSLDIVPQTPYPQVQS

SEQ ID NO: 174701 - protein, 146 aa, Triticum aestivum
  Clone ID: PAT_TA_69119.pep
SARGCGSLAEEGTVIKIGGTLQSSPLSNVPLVTKKGPESCQDVDQTDDMRKEELRTLTNSEHVDPELRDGELDEGRETSALVLADALMQESDGMHNGPVDENAKDDLEAFPPKSVALHRLRWNTNRGSERWLCYGGAAGIIRCQRI

SEQ ID NO: 174702 - protein, 140 aa, Triticum aestivum
  unsure (1)..(140): unsure at all Xaa locations
  Clone ID: PAT_TA_69120.pep
SARGWTCDSRXELFDKMTSSYGIKPQTEHYTCMVDLYARAGLLEKAEGMLNRSSFIPTPAMWAALVGACHDRGNIIIGERAARRLLEMRTENAGHYVLIANMYAAAGCWDELAEVRKLMRDSGVMKAPGLAWADLGNGFT

SEQ ID NO: 174703 - protein, 169 aa, Triticum aestivum
  unsure (1)..(169): unsure at all Xaa locations
  Clone ID: PAT_TA_69121.pep
FGTRFIFSPKSPPNQLDLPSTPPPPPXSHVPSPPQPTTAPPPTPPATPSPRPLPSSPPTPHHSVAEHTSDTDLSRRRPAPSPSHSTADHCPPPSTVLCHHHTLRASSPEQDLSPEHRPSLPPLRPLPQATERPSPPASSSASSTSLSQTRAFDRLQVVGWPPIGSYRKN

SEQ ID NO: 174704 - protein, 109 aa, Triticum aestivum
  unsure (1)..(109): unsure at all Xaa locations
  Clone ID: PAT_TA_69122.pep
GWWWFKAGRRPAPYIPPGPAPSRPXLLRSPTSRRDAGSVSQRHVTCRPGAQPPRIRDFFCCCALPRPRRVHFLNLERVLHFLPSMNCIFTGVAAHISVTPKDEVQFLAF

SEQ ID NO: 174705 - protein, 90 aa, Triticum aestivum
  Clone ID: PAT_TA_69123.pep
RSVAGWRTEGGPSVATTRTGRKKSTRARATWCPRASEGREPKPALAVDLGRIWASSRSPARSHRGGCSWWRRGRSQRRWREATRAQRRRI

SEQ ID NO: 174706 - protein, 247 aa, Triticum aestivum
  unsure (1)..(247): unsure at all Xaa locations
  Clone ID: PAT_TA_69124.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGXTLADYNIQXESTLHLVLRLRGGMQIFVKTLTGXTITLEVESSDTIDNVKAKIXDKXGIPXGPAASSXFAGKQLXRMGRTLAXDYNIQKECTLXLXXPPSWXXCQIFXXRTLTGKXXT

SEQ ID NO: 174707 - protein, 134 aa, Triticum aestivum
  Clone ID: PAT_TA_69125.pep
SLIFISLHFTGWEIFAVQGSCSFAQLCRLLHIWVNPVRISGLGICDCKGDFWVRGARDLRHVSPSILELSAHRGVQEDQSLIPFTVFTIKFTSILFNQTAGLVKSANLDRRTSKASASHDAHSHSKSWSYHQIF

SEQ ID NO: 174708 - protein, 166 aa, Triticum aestivum
  Clone ID: PAT_TA_69126.pep
AAGRFWATEPSSPMPGDRRGHRLSLSPPFGSPPDQPPPQVPFAGAPQSRDIASSASSGRTKRSASLPHAMDLRRHSSSRPALFWTGFSLSAIRNKLPFRRSPPPRRSSYRVAPPSLTLVCIASAPGAASSVSFERAKTSPALTSPGPGLSSIWSRLDLESPRSGVA

SEQ ID NO: 174709 - protein, 91 aa, Triticum aestivum
  unsure (1)..(91): unsure at all Xaa locations
  Clone ID: PAT_TA_69127.pep
QVCSIICRARXAHKQIDRGCKRLSHDGNVVDFFYSKNQKPIACDHQITGTGLQQNSRQTTIAIIHSSLCICFLQLLFLNFNFSFLGMLSNA

SEQ ID NO: 174710 - protein, 140 aa, Triticum aestivum
  Clone ID: PAT_TA_69128.pep
MNVNTDVQHSHNRTYPESHSDIQPITSAGNNLSSKPYQDNMYFQHSLPGSLPNNGSPSEVSDEASGISKGTIEELDKLCEDGNIKEALKALPVLQGKGIVLHAPQYFKLMQACADACALAEARQIHDQISQSELAVDIDV

SEQ ID NO: 174711 - protein, 134 aa, Triticum aestivum
  Clone ID: PAT_TA_69129.pep
AQMMYGAYSPVATVGEGQSYSPMHFPFSSPYYQPPASLSMGYSNSSTGMSQGDPMLQQEYFLPDGLLYSPTTVYHQPFESYNRAATQPSNAPGLFGQGNAPLVSGMHGSMYNSGSYKARQQASKYGGITPNWGS

SEQ ID NO: 174712 - protein, 261 aa, Triticum aestivum
  unsure (1)..(261): unsure at all Xaa locations
  Clone ID: PAT_TA_69130.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIXAGKQLEDGRTLADYNIQKESTLHLVLRLRGXMQIFVKTLTXKTITLXXESSDTIDNVKAKIQDKEGIPXDQQRLIFAGKQLEDGRTLADYNIQKEXSPLHLVLRLXGGMQIFXKTLTGETIXLGGWERHTKLRARFGQGG

SEQ ID NO: 174713 - protein, 140 aa, Triticum aestivum
  Clone ID: PAT_TA_69131.pep
VRQKVSKNAQIWPRTPAPTCSSDLGSHRIHTVPRNQMASSNGRDRTTKARKEEHAIQTSGQTRKTTRTRIERPTARRRRQRQVEPSCTQSKGAQLCEISRAKQEERRGEEHKKNNNTNPTSGAHRAKEATATDRSRGQSK

SEQ ID NO: 174714 - protein, 135 aa, Triticum aestivum
  Clone ID: PAT_TA_69132.pep
ASFLSSRHERHTAMDVAFKHPFPLRPLSTSMSPCVLTTTSRKARVEATTSYSAPPSPVSLRRRRSHTGDTIFLQDAMRLWLCFLYLASCNFLICRFQLFISPVVAIFIHEHQSLIHWFQHFFPSVVAFHVAGSNF

SEQ ID NO: 174715 - protein, 65 aa, Triticum aestivum
  Clone ID: PAT_TA_69133.pep
QEPVASCRPTGVGLQWADRGQLASCRPTGVQSACCGPTRPSQPAAGRRCIIFEKKLPSVIFMKIN

SEQ ID NO: 174716 - protein, 121 aa, Triticum aestivum
  Clone ID: PAT_TA_69134.pep
SIGHLHGGRSKWRCVKSLSCGTYPEALQSSMVILHRQMHIFATTDTCTSNNIVGVLPNFLGPISSFLDLDCKLCRGLAGDTRRPASQDDGRGWLEKDDIMTCKHVIYSLINISWNWEENKK

SEQ ID NO: 174717 - protein, 226 aa, Triticum aestivum
  unsure (1)..(226): unsure at all Xaa locations
  Clone ID: PAT_TA_69135.pep
LFYHNLPXGEDVPPLQLKEGVFRCIMQLFDCLLTEVHERCKKGLNLAKRLNSTLAFFCYDLLSIIEPRQVFELVSLYMDKFAGVCQSVLHDCKLTFLQIICDHDLFVEMPGRDPTDRNYLSSVLIQEIFLTLDHDDLSQRAKAARILVVLICKHEFDARYQKSEDKLYIAQLYFPLIGQILDEMPXVFYNLNAIEKREVLVVILQIIRNLDDTTLIKAWQQSIART

SEQ ID NO: 174718 - protein, 138 aa, Triticum aestivum
  Clone ID: PAT_TA_69136.pep
GGMQQRCIEAEMHSGGRADGGMWRTRCCGGGAGVGGSSEAGPQRHHSRRSCHGGWWRQRARSGPNLSRQIVVAAACFGQIARYPREAATRVFLGLISTESSEVDDGLVRLLLYGRRWHRGYWLGLNKGGWPYCPLIIH

SEQ ID NO: 174719 - protein, 157 aa, Triticum aestivum
  Clone ID: PAT_TA_69137.pep
MVTVRERLTQALAYIEEMQRDKHVLLQVWVPTMSYGQLVLTTRGMPFTLNKSSERLVQFRDVSTRYQLSADVASKGSPVGLPGRVFIGKLPEWSPDVRYFTSYEYPMVAHAQYLDVHGTMGLPVFEKGNPSCLGVIELIMTRQKLNFTSEINNICSA

SEQ ID NO: 174720 - protein, 200 aa, Triticum aestivum
  Clone ID: PAT_TA_69138.pep
GTMKLIQHPNVVRLHEVMGSKARIFIVLEYVTGGELHDIIAARGSLKEDEARRYFQQLINAVDYCHSRGVYHRDLKLENLLLDTAGNLKVSDFGLSAISEQAKADGLLHTTCGTPNYVAPEVIEDKGYNGALADLWSCGVILFVMLAGYLPFEDDNVSALYKKISGAQFTCPSWFSDGAKRLIPRILDPNPSTRITIPQL

SEQ ID NO: 174721 - protein, 87 aa, Triticum aestivum
  Clone ID: PAT_TA_69139.pep
NACVLTLVLRFNLLLLSLALLLLVHPAAYPTCFCLLPRVVRFLLSLCRSTRQGFLLSFLLHVCVFYFQYLLRHGVYLSDLLNICMSC

SEQ ID NO: 174722 - protein, 215 aa, Triticum aestivum
  Clone ID: PAT_TA_69140.pep
DLDVVFSQFSVSENGRRLSMNSIETVPVERLPSLASILSDKIDMLWSGSTEAHCSLPQDLIKADGKGSFSLLGNPNYKKAISPVRVHSFDSIFRLHEREQTGLLPASLHLSLKMRSVDSFRDLTSLVKDPMTNMRRAFSQISPRSRGNLNVILTRAPTYLKSASHMVSDGARLLLPHIGSEGALVVAVYDDEPTSIVSYAMTSQEYVEHVTHKLD

SEQ ID NO: 174723 - protein, 125 aa, Triticum aestivum
  Clone ID: PAT_TA_69141.pep
PAAGRACRRRTRWTHPRRTRSTACHQSRPRRVELAPSFPNQDSTSWPGDGAAHRAPAALGADDEDEGEDVEEQHLADHHDGRHGVAGRSEPNTLERSTMRSGGRGRPYDLARNPTAAIAGRRWWG

SEQ ID NO: 174724 - protein, 75 aa, Triticum aestivum
  Clone ID: PAT_TA_69142.pep
AKCLQTVEIVAIKKCAQISSGILLLCVRVLHFVLFDLSMTCLLQKCQGLALLNIFLMVEMAGIHADTPIRVFKTG

SEQ ID NO: 174725 - protein, 152 aa, Triticum aestivum
  Clone ID: PAT_TA_69143.pep
GATAANTTPRVLAAGEAASKMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKK

SEQ ID NO: 174726 - protein, 109 aa, Triticum aestivum
  unsure (1)..(109): unsure at all Xaa locations
  Clone ID: PAT_TA_69144.pep
ERMHVCCMXMLVCAPCPIVFARSSIAMPPSRGNPVVGITPPSCMTRSRHASFCTGISVSYRNRYVAVASFSDMLPWHHFRFTAVAPFSFRHGDKCFITCCCQHFHKNCI

SEQ ID NO: 174727 - protein, 145 aa, Triticum aestivum
  Clone ID: PAT_TA_69145.pep
TDRGNKLIIPLAKLPSYSKPTSRMAEQCKISAAMVSEQRSYARSYVLKVDGYSRAKAFLETGKCLTSDPFSVGGHVWTVECYPNGDNRIHAHYISLFLRLESADAGDVKGKFTLSLLDKNGEPVPSYSRASPVLTFSKKDSCLGY

SEQ ID NO: 174728 - protein, 131 aa, Triticum aestivum
  Clone ID: PAT_TA_69146.pep
DRQRARHPAPNGGGAATGRHHPLFPRSSSTPLHHRRTSRAAARCKPRAPRPLTESNRRSSPRQPPRSSSRRRPGEEPPKHAPRWSSPAPVPLLHACPSSSPELMWAATSPRWPGPPSPAPAPSWPATLTFS

SEQ ID NO: 174729 - protein, 167 aa, Triticum aestivum
  Clone ID: PAT_TA_69147.pep
MAGRTPLTNAGAATEADAHKPDVAMVQLRTYICTELLPAFPALNTRRLTALPSSSGIDRISLLPDALLCNIVSRLPVTDAARTAVLASRWRRVWLSAPLALIDEYLRPSGNPPTVTAAVSQILDAHPGPFRFVHLVRSHMDACQPQLARWLELLATKGVQELVLVNR

SEQ ID NO: 174730 - protein, 114 aa, Triticum aestivum
  Clone ID: PAT_TA_69148.pep
KVVRDVYKVEVVEEGRELICECANFEHTFLLCCHAVKVLDFVGIYQIPAKHILKRWTKDARDVLSTHLSHLQKDSISVNSITFRHSNLHTHALEVVRLEMQIQRPMTMSVQWTS

SEQ ID NO: 174731 - protein, 189 aa, Triticum aestivum
  Clone ID: PAT_TA_69149.pep
AHHDFLAIAEASAYVPLHRRAAVRTAIEGLLHEAHLFTTECSDHPLGIGIFGFASSFLRDTAVNTPLELEEEDLLITFVPHNEALNRRTTSFGPEIWLMFFGFPYDYQTDYYITKALGGYGSLVNWYNPRQDRRYMLIKARVIRLNLVPKSFIVWQLGGARDCWTVQVTILRSSDWNGLLPDVLPPNEE

SEQ ID NO: 174732 - protein, 225 aa, Triticum aestivum
  unsure (1)..(225): unsure at all Xaa locations
  Clone ID: PAT_TA_69150.pep
SARGSDFXSLGVPSCRSKTGKTVEWTSKDLLNGLEEFVPIYQTRPIKNNMHGMRFDHSFGLWFMARWLKPNLMIESGAFKGHSTWVLRQAMPNTRIISLTPRHPEKYLKKGPAYVDGNCTYLAGKDFIDFGSVDWEKLLMKHGISNPSKVLVFFDDHQNELKRLKQAHKAGFRHLIFEDNYDTGTGDHYSLRQICDQSHIRGGGHSCFWDSDEARLRSERMKFWG

SEQ ID NO: 174733 - protein, 194 aa, Triticum aestivum
  Clone ID: PAT_TA_69151.pep
EVGRLPQLELLSFADNRLSGQMPPILGKLSHLTALQIGGNQFSGGIPKELGLLSSLQIAMNLSYNNLSGNIPSELGSLALLESLFLNNNNLTGEIPDTFVNLSSLLQLNVSYNNLTGTLPPVPLFDNMVVTSFIGNRGLCGGQLGKCGSESPSSSQASDSVSRPMGKIIAIIAAIIGGVSLILIAILLHHMRKP

SEQ ID NO: 174734 - protein, 200 aa, Triticum aestivum
  Clone ID: PAT_TA_69152.pep
MEAPQSRPWSDLQSELLGLILKRLPVLADRVRLRAVCQPWRSNSLEQHLPLPFPWLTLPDGTFLNIPGGEIHRMPIPEGACCQGSIDNWLFLTHNDDVCSLMNPFSNTTLELPKLAREWKRVIGPCSRFKPIFYKLVVPSPLDSSPNSLVAALIMDDSNCRTLCISQPPIATDSLRGDRYPITRLSDIAFFDGKLYALSG

SEQ ID NO: 174735 - protein, 93 aa, Triticum aestivum
  Clone ID: PAT_TA_69153.pep
MLSRWIPAAGRQRGLLARLGSRAYSHGRVFDAAARDGELRVFVVAGEVSGDSLASRLMASLRKLSPVPVRFAGVGGCGLTPVPTFLVQLSVLL

SEQ ID NO: 174736 - protein, 46 aa, Triticum aestivum
  Clone ID: PAT_TA_69154.pep
FYICMLYHTHYDIMMFCCLGVVIFLCINILHGTHFDILMFCYLGAI

SEQ ID NO: 174737 - protein, 148 aa, Triticum aestivum
  Clone ID: PAT_TA_69155.pep
MAQLMQKDDELLEAEENVQLMQAKNRELCGVVGALQIAIEGAKVVKGELEKKIMILTEEGTTKDGEILLLRQANETLEMDAGILKRKEQSLISAHELMSEEVEQHERESLLLIGDTVTSSVNVAVYKEMALEFMMEAKAIEISAIAQK

SEQ ID NO: 174738 - protein, 199 aa, Triticum aestivum
  unsure (1)..(199): unsure at all Xaa locations
  Clone ID: PAT_TA_69156.pep
KARSTITRNTMSKHKSEITSHEKAAGTSAGSGDGPRTTAKKADPSVPNKFNKERKLNSTVTSTLPRVKKIKAPSPASTMDSSAKPATNKHAPSPSPPSGKQTERKITLNNVAKNAQLWQNKGEEKVTLSPLKLSRSTVRAVRKETSDSPVKSKKFYGIESFSGCKDKISKTASPKIRKPDVNNKERQSRKGTSYLYLXT

SEQ ID NO: 174739 - protein, 92 aa, Triticum aestivum
  Clone ID: PAT_TA_69157.pep
ECRHIWEIFLHYQNCFVNFFNSVSTHGHSTSSTRMHPCYCVAKQLNFNYCLAFSKDKDASLLVVEMPFSSDLLLIDCCHDLHGSSEVAGAGR

SEQ ID NO: 174740 - protein, 183 aa, Triticum aestivum
  Clone ID: PAT_TA_69158.pep
MNDTGSAINQSDISGIMSAGAAGIVLINRKDAGFTTLLEDYGSDVVQVTVADGNNIIEYARATSKASAKVIYKNTVLGVRPSPTVAAFSSRGPSTFSPGVLKPDILAPGLNIIAAWPPLTILGSGPFNIRSGTSMSTPHVSGIAALVKSSHPDWSAAAIKSAILTTADITDSAGGPILDEQHQ

SEQ ID NO: 174741 - protein, 128 aa, Triticum aestivum
  Clone ID: PAT_TA_69159.pep
IKKFIRWIMMHLWTICIAPSRTQTNHLLRRNSCRCLFVTADCYWSPHDKELTPRRAGHARFRIWHGEARPRRPATTRSTAHPRQTALEVDGAAHPFAHPKELLVRRPTVQPPPFGGEEGCASEEEWRR

SEQ ID NO: 174742 - protein, 103 aa, Triticum aestivum; identical to SEQ ID NO: 107316
  Clone ID: PAT_TA_69160.pep

SEQ ID NO: 174743 - protein, 300 aa, Triticum aestivum
  unsure (1)..(300): unsure at all Xaa locations
  Clone ID: PAT_TA_69161.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDQREGIPPDQQRLIFAGKQLEDGRTLADYNIQKESTLHLXXRLXXGMQXFXKTLTGKTXTLEXVESXDTIDNXKAKIRXKXGXPXXDXXAXIFAXKXXEDXXXPXGXNIXRPPNWGL

SEQ ID NO: 174744 - protein, 209 aa, Triticum aestivum
  unsure (1)..(209): unsure at all Xaa locations
  Clone ID: PAT_TA_69162.pep
RHEGNMHYHRXRTDVAILGAEKNEAGAKHEMVTSALNAKLAKCLEELDKSHGNLQRHSTEHHGYLEKLSTLVMDDSMISLMAEEFGKKVSTLRDMSLTVKGMHEHLAAMGFQIDPIMEDSEFGKLFSLQDYNNFVTERMLDRKNRKENIDDDSSLSNIVEQCSNQAGHFSGFFKDLSGYMSDNIXLXLRALQLASSNFAXTLXEHDSLK

SEQ ID NO: 174745 - protein, 62 aa, Triticum aestivum
  unsure (1)..(62): unsure at all Xaa locations
  Clone ID: PAT_TA_69163.pep
MAPQLLGYYWXSSWPRLPQVPPWPCASXAHRRVICFGPPXCXAGAVRVLAEVDPALALDRGA

SEQ ID NO: 174746 - protein, 198 aa, Triticum aestivum
  unsure (1)..(198): unsure at all Xaa locations
  Clone ID: PAT_TA_69164.pep
NSHTSSGAIILCCFLDADLHHTPAAHALSAGVETNDLTTDGVLRPAACDTHDQSPPMVNRSAEPGPSVGPRILAAQMGCAESTTACCLVLDQSGAIDQHATTSLDPSSPPHPVQQFLLDMTSPVSGPLLAGPRSPPPLTKQRRARRPPATATRRSYRLQGRKEALSGGGNTSLRLARRVLVGKRGLTIAEXWRGRRGA

SEQ ID NO: 174747 - protein, 166 aa, Triticum aestivum
  Clone ID: PAT_TA_69165.pep
MAANGSDGICVAQPRSADPLNWGKAAEELSGSHLDAVKRMVEEYRRPVVVMEGASLTIAQVAAVAAADGARVELDESARGRVKESSDWVMTSMANGTDSYGVTTGFGATSYRRTKEGGALQRELIRFLNAGAFGTGSDGHVLPAATTRAAMLVRVNTLLQGYSGIR

SEQ ID NO: 174748 - protein, 188 aa, Triticum aestivum
  unsure (1)..(188): unsure at all Xaa locations
  Clone ID: PAT_TA_69166.pep
MCFFDEKISEALLIELQDFEFAFSEDGEERRFYYHTQKTRELDNLLGDIYHKILDMERAIIRDLVCRVLQFLPQLTKAVNFAAELDCILSLAIVARQNNYVRPILTEDSILEIQNGRHALQEMTVDTFVPNDTKIRSAGRINIITGPNYSGKSIYIKQVALXWVFLAHIGSFVPADSAVVGLTDRIFC

SEQ ID NO: 174749 - protein, 194 aa, Triticum aestivum
  unsure (1)..(194): unsure at all Xaa locations
  Clone ID: PAT_TA_69167.pep
VNVLFMQXDGGLAPESRFSGHKAVLSGPAGGVVGYSQTLFELETSKPLIGFDMGGTSTDVSRYDGSYEQVLETQIAGAIIQAPQLDINTVAAGGGSKLKFQFGAFKVGPESVGAHPGPVCYRKGGELAITDANLILGTVIPEYFPSIFGPNENLPLDYEATKKAFEELAVEINSYRKSQDPSXKGMTIEEIALG

SEQ ID NO: 174750 - protein, 66 aa, Triticum aestivum
  Clone ID: PAT_TA_69168.pep
YSANHHHHFYSAHHNCHRFYSAHHHPHHFHSARHHPHHFHSEHHHPQHFHSAHHHLKSRRHACASD

SEQ ID NO: 174751 - protein, 180 aa, Triticum aestivum
  unsure (1)..(180): unsure at all Xaa locations
  Clone ID: PAT_TA_69169.pep
CRFGTRVTSSPRAPLLPSLVGPGRPLPPPPMAGSRISPIRRVSPREPSRPPPSAPPAKNPTPIQTASAIPAPRRPDPPLXRPDRPLPHQRSSPLLSYLLLHRRPPPAPSSTLTLISPMRRTLPPPPRASFPPLPPTTTRRGRWAHWGSPRLPPCGPPRLHCSPPSRPGDSXKRTSRTLLP

SEQ ID NO: 174752 - protein, 81 aa, Triticum aestivum
  unsure (1)..(81): unsure at all Xaa locations
  Clone ID: PAT_TA_69170.pep
KLFSECDISIYYIKNKFTSVPKIMLKLTCHLIDNSLCILFNFKSIAXTTLSHEITYFDKLLQDLDIIXVLSLDPVLEQVLP

SEQ ID NO: 174753 - protein, 145 aa, Triticum aestivum
  unsure (1)..(145): unsure at all Xaa locations
  Clone ID: PAT_TA_69171.pep
MLWRTIRSMEVMAHSSSFLLPKLHQPAKTPANNYTLVVLNQQLPRFMPRLWAQAKMRICADGGANRIFDEMSQMTNDLDKNRYIPEIIEGDMDSIRPDVKRFYSSQGSKISDKSHNQETTDLHKCISSIRHRTPDQEKANLCILX

SEQ ID NO: 174754 - protein, 61 aa, Triticum aestivum
  Clone ID: PAT_TA_69172.pep
EQGNRSSVSSLSGSEVTSLYDHEDVDHYHNFEHLRTHFFTPLPSIMDGEHGAGNPFKWAAA

SEQ ID NO: 174755 - protein, 43 aa, Triticum aestivum
  Clone ID: PAT_TA_69173.pep
TAPRKDIFEASKGHVLSCVLCSFADHRFTLKSGIIHEAFCSFP

SEQ ID NO: 174756 - protein, 96 aa, Triticum aestivum
  Clone ID: PAT_TA_69174.pep
VYNSLMQTRECVPNWSLHKSMLPAAIYRGCYSMQVLRYRVNIIQCPKLLFSSSRLEIFGHESRMIHHFLARFSFLHSHGFSGFGSAHRPNPLTHAS

SEQ ID NO: 174757 - protein, 205 aa, Triticum aestivum
  unsure (1)..(205): unsure at all Xaa locations
  Clone ID: PAT_TA_69175.pep
HTYMTQKYEIRHKWAKHYFKGVFCAXKTSTQRSESANHMLKNYVPSGCPMHILMRKYMLLQFDREAEENYEEKRTRIGRPLLRANMATERHADKIYTXAMFKQFGIEFTSVVXYKVEEIEKGKLYVAIHTDACCREKWCRISYKVTVLDGEEEFDYECGQFSHMGLLRSHALKVIXLYXTTEIPKKHIVKRWTGDALDILAPHLS

SEQ ID NO: 174758 - protein, 145 aa, Triticum aestivum
  Clone ID: PAT_TA_69176.pep
GAPVTVAVADVPSTGDSSQTIARLSASYPAVCFHLLPPATTRSEDAADPNADPFITLIADIRATNAALLAFLRSLPSVKALITDFFCAYGLDAAAELGVPAYVFFTLCVSALATFLHIPVMRSAVSFGEMGRSLLHFPGVHPIPA

SEQ ID NO: 174759 - protein, 60 aa, Triticum aestivum
  unsure (1)..(60): unsure at all Xaa locations
  Clone ID: PAT_TA_69177.pep
DLDXTLPSAFDPXAEANAXDAGAGPXAKDXVHVRIQQXRNGXKSLTTVQGLKKEFSYXKI

SEQ ID NO: 174760 - protein, 98 aa, Triticum aestivum
  unsure (1)..(98): unsure at all Xaa locations
  Clone ID: PAT_TA_69178.pep
YSDNISLQAYRCGITRATALGDQLPSVLFYNTSADIFTTYISATLTTTNQQLQQINNYKPSVSSSKXNKPARSQLPSHANQTADEREQPKANPRXEFL

SEQ ID NO: 174761 - protein, 183 aa, Triticum aestivum
  Clone ID: PAT_TA_69179.pep
WICLRSYCIMHEEQLSYLSGSSEEDLIYHSATPVDSFEIGYGSMLLRSSNSKSAEEDSEANSVPADNKSYLTSESYSGTASFVVHSESKGASNSNASPEKPKWFPVHTHEIAKRGKLHYSKQHTLENVGSILVSVALEGEGTKETGGNENTSALKDLTKSTMKPLKRPHESQLQSCPEGTMRI

SEQ ID NO: 174762 - protein, 63 aa, Triticum aestivum
  unsure (1)..(63): unsure at all Xaa locations
  Clone ID: PAT_TA_69180.pep
YGRVERXDMKTGFAXVYMEDEXDAEDAXHRLDRTDFGRKARRLRVEWTKEDRXXXRKGNGKRS

SEQ ID NO: 174763 - protein, 167 aa, Triticum aestivum
  Clone ID: PAT_TA_69181.pep
MSSGSISSDSEMLMEEIISLRRERKDLMESLTPRISCWRDQISGAAISSFHKMDSSTIKPASSFQSDSQQQVYLTDDFDVLEDVEDLGQRMLSLAHSLSTSHAPISLYKADELVSTTSKLERISVDFYNSTEAAMEEAAEEERDRMVEIRKTEGEGTAEELDEEMEI

SEQ ID NO: 174764 - protein, 176 aa, Triticum aestivum
  unsure (1)..(176): unsure at all Xaa locations
  Clone ID: PAT_TA_69182.pep
VKTLTGXTFTLEVESSDTIDNVKAXIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLAEYNXQKESTLHLVLRLRXGMQIFVKTLTGKTITXEVESSXXIDNVKA

SEQ ID NO: 174765 - protein, 78 aa, Triticum aestivum
  unsure (1)..(78): unsure at all Xaa locations
  Clone ID: PAT_TA_69183.pep
SLDDIDTXSEGRFGCNVSHVNNYXGIAEKSMDKFAALISSFRYAGSRASGLRAPLKDVKNTLSVRSILRPPEQNLRCT

SEQ ID NO: 174766 - protein, 168 aa, Triticum aestivum
  unsure (1)..(168): unsure at all Xaa locations
  Clone ID: PAT_TA_69184.pep
ACCARSRSPRSPPILPVSFPIPGGQGHNPAATCPCWGRWVPPAMVAPGLAPPRISARPRAPPPSCCSSTPYLPAAAPPASPRXAPPARPAARRGSPCSASPPHASASPRRTSGRTNPSATAPPSPSWXPPPPSSAPAPPPRPRILASSPPCPGPSPSQLLARIDRRER

SEQ ID NO: 174767 - protein, 27 aa, Triticum aestivum
  unsure (1)..(27): unsure at all Xaa locations
  Clone ID: PAT_TA_69185.pep
FFFXFFFFFFFFFFFFFFFFFFFFKLV

SEQ ID NO: 174768 - protein, 130 aa, Triticum aestivum
  unsure (1)..(130): unsure at all Xaa locations
  Clone ID: PAT_TA_69186.pep
SDHKSTQIPILMPAEVMSALIFMASYPIRPATDKKQGTCHLSIILDVLGTSECTGQDWDSRRSQEVVRPPPREQEEXYATLKRPEKSEGKRGGHREHWRGAAPTERGNGEGPRPPAIGWWEAGQSQRRVA

SEQ ID NO: 174769 - protein, 152 aa, Triticum aestivum
  Clone ID: PAT_TA_69187.pep
SNGPRNKTARVYILGSMTDSLAAEYESDKTACGIMLRLEQDFGEVSLVKVLSLVNKFLTSKMGDKTVNEHFNKLCVLAEELKTAGYPFQEEVQVMVVLNSLPPSWEQFKISFCHSERTLNMRNLRQHLLMEEDRRLNSGKDKAFYQPELHPW

SEQ ID NO: 174770 - protein, 63 aa, Triticum aestivum
  Clone ID: PAT_TA_69188.pep
TRAFSARSFMIVLHVFNLSCMGHISCIFKLTKNFKVFVKISIGTYSTLMLYFPLLIGCTNDGQ

SEQ ID NO: 174771 - protein, 36 aa, Triticum aestivum
  unsure (1)..(36): unsure at all Xaa locations
  Clone ID: PAT_TA_69189.pep
NRGNIHHHIRLXSFLASCTMGGVARWMRQEQAAXLT

SEQ ID NO: 174772 - protein, 30 aa, Triticum aestivum
  unsure (1)..(30): unsure at all Xaa locations
  Clone ID: PAT_TA_69190.pep
CSYXLEIHVPPXIHVFLWLISHNKIMXITL

SEQ ID NO: 174773 - protein, 152 aa, Triticum aestivum
  Clone ID: PAT_TA_69191.pep
QIRHEGYTPIKHCLHKAPAGIEERGSEWPEEWPKRLETFPDWLGDLQTRASADHSHWKAVVEKSYLDGLGINWTNIRNVLDMKAVYGGFAAALSSEKVWVMNVVPVHAPDTLPVIFERGLVGVYHDWCEPFSTYPRSYDLLHADHLFSRLKN

SEQ ID NO: 174774 - protein, 134 aa, Triticum aestivum
  Clone ID: PAT_TA_69192.pep
GCRFTRGPLFDAVISQLEQVYWEFDNEQWKSPRVVPTPKQLRELRLNGWKSGPARCHGPNFFDWFKTKCMKSPSIHNALRQMSYGFRTRVATYGCYDVNGYRFRSEKYERKKSELTTVNSGVCVTSLDEDDNQF

SEQ ID NO: 174775 - protein, 89 aa, Triticum aestivum
  Clone ID: PAT_TA_69193.pep
TVADVNAIDHTGQTALHWSAVRGHIQVAELLLKEGAKVDAADLYGYQTTHVAAQYGQTAFLYHIISKWNADPDVPDNDGRSPLHWAAYK

SEQ ID NO: 174776 - protein, 34 aa, Triticum aestivum
  unsure (1)..(34): unsure at all Xaa locations
  Clone ID: PAT_TA_69194.pep
PIFFAEPMRASNSFVGTEEYXAPEIITGAGHTSA

SEQ ID NO: 174777 - protein, 64 aa, Triticum aestivum
  Clone ID: PAT_TA_69195.pep
RHEGCLMNAWVCHLCNICWLMNAWVCHCLFHATFRNCSFLCYDNFTASCRNLFKILQILVLPHN

SEQ ID NO: 174778 - protein, 100 aa, Triticum aestivum
  Clone ID: PAT_TA_69196.pep
AMALLDWIELSDDEEVAVKERLPPEKVKEEFPPIEVKEEFPPTIVKEELDTHVHGTAQLEVEIVDLTTEEADVEEDRNAHGKGDAAQGATTSHRQQFVAP

SEQ ID NO: 174779 - protein, 81 aa, Triticum aestivum
  Clone ID: PAT_TA_69197.pep
AAAAAAASGLLDVGCSTSFRSSSPSRSRTANMLARLDILSQIFPRFKITPRKTCGVPVLINQTEFFWWNWGKNMPGSTADN

SEQ ID NO: 174780 - protein, 41 aa, Triticum aestivum
  unsure (1)..(41): unsure at all Xaa locations
  Clone ID: PAT_TA_69198.pep
ISEGQLVGNPVRMMIWQCHWHTEVLQCPPPPPPKKIFFXGG

SEQ ID NO: 174781 - protein, 94 aa, Triticum aestivum
  Clone ID: PAT_TA_69199.pep
RCSQILGYYIRPTLEYLHESFLILPDRNGAPRPKPVQPWLMATMVCSVANHGNGSRAQEASSMVPITSSNTLMCPSQRWFTSFPSLIYTALLRM

SEQ ID NO: 174782 - protein, 60 aa, Triticum aestivum
  unsure (1)..(60): unsure at all Xaa locations
  Clone ID: PAT_TA_69200.pep
IPLLMDCGSGTCRSARPHAARGELPYVTTFLPQSGQPTIGSTGGMSPRFRLAIIDDXLSL

SEQ ID NO: 174783 - protein, 49 aa, Triticum aestivum
  Clone ID: PAT_TA_69201.pep
SLFQTEHNKCSSSKNTKLVYYNLYIVYYNMYSLLHIDKTYNYLLHGLNF

SEQ ID NO: 174784 - protein, 26 aa, Triticum aestivum
  Clone ID: PAT_TA_69202.pep
HIGVKNMQAQFHDSGLSSSGLLGIES

SEQ ID NO: 174785 - protein, 153 aa, Triticum aestivum; identical to SEQ ID NO: 109663
  Clone ID: PAT_TA_69203.pep

SEQ ID NO: 174786 - protein, 90 aa, Triticum aestivum
  Clone ID: PAT_TA_69204.pep
ACPRDMQTAICCNSESKGAVVQDGTKSYHAFHTILRNSPPARYLLCYKCKVLELLCANKMAKLCVKQCFITSSLDIEQGAILQFRMFRCG

SEQ ID NO: 174787 - protein, 82 aa, Triticum aestivum
  unsure (1)..(82): unsure at all Xaa locations
  Clone ID: PAT_TA_69205.pep
EXDPDVVVXIALQSNTISSPVLRLAVKQITIKEKEVDTLWNLTLSLLVLIDPSTQRNKRFYRPDTIAKSTKKLQWWRIYSPS

SEQ ID NO: 174788 - protein, 85 aa, Triticum aestivum
  unsure (1)..(85): unsure at all Xaa locations
  Clone ID: PAT_TA_69206.pep
RRAVSRNSEIKKDEQTVIEKEDDTESTLEIERIRGDPXMLQSMTXKELKELTRRMGVXARGNKKDXVSXALMESXGEEVXGKEGA

SEQ ID NO: 174789 - protein, 178 aa, Triticum aestivum
  Clone ID: PAT_TA_69207.pep
MMEDEQSATYTVDDALISSGFGKYQILILSYAGIGLIAEAMEMMLLSFVGPSVQLEWNLTAHQESMITSVVFVGMLIGAYSWGVVSDNYGRRKGFLFTAIMTSGAGFLSAFSPNYVALMALRFLVGIGLGGGPVLGSWFLEFVPAPSRGTWMVVLSAFWTVGTIFEASLAWVVMPKYG

SEQ ID NO: 174790 - protein, 50 aa, Triticum aestivum
  Clone ID: PAT_TA_69208.pep
LQIAYIRTCQLGILTPATTWTRKLHQQTCIGVWNIQHFLLFIYFIQYLGT

SEQ ID NO: 174791 - protein, 80 aa, Triticum aestivum
  Clone ID: PAT_TA_69209.pep
MSQPHRRSTGNGGAVSGAGGGGDYIKSWIMCGNLQRSFGSLVREPCGLNPDPYYLKGGKMLRPEKWNACFDTDGKVIGFP

SEQ ID NO: 174792 - protein, 172 aa, Triticum aestivum
  unsure (1)..(172): unsure at all Xaa locations
  Clone ID: PAT_TA_69210.pep
EFVDRFGVLVPELMFGSXDERALTEAVLEKMKLNNFQLGRNKVFLRAGQIAILDVRXAEVLDNAARRIQXCFRTFAARKEFVKTKKAXISIQAYCRGCFGRKMYKIRRETADAIILQKYARRLLLQRNYHEACSAALLIQXCIRGFIARRYFXAIREQKAAXVIQSFWRKRK

SEQ ID NO: 174793 - protein, 157 aa, Triticum aestivum
  unsure (1)..(157): unsure at all Xaa locations
  Clone ID: PAT_TA_69211.pep
AYSFPPPPPPPPLCTAQVLRRRSVQVLRRRSAPLLPPPPVDLCQLASICLSLFYYLLPSIADRRREEDERQHSADPEPGVVRRGQTRVFAAAPEPGALQGEVFPPDGTRGGRSWQGAANTDARPVRGHQQDKDLQHRSGDGGGGGAQDRSAKNRAXH

SEQ ID NO: 174794 - protein, 76 aa, Triticum aestivum
  Clone ID: PAT_TA_69212.pep
GRTGVFFPPLSLDKCQNSEGGQSSPAASLISTAHLLCFFVCILSLQTSHAKKVEMSKLLTSSSRLLTCKAESSKPQ

SEQ ID NO: 174795 - protein, 211 aa, Triticum aestivum
  Clone ID: PAT_TA_69213.pep
YPTGLEQAASSNGAVMGNNDISRLLFEMEEDDDTFNLAVESRKEAAETVRQSRQDLIVVASLVERIPNLAGLTRTCEIFRAGGLAVEDMGVVQDKQFRLISVTAEKWVPMVEVPAESMRAFLQRKRAEGYTVVGLEQTANSVALDEFVFPAKTVVVLGREKEGIPVDIIQEAVDVCVEIPQLGVVRSLNVHVSAAIAIWDYTRQQRVRSSS

SEQ ID NO: 174796 - protein, 221 aa, Triticum aestivum
  unsure (1)..(221): unsure at all Xaa locations
  Clone ID: PAT_TA_69214.pep
VHXVLPLXSLVPADAPAVPSCDSSLPFRWDPSSFFAWSLSAACLSCAGKQNLTWVRLPPPPQLPAFGFFAALELKSGPRVPDFAPRRGLGGRFAPAFHGTRSLSLSLSLSLSLSISSTISRRQILLRGFFPFSPLQLSLGFSWFPGSIPFGRVLVLFFFLKLAVLVLDARXFIYIRRTWQAAAADDIHEEGSACYSAAVREQDDQKPAHAVXSSSATDFQS

SEQ ID NO: 174797 - protein, 37 aa, Triticum aestivum
  unsure (1)..(37): unsure at all Xaa locations
  Clone ID: PAT_TA_69215.pep
FARGGCASFPPITLXIXXCDLQETXPNHEPGXKHQXK

SEQ ID NO: 174798 - protein, 64 aa, Triticum aestivum
  unsure (1)..(64): unsure at all Xaa locations
  Clone ID: PAT_TA_69216.pep
FIFNXAVLRPAGGQGCSSSHFQVALVARDGACTRVSICVYSSETGIWSNVKSLQMKLSIPIERA

SEQ ID NO: 174799 - protein, 218 aa, Triticum aestivum
  unsure (1)..(218): unsure at all Xaa locations
  Clone ID: PAT_TA_69217.pep
FLQTLSNPYTAASVAKAFFEGIVCLHGLPQSIVSDXDPVFTSNFWRELFNLSGVQLHMSLVAFHPQCDGQTEVVNKIIAMYLRCLIVDRPRRWVEWLPWAEFCYNTSYHSALRATPFEVVYGRPPPRLCDYVPGEAKVAAVGTAFQDHANFVHEVGEHLHQAQQRAKHYYDDKHRELAFGVGDWVWLHLHHCAPASLPGHKHGKLSPRFYGPFQVTEV

SEQ ID NO: 174800 - protein, 75 aa, Triticum aestivum
  unsure (1)..(75): unsure at all Xaa locations
  Clone ID: PAT_TA_69218.pep
SRYIARAXALNITHVLSIMPHIVRQAXRIFCLDLAPAIIEAGNLWDHLMPMXPQMCWFPSPIFRGVAXVXCYNIR

SEQ ID NO: 174801 - protein, 47 aa, Triticum aestivum
  Clone ID: PAT_TA_69219.pep
LCYLIYCKFTILNFNNFLCVRRQRMFQFSATIKKECCSANRSCIIVG

SEQ ID NO: 174802 - protein, 81 aa, Triticum aestivum
  unsure (1)..(81): unsure at all Xaa locations
  Clone ID: PAT_TA_69220.pep
LLEWHETSYSKLLVSLAVFFKKKNTTSTIKIHEISISKKMYQIFSNMLCCILRLANIKLHNTHVMSHNTCTWGLLVRKXIS

SEQ ID NO: 174803 - protein, 174 aa, Triticum aestivum
  Clone ID: PAT_TA_69221.pep
MTPTARHLVDEILEEIFLRLPTPAALARASTASPRFRRIITERAFLRRFLALHPPPLLGFAAGVGGFYPAQDPHPSAPLARAIVDAADFTYSFVPKAKSWFGHWHPCDARDGRLLLEASYRFDLETIPSHAVCDPLSRRYVVLPAIPEETTIPQERLFEFRSILAPIAEDEDET

SEQ ID NO: 174804 - protein, 47 aa, Triticum aestivum
  unsure (1)..(47): unsure at all Xaa locations
  Clone ID: PAT_TA_69222.pep
GGGAAVEDCDGRIRWLACXGAGGAGRVAGSRWCGGAEGWRWRXRCRX

SEQ ID NO: 174805 - protein, 145 aa, Triticum aestivum
  unsure (1)..(145): unsure at all Xaa locations
  Clone ID: PAT_TA_69223.pep
PPSPQVAPFPVDPPMSALWLGSSAXHGLKDVGKPPSSLTNEAPSNAPAQPPTSLSPTQSRPLPRRRXPLPSLPPRAALFPARAALFPAGAALHSPSVLQAGTASQRGRGQIPHFHLQMQPPPWATNTRFIYICRLQXLVHRLGLN

SEQ ID NO: 174806 - protein, 214 aa, Triticum aestivum
  unsure (1)..(214): unsure at all Xaa locations
  Clone ID: PAT_TA_69224.pep
IRHEAELDCAPDVFSYSIVINGCFKEGEVDKACNLFHEMIQLGVQPNVAIYTSIIDALSKCGAMDKAEVVLRQMVDQGIGPNIRTYTSLIHGYSASGQWKEAVRLFKKMIRLGALPDTVMWNSFMDSLCKHRRTKDARDIFDSMAAKGQKPDIFSYSTMLNGYAKEGCFDDMTCLFNSMLQNGILPDHXFSTLINAYAKRGLMDEAMHMFRSNE

SEQ ID NO: 174807 - protein, 154 aa, Triticum aestivum
  Clone ID: PAT_TA_69225.pep
TGIRLASMRSVGAFQVLGDEEGAQVEHHGKPQVRPYQATTAAPDGSAVLHGREGLAQGRPPCHWLLAPLPSMAQRHTHPGGGGVARRSSRNASRRVAARGGEEERTEHRLRRREGERERGAARVHPIHRWREERPQRRHGRPSQQAMLLTVMPT

SEQ ID NO: 174808 - protein, 84 aa, Triticum aestivum
  Clone ID: PAT_TA_69226.pep
RTISNRKSMSKNLCLATKQTFKTLKVTSKAKESQIGCSGSEAYKNPNCRDSEVHPFKKETRQIQASRTGKYESIAHAKKKKLQL

SEQ ID NO: 174809 - protein, 79 aa, Triticum aestivum
  Clone ID: PAT_TA_69227.pep
RGRRLAGADQGRGRSRRRSGSRGRSLRRPGSRGRSQRRSGSRGGRGRSRSRLLRSYSLRGSTGADEALLLAASGWRRRG

SEQ ID NO: 174810 - protein, 89 aa, Triticum aestivum
  Clone ID: PAT_TA_69228.pep
KVEAESTDFPSNNCQTKHKIRRGKGRPSQARSAAAPTPALPAPTSVVDPVSARHGRSGLEVEKGGGGCGLQWRRMGSRRQGAWLTLVPN

SEQ ID NO: 174811 - protein, 63 aa, Triticum aestivum
  Clone ID: PAT_TA_69229.pep
LANYTYMYKPWSAIGSSTCLLLNFEIGLRKFGICLDIFYSAAVQLLGLLQNFTFCEFLRASDS

SEQ ID NO: 174812 - protein, 188 aa, Triticum aestivum
  Clone ID: PAT_TA_69230.pep
MSFVKMMQTHSPQSWSALPSELAGMVLCRLPSHVDRVRFAAVCHHWRFSRQEHSLPPPLPWLAFPDGTFFGLPRGDGAKESFKLPISANYCITCGDWLVFSQNDTCFLMNPFSKITLTLPNLSSFCLVDEPVGIINGRDVLDEDMSSPLLQMDTAISLRKVIRCSELLVAAIVEIGPLCTVAYCQPGS

SEQ ID NO: 174813 - protein, 128 aa, Triticum aestivum
  Clone ID: PAT_TA_69231.pep
EYSTKYKHHQFSYLWLPEFIIWVSRISREGRNSWREGRSSPGEPSGSILGWQPAGDPGIYLSLAGDPGIYLRLAGDLIIYLRGVGHGTGSSKKNWSSPGGGSTAVGGGSGERRRPRRRRQAVRPVLDR

SEQ ID NO: 174814 - protein, 281 aa, Triticum aestivum
  unsure (1)..(281): unsure at all Xaa locations
  Clone ID: PAT_TA_69232.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEXESSDTIDNVKAKIQXDKXGISPDQQRLIFAGKQLEDXRTLXDYNIQKESTLHLVLRLRGGMXIFXXTSPGDHHSGGESSDXXDNXRADXRKXXGISPDQXXLXFXGXQLEDX

SEQ ID NO: 174815 - protein, 159 aa, Triticum aestivum
  unsure (1)..(159): unsure at all Xaa locations
  Clone ID: PAT_TA_69233.pep
PCRRPSSPRSPRPPPLLRRVVGPLPPPTSSSLLSVLCQPPPKPEPPFPSIPAVTXPQPPAPSHSRRTIPPXPPPPPSRIPTTVPTCRQRAMKSGRRGQRGRERREIKRRPAARPITATRSTSQSLLLPCLTVAWSRQAHVGAAATAGWLCRSLPLQIEN

SEQ ID NO: 174816 - protein, 203 aa, Triticum aestivum
  unsure (1)..(203): unsure at all Xaa locations
  Clone ID: PAT_TA_69234.pep
EAPIQKSSRPPTRSPPPLDLSPPTSASPGSPHPSXRPPSSATIGAGAPTAASXPRPQPPEHRPATGAPPPATRTRPSPTFPFVSHLSFLLPPPHHFSCCFRGSPWIWSSAAPSSALLPXAPAPARKRTDPSSLRPSPASPPCRSPRXAEPFAAWSLGSHRPGPASPPDLPSLWSPKTPPPSQPGTPEERRQSSSFSTPGFRHP

SEQ ID NO: 174817 - protein, 171 aa, Triticum aestivum
  Clone ID: PAT_TA_69235.pep
TTRHEPPCPIPFLLPSTLHRSPPRLQVCRRRAPPSTTSPLGSLARSSSSSCLVAGPCSTSSLLHSLPSPVRHLPGAPPPLFVAANRSSKRHGRSLGASSSASPPPSGGLSLARRALRERSSPQQRSNPSSHIHLSSLPRRSPSVPAPPSFPCSSEAAIDLVSLRGRRALAR

SEQ ID NO: 174818 - protein, 211 aa, Triticum aestivum
  unsure (1)..(211): unsure at all Xaa locations
  Clone ID: PAT_TA_69236.pep
GHKHYELMLXLQLGIRHSVGKQGPVTLELKPSAFDPKEKVWTKFPQEGSKHTPRHNSCDFRWKDYCPQXLRKLFKVDAADYMLSLCGSEALRELSSPGKSGSFFYLTNDDRYMIKTMKKSEVKMLLKMLPAYYNHVRAFEDTLVTKFFGLHCVKLAGANQKKVRFVIMGNLFCSHNSIHRRFDLKGSSLGRTTDKPQTEIDQYTTLKDLDL

SEQ ID NO: 174819 - protein, 151 aa, Triticum aestivum
  Clone ID: PAT_TA_69237.pep
MGMRPGWVGGLVEETFFVACSAHESRKKNEKNIFCLACRTSICPHCAPAHRHHPLIQVRRYVYNDVVRLDDLERLIDCSFVQPYTINSAKVIFLKPRPQSRPFKGSGNVCLTCDRILQEPFHFCCLSCKVDHVMMQGGDLSNILYMSGEPD

SEQ ID NO: 174820 - protein, 188 aa, Triticum aestivum
  Clone ID: PAT_TA_69238.pep
MELCAGGELFDRIVQKGHYTERKAAELARVIVGVVEVCHSMGVMHRDLKPENFLFVDQTEEAALKTIDFGLSVFFRPGQIFTDVVGSPYYVAPEVLKKKYGPEADVWSAGVIIYILLCGVPPFWAENEQGIFEEVLHGKLDFESDPWPSISEGAKDLVRRMLLRDPKKRLTAHEVLRHPWVQVGGLAP

SEQ ID NO: 174821 - protein, 131 aa, Triticum aestivum
  Clone ID: PAT_TA_69239.pep
PPSVPPLPSLLQRPASHILAPPPLLSLALPRRPCRSPCVVASACLAIAPSVLSRGSAGHRRLSREVTSPGQLWPPPPPHTGRSPPPLILLLHRMVITGRGSGSAWRRRYRLEERRTIVLGFMHLWEEGEPR

SEQ ID NO: 174822 - protein, 221 aa, Triticum aestivum
  Clone ID: PAT_TA_69240.pep
RHEAEDELKEKHANLNGEVLDNDRMLSPSNDGPIRMNTGNDSAIVEENSSPMQRGMVLPFLPLSLTFDNIRYSVDMPLEMKAQGVVEDRLELLKGVSGSFRPGVLTALMGVSGAGKTTLMDVLAGRKTGGYIQGNISISGYPKKQETFARVSGYCEQNDIHSPQVTVYESLLFSAWLRLPEDVDSNKRRMFIEEVMELVELKPLKDALVGLPGVNGLSTEQ

SEQ ID NO: 174823 - protein, 169 aa, Triticum aestivum
  unsure (1)..(169): unsure at all Xaa locations
  Clone ID: PAT_TA_69241.pep
SPLHPPAPPLLDPEGITSSSPAATSSSTTRTPSPSPTPSSHSLPSTPSSALIPLSPSPASVGTKGALPRCHGQGLPSPKPPRIWRGSPPVDXPPPPRDPPWPPLGASCHAQPPPVPPMLLPQQRTSTPPRPRTACEAHRPPLLRASRAATRSTSSSFHTPRPRTPTPAS

SEQ ID NO: 174824 - protein, 200 aa, Triticum aestivum
  Clone ID: PAT_TA_69242.pep
MPFYGHRAADCRDPFMCSRCLENGHRARGCRNAWRPLSLLASLAASPLTCPVAEHREAPAPCQAQIEAPILPKTFRRDSWASIVSAPVASVAMADVSLRSTMEGQAELLRSELLNMASFRLEETVQPLRDVIDSMKGWMLQMGNFLERAEAVLSGLLQVSPVLQTAPMQHPLIVPDVNLEDENGDGLHGRFSPRAGVGSP

SEQ ID NO: 174825 - protein, 37 aa, Triticum aestivum
  unsure (1)..(37): unsure at all Xaa locations
  Clone ID: PAT_TA_69243.pep
YLLPPPHNISTFFDTTLVLXXHFTXWDGWSTNIFIFL

SEQ ID NO: 174826 - protein, 168 aa, Triticum aestivum
  Clone ID: PAT_TA_69244.pep
IPVLKEKNKEGVEIKRHASSWEDYYINKVTEGENIGEAAAHRLMQEFWSIYKLVDDSPAQIIEVDRILENSAKRQFRQMWYQARKEAVKLYYKDIVKEPIKDHEACQKELTKNQYMQAQLYWCIDHEVWESICDYWCSSKFEGLRNLGRVSRFKSEDIAQNRGGSRSF

SEQ ID NO: 174827 - protein, 153 aa, Triticum aestivum; identical to SEQ ID NO: 132616
  Clone ID: PAT_TA_69245.pep

SEQ ID NO: 174828 - protein, 86 aa, Triticum aestivum
  unsure (1)..(86): unsure at all Xaa locations
  Clone ID: PAT_TA_69246.pep
KGXYAQRVGSGAPVYLAAVLEYLAAEVLELAGNAAKDNKKTRIIPRHLLLAVRNDQELGRLLAGVTIAHGGVIPNINSVLLPKKSP

SEQ ID NO: 174829 - protein, 173 aa, Triticum aestivum
  Clone ID: PAT_TA_69247.pep
LLVAQGLEVTVVLSGVGDADDLTRIRAANPSLSFHCLPTPMLPSAGADSFEAKVFGLAHASLPDLRDFLRSASPAALVIDFFCASAFDVGAELGIPTYFFLTTCISVVAFGLYQPAMDEQTTLSFRDLGGDLVHAPGLPPIPADHLPAFTLDRNSLSTKLFRDVPHQLCNSQG

SEQ ID NO: 174830 - protein, 51 aa, Triticum aestivum
  unsure (1)..(51): unsure at all Xaa locations
  Clone ID: PAT_TA_69248.pep
HAAAXSSAHQPIPFSPSSXXLLLTXDRXPSSSADXLXPXXSXSTPNXRLRS

SEQ ID NO: 174831 - protein, 115 aa, Triticum aestivum
  Clone ID: PAT_TA_69249.pep
STTNRLLSPILKIKHTSIESQASVLLSLAWEARRPVAGAATASDSLPDPAPPAPSPFFLSPSRPVSLSMNEQDAAAATGTNRRTSSQIGRCRPRIRPYSSRRRHVGSLPFALLDC

SEQ ID NO: 174832 - protein, 172 aa, Triticum aestivum
  Clone ID: PAT_TA_69250.pep
KRRWRPLNLPPVTAQLPLSSVWAATKKARLTRCVGPTSTCCNCSCCFCQRASLPRSTPPPCSYCSGRRATLPWPTCLFAAAAPDREPPSAADPARICRCINPRRFSPPVPVLAPKPNMCSTSLSDGSRTASFAASYPPISHGSIVAGGGIGATMGKRGEGGDEHTCKGEGGG

SEQ ID NO: 174833 - protein, 48 aa, Triticum aestivum
  Clone ID: PAT_TA_69251.pep
VIRMKIILYIFSATQVSGSSYFWHHVNKNVHLSKNKIVYNIFCSSKKK

SEQ ID NO: 174834 - protein, 138 aa, Triticum aestivum
  Clone ID: PAT_TA_69252.pep
MPPPPATLPDELLEEILLRLPPEDPGCLFRASLVCKPWRSRLTGTAFSRLYREFHRTPPLLGFFENDETVLCYFSPLSPTSPFFPVHPGKCSLFVLDSRHGLVLSNTIGPSGEPLCLIVWDLVGHRQWRLSLPDFVDW

SEQ ID NO: 174835 - protein, 199 aa, Triticum aestivum
  Clone ID: PAT_TA_69253.pep
MAPSLPPPPLIEDVTDEILLRLPPDEPEHLFRAALVCKTWLRTLCDPGFLRRYRTFHGTPPLLGLLHRLQVLEGPPARRFASTTSVPDFPHPSSGDPWERALDCRHGRVLIYMRTDDNADYLVWDPVTGERHGVPSPDIDWLIESAVVLCAADGCDHLDCHGGPFRVVFAATHDYKDTIFASVYSSETGVWSVPVCLDK

SEQ ID NO: 174836 - protein, 72 aa, Triticum aestivum
  Clone ID: PAT_TA_69254.pep
FFLPYVKDGFAIMMTPSSIKGGSCLPLQRSKLCSITRVAALPTHFATSCTPYLSSNTANIQSKSRVLHFTAA

SEQ ID NO: 174837 - protein, 164 aa, Triticum aestivum
  unsure (1)..(164): unsure at all Xaa locations
  Clone ID: PAT_TA_69255.pep
CRQQQTVSADSXNIQTMLNSSAIQHQLQQLQQLQQVHQVQQAQQAHIDQKQKIQSDQTYHVPTSASLPSPTSLPSHLREKFGFSDPNANSSSFTTSSSSDNMLESNFLQGNSKAVNLSRFNQPVASDQQQQQQQQQQQQAWKQKFMGSQSLSFGGSGLLNSPTS

SEQ ID NO: 174838 - protein, 101 aa, Triticum aestivum
  unsure (1)..(101): unsure at all Xaa locations
  Clone ID: PAT_TA_69256.pep
XPDTHRACLPPPPPLALAGAAPTRATGRPVDGDPLRSSVQSPVPQIRRVTTCSVVSCTQSHSADLLLQEKNLDFEPEVSQISCLLWRLGSTQSSMFRRSCC

SEQ ID NO: 174839 - protein, 167 aa, Triticum aestivum
  Clone ID: PAT_TA_69257.pep
PPLSLLDSPPNHPIHQLNQPTATLDPPHPQSHSIPLLPYLAHTIQGEEILLAPPKRSFFWSSSCTLPLLGPVVVSPPPTSSGEQRANRASFPALSLSLHLMLVTPSHLCPGAPTSTAAVPCASICRGQPSLPRRLATPVTTSSRSLEGACCFELQAPDVKSPSVAVT

SEQ ID NO: 174840 - protein, 217 aa, Triticum aestivum
  Clone ID: PAT_TA_69258.pep
VKHHIISLSDEENFATVLNGRICNSFPNKIRRLSMQSSGKEHKGAVGAIRETKMHIRSLTVFELHKPIVPHLVDFHALRVLDLGDCIWLENKHVKDIGSSRQLRYLRIGHSMITELPCEIGKLQHLETLDLLYCNSLPRLPSTVTQLRKLVRLFVSDYTQLHASGFRSLQALEELGFVETDDPVRFSEEVNESGKCNLRSLRTGGEIAERLFCNSCC

SEQ ID NO: 174841 - protein, 93 aa, Triticum aestivum
  Clone ID: PAT_TA_69259.pep
KSSTGWCVQFYRERLGLDQDVVYGTRGWARPHPHLKRRHAQQHKKRHAPRTRVGPISQVKWQVNRAHHQNLVVHLLRPHHQVRPRRTPPIRQF

SEQ ID NO: 174842 - protein, 165 aa, Triticum aestivum
  Clone ID: PAT_TA_69260.pep
PRIPLPAPSSHRGVGADVLKEAPPPSLQASRSPSGHRCRDPPSPSSGRGGGRQPGGEAHNDPEDIRPHALIVLFDLPEGCRWAPRRRPRRDLRLGRDNPSTPVAGEISLPVYQVVPDKEMLLPGTCTHVGRPPASGAASSLLRRPWPPNHSVERYLCAQVSAPRS

SEQ ID NO: 174843 - protein, 69 aa, Triticum aestivum
  unsure (1)..(69): unsure at all Xaa locations
  Clone ID: PAT_TA_69261.pep
XPXKXXKXGGGGARRPWLPRFLFEIERSREYPEVRIFGRSLQLPHKLRHLHALLSPFSWQLAXLDVHRC

SEQ ID NO: 174844 - protein, 164 aa, Triticum aestivum
  Clone ID: PAT_TA_69262.pep
LPLALSFPSLSPLPHTQIPNLGRVTHSTPSAVAPTAATTSELVSHHYPLSSPPLYSSDGADRADRATRRRPHAHTTGDQHHAKVTTAVAEGRSSSTSTDELARQERSGDPALLPRSAPLSPCHGWTSLCSHQGHVPSLLSSSRYYPPSYMIWTTHDLWNEKSRA

SEQ ID NO: 174845 - protein, 63 aa, Triticum aestivum
  unsure (1)..(63): unsure at all Xaa locations
  Clone ID: PAT_TA_69263.pep
YXLLSLSLSLSLSLSLSLSLSLEGGGEHRKAGGVVARRHGSEGTRSRKKREEKRTEESKAINY

SEQ ID NO: 174846 - protein, 98 aa, Triticum aestivum
  Clone ID: PAT_TA_69264.pep
ASCRNSVDVRLQKKAVFLITDLADFQLNSGSSGLAFLSERVFLKSVTDMLSKFDLDLQEKVLLAIRSLLKLPSTDATDLESCGLDSVLYRLGVQLEEL

SEQ ID NO: 174847 - protein, 190 aa, Triticum aestivum
  Clone ID: PAT_TA_69265.pep
AHLPSSPDPLPFPAGAVLLPSPVLSSPNPSCSPSPGIAELPFRLDLQRRGQPAVGRAALTLPSNFWGTNDPARYLAVGLGVEATADPLLDLFPPIYGDLPLDLVSRPQRLCCPPRLSRRRRRLIGPSGRQPPRHRDGTPSSSHSSPWTAAQSPSPACGFSRRIPGSASLSYHCGISDTGACGNFCVIFFR

SEQ ID NO: 174848 - protein, 196 aa, Triticum aestivum
  Clone ID: PAT_TA_69266.pep
VIYLLEDYLRQVNLELRGEWPLLVKANFRELCSFRQFDSDSTLCLFPWNPGGYLFRITTGFLTSSSGSQWHVMCIIAESSQRFSQIAKSDCLFPICLKVMMRCLVLLSSADIDYELRHRPDQTKDRGVLAKFRILHIFLVPSVKLQPWPSCRYTFTHFERQFFPQLPFPRTDKMPDTRRHMNISIQWQHLDIMLVL

SEQ ID NO: 174849 - protein, 139 aa, Triticum aestivum
  unsure (1)..(139): unsure at all Xaa locations
  Clone ID: PAT_TA_69267.pep
DGRLPHRVRRGLCSRSREELRGGRRPRRSRGRGRRRPPQRRRRVRWRRQPPRRRRRRXRRRRRQRRRRRGRRRRRQRRRRRDXQRPWRRRGTSRXRRRRRRRRGTRRRPVSSQRGWWWRRRDRGGEEEFDRGVGEVHEG

SEQ ID NO: 174850 - protein, 75 aa, Triticum aestivum
  unsure (1)..(75): unsure at all Xaa locations
  Clone ID: PAT_TA_69268.pep
RRVRXRHGGEHGDRGXEDGDHEGSRHGCVRVCLDSGVCDRKIERKRERTEYLILVGVALWSHRDGPLGVLVYRGT

SEQ ID NO: 174851 - protein, 185 aa, Triticum aestivum
  Clone ID: PAT_TA_69269.pep
GEVKAASDMTGLLNILPSKARLMVDNDAEQSSFTEVPCGTLAVGDYMLVLPGDRIPADGLVKAGRSTVDESSLTGEPMPVTKIAGAEVSAGSINLNGKLTVEVRRPGGETVMSDILHLVEEAQTREAPVQRLADKVAGNFTYGVMALSSATFMFWSIFGSQFVPAAIQQGSAMSLALQLSCSVLV

SEQ ID NO: 174852 - protein, 96 aa, Triticum aestivum
  Clone ID: PAT_TA_69270.pep
WKFRSKPKHKESLEEHIYLLHFAQLTRIGSRLFVLLIMLYFGTNKNWQQTLILLIMLYFVTSTFYLDYVAFHSQVRDAKISSMPCLFLLKTCLVTK

SEQ ID NO: 174853 - protein, 184 aa, Triticum aestivum
  unsure (1)..(184): unsure at all Xaa locations
  Clone ID: PAT_TA_69271.pep
MRMAFDXQQQDLVDAASKALSYRQDIIEENIRLTYALQAAHQERSTFVSSLLPILSEYNLQPSVHDAQSIVGNLKVLFTHLQEKLIISEEKLKESQYQITPWRAESSNNTSGPAQSPPPGNALVASSQPSLDIVPQQPYSHVQSPISSPVRARRDWDLLANDNRQVISAEAAATTTEHGNAGRT

SEQ ID NO: 174854 - protein, 116 aa, Triticum aestivum
  Clone ID: PAT_TA_69272.pep
CIASATFNVQVQFIIQLWNINSEIKYDRATLLFLSNVNMKTEIRNFQVTCTCHSRRTRTTTSPLLAINHGRARVDWWPVISDVLELGTTPWTTPSAIFLVKEEHEDVDNSDRPVRL

SEQ ID NO: 174855 - protein, 195 aa, Triticum aestivum
  unsure (1)..(195): unsure at all Xaa locations
  Clone ID: PAT_TA_69273.pep
ANSARGEVAKKDFEXNLRQDSDASEPEPEPLPEPEPKPQRRRGRPPKNAVKQQVEQPPAERATANFSAAALAMAGNSGLYAHSGFDIQRRIADVLKASFANRSNEHNWSSERKLESIEDYSGSGSKWSGKMGKKPLLVEESRRTTYYQNQPSSSMYELPVATSYNGTRKVLVPIGAQLPQAYSRSLARFAAQLGP

SEQ ID NO: 174856 - protein, 159 aa, Triticum aestivum
  Clone ID: PAT_TA_69274.pep
RLAAWFPMANQLPVQQQVNPLGHGDLNQQRMCAPRQQNLNNVPVIHLDIGRPPHGEDDDLAQRYEDFVRIIIRRLTKICPATYYGKPITPYPNAANHPTEGHSYFRVVFFSSTNDYARVEFLIRDFDLYLLGLRRQLDGEWSPWYRFTPSLGWPSFPMG

SEQ ID NO: 174857 - protein, 58 aa, Triticum aestivum
  unsure (1)..(58): unsure at all Xaa locations
  Clone ID: PAT_TA_69275.pep
PKSXXDLRVRDXSMGXIWGFTSXRERERERERERDLRIRQRRSSIFPVAGVLLDXSCR

SEQ ID NO: 174858 - protein, 142 aa, Triticum aestivum
  Clone ID: PAT_TA_69276.pep
HEGFVDLRGMLKVVSGFGSEACLTIFHHKKKIFNRTFQIAIRNLKAVKVPESCPAGTFLENIIFEVSDCDGVIDESIHGLQHTLSIRSNQLKDVQGVQYAFEHGRCVLPRAQVPNEPGTVSFVAYHTHFADLETIIQVDLTR

SEQ ID NO: 174859 - protein, 36 aa, Triticum aestivum
  unsure (1)..(36): unsure at all Xaa locations
  Clone ID: PAT_TA_69277.pep
FFFRQGFIHANITFHHPCPWAELHGNGKVKSNXGST

SEQ ID NO: 174860 - protein, 80 aa, Triticum aestivum
  Clone ID: PAT_TA_69278.pep
LLLPVTNGGRSACFSPSPAVSCPGGRRRSPPPACTERVRLDLPVSSGTDERTLTRHSPCAHSSCSDMSGGNCIQLVYFLK

SEQ ID NO: 174861 - protein, 91 aa, Triticum aestivum
  Clone ID: PAT_TA_69279.pep
FFLRGFLTVVCCAYNGSKRSIYIYMCIDKHPLADRFCQILRKETGTSCRTTACRCASSILMYCQNHGQSMLASPKFFTNIHTRPRAVCSAI

SEQ ID NO: 174862 - protein, 95 aa, Triticum aestivum
  Clone ID: PAT_TA_69280.pep
RARAALGLAGGGAAALGVRSPAGLVVACVGGSDPEPGWIWPSLQAWCFAAGRCPGGQRRSCVCAAACSLPLELGGDHDGGALANPKIQLNACCLM

SEQ ID NO: 174863 - protein, 157 aa, Triticum aestivum
  Clone ID: PAT_TA_69281.pep
IGSNQIPSLLPPLIPQSRAHPPTKKLRSSSNPSRTPSPLLAAASERARAEPSEPRFGLWGVQETGGIKKPSPLARTGDRSLGGLLLPPRARQCRIRPGRRPRPPPPPPAPGCRHGVSESRGLPRPPPMLAGFFAEDGAGAAAGGDEERRCRSGSRRA

SEQ ID NO: 174864 - protein, 131 aa, Triticum aestivum
  unsure (1)..(131): unsure at all Xaa locations
  Clone ID: PAT_TA_69282.pep
LNHQTKFSFRAGNIIITLYREVSCMLTIQYLKRTKRYFIPMVYSILDAFIPMVYSITKKKATGKHITEHMVYLPRAAQEKEREPEVGDGITHRRGRLWSTAVVGVGHGLHVTQQHRXPAGSGXKCITMFNT

SEQ ID NO: 174865 - protein, 191 aa, Triticum aestivum
  Clone ID: PAT_TA_69283.pep
ALDLRLSALKEEILVLLSRAVGSKLLNKEVSDLSGFVQHFGTSEFSWLVRCLLLIRDCQPSVLPPHQASTAERKDDALETRDISSQTNIQRPITSNVSPAKLAQVERKMSMESDDSSESTDEDEAVVERSRPLMRSASPRRSASPMRRVQIGRSGSRRSTPIAIKSLSYFPPSQRVALDKDDESSCNGETD

SEQ ID NO: 174866 - protein, 196 aa, Triticum aestivum
  unsure (1)..(196): unsure at all Xaa locations
  Clone ID: PAT_TA_69284.pep
NXAIETGITDCKSEVVSQLVAVDSDKFNQNFTEANSPTFSTITYLSSETHDGSSIACGHKACQEKVVIISTSETLESSYDVSNILADEVHYAEGNSLADGLQFEECSRVSSGKLEQEDVKERSLSNHSSSNKEDLYNLGVPEVSVFDDSSSQTFQANLPDKDISVSTLXNDHMDIXXNTXAMIIIPAHXMIXLVSM

SEQ ID NO: 174867 - protein, 37 aa, Triticum aestivum
  Clone ID: PAT_TA_69285.pep
VHSLLLGGAALIEWLDVYLHGILCRGWYYRLTWRPPS

SEQ ID NO: 174868 - protein, 156 aa, Triticum aestivum
  Clone ID: PAT_TA_69286.pep
PSSSCSSNSRYTTKSSAPFASLVAAALLLCFVSPARSCTEQERGALLGFLGRLTPGGSGSLNVSWVNDTDCCQWEGVLCSGDGTVTDVLLPSRGLRGLVSPSFGDLPGLLRLNLSHNSLEGSLPAELVFSRSITVLDVSFNRLDGPLQELQSSDTG

SEQ ID NO: 174869 - protein, 62 aa, Triticum aestivum
  unsure (1)..(62): unsure at all Xaa locations
  Clone ID: PAT_TA_69287.pep
QKGQRIKIEPNNGHAAXISCLFNHVPMGEMQGLRMTSRSEVETRXLIMTNRDKSPLKLRLID

SEQ ID NO: 174870 - protein, 34 aa, Triticum aestivum
  Clone ID: PAT_TA_69288.pep
LQRCGRVTIFPKISGDGKLQKASSMMPDFKVNLW

SEQ ID NO: 174871 - protein, 95 aa, Triticum aestivum
  unsure (1)..(95): unsure at all Xaa locations
  Clone ID: PAT_TA_69289.pep
VFXXXFFXXLCFIXXFYVIXXTLDFSYLLHLHSSGLARSPLAMRKRPRSTEENSGDPLLSRREIVKKTKCRGSRPWSWPAGRRQRSSHRPQPPSS

SEQ ID NO: 174872 - protein, 61 aa, Triticum aestivum
  unsure (1)..(61): unsure at all Xaa locations
  Clone ID: PAT_TA_69290.pep
VTATLAASKXPTLLSPMFFTRSLPGHTQVGTEVGRTMQVYYIKVAEREGYALEWPLKVYXG

SEQ ID NO: 174873 - protein, 38 aa, Triticum aestivum
  Clone ID: PAT_TA_69291.pep
FFFSRHHATQCSLARHPIQSIIVHIYKSQLPANCKVSK

SEQ ID NO: 174874 - protein, 71 aa, Triticum aestivum
  unsure (1)..(71): unsure at all Xaa locations
  Clone ID: PAT_TA_69292.pep
FKYTLLQAEFTLMGGTFMSLLAAYCDYFTRNLQYALSGHTSANVAXCYSEHSAVKHITMTIGTEGSFNICP

SEQ ID NO: 174875 - protein, 184 aa, Triticum aestivum
  Clone ID: PAT_TA_69293.pep
SARGPREDAEFVGARVEAGLRAARFSSPPSSEEFAASIEPKNVPAVFRGVLKGSAASPRWDPLHGGLDYLLEKVGPDVAVEAMMSSTGHVFYGDLRSHERVSIPFSTFMHSCKSYLGHLNAASDSSKDKGIGEEPTCSGEMCSAGLEISEQLYLAQVSILNTENKERCSLEVLKEDIQEPIFLK

SEQ ID NO: 174876 - protein, 273 aa, Triticum aestivum
  unsure (1)..(273): unsure at all Xaa locations
  Clone ID: PAT_TA_69294.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQXRLIFAGKQLEDGRTLADYNIQKESTLHLVLRXRGGMQIFVKTLTGKTITLEVESSDTXIDNVKAKIQDKXGIXPPDQQRLIFAGKQLEDGRTLADYNIQXESTLXLXVLRLRXGMQIXXKTLTGXXITLEGESSAPIGQRQGPRSRDKXGIXPGQQ

SEQ ID NO: 174877 - protein, 178 aa, Triticum aestivum
  Clone ID: PAT_TA_69295.pep
MSLEDPLHPVGIIQECLSKCIKKQVDHIGKQILCKLMGEWRLMDELLVLRAIYLLGSGDMLQQFLITIFDKLDKGNSWDDDFELNTLLQESIRYSADKMLLTAPDSLVVSLAKHDTRYDEESAPTSRKGRAQGFGIDALDALNFTYKVSWPLDLIANTEALKKYNKVMGFLLKVKRAK

SEQ ID NO: 174878 - protein, 190 aa, Triticum aestivum
  unsure (1)..(190): unsure at all Xaa locations
  Clone ID: PAT_TA_69296.pep
MLWYAITFDTTYRTNLYDMPFGXFVGVNNHFQSIIFGGAMMRDEKEDTFKWIFREFIRMVGRKHPXTILTDHARAMELAIAAELPNTVHRWCKWHILKKAKESMGVLWSKDSKFKMEFHKLLHHMITKEEFEAGWQDMLENYNLRKHPFLTQIYEVRHKWAKPYFRGVFCAKMTSTQRSESANHLLKXYX

SEQ ID NO: 174879 - protein, 106 aa, Triticum aestivum
  Clone ID: PAT_TA_69297.pep
MGASRAAPLRGKLGSLQLSEAEKKGVRITGKQQQQQQPCPSPQASGGKIQAVGKLLSEKPAIAQHVGTSLGAVWSPSFGVKCEDLGRNRFLFTFRHEADKEKALDA

SEQ ID NO: 174880 - protein, 176 aa, Triticum aestivum
  Clone ID: PAT_TA_69298.pep
LVARALLENPQLIDWRLVFKALYGLVALICGNGYIVGINQIYDIGIDKVNKPYLPIAAGDLSVQSAWLLVVAFAVVGFSIVVSNFGPFITSLYCLGLFLGTIYSVPPFRLKRYPVAAFLIIATVRGFLLNFGVYYATRAALGLAFQWSSPVAFITCFVTVFALVIAITKDLPDVEG

SEQ ID NO: 174881 - protein, 168 aa, Triticum aestivum
  Clone ID: PAT_TA_69299.pep
DALPKEQALISDPSESSQNPIVFGPHPADYLAAENHTQPLYGGDGEQDDCFGIGDMFGEPEITSDAKKETGTTGDIDVMAWSSNSADDEVDDSNAPVSVEGCLSLYTEPELLTESWHCEHCSIAVAQPNTNELEEGEETAASANDRKDSAEMMASGDEKHVDDKVPSC

SEQ ID NO: 174882 - protein, 136 aa, Triticum aestivum; identical to SEQ ID NO: 116005
  Clone ID: PAT_TA_69300.pep

SEQ ID NO: 174883 - protein, 141 aa, Triticum aestivum
  Clone ID: PAT_TA_69301.pep
RASSPNSSLLPPPPPYPLPSPSASSQPRRPPFLQTPSPAASPSRTTSSPPAASPEREHSRRPRDSPTSTPPPNPTPSSPSSPASASPGPTSPPPWQGTPVYSALKWRVPSPPSSPGSPASACHTPRSRASPRSPTTASAPN

SEQ ID NO: 174884 - protein, 104 aa, Triticum aestivum
  Clone ID: PAT_TA_69302.pep
QSGQDLEVFFCSSSSSNTRISMPITPPPLCLPFKNLLTANGQICSQRRFSMGTQTPSPSPLHLALPFPSLPENDATDGHPWTTCSGRRQPNYRTAQPPPRRHRP

SEQ ID NO: 174885 - protein, 153 aa, Triticum aestivum
  Clone ID: PAT_TA_69303.pep
SARGFCALGAPLPPATPPPPRLFLLPAFPSLRLAVSGGSIHSVVSDGLPSPSLVRVRCRHSISILGACGREASCLLPGRDMGVEASERVGVAEEAGEARRGRRGVSWPRWPEGRLHVTVYEVPRGGCCGRLNSSPVIEQSAVPSPSSLPSSHP

SEQ ID NO: 174886 - protein, 156 aa, Triticum aestivum
  Clone ID: PAT_TA_69304.pep
EASLGRGKRLRKAVSYRETFAAIANEALSEDSDDGDEPKREYTAAGLALKEKYGKLRARQKERIAQRHTIKSYADDKLEDFIKLYDSSVNEYGVNPLRVVEDPDSAQPSGAKRFSDSTAEMRHSSKKAKRYPEISRELHAKLAASATSSKHHSKAT

SEQ ID NO: 174887 - protein, 99 aa, Triticum aestivum
  unsure (1)..(99): unsure at all Xaa locations
  Clone ID: PAT_TA_69305.pep
LEADIQHANNLASEXSRDYXXAXLXMRMXYXPXARXXLFLLXXTXCXLXXXLXXLXXXXXXXXXXXXTTXXTHXXXAXXXXXXXXXXXXXXXXXXXXXX

SEQ ID NO: 174888 - protein, 86 aa, Triticum aestivum
  Clone ID: PAT_TA_69306.pep
FLMLQKYQSKKAKITKTNFVAYLCKDMRRGLQLVLQICEVNFQYVRSPHSASFCPSPPCLLYAQESRMPWIHLGRRAPAFLIVTSD

SEQ ID NO: 174889 - protein, 55 aa, Triticum aestivum
  Clone ID: PAT_TA_69307.pep
DLKGFRCHKSQLMGDTFLKVNHFMHEATQKKSTHKYGVNLCVTYENYQINILESI

SEQ ID NO: 174890 - protein, 239 aa, Triticum aestivum
  unsure (1)..(239): unsure at all Xaa locations
  Clone ID: PAT_TA_69308.pep
VKTLTGKTTLEVESSDTIDNVKAKIQDKEGIPPDQQRLIFAGKQLEDGRTLADYNIQKESTLHLVLXXRGXMXXXVKTLTGKTITLEVESSDTIDNVKAKIHDKXGIXPDQXRLIFAGKQLEDXSXTWXDYNIQKESTXXLVLRLRXGMXMFXKTLTXXTITLEVESSDTIXXAKAKIQDKEGIPPDQQRLFFFLXKQLXEDGRTLADYNIQXESTLHLVLRLXRGGMQIFXKTLTGKT

SEQ ID NO: 174891 - protein, 79 aa, Triticum aestivum
  unsure (1)..(79): unsure at all Xaa locations
  Clone ID: PAT_TA_69309.pep
IQLTILLKQYSSRITSKTSGTSSAGTNGKHGAPGQRQTQKGLDAATGIRQQLSPPTTDTLAXGKGERQRRDPXAEXPAX

SEQ ID NO: 174892 - protein, 81 aa, Triticum aestivum
  unsure (1)..(81): unsure at all Xaa locations
  Clone ID: PAT_TA_69310.pep
LALELLYRRAISPCXVTLTALLVLPRLHAAAWLSAAARQQRPCFACSASSCWRRDAPTPSITIAASSASSHAQTCVGFSGI

SEQ ID NO: 174893 - protein, 34 aa, Triticum aestivum
  Clone ID: PAT_TA_69311.pep
AALPPVVSLFSVLGRRLSSPASLSQTIAHHISSP

SEQ ID NO: 174894 - protein, 139 aa, Triticum aestivum
  Clone ID: PAT_TA_69312.pep
LWLLWEDFTTVGGLTVLPQVMWSTFVPVIPSSILPGIICGSLAVAAVAMARMGKLSEGGTKFVGSLSGWTATLLFMWMPVAQMWTNYLNPSNIEGLSAFSMLLSMIGNALMIPRSVFIRDLMWYVLFQPIHFSNPSTTA

SEQ ID NO: 174895 - protein, 87 aa, Triticum aestivum
  Clone ID: PAT_TA_69313.pep
DLHFVFLRSPAHGLTDGCKTQRSITNWSAVSSSVCVHKIHFTFLFALCINDVVELRSLFLQCCLQGRREVTNAFELLYVIVHLLNLF

SEQ ID NO: 174896 - protein, 216 aa, Triticum aestivum
  unsure (1)..(216): unsure at all Xaa locations
  Clone ID: PAT_TA_69314.pep
RHEAKKXKKTRLFAGFGSASVAAAAHRPGALLPARMLPPSPSPNLYTTGLNPQPGRRSAFTRGREALGCSPSPVKERDNSGESFFPSRAHTRPHPVHTSSSSPSRSALIRTRACNHSIQRTKRICPPFFIVPISSSPAATASHTDGVDTGSENVSVSGVPVRSAQASNGGSGRRGHGRLGRHQGGDQAARLRHRGQDQAAQEPEERSAEDEDDAGG

SEQ ID NO: 174897 - protein, 121 aa, Triticum aestivum
  Clone ID: PAT_TA_69315.pep
PPPPFMPRASSGSEGGGSRRCRGRGRCCHRSREKKSPAMESVMAAPTLRKSRGRSLRPPPPPPPLQSPALGISLSLDLPCQEHLNPAACERQKQGEPNQWLKCPRIAKKVANKFLILVTRT

SEQ ID NO: 174898 - protein, 227 aa, Triticum aestivum
  Clone ID: PAT_TA_69316.pep
ELCNVVDALSKLAIRPGSPESLQQLIEIARSNFKNAASFAAMKDEKVLSGRPSSIYKEENDSAFADAVSFQDQVAVLFSDWCHICDHPTMGDSAYSHYIVQLQQHGLLKGDDLTDRFFHTLTELAITHAVVSEQVIAPGGMSQQPAQQLQISYFSIDSYSKLVTLMFKYGVDLGPNKGSLLLKILSITTRIIQKDAEEKKVSFNPRPYFRLFINLLSELSTADLHDG

SEQ ID NO: 174899 - protein, 204 aa, Triticum aestivum
  Clone ID: PAT_TA_69317.pep
MTRVESRSLDGFVAFVCYTYSISEQEAVVLLCQHRFNLSYMLQGSEKIFLNLASAALVAKHPQPAAFGDFLNSLTPAKLVRLRSLISDRGLRHVLSDDTLVQLKKMATNATACVAAAAAVQSMTPDLGQSALKTLSARRETFKSEQDYVRTKLQKLLLDYGHDKGHFYRLGIVCGVTTARYGFYPTCYHVNFLASTDVPNDSTR

SEQ ID NO: 174900 - protein, 69 aa, Triticum aestivum
  Clone ID: PAT_TA_69318.pep
DCLVPYLFMFSVWMICSNFRLYCFCPNCLHLLCNLIFMQHCILQLLDKFKHAHASSLIKVTEINKTSMT

SEQ ID NO: 174901 - protein, 65 aa, Triticum aestivum
  Clone ID: PAT_TA_69319.pep
ATGSANDPRVHGGWLSVYTSTDPGSRYNKQSARYQVILVILDSAFVYHQNQYYRLPHVLKHKPLN

SEQ ID NO: 174902 - protein, 179 aa, Triticum aestivum
  unsure (1)..(179): unsure at all Xaa locations
  Clone ID: PAT_TA_69320.pep
SCFTSFYMMKWKEXFPSKELVQPPKFEAEVLCYPKPKIVCDYLSWXRQAECHNRNQXNTCFWMLVKSGEEENKANEILKGTLSKDKNELLFQRFQMNYNNEPAMFRKGSCTYRQKVKVSGDVVRDGWDVAVTHVDMRPDLEKAYVYFRQMMIWMYLLGRFVALIILEFYLETSRFCRLW

SEQ ID NO: 174903 - protein, 89 aa, Triticum aestivum
  Clone ID: PAT_TA_69321.pep
RWLRDPGSVQIAVIILHQQNHGVLVGAAYKVTNPCGCIWLVAATACQSDKRSQGAISDGVASASCQLEERPRSHRQEATLSWNLKWSNG

SEQ ID NO: 174904 - protein, 140 aa, Triticum aestivum
  Clone ID: PAT_TA_69322.pep
VGVTSEVRGIVSEELSSVASRIKGTIGRVDDELVWSAIDYFELAERDSRPAQGSLPTTELRVVSWLGMPIYDTDFGWGKPVMMMRAESERGGRVYMMDGDGDGDGDGGSVRIIVCLEATIIKDFHDMLYAKFSDLIRSSL

SEQ ID NO: 174905 - protein, 66 aa, Triticum aestivum
  unsure (1)..(66): unsure at all Xaa locations
  Clone ID: PAT_TA_69323.pep
SVYPSCRSDPEEIYESRRPRRAVQVNASLVRHGKHGGRRSICVVRAEPCHLVVAAADQVSLRRQRX

SEQ ID NO: 174906 - protein, 69 aa, Triticum aestivum
  Clone ID: PAT_TA_69324.pep
IVNEEHMPHLQFITLLFNLPVNSVVFRKASSSLEATMKCCRDDAVLEVGLEMRTSGMLMFGSVNLLSEG

SEQ ID NO: 174907 - protein, 38 aa, Triticum aestivum
  unsure (1)..(38): unsure at all Xaa locations
  Clone ID: PAT_TA_69325.pep
KVISSIFRFRLGFVLYPESEYARNDLLXXAXXXXXXXX

SEQ ID NO: 174908 - protein, 88 aa, Triticum aestivum
  unsure (1)..(88): unsure at all Xaa locations
  Clone ID: PAT_TA_69326.pep
LCSIYALHIEXTDFTGCCYNQRXVQHHTYMATISSYIYALHIEILILLVDAFLLLLKRNSLIEGLNSGSISCCSSPRRRPHQLHRPAP

SEQ ID NO: 174909 - protein, 34 aa, Triticum aestivum
  Clone ID: PAT_TA_69327.pep
KLVTNFYDVRHRHLYLRQNVLKVDVKFRPYQCRV

SEQ ID NO: 174910 - protein, 79 aa, Triticum aestivum
  Clone ID: PAT_TA_69328.pep
WLTVELHHNGRHHLDQRLINESALTSSTGVRAILTLEAMGLSLKHGVFPASHHPRSQHHLILSVTTTTMVGSFYIHMAN

SEQ ID NO: 174911 - protein, 86 aa, Triticum aestivum
  Clone ID: PAT_TA_69329.pep
ILNEAMCVKLWNMFGGTHVTSSALQVLRFQLALSHSMILPAWLLGLWQLILLVCLLATLCGECGFSFTVVLLSTCWCLGVQSATQG

SEQ ID NO: 174912 - protein, 69 aa, Triticum aestivum
  Clone ID: PAT_TA_69330.pep
SNLYYSGCFGFKPSQKRCNRDVCILFNYVFLLTLTKLTPTCLGQKRLCCCNLNNLQLNKALKFSRPRRA

SEQ ID NO: 174913 - protein, 81 aa, Triticum aestivum
  Clone ID: PAT_TA_69331.pep
IDEPGLSKIVHECRVMFHSGLFLLIVKQCTLIWLISQKKSTNSKISKSSKLDKSNFNTQSLTGVYFKGAEKLKRCAEASHR

SEQ ID NO: 174914 - protein, 53 aa, Triticum aestivum
  unsure (1)..(53): unsure at all Xaa locations
  Clone ID: PAT_TA_69332.pep
VSGTQYAXFFCQSVETTTKKKRXXXADPPXXFRXKXTXXXQXPXLANXTTTXA

SEQ ID NO: 174915 - protein, 40 aa, Triticum aestivum
  unsure (1)..(40): unsure at all Xaa locations
  Clone ID: PAT_TA_69333.pep
XKXVCKXLWNVXXHAPKLMIFXXSIXPLTCSTSAHLGQYP

SEQ ID NO: 174916 - protein, 67 aa, Triticum aestivum
  unsure (1)..(67): unsure at all Xaa locations
  Clone ID: PAT_TA_69334.pep
QTSHIYXFDLXKTAXXYLHRAGRTGREPFSKSECSVTTLITEEEHFVLQRFQNELKFHSQQLPLECM

SEQ ID NO: 174917 - protein, 52 aa, Triticum aestivum
  unsure (1)..(52): unsure at all Xaa locations
  Clone ID: PAT_TA_69335.pep
VWRQLIWIXGSSISTSGLIRLILIALLQQLFLMLTVLPHIXCKLGVTPKIKH

SEQ ID NO: 174918 - protein, 97 aa, Triticum aestivum
  Clone ID: PAT_TA_69336.pep
RLSLPRQKRSPSPSPSRAAARSRGAGRGRRMSAHERLYEARRAEAEEMRRRTYLPYRQGGLLIFGCIGLGNRSYGTAVHGLARGLNTATATAVSSRS

SEQ ID NO: 174919 - protein, 86 aa, Triticum aestivum
  unsure (1)..(86): unsure at all Xaa locations
  Clone ID: PAT_TA_69337.pep
SSXXTXSKKGKSQNKEQQAISVGYAKGMSSNPYRCDKHPLHKRIKLNKTYLRPTSXTHSQLTYFYYINSSFFLPENNVASLNSQFL

SEQ ID NO: 174920 - protein, 73 aa, Triticum aestivum
  unsure (1)..(73): unsure at all Xaa locations
  Clone ID: PAT_TA_69338.pep
MQYSMSHHXSVLGLNRSRPEPFSDAEIKNAFRRKAMEYHPDQNQNNKAVAEEKFKEVMDSYEAIKLERQNGSC

SEQ ID NO: 174921 - protein, 63 aa, Triticum aestivum
  unsure (1)..(63): unsure at all Xaa locations
  Clone ID: PAT_TA_69339.pep
ICRADALSGSNQLAGWLHLHCSNFDFIYLFTAVIFSIFCSSLLSASCDLLCAGIELYRRPXQV

SEQ ID NO: 174922 - protein, 95 aa, Triticum aestivum
  Clone ID: PAT_TA_69340.pep
RPDLGFHLGNCGSVFESTTKNACHNQNCLSPICCCPLLQRPCAVNLHRNQNSSLPLNPPIAAAMTFFTTVNAWKSILRHVPWHRHDSKASRHALM

SEQ ID NO: 174923 - protein, 46 aa, Triticum aestivum
  unsure (1)..(46): unsure at all Xaa locations
  Clone ID: PAT_TA_69341.pep
ACRSSSRXVIRDAVTYSEXVLRKXVAAXXVVYALXRQGRTLYGFGG

SEQ ID NO: 174924 - protein, 55 aa, Triticum aestivum
  Clone ID: PAT_TA_69342.pep
QEFESARRGSGFRVRGGRKDTWPNGAASVLIQRYPHSHPLLIYIYMVHLLQVGPV

SEQ ID NO: 174925 - protein, 104 aa, Triticum aestivum
  unsure (1)..(104): unsure at all Xaa locations
  Clone ID: PAT_TA_69343.pep
MQNVCQTLRTVTDKELEDDAMKPNSFGGLQMNKKANKRKPMAPRSTVWKSFTKVMVGDTXKAKCNYCGENYCCESKNGTSSLISHLKRCKLNPNKSSVGVCIYV

SEQ ID NO: 174926 - protein, 74 aa, Triticum aestivum
  Clone ID: PAT_TA_69344.pep
IEITTIHASYLAKKIVLCIVDTCTIWIVDTCIDCRFFYLSEASILFYQSIIQMWLGFSVIRKHTLYCLCFYRKM

SEQ ID NO: 174927 - protein, 33 aa, Triticum aestivum
  unsure (1)..(33): unsure at all Xaa locations
  Clone ID: PAT_TA_69345.pep
SXYSTXANCKLKSDEDFRAQWLGLRTIMPTENY

SEQ ID NO: 174928 - protein, 72 aa, Triticum aestivum
  Clone ID: PAT_TA_69346.pep
YATHLPVDDELGTQSGCAADYKCENPSCSRAFHSVCLRDWLRTITTTRQSFDVLFGNCPYCSEPVAVKSTDS

SEQ ID NO: 174929 - protein, 202 aa, Triticum aestivum
  Clone ID: PAT_TA_69347.pep
EETRIPPSDLHQHLGDLLENKDAADLIFQVGAQSFSAHRCVLAARSSVFKVELLGTMKESSAANPIEIYDVEADVFKSLLHFIYTDSVPPVLDVVMASHLLVAADRYNIGRLKLICEEKLCTHIDSNMVATSLALAEQHGFHRLKEACLQFLASPSNFKAMMASDGFEHLTSSCPHVLKELVARILPAEWGVPKDVVMTMWK

SEQ ID NO: 174930 - protein, 39 aa, Triticum aestivum
  unsure (1)..(39): unsure at all Xaa locations
  Clone ID: PAT_TA_69348.pep
LVXMGGXGASPGGSNRRKGXAAESXVHLFXRRTEDXSXQ

SEQ ID NO: 174931 - protein, 93 aa, Triticum aestivum
  Clone ID: PAT_TA_69349.pep
SSTPPPSSRHSSHQHAHVVLLVTANLNFLRNSPRINKLSAFVTTLGLVVSSACSLLYSVSIAMEKPEDAVGEKEGLKSVRRHGLVVKQAFLYQ

SEQ ID NO: 174932 - protein, 79 aa, Triticum aestivum
  unsure (1)..(79): unsure at all Xaa locations
  Clone ID: PAT_TA_69350.pep
RRVRVASSSXRSAPSXSLLHVLPFPMESXALGRESACAXGVPVYEWPDRGAWVHEIEASXCTDCTIVLLTFKSTACIFS

SEQ ID NO: 174933 - protein, 134 aa, Triticum aestivum
  Clone ID: PAT_TA_69351.pep
TLHIMSAKGVYQAGNVRLNLRFWESAKPTKSVEFSIKVISFCEFRGELGEAAFLKFFFRSARALESAMITMRSGSFSTDELSSRVKQVSQKMVSKSCKMIVLGSDGPEGGRPWSFKRGTDYCFKDPFSAVEWVG

SEQ ID NO: 174934 - protein, 190 aa, Triticum aestivum
  Clone ID: PAT_TA_69352.pep
VDQSRLKPQGSMEASHVLLTETEDSATVVVQTNNFSSDSETDSHLMDLAAHHSETQTGLLQIATGAISETTISAVGSSAHKRKGKAPVPIDTSTLRRSTRTNKYDGFRTTSLSEAKVSKSKVKPRTVPTAVSAGPATAASNQMAPEDLPPPTDIATMQAIGTNLCAIPEEELTVAAFTEDPAGTSSSTSA

SEQ ID NO: 174935 - protein, 165 aa, Triticum aestivum
  Clone ID: PAT_TA_69353.pep
LDPEYFLTHNLTDKSDVYSLGVVFLELLTGMQPISHGKNLVREVVAANQSGMILSVVDTRMGPCPWECVERFAALGLRCCRDETDARPSMVEVVRELETIWQMTPETDSVPLESESRCPWTPGRTGTQLSSSSAGGLMMAYQYMSSSDASGSNLLSGVVRSTNPR

SEQ ID NO: 174936 - protein, 39 aa, Triticum aestivum
  unsure (1)..(39): unsure at all Xaa locations
  Clone ID: PAT_TA_69354.pep
EVYGLIEYAQXSLGLRXVAXXIGVKLGLXXXASXMHAXC

SEQ ID NO: 174937 - protein, 180 aa, Triticum aestivum
  Clone ID: PAT_TA_69355.pep
LDDDLVISSFESIIDSLGDLSLVPQPLAPGDPFTIREYLVECGGRLLMVTRWIHRVNISASDDGFEDKRTAALEVFEADLQSSPRRRWRRVHDLGGHALFLGQHGSKSLPPAECSEYQEDCIYFMCDYPLPSSSANPLRDSGVYNVRNGMITPLMSETAAVPLERVGQWRPAWVFPSAAM

SEQ ID NO: 174938 - protein, 108 aa, Triticum aestivum
  Clone ID: PAT_TA_69356.pep
SYSEKTDVKWEPSDPDFKHKNLAKLTIYGFQSDDNFTGHIRRVMEAAVNIKEVSLHDRKVCKVCAVKFPHVEVRPSSYPRTSDEKNLLRNKITEALPKASPAVIHFHS

SEQ ID NO: 174939 - protein, 50 aa, Triticum aestivum
  Clone ID: PAT_TA_69357.pep
MSLFLAYFSAAHVACMYAILSVTILKTDPKGKSVQNCLKVTSIKLYISLR

SEQ ID NO: 174940 - protein, 93 aa, Triticum aestivum
  unsure (1)..(93): unsure at all Xaa locations
  Clone ID: PAT_TA_69358.pep
SSSRSSRRSHPPGARAVPFPQELAPXPCPRSSRXPHPXGARVXPIVRSSCXXLPPGARVVGFLQKLVPSPSSXSLRXXPPPRARVSPHHTGAR

SEQ ID NO: 174941 - protein, 138 aa, Triticum aestivum; identical to SEQ ID NO: 141364
  Clone ID: PAT_TA_69359.pep

SEQ ID NO: 174942 - protein, 55 aa, Triticum aestivum
  Clone ID: PAT_TA_69360.pep
YYNLSQSSKALLSPLRILPSFGFAAISFFRYTELINDYPFPIYQLLIVTGAAWLT

SEQ ID NO: 174943 - protein, 35 aa, Triticum aestivum
  unsure (1)..(35): unsure at all Xaa locations
  Clone ID: PAT_TA_69361.pep
SKMVCVPEAGKALRTIFVTLTQMIVDSSMPFLXXI

SEQ ID NO: 174944 - protein, 37 aa, Triticum aestivum
  unsure (1)..(37): unsure at all Xaa locations
  Clone ID: PAT_TA_69362.pep
ASLXCQPLIVTSXSAQRGTKKWXXCLLIYTRHCHDVA

SEQ ID NO: 174945 - protein, 30 aa, Triticum aestivum
  unsure (1)..(30): unsure at all Xaa locations
  Clone ID: PAT_TA_69363.pep
FIHFIDXYMPXQFSSRCKLCHVXLVKPWVV

SEQ ID NO: 174946 - protein, 162 aa, Triticum aestivum
  Clone ID: PAT_TA_69364.pep
QVITAVKEACRAAVLQNNPRLVEGMYFCELTTPTQQLGSTYAVLGRRRAKILKEEMQEGTSVFRVHAYLHVAESIGFSSQLRTLTSGAASALLVFSHWDAIQEDPFFIPKSQEEIEEFGDGASIGPNLAKKLMNSVRRRKGLHVEEKVVEHGTKQRTLSRKT

SEQ ID NO: 174947 - protein, 117 aa, Triticum aestivum
  Clone ID: PAT_TA_69365.pep
PALHLQFMLTESCQFHHKLHSAGIADSQTLGFKEATRKRSYFKVVQLEVQEDTNGVLRRGGMTTARDATISSMAELTVGRRLSLPIQCSRDLVASHNVISRGPEAGAPTISSSSPWT

SEQ ID NO: 174948 - protein, 65 aa, Triticum aestivum
  unsure (1)..(65): unsure at all Xaa locations
  Clone ID: PAT_TA_69366.pep
VNSFFSLSSQQCKHADSVFTIDRSVFSCLLTYVVFVNRKTSAICWYCICFSLSYLKCQHTXGCCS

SEQ ID NO: 174949 - protein, 107 aa, Triticum aestivum
  Clone ID: PAT_TA_69367.pep
AANINVLYVFSDMRIVLLSDDCLIQLLPKTHHHEIYIESSVEGPHCGIFPIGAPSTSTTTTGLKWNLSDAEMRFGSMISTSNIVDSDKVTVQSDADLLWTISLRNLT

SEQ ID NO: 174950 - protein, 38 aa, Triticum aestivum
  unsure (1)..(38): unsure at all Xaa locations
  Clone ID: PAT_TA_69368.pep
EFQSFYPREDRMFLRIWPVTGRLSXSPXLLLSPQXLSS

SEQ ID NO: 174951 - protein, 78 aa, Triticum aestivum
  unsure (1)..(78): unsure at all Xaa locations
  Clone ID: PAT_TA_69369.pep
SEVSDIYSNTNLNLLPRKGQMMVASXSTYLXNILYGKGGVPLTTGSWKLALKFRGQVGDERKHYRCHSPRMNXPRTAR

SEQ ID NO: 174952 - protein, 133 aa, Triticum aestivum
  unsure (1)..(133): unsure at all Xaa locations
  Clone ID: PAT_TA_69370.pep
DXMDIVKXKXQXKEXIXXDQQXXIFXGKQLXECXTLAXYNIQKXSTXHLVLXLRGGMQIFVKTLTGKTITLEVXSSDTIDNVKAKIQDKEGIPPDQQRLIFXGKQLEXXRTLADYNIQKESTLHLVLRXRGGQ

SEQ ID NO: 174953 - protein, 73 aa, Triticum aestivum
  Clone ID: PAT_TA_69371.pep
NSEAKLLRFARYFNDAIVIAQPDWNYVICRWQHIFPVGILTSMDGDVSGYFLSNFMLLQNDKKNGSSGLCGWL

SEQ ID NO: 174954 - protein, 88 aa, Triticum aestivum
  Clone ID: PAT_TA_69372.pep
FQAEGDQVGVGVKMARVLENDAVNSANESGNMMACLLPPAKRKEIGRPTTSKEKAPYQGLSKRTRFCMICRRQGHKRTTCPDLGDVPK

SEQ ID NO: 174955 - protein, 36 aa, Triticum aestivum
  unsure (1)..(36): unsure at all Xaa locations
  Clone ID: PAT_TA_69373.pep
ARSGSLILVVQPITIQLFFVYQLKAVIXTTPXKTIL

SEQ ID NO: 174956 - protein, 74 aa, Triticum aestivum
  Clone ID: PAT_TA_69374.pep
ETEAISPCCQLPPPPDHTCFSLHLHKIKMKSSTEPLQVPTAIFFHASILLAPKRVLSDQGFIGAAGPWVAKDTI

SEQ ID NO: 174957 - protein, 75 aa, Triticum aestivum
  unsure (1)..(75): unsure at all Xaa locations
  Clone ID: PAT_TA_69375.pep
VTVGNDEDQDEGPSSGEPNGEETCEEQEPSRRXLSHPTLKGLPVSRLRDSVRSIAFXWTAEKRSGDSALISASIN

SEQ ID NO: 174958 - protein, 111 aa, Triticum aestivum
  unsure (1)..(111): unsure at all Xaa locations
  Clone ID: PAT_TA_69376.pep
VXILKLIVLPNNLNLYSEVIYKWRGDCLINSKYYTNSAYVLRFFLHIAPVHFQLDSWLGPHQPAAPFVKRRIHRALQLYTFLLRRNIMSSVATGFPSRLQTCAHCCISASS

SEQ ID NO: 174959 - protein, 40 aa, Triticum aestivum
  unsure (1)..(40): unsure at all Xaa locations
  Clone ID: PAT_TA_69377.pep
PTRLPEAYLITXFSXLLRXGSLLLPGSQXALVHPLDAEXA

SEQ ID NO: 174960 - protein, 66 aa, Triticum aestivum
  unsure (1)..(66): unsure at all Xaa locations
  Clone ID: PAT_TA_69378.pep
YFVMFRIEICMACVVQICLVXLFNICALFIXLVICKNLAYLSIFVLXVLSCQVSSLNIFNYSSXLC

SEQ ID NO: 174961 - protein, 142 aa, Triticum aestivum
  Clone ID: PAT_TA_69379.pep
GTTYKDISAFSHPVQCDWSSKKSFYRIFPKKGEIWAMYKNWKITLNSTDIDKCEPRMVEILSDYTDENGVNVCSLTRVKGCLSFFQRALLEGFHLTRWISKSEMLSFSHRVPAFVVIEIRERDIPQGSWHLEPSALPFRSIH

SEQ ID NO: 174962 - protein, 73 aa, Triticum aestivum
  unsure (1)..(73): unsure at all Xaa locations
  Clone ID: PAT_TA_69380.pep
RNYLGVSDGIMLDTEVEECSTVDELKRXVELDXQSIKLMWRELEEERSVSAVXASQAMPMISRQQEEKAAMRT

SEQ ID NO: 174963 - protein, 58 aa, Triticum aestivum
  unsure (1)..(58): unsure at all Xaa locations
  Clone ID: PAT_TA_69381.pep
ASRELIYEETRXVLKIFLENVIRDAVTYTEHARRNTVTAMDVVYALKRQVRTLYGFGG

SEQ ID NO: 174964 - protein, 117 aa, Triticum aestivum
  unsure (1)..(117): unsure at all Xaa locations
  Clone ID: PAT_TA_69382.pep
NRNPVILTGDLNCAHQXIDIHDPXGNSRSAGFTKEERXSFETNFLSKGFVXTFXKQHPDVVXYSYWGYRHNXRKTNRGWRLDYFLVSESIAERVHDSYILPDVSASDHSPLGLILKL

SEQ ID NO: 174965 - protein, 50 aa, Triticum aestivum
  unsure (1)..(50): unsure at all Xaa locations
  Clone ID: PAT_TA_69383.pep
SQDELPSPFHSFVRKSFVLMMYAWQVNFPPAQVNVAXHPLHFLLKNHQYS

SEQ ID NO: 174966 - protein, 150 aa, Triticum aestivum
  Clone ID: PAT_TA_69384.pep
LIGGDAHDPHVSCRNSRRKVCRGLSSTASFCVDGDGGLHGWCRRSAWWLGSASGIGGAKGGCCHWWGNKVTLFLYFSYPSSISMLCILAYNFLQQKLRLASEELNVMELKRMGGQSSKTMKHHTYPEMRLFDHVIFNFPHAYSKDIRTRA

SEQ ID NO: 174967 - protein, 136 aa, Triticum aestivum
  unsure (1)..(136): unsure at all Xaa locations
  Clone ID: PAT_TA_69385.pep
LHSEQALSXXCKCCPPPPKGQGEGRCLCGSSAARSEDCCVQPAQECQEVLLEDVSHDACFCHDFLQLDFVDLGVEKLWAVDAGLRTCTSTTTRDLGCFFVASKLGNVXLKVSLVSCLWIHSFSHDHPLRHLGFQRN

SEQ ID NO: 174968 - protein, 108 aa, Triticum aestivum
  Clone ID: PAT_TA_69386.pep
SCNPGVKSSTRNPLCGLSGATIWARHQHMPHLSTNVLTKNGDDELPIFCVAAILIINRHKIIRDTHSIDDAIKMFNDNILKINVKRCVRLAVRLRKKYQYKLLKGGSE

SEQ ID NO: 174969 - protein, 47 aa, Triticum aestivum
  unsure (1)..(47): unsure at all Xaa locations
  Clone ID: PAT_TA_69387.pep
AXFCAXPAXQSPNRHCTXXXILVLCMTRLSHQXXAPFXAEINRDNTH

SEQ ID NO: 174970 - protein, 167 aa, Triticum aestivum
  unsure (1)..(167): unsure at all Xaa locations
  Clone ID: PAT_TA_69388.pep
QIKCHNACLHTLAKVQNDWLNHSEHLLDPLLVVEQVTTGFVLDHTEATDQPFAFATTVVIXFYGTISAILAFAVAVAVGYFHTSEEGELLVNIHLVRFLVELHVIQEVHDHELARTKAXTPGLEQLAWLPLLWQVIVHPDPHLLWRRLLPFDDAREVSSAGEVVCDA

SEQ ID NO: 174971 - protein, 57 aa, Triticum aestivum
  Clone ID: PAT_TA_69389.pep
PQVILTSHDYTHLLFTKVAMTTYLPTIYKSCHAYLSTYYSQFFHVKETLVISKNVHG

SEQ ID NO: 174972 - protein, 52 aa, Triticum aestivum
  unsure (1)..(52): unsure at all Xaa locations
  Clone ID: PAT_TA_69390.pep
KTAQFRVTHALHAQTNILHTITTSRFGSRIRXSINRSQLAXCILYISALVIQ

SEQ ID NO: 174973 - protein, 151 aa, Triticum aestivum
  Clone ID: PAT_TA_69391.pep
SAHKFTYGQDYIYNTDEMDSSFVYTDKMDSWMVRYELFLGEDGGVFLLVVDLAPFFQEFPFPLVTLVCVRNSAAAAAGPVYTYSVRADAPPAQRRKLKLEIKEVASCPDWRMERDCFPLLPGMLREEKTSKSVLVRICVSKSESSSASCSS

SEQ ID NO: 174974 - protein, 119 aa, Triticum aestivum
  unsure (1)..(119): unsure at all Xaa locations
  Clone ID: PAT_TA_69392.pep
TTYEYFQNSSQSFVMVFDDPGPYGRGRYNYNMTPEVELEQWRKGSQWFEVDRDLGIEIIRDTRYYPKFKEFCRPHCYXDEHYFPTMLTIEXPXSLANXSVXWVVWXRGGAHXATFGRGD

SEQ ID NO: 174975 - protein, 109 aa, Triticum aestivum
  Clone ID: PAT_TA_69393.pep
QGCSRTVKGTSSWQPRVRFETAEETPQLTESNLDAAQIMKASSFRPVTLRRCTFPTSVASQRRRRVYWNFPSIAEHWRNDVRKSLVISWKNRNWRGRRNLCQVEPPSCC

SEQ ID NO: 174976 - protein, 39 aa, Triticum aestivum
  unsure (1)..(39): unsure at all Xaa locations
  Clone ID: PAT_TA_69394.pep
HRTQXQHEPKNSTATMPQLNQHTITVFRFGSGSVAVAWS

SEQ ID NO: 174977 - protein, 89 aa, Triticum aestivum
  unsure (1)..(89): unsure at all Xaa locations
  Clone ID: PAT_TA_69395.pep
ESIYGEKXADEKFVHKHTKPGILSMANAGPNTNGSQFFICTVPCNWLDGKHVVFVEVVEGMDVVKXIEKVGSRXGTCSKQVVIADCGQL

SEQ ID NO: 174978 - protein, 125 aa, Triticum aestivum
  Clone ID: PAT_TA_69396.pep
VYMSKNIFYGKLEIRLNLTNSMASSSALPEPGDDLYGQSSPHDGGRRRCTSPDEFVVPPSGSVMADGEVDGGAANQSWSIPFRWCCHSLLHDRCCHEPKSLGWISTALVDLIEIGCFKGFEGSLL

SEQ ID NO: 174979 - protein, 47 aa, Triticum aestivum
  unsure (1)..(47): unsure at all Xaa locations
  Clone ID: PAT_TA_69397.pep
IHLSQFHAELXKRMPDXDGLDAWVLDRAIEFEELKPTCKGYSPALVG

SEQ ID NO: 174980 - protein, 27 aa, Triticum aestivum
  unsure (1)..(27): unsure at all Xaa locations
  Clone ID: PAT_TA_69398.pep
LALIVDLVGYIXHXWXSTILWSTNVXM

SEQ ID NO: 174981 - protein, 112 aa, Triticum aestivum
  Clone ID: PAT_TA_69399.pep
LNIEYLQCRGEGLWYALILRRCIGLKPPMDVGTLNLTLVNKSVFLWVWYLICEIAELHKVCFFWEVIRSFIESPSGYFLKLVYRRDRCTAAKSKSFFPSTCQLIPSDVECKL

SEQ ID NO: 174982 - protein, 123 aa, Triticum aestivum
  unsure (1)..(123): unsure at all Xaa locations
  Clone ID: PAT_TA_69400.pep
RCIQAELPAHLKGKATNAYLGSQKDAVSLRQSIIRGHGMYNFLVRVLTVMSMLDSKVAIEQGNCVKFFMATEFCEFSPEIEDHFEIFETIGGFNVTIVTTACSKEETSLLWSGFLXKXEGEIS

SEQ ID NO: 174983 - protein, 48 aa, Triticum aestivum
  unsure (1)..(48): unsure at all Xaa locations
  Clone ID: PAT_TA_69401.pep
PLHXLYNLITQADHLLQVIPFSLNQSICKTQCYHQPIKMSXHLYHLSC

SEQ ID NO: 174984 - protein, 114 aa, Triticum aestivum
  Clone ID: PAT_TA_69402.pep
LSLVITVPDALYGLYHTTQQNDGESFNEWQLKNVAALPRGCLYDTVGATEGFMVLRGYQEPHHGLPGNRDVEDLFSLDLKTSELTKVCRVAPQDPTRRVCSYFGFPPSLSKPSL

SEQ ID NO: 174985 - protein, 115 aa, Triticum aestivum
  Clone ID: PAT_TA_69403.pep
RWHSCVLQFLHAGGAMHWAGCMRDKWHGRSTGDPVARFKDYHDGTSVAWKRSSSLAQPQRWLLPLVNFLCSSHSWPSLPKFSSEYFLVAILCSSSGGDYSLVASQFSTSSLESPS

SEQ ID NO: 174986 - protein, 96 aa, Triticum aestivum
  Clone ID: PAT_TA_69404.pep
IRIYMYMSIVVIERITNMTTEKEGNGWNNTIQKGNQCKEPPLPKNAIFYCRYIRMKNRNSVSALLSEYQDPAVEIHVAQFLLQSSSQSKTTTLPLN

SEQ ID NO: 174987 - protein, 139 aa, Triticum aestivum
  unsure (1)..(139): unsure at all Xaa locations
  Clone ID: PAT_TA_69405.pep
LRAAGSSSELAXGLLMKDFDERLSCAPESPPSPLGRAAARLFAWSFWLGFISWTLQLCGLFPEISDLLDDASNLGIWSCFALIYLRAGMALRRMNPRPSDIIAAEADHAASPTQLLAGFRAGSSKVMGISASAGSAAAS

SEQ ID NO: 174988 - protein, 49 aa, Triticum aestivum
  unsure (1)..(49): unsure at all Xaa locations
  Clone ID: PAT_TA_69406.pep
XPXEGGXLKXGGGAAGPERSGGXHGHXHATXXXXGIARXAPPPLFLSRT

SEQ ID NO: 174989 - protein, 112 aa, Triticum aestivum
  Clone ID: PAT_TA_69407.pep
VLLWMEMETNMCRCSILLVGSEEPHLAISSGTARNIFYNISASTTDIFSASSFTKPYPPCFTSYYIILMYHTYYNSTMHIVSGQQGTNMFFFHQLLCLSTSGLPRVVEKDHQ

SEQ ID NO: 174990 - protein, 73 aa, Triticum aestivum
  Clone ID: PAT_TA_69408.pep
IVVASSRCDAYAYDYGHRPVAFLPKLTKDLFPLTMSFLPWMASSCSPELGRDGGTHHQAPNHRKQRKQGVGRL

SEQ ID NO: 174991 - protein, 59 aa, Triticum aestivum
  Clone ID: PAT_TA_69409.pep
MPELPSPPTASGLHWQGDPRYGSAADSAAVFVPDICSPENPFRCFAAGADQQLKRRRRC

SEQ ID NO: 174992 - protein, 146 aa, Triticum aestivum; identical to SEQ ID NO: 134851
  Clone ID: PAT_TA_69410.pep

SEQ ID NO: 174993 - protein, 41 aa, Triticum aestivum
  Clone ID: PAT_TA_69411.pep
IHLFITSDLFVRVILPRSATVCHSVMVISISLLVEIVPVCL

SEQ ID NO: 174994 - protein, 46 aa, Triticum aestivum
  unsure (1)..(46): unsure at all Xaa locations
  Clone ID: PAT_TA_69412.pep
YNSCITQXLINPXHYHSYTNLAHACFLLHTHXGHTTTFRRVHHKVQ

SEQ ID NO: 174995 - protein, 221 aa, Triticum aestivum
  Clone ID: PAT_TA_69413.pep
SDHPAKKIRKEEHWVSSRKNFTDGRRKARTNSAPLDKNIGIGTSSSQQNANTETNHAISQKNLRTTPVNYGLRNTEARVSKGKAGSKQKNTVGGNHDHFEGRRVSSASHPQAYPGNSVGMHHPLSERPQRPPPLREVGNAWQHHMDGRSISCPNPTMVFGQPNAAPAGWRAPGYFRGPPPDQRAVVFPPFNTSQTIYRRHPDGANVMPQYRYSGGSNGFPR

SEQ ID NO: 174996 - protein, 79 aa, Triticum aestivum
  Clone ID: PAT_TA_69414.pep
YHICICVCVCSSNLFQFIVHVFTLVQVLYKYVCLCECNSSKILLCDDDICSVRRHVCFLLILLTSESLYCYIVSLISNV

SEQ ID NO: 174997 - protein, 41 aa, Triticum aestivum; identical to SEQ ID NO: 174993
  Clone ID: PAT_TA_69415.pep

SEQ ID NO: 174998 - protein, 128 aa, Triticum aestivum
  Clone ID: PAT_TA_69416.pep
CVGTPCHCSLLAKTAFAKYTIEKTTRMLEPILNEMPRPTRTTSWTDEYHDDRRSPSTHSDGQVPLQMYDYTVLRQVPRWPEPSDPSSLSTNRGQLPLSEEPQGTRAVNSYARRGSDKFASTTTSHYDP

SEQ ID NO: 174999 - protein, 56 aa, Triticum aestivum
  unsure (1)..(56): unsure at all Xaa locations
  Clone ID: PAT_TA_69417.pep
LYFGIIDILQDYDISKRLEHAYKSXQYDPTSISAVDPRQYSRRFKDFIYKAFQEDS

SEQ ID NO: 175000 - protein, 103 aa, Triticum aestivum
  Clone ID: PAT_TA_69418.pep
MSGRGKGGKGLGKGGAKRHRKVLRDNIQGITKPAICRLARRGGVKRISGLIYEETRGVLKIFLENVIRDAVTYTEHARRKTVTAMDVVYALKRQGRTLYGFGG

SEQ ID NO: 175001 - protein, 62 aa, Triticum aestivum
  unsure (1)..(62): unsure at all Xaa locations
  Clone ID: PAT_TA_69419.pep
TXVXARPXRYNXXVXAPXGXKVTVTPXTLEFRWXNEKRSXSVQFTSEAGAKARAGRHVGVRP

SEQ ID NO: 175002 - protein, 72 aa, Triticum aestivum
  Clone ID: PAT_TA_69420.pep
SSSSKFSSSSSLSSSNGCLICFMHVYITSLSSSNVAMTILLISAPMPSVFDLDFKCHGVLLEYMVKFMEKTR

SEQ ID NO: 175003 - protein, 141 aa, Triticum aestivum
  Clone ID: PAT_TA_69421.pep
CGYYHSYNVRSNLRQKYVASTVVRKKLEESSVRVRFHVRHLFGAFLVFGVNSERFHFCHVMGQPISGSAWAPELQPALKAPVRSSPFARRKGAAGLKQRGPRHMDEAGARSTRSSSPPGDRARQGKQNTFLCPTENRAATA

SEQ ID NO: 175004 - protein, 79 aa, Triticum aestivum
  unsure (1)..(79): unsure at all Xaa locations
  Clone ID: PAT_TA_69422.pep
STPXLSRTASHEGKAGPLPHSLRPLSSPISFRPAARVKQTNRCFPSRSIVVNHAFLCVNSWVNPANLVSCAPRLAPVIS

SEQ ID NO: 175005 - protein, 182 aa, Triticum aestivum
  Clone ID: PAT_TA_69423.pep
LWVVRRPVTGDEHHQLAVDELDLDALFPTGFLHRTRERGLVVMSWAPQRDVLAHGAVGGFVTHCGWNSVMEAVMAGVPMLAWPLYAEQRMNKLFLVEGMQLAVAMEGYDKQMVEAEEVAAKVRWLIESDGGRELRQRTHAAMRVAKDALDKAGESTTALVHLARQWKNADHDATAACGLIID

SEQ ID NO: 175006 - protein, 139 aa, Triticum aestivum
  unsure (1)..(139): unsure at all Xaa locations
  Clone ID: PAT_TA_69424.pep
MRSVKVLHLTSXGPNLDAAIAFLKIFPCLEKLYITSCPGNDMENVHHLXPQDPIECLDHLREVELKFYVGSRSDVNFAKFFLLNGKVLESMIFGVKDQYTEEWVANQHSQLHVDSRPSPNAQLEFTAADGGNLLTIFRS

SEQ ID NO: 175007 - protein, 140 aa, Triticum aestivum
  Clone ID: PAT_TA_69425.pep
RSRKFNMSSKEVENHNPSSGRDNSGRLGACCRQPTASPVVLLGESGHWAGCRWTHSAFPMVPSILKSPVHSPPSLFLPPLLPSLSVPHLSLPQGPGHGAGSNQTPQPLPLACRSPPLPEMPAITPTCLGLYMKKAEKQDL

SEQ ID NO: 175008 - protein, 45 aa, Triticum aestivum
  Clone ID: PAT_TA_69426.pep
TAMSWGIYYYGWMCKDPSLVPCSVTVLQEIKQCKAENSHNFISSN

SEQ ID NO: 175009 - protein, 105 aa, Triticum aestivum
  unsure (1)..(105): unsure at all Xaa locations
  Clone ID: PAT_TA_69427.pep
HSXDDVEQKKSQYITWERNMSFLYIGEPLTKQCPRLLRYHLHTSMRLQVVALKISVDKPWEPVGTTHSKHGGIHANPKEYPPHAQTPPPDNRHSSVSQQMQQQGT

SEQ ID NO: 175010 - protein, 89 aa, Triticum aestivum
  unsure (1)..(89): unsure at all Xaa locations
  Clone ID: PAT_TA_69428.pep
IVPNNDEVVXAAKRKSSLDGNNGLAKDTVMSLLHAELKTWMAGCSFQIGPILVVDEPFTIDNGLMXPTMKIRRDKVAAKYQSEIEALXK

SEQ ID NO: 175011 - protein, 115 aa, Triticum aestivum
  unsure (1)..(115): unsure at all Xaa locations
  Clone ID: PAT_TA_69429.pep
LXLXPSLXSASQAIXTXAACFHHCCRPAPVSNVFDQSRQAXCVXQQLLLPHKHKXKAAGXXGXLGXIKFQQXQPXXADLFFFLCVCVLPAASQAQDSRAKAVRATPAHDLKRTSV

SEQ ID NO: 175012 - protein, 91 aa, Triticum aestivum
  Clone ID: PAT_TA_69430.pep
SLWIMIGHRDGFVIMEVNHEGFVGTDGRENSTCYDQHVEKLITVLVDQVQADIENHRHKHWLPYVRLFLQEAYQLATKICFKKLMVQIVSR

SEQ ID NO: 175013 - protein, 109 aa, Triticum aestivum
  unsure (1)..(109): unsure at all Xaa locations
  Clone ID: PAT_TA_69431.pep
AAGTPSPNTPXSPGSGWVRASPAAACSVEDDKHPPEPAASLAASVHDAHVPMPGRIPLARVTNPPPYFFLGVKNNLFITKIHMKWDTRRVMGIPKPHMASRTLRKSKFS

SEQ ID NO: 175014 - protein, 166 aa, Triticum aestivum
  Clone ID: PAT_TA_69432.pep
VCLNVTASVTGDCIHTKNGIKSVEKSSMFSPSAEPRLLQLSFELPAGLRWLVLGGHSLILLVSFPHQRFFCDDIFPLLVILKHVIFKGSADMDSALGEQVGCFFNGTLQSLHPAWSCFVTIDFHLELCKAWKMLDTQVCKKVRHDPHWVQFKTETMECLHSTWCKC

SEQ ID NO: 175015 - protein, 114 aa, Triticum aestivum
  unsure (1)..(114): unsure at all Xaa locations
  Clone ID: PAT_TA_69433.pep
RTPALXQAWRSGCCEPHIHLGSSLLSGLDAAWASYLAQSSRKASPPRRTKNLIILVKPLHNRVFISHXEVWIHACIFWPSAPSTYICFADKKKKAKEKKTKVKQSTAYVLHYIV

SEQ ID NO: 175016 - protein, 98 aa, Triticum aestivum
  Clone ID: PAT_TA_69434.pep
SSTGSLNKQIIAIAHNPIIRRSPTLWQLFRLCPSIPHFLHLAGLRTGFGASPLSGHVVLLCPCRRHMLQNLVRLLRNLKLLIIRPESAPEPLTLRSAP

SEQ ID NO: 175017 - protein, 55 aa, Triticum aestivum
  unsure (1)..(55): unsure at all Xaa locations
  Clone ID: PAT_TA_69435.pep
VRNDQELGRLLAGVTIAHGGVIPNINPVLLPKKTAEKSPKEPKSPXKXAKSPKKA

SEQ ID NO: 175018 - protein, 74 aa, Triticum aestivum
  Clone ID: PAT_TA_69436.pep
SEIPCFYHRFCTGVSGWRPSSADYSCLAEVYYICNQHKCPSIYKLNIHHFLMERTEKRKTCTAKIASGGVGVSD

SEQ ID NO: 175019 - protein, 103 aa, Triticum aestivum
  unsure (1)..(103): unsure at all Xaa locations
  Clone ID: PAT_TA_69437.pep
LHAQGQFEXTSANYKLWLEYRNGEREKEGKEAAATVRDPLDTLFVASSPLTYSWQRFNGCTAQPSPYAVHGWAGRLGGLLTSPPPPPLFXKXXFPXXXFXKKX

SEQ ID NO: 175020 - protein, 33 aa, Triticum aestivum
  unsure (1)..(33): unsure at all Xaa locations
  Clone ID: PAT_TA_69438.pep
CLFIXVALCDPTMXYFCVPNVFRDLSLHSRRYV

SEQ ID NO: 175021 - protein, 44 aa, Triticum aestivum
  unsure (1)..(44): unsure at all Xaa locations
  Clone ID: PAT_TA_69439.pep
SFCEXYXCTSSVSELLIIEVDVSKCILVLDISIFATSNLKWRES

SEQ ID NO: 175022 - protein, 68 aa, Triticum aestivum; identical to SEQ ID NO: 127569
  Clone ID: PAT_TA_69440.pep

SEQ ID NO: 175023 - protein, 38 aa, Triticum aestivum
  unsure (1)..(38): unsure at all Xaa locations
  Clone ID: PAT_TA_69441.pep
KPWTKKTGYHIPXTRXLLXSVRTEDANWSNGARWREID

SEQ ID NO: 175024 - protein, 79 aa, Triticum aestivum
  Clone ID: PAT_TA_69442.pep
SDHETFANDCPMPISPSPSYFPSFLLLLVPSPNPRSWPCICVLLSRTLQIYALLKHLPVAWLHQILNLHGSTKSNSELS

SEQ ID NO: 175025 - protein, 54 aa, Triticum aestivum
  unsure (1)..(54): unsure at all Xaa locations
  Clone ID: PAT_TA_69443.pep
SLCRCEXRFRIPSPLFFATDRQTCFSRIFTLFGLQRQDARHYFFTMCTIXXXIR

SEQ ID NO: 175026 - protein, 116 aa, Triticum aestivum
  Clone ID: PAT_TA_69444.pep
THLHVAGMHNHQIQIDLNSSTIGLSPIRDRDQVAIHSSLLTTGRSACSPIIWGILLVQRYEARLKNRHSIGRGSLMHRRDQMRFLDPLQNTESIHHIQEAVDMVDSVIIPHLVSGS

SEQ ID NO: 175027 - protein, 167 aa, Triticum aestivum
  Clone ID: PAT_TA_69445.pep
GSGLLLRPCCSKLADLRSGEHGVGPGRRATMLSNPPFAVGRSFGSQSFSCDGASSDHGVLGVRLPLPRRCFGGGDGRCRASTTSCAGTPKGLIVILFLFLGCFLLMFWTPVCSGSFVWVLLHVLYSCLLYEWHVVLQKKNVFLQPSAACCRKQHSAVHHFSSFAACN

SEQ ID NO: 175028 - protein, 77 aa, Triticum aestivum
  Clone ID: PAT_TA_69446.pep
LQERSEDLIINSSPGRRVLHARLCSGKLVALGCSRISWIFLNQDVYGVWLSTSKLGGYQVGNSAVVITPNLKHRPAS

SEQ ID NO: 175029 - protein, 97 aa, Triticum aestivum
  Clone ID: PAT_TA_69447.pep
TVNSGQVSLVSQQGRVPPPHDILFEHHIQQQIQHHGRTRTIIKISSLATSSLATRYITSQRCSILWAQMTTVMCRRLLFGKLLEPVPLQHAQDPLLA

SEQ ID NO: 175030 - protein, 38 aa, Triticum aestivum
  unsure (1)..(38): unsure at all Xaa locations
  Clone ID: PAT_TA_69448.pep
TCRPXRXTLVXARCXRSTKRQXCLSSXVHALXRLVVFI

SEQ ID NO: 175031 - protein, 87 aa, Triticum aestivum
  unsure (1)..(87): unsure at all Xaa locations
  Clone ID: PAT_TA_69449.pep
QVNNIXSKSLTGASSFLRISSGRIPFGAPTAXPPDATATPPTTTTTAVAPPIMTXVAFQIIIIEEKIXKQATNIASALHVQILAFST

SEQ ID NO: 175032 - protein, 52 aa, Triticum aestivum
  unsure (1)..(52): unsure at all Xaa locations
  Clone ID: PAT_TA_69450.pep
XNAXHXXXXIXXXXXVLALXKGAGPXVXRAMSXNMGMLAXYDQSVELFXDKL

SEQ ID NO: 175033 - protein, 72 aa, Triticum aestivum
  Clone ID: PAT_TA_69451.pep
IIIRAWRSIQHQLPKLGDEILDKDIQQLMYCIGKLDFCIPERTGGWLLAQATRSNMRNGAHTAAFSFSSSMG

SEQ ID NO: 175034 - protein, 50 aa, Triticum aestivum
  unsure (1)..(50): unsure at all Xaa locations
  Clone ID: PAT_TA_69452.pep
SFQQLSNIYIYSPKRXXHTSRLPQHLFAHSIYKMXXXKYSLLXMISXFKN

SEQ ID NO: 175035 - protein, 77 aa, Triticum aestivum
  Clone ID: PAT_TA_69453.pep
VFAFGIIVLQIITGKRAVSQVKIGTATSDLEGLIDPNLGGIFSRTEAAKLAEVATHCTHEAASQRLTMDAVVLQLIG

SEQ ID NO: 175036 - protein, 194 aa, Triticum aestivum
  unsure (1)..(194): unsure at all Xaa locations
  Clone ID: PAT_TA_69454.pep
PXNLQLIGPRTPIGYISMCRALGPCLWTKRSPLRLVLFYIFHFRFYFLCLLLSFSPTFPFCFSFRNIYSNSGTLFKIMNNFFFFYKRSLCFYLQEMTGESPGSCFVFDLQEMTGESPANCAKNTHRLHFYESSSRSTFMDQTFAPWISIILYFPFFIFILFFMFVFFPFLLLXXVVFHFXTFXQIREHDLETXT

SEQ ID NO: 175037 - protein, 100 aa, Triticum aestivum
  Clone ID: PAT_TA_69455.pep
MPVGEEGYLDLSRQVVSVKSRGRLEILMKAGEISGSVVFPTKFSNISRESCELGSCEVEITVAWSLLIENQYDISVMGAIQPYAWESIPRRPTMKLVGAC

SEQ ID NO: 175038 - protein, 80 aa, Triticum aestivum
  unsure (1)..(80): unsure at all Xaa locations
  Clone ID: PAT_TA_69456.pep
LIIXEISAXXGTENEVAFVERLLNWATVLKXMXIXFHQSVXESXXEDLCQTLXSFSRLXTCMKFYVHRGLXXKVPYFPEG

SEQ ID NO: 175039 - protein, 100 aa, Triticum aestivum
  Clone ID: PAT_TA_69457.pep
FPAAMDETEITSGSKEHSNTANSDQHICKEPSDNPELSDEPKTESSILKGVDGSTTEASGTTPAAEASSATPNPLDDVQSAVKEDELKVDSKESRLTTTT

SEQ ID NO: 175040 - protein, 117 aa, Triticum aestivum
  Clone ID: PAT_TA_69458.pep
AKTKESRKVFTLHLSREALLEKSSSKLSWKTAGGVRDPSEEELALSPHRSFTQVEIHGLNRHLEPAKLRGFLKDIYFPYIQYDEDNGSASTRRPVQFEVCPEFPITTVGLNNKTIVI

SEQ ID NO: 175041 - protein, 32 aa, Triticum aestivum
  unsure (1)..(32): unsure at all Xaa locations
  Clone ID: PAT_TA_69459.pep
LIHDRINYCSFYYLRRXDLGHFAICWELGFIY

SEQ ID NO: 175042 - protein, 87 aa, Triticum aestivum
  unsure (1)..(87): unsure at all Xaa locations
  Clone ID: PAT_TA_69460.pep
IRXEPVHRWRRAGGASKSAAGAAMAXCVRVAGCAGDFFCIVFRMMXQXRXKRGPDLTXLXXLIXRVCVDRLNFVPVPAPIXRLSFRX

SEQ ID NO: 175043 - protein, 54 aa, Triticum aestivum
  Clone ID: PAT_TA_69461.pep
GACYMCHSREPEELILSCHVCRSQWVHSYCLDPPLTPWTCIHCRDLRRMYQRYR

SEQ ID NO: 175044 - protein, 38 aa, Triticum aestivum
  unsure (1)..(38): unsure at all Xaa locations
  Clone ID: PAT_TA_69462.pep
AGFAIGLAMVFXGXNANSSCXWCHYXSCVPTASWSCAN

SEQ ID NO: 175045 - protein, 70 aa, Triticum aestivum
  unsure (1)..(70): unsure at all Xaa locations
  Clone ID: PAT_TA_69463.pep
IHHFCHFDDKYFRTEGVPQCIVWLIIFLALEPLIVSCVIGTKASLWLISAVNLVSXEVPRLTKIXYRXKQ

SEQ ID NO: 175046 - protein, 90 aa, Triticum aestivum
  Clone ID: PAT_TA_69464.pep
MAAPVKASWMVAMSVGAVEALKDQARLCRWNYALTSIHRAAKARTNVRGSVSQGPKQLPASAAAVAERRRAEKAEEGLRTVMSLSCWGPN

SEQ ID NO: 175047 - protein, 50 aa, Triticum aestivum
  Clone ID: PAT_TA_69465.pep
QRCSLGYDCYMFETLLPLIIGQHMMSGEAAATWTYRCSYIVMVIHSCSPW

SEQ ID NO: 175048 - protein, 130 aa, Triticum aestivum
  unsure (1)..(130): unsure at all Xaa locations
  Clone ID: PAT_TA_69466.pep
KEFTHAIEAEQVAAHQAEHAKFIVEKAEQDKKSAIVLYALSNNKGEAKSAELISQAIANDPAFVPLXQIEAAREIAYTITSYNNKVFLDSSDLLPGLRSLTSWPNTKNETIPCHSCYGCCVESRRCRVHS

SEQ ID NO: 175049 - protein, 55 aa, Triticum aestivum
  unsure (1)..(55): unsure at all Xaa locations
  Clone ID: PAT_TA_69467.pep
RRXGQPLAIAFRXXILVRSVLXLLLPCSSIAYGLLXGXPWXGXFXRAASXGGLWI

SEQ ID NO: 175050 - protein, 131 aa, Triticum aestivum
  unsure (1)..(131): unsure at all Xaa locations
  Clone ID: PAT_TA_69468.pep
YICALLGDQGLATIARAPTLSCKMLPKIPEAQLNYPSITVPLRTRPFTVNRTVTNVGPINSVYTLKMEVPKSLTVRVYPETLVFSKVGQKKTFSIXVSRHRNVGSKALQGSLSWVSKKHVVRSPIVASPLL

SEQ ID NO: 175051 - protein, 196 aa, Triticum aestivum
  Clone ID: PAT_TA_69469.pep
YLDSLLAIAQNTECDPLKRKVVITYTSTKTPHEIIGQDPPVRCVPPPTGWVKLNTDELWTEEGGAGAGMVLRDCLGKIIFSSCKVLFSRRDALEAELCACMEGISLAIQGSELSICVKMDSVVAVNMVKDRDTDRSIFASLVNEIKHLMSLRTTSVFHINRNQNVVSDYLAKFARIEGRTIVWLGSGPPHAGICVN

SEQ ID NO: 175052 - protein, 96 aa, Triticum aestivum
  Clone ID: PAT_TA_69470.pep
EQLSGQSKHHLPCKRCTAVASATECARCKRRGSGCRCITYYGVRRTVFCDARKRDVVYIEQYYDGADEQLLKQAMMKVSIGLVGTVEGCQSNKSSL

SEQ ID NO: 175053 - protein, 139 aa, Triticum aestivum
  Clone ID: PAT_TA_69471.pep
YIVEAHTQLEMSMKIARIVHISYSSVHTAPFSCRVSFHHRSLDYSPFGWLCLWHKRYPKPLAESVSTIDHLITAHLDGCAYGIKDTQNLRMKRIRDLLQNCCSFQEAPSVLIFKISGGGLDHLSFCCCFCLPHHHLLNT

SEQ ID NO: 175054 - protein, 33 aa, Triticum aestivum
  Clone ID: PAT_TA_69472.pep
LHNKELCIPNYDKLVPSQSYNFQFSNRGLKHSF

SEQ ID NO: 175055 - protein, 69 aa, Triticum aestivum
  unsure (1)..(69): unsure at all Xaa locations
  Clone ID: PAT_TA_69473.pep
RRTQHMPNXXLRIFTSXLLNCSHQTMPSALLPGSALQVHCKIEVPNILTKPNGCQITEEIEALQQNLSI

SEQ ID NO: 175056 - protein, 131 aa, Triticum aestivum
  unsure (1)..(131): unsure at all Xaa locations
  Clone ID: PAT_TA_69474.pep
IQMNDKWNTFPLKKHDKFGHPFGCLKPNSXKSYEELLLCIAEGEDTEPEVVPSTTPPNNGVLLIANVKNLVTGCYLSAWECCGYFVYQTKVDFDRASETGISNRMASFSFQDGEFEDLKKLCCAIADDLVT

SEQ ID NO: 175057 - protein, 95 aa, Triticum aestivum
  Clone ID: PAT_TA_69475.pep
MDVDTFAGLDAPEKRKKQGRPTSSREKAPYEQLSKRTRFCRICRGSGHKKTTCPERGDHPKNPRKQAKCSNCGVEGHKHNTCTNAFAVKLHAGGV

SEQ ID NO: 175058 - protein, 64 aa, Triticum aestivum
  unsure (1)..(64): unsure at all Xaa locations
  Clone ID: PAT_TA_69476.pep
VXYHXFHPKSSYPSKRNXSVVSSVLLQLPFCVFTSILQKAXXHQHLLCHQQHARLQLSPPPSQQ

SEQ ID NO: 175059 - protein, 119 aa, Triticum aestivum
  unsure (1)..(119): unsure at all Xaa locations
  Clone ID: PAT_TA_69477.pep
QLLYIASLDSQGYGSDRSLTISVYVLSVEIYNWDVCHQDDKRMYWKLYKFSDVIPXKKFPKLIGVHPHANLXFIAHSXNXXLAYDLDRHESPVVYHLDHKYQIFMQFCPYVPLLSCXPL

SEQ ID NO: 175060 - protein, 54 aa, Triticum aestivum
  Clone ID: PAT_TA_69478.pep
NDEIATKTRLLSLELLEGFLDVRPCSCASMCVSLIRSRSCLPMQQGPNYVPLYA

SEQ ID NO: 175061 - protein, 145 aa, Triticum aestivum; identical to SEQ ID NO: 131257
  Clone ID: PAT_TA_69479.pep

SEQ ID NO: 175062 - protein, 41 aa, Triticum aestivum
  Clone ID: PAT_TA_69480.pep
HRRLNTQQCLACRTTSDSPKELRSWKNIANLRFINETDHQR

SEQ ID NO: 175063 - protein, 85 aa, Triticum aestivum
  unsure (1)..(85): unsure at all Xaa locations
  Clone ID: PAT_TA_69481.pep
KLREXHGEILFITYESLLLLLGSYYKYSINLESPITQLHYSSTLLLSYSTSYISLSSLSQATPMHHHRSLPSSFMSLQVTLFLLL

SEQ ID NO: 175064 - protein, 86 aa, Triticum aestivum
  Clone ID: PAT_TA_69482.pep
TNPHPFRLGVAKPSLTIVRWECYHQPKVINVLVFVIILRTRSPSCTHHSPTNVEALNMRGFLCVLVAGLRHSQPFPFLVCSNTRTA

SEQ ID NO: 175065 - protein, 47 aa, Triticum aestivum
  unsure (1)..(47): unsure at all Xaa locations
  Clone ID: PAT_TA_69483.pep
WCDTEMNHRTPLKRFICNHSGADNRLRHVERGGGGGGXXKXXXXGPX

SEQ ID NO: 175066 - protein, 61 aa, Triticum aestivum
  Clone ID: PAT_TA_69484.pep
LTRIWISFLCHDLRYSLLPPGGDSQPPLTLSYVSPYFHHISLCRAKEGRNNNTTKRNKIRI

SEQ ID NO: 175067 - protein, 144 aa, Triticum aestivum
  Clone ID: PAT_TA_69485.pep
AFVFGSPRVGNSDFQKAFDSAEDLRLLRVRNSPDVVPNWPKLGYSDAGTELMIDTGESPYIKSPGNPLTWHDMECYMHGVAGTQGSNGGFELEVDRDIALVNKHEDALKEEYSIPPSWWVVQNKGMVKGKDGRWHLADHEDDDD

SEQ ID NO: 175068 - protein, 183 aa, Triticum aestivum
  Clone ID: PAT_TA_69486.pep
ARDVRDLILPGMTHWQSPRHFAHFPASSSTVGALGEALIAGINVVPFTWAASPAATELEMVVVDWLGKALHLPESLLFAGGGGGTLLGTSCEAILCALVAARDKKLAEIGERRIGDLVVYCSDQTHFAFRKAARIAGILRDHCRAIHTCREDMFALSPTELQAAMQADVDAGLVPLFLCATVG

SEQ ID NO: 175069 - protein, 164 aa, Triticum aestivum
  unsure (1)..(164): unsure at all Xaa locations
  Clone ID: PAT_TA_69487.pep
RKCGRLPLAIRXIASALAGRDVTENEWKKFLEKYASSQSMFSDETEGVLYLSYDELPHRLKQCFLYCALYIEGTIILRREITMLWIAEGFVEEKQGQLLEDTAEEYYYELIHRNLLHPDSVIFDQAECRMHDLLRQLACYISREECFIGDVETLSGQNMSKLRR

SEQ ID NO: 175070 - protein, 174 aa, Triticum aestivum
  Clone ID: PAT_TA_69488.pep
MGHTRAAVLAVVLAVAVLGLATDGQAQLQNGFYTGKCRGNDVEAVVQGIVQARFASNSDIVPHLLRLLFHECGVNGCDGGLLINGTGTEKTANPNLSVKGYELITAIKTELEKRCPGVVSCSDIEVLATRDAVAASTGRRYAVRTGRRDSRRSVATDVNLPGPDDTVPKAAAFF

SEQ ID NO: 175071 - protein, 154 aa, Triticum aestivum
  Clone ID: PAT_TA_69489.pep
MNTEDDKQTVLSTLPKDLPLDFLKTITDQFSDNRVIGKGAFGTVYTVCSCLNILYHLEKLRIFLNRSVCEVEQGTMPDGQTIAVKKLAENAPIARDKIFNNEVQNIMAYRHENIVKLVGFCHEGQKKVVLNNGRYIVADVYEGLLCYEYLPKGS

SEQ ID NO: 175072 - protein, 84 aa, Triticum aestivum
  Clone ID: PAT_TA_69490.pep
MKVGALLTSAGINIGLCILFLSFYSVLRKQPQNVKVYFGRRIAEQHKRLRGAFILERFVPSPSWIVRSLQCTEDEILSTAGLDA

SEQ ID NO: 175073 - protein, 119 aa, Triticum aestivum
  Clone ID: PAT_TA_69491.pep
YGSVVQIVLQGTNIFAGENHPIHTHGYDFFILAEGFGNFDAATDTAKFNLDDPPMRNTVGVPVNGWAVIRFVADNPGVWLMHCHLDVHITWGLAMAFLVEDGVGELRSLGAPPPDLPIC

SEQ ID NO: 175074 - protein, 159 aa, Triticum aestivum
  unsure (1)..(159): unsure at all Xaa locations
  Clone ID: PAT_TA_69492.pep
KSLRQLARHPTSLCSLIFRALADLMGLSPSVLGKFRGDPPPMENMVGKSPEPEPELPPDMLSSIFALLEVPDLVRAGSVCSSWRSVYTGLRRQLRQHKQRQTPCLLYSLAGENAACLYSLAEKRAYKLTLPDPPIRSRYLIGSSHGWLITXDERSELQI

SEQ ID NO: 175075 - protein, 58 aa, Triticum aestivum
  Clone ID: PAT_TA_69493.pep
SGIFTATTISPSSWLRQCPDRYTIRAGRNLPDKEFRYLRTVIVTAAVYWGFNSVRRLR

SEQ ID NO: 175076 - protein, 224 aa, Triticum aestivum
  Clone ID: PAT_TA_69494.pep
SARGDNNELGCKRNDALQELEMLTVNAKEAQQLILTKILESNQASEYLSKFMNRSTNTSTFKRNVPVVTYDVVQPYIARISTGEDSSIISGDRIVELLRSSGTSRGEPRLMPAISEDLDRRTYLYSLLMPIMNKYVSGLGEGKAMYLLFVKAETLTNSGIPVRSVLTSYYKSPHFLHRKHDLYNNYTSPDEVILCPDSQQSMYCQLLCGLVERQHVLRLGAVFA

SEQ ID NO: 175077 - protein, 206 aa, Triticum aestivum
  Clone ID: PAT_TA_69495.pep
PQAQKAVGIWLFGCAAWVFSMVILGGVTRLTRSGLSMTDWKFAGGLPPMSEEEWLLEFQKYKQSPEYTRVNKGMNLEDFKFIYWMEYAHRMWGRALGFVFAVPFAYFVAKGYVTRQLGVRLSALFALGGAQGLIGWWMVKSGLEEPASEYVEPRVSPYRLAAHLTSAFVIYCGILWTALSVVMPDPPAESMKWVKGAAKFRKLAIP

SEQ ID NO: 175078 - protein, 168 aa, Triticum aestivum
  unsure (1)..(168): unsure at all Xaa locations
  Clone ID: PAT_TA_69496.pep
AVAAGGEXRVELDESARGRVKESSDWVMNSMANGTKEGGALQRELIRFLNAGAFGTGGHDHVLPAAATRAAMLVRVNTLLQGYSGIRFEILETVAALLNANVTPCLPLRGTITASGDLVPLSYIAGLVTGRANSVATAPDGSKVNAAEAFKIAGIQHGFFELQPKEGL

SEQ ID NO: 175079 - protein, 60 aa, Triticum aestivum
  Clone ID: PAT_TA_69497.pep
WPCVSSYYCRSSSWPPPARAPPPRSPPTPPPMAARWIFWMRGASPSSASPTSTPSTAAKT

SEQ ID NO: 175080 - protein, 273 aa, Triticum aestivum
  unsure (1)..(273): unsure at all Xaa locations
  Clone ID: PAT_TA_69498.pep
SARGSRAXTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLXEDGRTLADYNIQKESTLHLVLRLXRGGMQIXXVRPSXGKTITLXVERXPHHKTTXRAXSQDKGGVXPPDQXPS

SEQ ID NO: 175081 - protein, 270 aa, Triticum aestivum
  unsure (1)..(270): unsure at all Xaa locations
  Clone ID: PAT_TA_69499.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVXRLRGGMQIFVKTLTGKTITLEGESSDTIDNVKAKIQDKEXFPPDQQRLIFAGKQLEDGXRTLXDYNIQXESXLSPWSWAXXXGMQIXCGXPSPXKXSLXRVGSSDTIXXXLRAKFQDXXGXSP

SEQ ID NO: 175082 - protein, 145 aa, Triticum aestivum
  Clone ID: PAT_TA_69500.pep
RISPKTKRNSYTNNFGESPSFEYYNNICYDASQLMDQETYQKRLSKSMTTLQRREATGSSTFNNHNNSNHDKTSSPSSSPSMPMHHHLDRKHLSKSSDYQMKRKTIRQFQISLNEDEESLRRVVTTERKSLFAALFRKKKTDYGG

SEQ ID NO: 175083 - protein, 99 aa, Triticum aestivum
  unsure (1)..(99): unsure at all Xaa locations
  Clone ID: PAT_TA_69501.pep
EFGTRERERERERERERERERERERERERERERERXXLSLLSLSLSSLSLSARRPPPPPPHPLCRLSLILSALSLTAPCSPPLVSLSLSLAPHSSLSLS

SEQ ID NO: 175084 - protein, 130 aa, Triticum aestivum
  Clone ID: PAT_TA_69502.pep
PNTIPCRSTLAVLPVVLLWLGAVLATRFPLFVAASPQPSSKCQRKCGSVDIPYPFGIVHSPDDDDGPCAMNGFGLTCNETGINGGRHRPFYDDVEVVGISLQQGQARMLNDISYYCYNATTREMVRDEWW

SEQ ID NO: 175085 - protein, 154 aa, Triticum aestivum
  unsure (1)..(154): unsure at all Xaa locations
  Clone ID: PAT_TA_69503.pep
QRASPRXQQRLIFAGKQLEDGRTLADYNIQKESTLHLVLRLRGGMQIFVKTLTGKTITLEVESSDTIDNVKAKIQDKEGIPPDQXRXIFAGKQLEDGXTLXXYNIQKESTLHLVLRLXGGMXIXXKTLTXQXHXXWKVXSSXTIXNVKWHTPRR

SEQ ID NO: 175086 - protein, 183 aa, Triticum aestivum
  Clone ID: PAT_TA_69504.pep
LVEIEGPGEQRHPLANWRSELYLNFGRGRSNPTLPVCMRIITGSPLLLHLNSGPPSKARAARPLDGRCARARPRRAPPAHRRRMCQRRAVQPREVELGVRRRGRPGGGHRGAVPQLEGRVSPELLDELRGAAVDVGGARAVCRRVDGRRRLRWRACRRVEARRPAVVVVSAVQQAGRETAAGC

SEQ ID NO: 175087 - protein, 210 aa, Triticum aestivum
  Clone ID: PAT_TA_69505.pep
GCRFGEGTVRPATPDGPSKRPYTEEVLVPLPSATLSRSDEQESPDVFRCLSCFSFFIPAGCSFNIFRIFGRRDVDGQPDVLPPPASEDTPPRSENCTSWLLSCFQPGDSPNQPAPAADPLTVPQSTVESSSENQAAEDPATMPLQSETRNSNDTTTTTESSTSYIHHSHGTVVKPEHSITSSSEDQTTTTTTWTTKATSTSSSTATSKAA

SEQ ID NO: 175088 - protein, 152 aa, Triticum aestivum
  Clone ID: PAT_TA_69506.pep
MAKLAAVLTLIALIGCAVRTCQAEYGNPTPVPSIPSITSPPPPYTPSTHSPPPPTPATPSPPPPYTPTTPSPPPPTPATPSPPPPYTPSTPSAPPPTPATPSPPPPYTPSTPSPPPATQSPPTEGLAVGYYKKCPAEDIREVVRDANAIMAG

SEQ ID NO: 175089 - protein, 171 aa, Triticum aestivum
  Clone ID: PAT_TA_69507.pep
MGHLVPMIELAKLFAARGLAITVVLMDPPYDTGATGPFLAGVSAANPSISFHRLQQVKLLESDDSVMPALAFARLSNPHLRDFLAGASPDFLVVDFFCSAAMDVAAELDIPAYFFSTSGAQILAFFMHLTVLHGKSTRSFREMGEELVHVPGITPFPATHSIQPLMDRDGA

SEQ ID NO: 175090 - protein, 180 aa, Triticum aestivum
  Clone ID: PAT_TA_69508.pep
MPRGSSQRCTASGPPASMVSASASEDELALLTGPQLVIHLTKTHRRADFDAVSRILAARDRERASLEANLAAAEAELEAARARLVGVDEVHSNLKAALRELKAQEEKKKALAGAYHRPRDETDEMAFVPGDAAPEAVHRDEGRVKEAKEGEGNDDDDIIDLCSDGEEGDRTAVAGEMEME

SEQ ID NO: 175091 - protein, 206 aa, Triticum aestivum
  unsure (1)..(206): unsure at all Xaa locations
  Clone ID: PAT_TA_69509.pep
MANSTSVKATSAQNSRSSTPTSRPRSVSSSSSSTAPSVSHPSSSSGRIPAIVRTSSSSSTASVTRSSSRSSTPTRQPVMRPSAPSXLANLRTKLPERPLSAGRARPGIGLGARSTPNAEPVTSAPVKKISVPAITRNKFSDAPSKTPSLTNGHQNRQTERSVMDSQPARPSRSATSEENGFGRTISRKSLDMAIRHMDIRHNLGGI

SEQ ID NO: 175092 - protein, 153 aa, Triticum aestivum; identical to SEQ ID NO: 168119
  Clone ID: PAT_TA_69510.pep

SEQ ID NO: 175093 - protein, 199 aa, Triticum aestivum
  Clone ID: PAT_TA_69511.pep
VLQVQNSGSTLADVTLLFTWANSVGGRSELTGNHTNSKMIERDGVHGVLLRHRAADGHPPVTFAIACQETEDVRVTDCPFFTMGSSDSGDFTAKDMWEEIKQHGSFSEARTGKEPRASKSGSSIGAAVAAATTVPAGGTRVVSFALSWSCPEVKFPDGKTYHRRYTKFCGLDRDAAAESLAHDALLEHMDWESKIEEWQ

SEQ ID NO: 175094 - protein, 112 aa, Triticum aestivum
  Clone ID: PAT_TA_69512.pep
FHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 175095 - protein, 78 aa, Triticum aestivum
  Clone ID: PAT_TA_69513.pep
SSLPCSSWLQGLPLGSLFFSMVLQQLHKEVSYLDRCPITQAGDDGRICTRGHVSGQPPSVLRAMLLHESPPGQVIVTL

SEQ ID NO: 175096 - protein, 150 aa, Triticum aestivum
  Clone ID: PAT_TA_69514.pep
TTEASVATYCTNNEDQVCNVKGLEAAAAFHLFREEVRRTKSTSHLIKHNSDELDELIFKCGGLPKVIVALAELLATQTVKLMDNIHSLNHRFMHHLETNPEYDSLRGLFSWMQSYFRNCPDLLKPCIFYLSIFPRDYNIRRRRLVRRWIA

SEQ ID NO: 175097 - protein, 186 aa, Triticum aestivum
  Clone ID: PAT_TA_69515.pep
YVEVNAGNLRSITNSVPEEQNPEWNSTFAFSRRQLDNAQITRIYVVVYDGFTDDSVGLISFDLSDIPERSRNDKPVVPKWHQLIDQSGRTAQGELMLSVWKGMQSDEAFCDSWKSDWLEASGVVRPHIVPKVYNLPRLWCLRVHIVEFKCIALACGSKIVESYVTVVVGCQRKTTKRMKKPLAHYV

SEQ ID NO: 175098 - protein, 197 aa, Triticum aestivum
  unsure (1)..(197): unsure at all Xaa locations
  Clone ID: PAT_TA_69516.pep
DEAHRRHRRNAHLLLRSAAHPELQPHPPHLLCCEAAHPPKPPPHPPTFSGPARRRPARHLPRLDPWCHPGXPGPPSPIFLTPPPPPGPDQSHXKPPDMHPDPSPFYQIWLDPRSCRRRLGSPELPHPIHLPRRSAPPHDALDGGAPTPASPLQPPPDQGGTSSTHHWWCPTTAALAVQSGGERACSAVRRRAVSNVV

SEQ ID NO: 175099 - protein, 126 aa, Triticum aestivum
  unsure (1)..(126): unsure at all Xaa locations
  Clone ID: PAT_TA_69517.pep
MVKSPRSPVTTGTKRCRAKPQKKGEEFTAQGKLVDGPKNATNGVEKGAGSATHKRPRRAAACSDFKEKSVRLSEKTSVVKIKKNRMEEEEIDAINLTKLGPEDSPPCRXKLIDFILHDADGNLQPF

SEQ ID NO: 175100 - protein, 183 aa, Triticum aestivum
  Clone ID: PAT_TA_69518.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLAEIVGTFVLVYTVFSATDAKRSARDSHVPILAPLPIGFAVFLVHLATIPITGTGINPARSLGAAIIYNKKQAWDDH

SEQ ID NO: 175101 - protein, 98 aa, Triticum aestivum
  Clone ID: PAT_TA_69519.pep
MVSPTTPFSEGRELATTLSPFQHAQRARHFLTRPSRVAEGAAFDPMRDGFPHLRVARPPAEGRGRNQLLPRYWPRITDQELQQISGDSNSTIVPLFEK

SEQ ID NO: 175102 - protein, 152 aa, Triticum aestivum; identical to SEQ ID NO: 126264
  Clone ID: PAT_TA_69520.pep

SEQ ID NO: 175103 - protein, 93 aa, Triticum aestivum
  unsure (1)..(93): unsure at all Xaa locations
  Clone ID: PAT_TA_69521.pep
GPXRPSRIRSSIPRQKRTATPRLLPTSSSARRASPPALRLRFGSSCSSPAGLRQRRLPRSSSQPQLPSHFHRVPRNRGLPPATCLRSCGHWPS

SEQ ID NO: 175104 - protein, 210 aa, Triticum aestivum
  Clone ID: PAT_TA_69522.pep
TPDAAAAVLRRCRHLPVPSLRFFLFAAGLPGFSHLPDSLLILANSLAGARLFPLLRSLLSDLPPAALSRDLFPRLFRAYSRALLPDDAIRAFSSMAGFGFHPTLADFHSLLFALCHNGLVNHAEVFFKESGTHFDVSAKTYTILISGWAVVEKPENAQKLFDEMVERGVEPDVPAYNALIDALCRGGDIARAQEHLKDMQQSRGLVPDAA

SEQ ID NO: 175105 - protein, 211 aa, Triticum aestivum
  Clone ID: PAT_TA_69523.pep
AALAATALASRRSDPTIGGRKATTSSDVAPTALASQIIAGGDRFVPPVRPGWGDWRGCFRRDDAPTVECCAAAPPGDELGGWQLVSKGRRSASPPAFHRPTFNARLPPPTWLKDRCFRCLCRGHRAHSCRDPIRCRNCLRFGHIARFCRAKQLVDEAMPQPCVAPPPASVIQADVPLQPVLEQQAELLCVELRECLVRVESVLARAEVALG

SEQ ID NO: 175106 - protein, 214 aa, Triticum aestivum
  Clone ID: PAT_TA_69524.pep
VTFWVDHIDEVYHQSVEGSASFAGLHIVPHPCEVQSNGVVADELKLEKTLEKSESSPSNLSDRIDLAWTGSGVETLLVAPTALMNGSSYQNVMAPIRIKSFDSGINFRNGLSPVDDSNVSIRRAYSQRPPRALERTGRGLSPTFTNKLSLPGMVDGEGRFLLSQSVSDVVIPVYDDEPSSMIAHAMTVPEYRSFMLPVLNLHNELDRPSVLNSL

SEQ ID NO: 175107 - protein, 189 aa, Triticum aestivum
  Clone ID: PAT_TA_69525.pep
MGRKFFVGGNWKCNGTVEQVESIVNTLNAGQIASTDVVEVVVSPPYVFLPTVKGKLRPEIQVAAQNCWVKKGGAFTGEVSAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 175108 - protein, 88 aa, Triticum aestivum
  unsure (1)..(88): unsure at all Xaa locations
  Clone ID: PAT_TA_69526.pep
NXXDKLXLRIMDHXNXXSDXXXXQXXINXTDLIXMXMESXXXXXNPXKXRXXTXXNXXHXXIXXXITXTXXXXDSHXQEEATSDHMPN

SEQ ID NO: 175109 - protein, 136 aa, Triticum aestivum
  unsure (1)..(136): unsure at all Xaa locations
  Clone ID: PAT_TA_69527.pep
LLPPGPPAHIAQPLPTSTTPSSPAPVGGTPSPHPTPTPXLKLPPDTSLFLLPSSSQILRTSSRRPVHPRPSPSPPTSSFPCPPSTNAATSYLPRAPHCSPPRGRPATSNSSRPAGSGEIRRIRPRSGAARRHSHSR

SEQ ID NO: 175110 - protein, 170 aa, Triticum aestivum
  Clone ID: PAT_TA_69528.pep
LTSCRGAGIYEVEVEYNQTYLLRIINAAVNVELFFKVSGHNFTVVAIDASYTEPYATDVIVIAPGQTVDALMTTSATPGGRYYMAANVFESKTVQIRFNNGTVTGIITYKGAANGTAPSMPAMPAPTDVVTAGNFYWSLRGLVRPIDPPLPTTVDHQMLVEFGVDQAPCA

SEQ ID NO: 175111 - protein, 48 aa, Triticum aestivum
  Clone ID: PAT_TA_69529.pep
LILLIYFLFVLFFYRKMGLGAPLGCDPGGLAGAAKRAPTGPQARGASA

SEQ ID NO: 175112 - protein, 128 aa, Triticum aestivum
  unsure (1)..(128): unsure at all Xaa locations
  Clone ID: PAT_TA_69530.pep
RSPLSPTASAASWTPAPPRPTAPLPSTLLPVLPLXPAPSPPSHSTDSPRPAPAAPQPPSLTPPSSCSPAGSPGPAQTQTQRPARNSNRGRTGLRRRPWFGWNSGATPRKAGFSSSKWSFVGTVEQQKQ

SEQ ID NO: 175113 - protein, 108 aa, Triticum aestivum
  Clone ID: PAT_TA_69531.pep
RSRVRKNMEEFNGSVIKRSSTFPELRTVSWMIFLCPTPIIRFHLLPSRLKNSNRCESNDANTTWTPPPEGSAMLIVDATIFSQSRRMGAGYILRDHGGRSMSAALIDL

SEQ ID NO: 175114 - protein, 90 aa, Triticum aestivum
  unsure (1)..(90): unsure at all Xaa locations
  Clone ID: PAT_TA_69532.pep
IGAANVVLMGNNLTLSFDDVEANFSPAVKGSGVNGLVYTAEPLNACSALTSKAVEGPPSPFALVIRGGCTFDEKVKNVQDAGFKAAIXYD

SEQ ID NO: 175115 - protein, 186 aa, Triticum aestivum
  Clone ID: PAT_TA_69533.pep
MGDGRGGGSNRPAWLQQYELVGKIGEGTYGLVFLARLKPTHPQAAGRRGSPIAIKKFKQSKEGDGVSPTAIREIMLLREINHENVVKLVNVHINHADMSLYLAFDYAEHDLYEVIRHHREKLNLSINQYTVKSLLWQLLNGLNYLHSNWIIHRDLKPSNILVMGEGEEHGIIKIADFGLARIYQAP

SEQ ID NO: 175116 - protein, 103 aa, Triticum aestivum
  Clone ID: PAT_TA_69534.pep
KVARSPSHVLEGVELCDGILKNLFLCLQINDIEPFCQDEIVLYKQCAEKRDKEIRERLQDSEYKLGFSMPLEDAKERVTQLQSELTLLERRMILASGLPGMEG

SEQ ID NO: 175117 - protein, 172 aa, Triticum aestivum
  Clone ID: PAT_TA_69535.pep
MAHYKDDIKYEEGFTLNSRGSRLFTCKWTPKKQQRKALIFICHGYGGECSISMADTAARLVHAGYAVHGIDQEGHGKSSGSKGYISSFGDIVKDCSDYFKSVCEKPENKTKKRFLYGFSMGGTVALQVHRKDSMYWDGAVLLAPMVKLGDGMRPHPVVVSALKMICAVVPSW

SEQ ID NO: 175118 - protein, 146 aa, Triticum aestivum
  unsure (1)..(146): unsure at all Xaa locations
  Clone ID: PAT_TA_69536.pep
AASPAGPAGNKEKGRKGSGGCRGIIACGKRTDFGYDKDFEARYALGKLLGHGQFGYTFAAVDRQSDERVAVKRIDKNKMVLPVAVEDVKREXKILKALHGHENVVHFYNAFEDDNYIYIVMELCEGGELLDHILAKKDSRYSEKDA

SEQ ID NO: 175119 - protein, 144 aa, Triticum aestivum; identical to SEQ ID NO: 131258
  Clone ID: PAT_TA_69537.pep

SEQ ID NO: 175120 - protein, 169 aa, Triticum aestivum
  unsure (1)..(169): unsure at all Xaa locations
  Clone ID: PAT_TA_69538.pep
MAPXGGHAAASSGSEDEEEEAEAGFSRSYFLAKEKEPSSAKKRARAAAAGKLSDLNLVDEQVLRASLAEIPPKHEKEVEALTRSYKDQYRNWLFELRCGFGLLMYGFGSKKLLLEDFASTTLTDFTVIVVNGYLPSINLKQVLATIAEMFWEQKKLKRKRHSGTRSQQS

SEQ ID NO: 175121 - protein, 153 aa, Triticum aestivum
  Clone ID: PAT_TA_69539.pep
QRQDEHGAVACGWSKSSSSPCRGRLPHAVNFRSSRSPAPPLHNVYGLRRLAGAPTAGLHLLCRRRPPSLLRAAQVMPPVENTMYRSRAPSRWCASSMSALPLAAATHLLAGQVPPPTSVAASTSNRLASTSSRHLFCLCWYYSMTSSRLLCRL

SEQ ID NO: 175122 - protein, 145 aa, Triticum aestivum
  Clone ID: PAT_TA_69540.pep
EFGRGVDAEAPFLTEDAVDEPPLAGVSDFRGRPVYSSTSGGWRSALFVAVMEVASAFAYYGVSANLITYMTGPLGHSNAAAAAAVNVWSGTATLMPLLGAFVADSWLGRYRSIILAGTLYVLGYAMITLASVLTAQHPSLSGDTS

SEQ ID NO: 175123 - protein, 57 aa, Triticum aestivum
  Clone ID: PAT_TA_69541.pep
KESRVNAPDETMDSRSIVLLHQLCMSIILVDTFHMLAAAMFDASCCLTIILSTVQAQ

SEQ ID NO: 175124 - protein, 108 aa, Triticum aestivum
  Clone ID: PAT_TA_69542.pep
MDAGSHSISSGKNSAAAVQRPPLQEAGSRPYMPPLSTTSRNPSAKCYGDRFIPDRSAMDMDMAHYLLTETKKDKENAAAIAASPSKEAYRRLLAEKLLNNRTRILAFR

SEQ ID NO: 175125 - protein, 153 aa, Triticum aestivum
  Clone ID: PAT_TA_69543.pep
MAGVVEELVKKAGGCAVIDGGFATQLEALGADINDSLWSAACLITKPHLIKEVHMQYLEAGADVIISSSYQATIPGFLARGLLLEEAEGLLRTSVQLAREARDEFWKSTLRSSKPVYNRALVAASIGSYGAYLADGSEYSGSYGDDVTSEKLK

SEQ ID NO: 175126 - protein, 129 aa, Triticum aestivum
  Clone ID: PAT_TA_69544.pep
MSTTESRRLSDDYEVADVLGRGGFSIVRRGVSKSDEGKTQVAIKTLRRLGPAMTGMGMQQGSKGAPSSGGLPLWKQVSISDALLTNEILVMRRIVENVAPHPNVISLHDVYEDAHGVHLVLELCSGGEL

SEQ ID NO: 175127 - protein, 201 aa, Triticum aestivum
  Clone ID: PAT_TA_69545.pep
RCSEKIKLEGEKAEAHREIKKLQSQRTHLERDLRKHDSVTVDKRHELNVKPEELAGFFDQAVQLQEEYQRLEIHASDMEDEIASLQETLATLTAEKEEALSKVEFMVLEQEDLENRLTSAESKINSLNEEIAVLTKKLDESEYFGRKLEASLSSISKEKEDLGMQLTDVLLEMESERSMWIAKEKAYLETKQQLDICTDEN

SEQ ID NO: 175128 - protein, 194 aa, Triticum aestivum
  Clone ID: PAT_TA_69546.pep
MQNWEDVLMAKLKPSHTGEVPVPGSSSAGSMPKWEEALLAEGKPNNTSEVPGYSSAGSMQNWEDLLVAGLKPNNMSEVPGSFSADSMQNWEDPLFAERHTGEVPEVGMIVYEQGHMNNTLKDHLVHGVWSPVTESWRTRLEVLLGASRGVEHMHRCAIIHGNVSSSNILPDANWKPRLSGFLGVHVLQAGQLVV

SEQ ID NO: 175129 - protein, 138 aa, Triticum aestivum
  Clone ID: PAT_TA_69547.pep
ERERELEFLVKGGNPLDFKLGHVVSLSVQSTSVTDQIAEQNVMSEAKGSFTFAASPHGDSFGSSGRPGSSCREANTADNLMLLDGDTSKIGGEKLVKRGTKRSNTPQPEMSFCNDGQNNTKEAEDSGLFPHGAKSQAY

SEQ ID NO: 175130 - protein, 90 aa, Triticum aestivum
  Clone ID: PAT_TA_69548.pep
PLRPLARSSPRRISATLQRDGLETVGKAAALVGGGSSAGGAKKAKADAEVAGSLLEKAAPIIVCRKRSSIAKAAAANKEKVEKEDTDEDE

SEQ ID NO: 175131 - protein, 119 aa, Triticum aestivum
  unsure (1)..(119): unsure at all Xaa locations
  Clone ID: PAT_TA_69549.pep
RHEGFVIEVFEAAVRLLPYALPFEYVKAASMPYDDLVQAVGNGTFDAAVADITMTASRSNHVDFTLPYAGTAIAMLVRVRDQRSNKRTWVFLKPLRYDLWLVSAXFFLFTGFVVWAIEH

SEQ ID NO: 175132 - protein, 135 aa, Triticum aestivum
  Clone ID: PAT_TA_69550.pep
MGWGTLITRRLKVFSLALFVYFDYKAVQKRVQWVSTVKKNAIWAKTHERNARRVLNLMIELEGLWVKMGQYLSTRADVLPEPYIEVLKQLQDSLPPRPLEEVCGTIEKELGKPMRQLFATFDVDPLATASIAQVH

SEQ ID NO: 175133 - protein, 34 aa, Triticum aestivum
  unsure (1)..(34): unsure at all Xaa locations
  Clone ID: PAT_TA_69551.pep
DQHAHFEIRRPALWWPTPRSSQAXPPPSWXXSCM

SEQ ID NO: 175134 - protein, 126 aa, Triticum aestivum
  Clone ID: PAT_TA_69552.pep
YNYTLLNRTTMGVPLALDFAAGEAACPAKGQPPPPDYACVSGNSSCANATFTPGYICKCWDHYAGNPYVPDGCQDIDECKRPQVFPSSSGAVCRNRLGGYDCPCKFGLKGDGKAGTCTHIFSPAAN

SEQ ID NO: 175135 - protein, 185 aa, Triticum aestivum
  Clone ID: PAT_TA_69553.pep
APTNRAVDGLYRPSGASFIRHHLRSLAAYQPILPFEVLSARLGRKPEDIIKLDANENPYGPPPEVAAALGNLKFPYVYPDPESRHLRAALAEDSGLETEHILVGCGADELIDLIMRCVLEPGDKIVDCPPTFTMYEFDASVNAALVIKVPRLPDFSLDIANIVKMVEQEKPKCIFLTSPNNPDGS

SEQ ID NO: 175136 - protein, 25 aa, Triticum aestivum
  unsure (1)..(25): unsure at all Xaa locations
  Clone ID: PAT_TA_69554.pep
MRLGLEVVFWLRWPDLGPRXAPRAS

SEQ ID NO: 175137 - protein, 77 aa, Triticum aestivum
  Clone ID: PAT_TA_69555.pep
MGTEPTMLQRWSSSMWGMSGRDRLRLEDKAWRAHAGMAFTQLAYGGYHVLTKSVLNVGMNQIVFCVYRDLVALALLA

SEQ ID NO: 175138 - protein, 45 aa, Triticum aestivum
  unsure (1)..(45): unsure at all Xaa locations
  Clone ID: PAT_TA_69556.pep
QIGQTMMRTCPSHHLNLFCFLLLVLFEKCLHILWHLETAPLLXLH

SEQ ID NO: 175139 - protein, 162 aa, Triticum aestivum
  unsure (1)..(162): unsure at all Xaa locations
  Clone ID: PAT_TA_69557.pep
SSASTSRSATRPSAGTLVVCPASILKQWASEIKAKVAESSRLSVLXYHGGSRTSKPTELAKYDVVVTTYTIVGQEVPKQDSDDDMEPNNDEKYGLCPDFAARKRKLSKQTKKKAIKKKKVNSSAADLDGGPLARVRWFRVVLDEAQTIKNHRTKSARACCGL

SEQ ID NO: 175140 - protein, 61 aa, Triticum aestivum
  Clone ID: PAT_TA_69558.pep
LFQQNFWFADGRGAVNPKGLQFYNNIIDELVKHGNCSFYFSIHVLGLRSLRQIFVHSGNQV

SEQ ID NO: 175141 - protein, 47 aa, Triticum aestivum
  unsure (1)..(47): unsure at all Xaa locations
  Clone ID: PAT_TA_69559.pep
PEMLLTRESVRCSPPSVIAAFCGSHVMSHRSAKFAPXSPSLXTAXNA

SEQ ID NO: 175142 - protein, 151 aa, Triticum aestivum
  unsure (1)..(151): unsure at all Xaa locations
  Clone ID: PAT_TA_69560.pep
RRRLRLGCGAGCGGMVIEGPKTGFVKSGGCGSGCGGGCGSGYDGGCGGMVIEGSKTGFAKSAGCGSGCGSGCGGMVTEGSKTSHAKSGGCGSGCGAGCGGGMSRAKSGGCGSXCGAGCGGXXCGGLVMEGSXMSHAKSGGYGSXCGAGCGG

SEQ ID NO: 175143 - protein, 47 aa, Triticum aestivum
  unsure (1)..(47): unsure at all Xaa locations
  Clone ID: PAT_TA_69561.pep
RELGADHPDLDAXKVSLGVLXXISHVTLAMQPLFKRSVTLVKRDDSD

SEQ ID NO: 175144 - protein, 75 aa, Triticum aestivum
  unsure (1)..(75): unsure at all Xaa locations
  Clone ID: PAT_TA_69562.pep
MAIAGSGRGKAKPAASAKSVSRSXKAXLQFPVXXVARYLKVGKYAQRVGAGAPVYLAAVLEYLAAETLELAGNAA

SEQ ID NO: 175145 - protein, 139 aa, Triticum aestivum
  unsure (1)..(139): unsure at all Xaa locations
  Clone ID: PAT_TA_69563.pep
ISLPRXLGFRPRHSRRRRRHPLPPPVRFISSPLQAIQSSSSPPPGPVAHLRRGSLPRLRPWSTTTSGGCARQLAHDLAHGCGSARARLRLSVRKDTPKNIYAPKFGRSPRISRITRVLNSGNGSWAICSTAWMGEQQCT

SEQ ID NO: 175146 - protein, 220 aa, Triticum aestivum
  Clone ID: PAT_TA_69564.pep
SARGRVSALLTNAPFIINFDGDHYVNNSKAFRAGICFMLDRREGDNTAFVQFPQRFDDVDPTDRYCNHNRVFFDATLLGLNGIQGPSYVGTGCMFRRVALYGVDPPRWRPDNVKIVDSSTKFGSSASFISSILPAADQERSIMSPPALEEPVMADLAHVMTCAYEDGTEWGREVGWVYNIATEDVVTGFRLHRNGWRSMYCRMEPDAFAGTAPINLTERL

SEQ ID NO: 175147 - protein, 173 aa, Triticum aestivum
  Clone ID: PAT_TA_69565.pep
MLSWLSSNNWQRATTMDDLFNAHFLTPGQKDVQDASKAADASAAAAAANPAASPSPTTRWGKIIARAKSNPCSCLLPSVAVALALASLFLAMLYSAVEGSSKPAMNLGPLQYPILTDSNYAAWAIKMEAYMRAQGVWDAVVAKDHPKVSARNNQMALAAIYQAIPEGTLFLLS

SEQ ID NO: 175148 - protein, 184 aa, Triticum aestivum
  Clone ID: PAT_TA_69566.pep
MKCLLFTSAVAVVLALFPVAAVGAGLKVGFYSKSCPSAENLVQQAVAAAFKNNTGVAAGLIRLHFHDCFVKGCDGSVLIDSTANNTAEKDAPPNKPSLRGFEVIDAAKKAIEAKCPKTVSCADILAFAARDSVALAGNVTYKVPAGRRDGRISTNASALSNLPSPLSTAAELVGNFTLKNLTAE

SEQ ID NO: 175149 - protein, 141 aa, Triticum aestivum
  Clone ID: PAT_TA_69567.pep
MEYENRGHVAANDDGLCVVQPARADPLNWGKAAEELSGSHLDAVKRMVEEYRRPVVTMEGASLTIAMVAAVAAGSDTRVELDESARGRVKESSDWVMNSMANGTDSYGVTTGFGATSHRRTKEGGALQRELIRFLNAGAFG

SEQ ID NO: 175150 - protein, 64 aa, Triticum aestivum
  Clone ID: PAT_TA_69568.pep
IMNSFINDIFEKLAGESAKLARYNKKPTITSREIQTSVRLVLPGELAKHAVSEGTKAVTKFTSS

SEQ ID NO: 175151 - protein, 162 aa, Triticum aestivum
  Clone ID: PAT_TA_69569.pep
LLRGTIANAESPIAACRLVLSRDGNLALHHLATTVWSTRANTTANTTVAALLDNGNHVLRSVGGTPNSSNVFWQSYDHPTDTVLQGRSTGLIRRLVSRKNAVDQTPGMYSYELSGHNGDTSIVSMFNSSKQYWSSGEWGGQYFSNIPESVGQKWLSLQFTSN

SEQ ID NO: 175152 - protein, 234 aa, Triticum aestivum
  Clone ID: PAT_TA_69570.pep
MEVDAAYPAATAGDELRRLLTATLSDDKASVDAATAGLDRISAAGDPRFPIALLAVAAGDGDQGTRIAAATYLKNFVRRNMEGGLSSSDLYREFRDQLAQALLRVEPAILRVLIEVFGQIVEKDFVKENSWPQLVPQLKLVIQSSDAISPGQHPEWKTINALTVLQAILRPFQYFLNPKVVKEPVPEQLEQIAAEILVPLQVTFHHFADKVLLSHDGNKLEYEQLLITCKCMYF

SEQ ID NO: 175153 - protein, 225 aa, Triticum aestivum
  Clone ID: PAT_TA_69571.pep
AGNSARGRRLKSQVAVEHAAAFPDLGPVAVKSFQVLRKGAMYHLSDSMALRSAFSKVKAGCFLHVKMVAVATDSHYCRDEDRGRSSRGCLGVDMDKCLMELPATISGGVNPQMLEGSEEAAALLNVHAHDAVPNDVQLSSSSHPNTETKKDAAVSLATDVQTNSVANVSRFSNQSNAALVGEELLARKENLLHSVKDHDLGVVSGDKQVGTREGTVGELHALDDP

SEQ ID NO: 175154 - protein, 43 aa, Triticum aestivum
  unsure (1)..(43): unsure at all Xaa locations
  Clone ID: PAT_TA_69572.pep
MIVTLMNFLRACWRPSSNRXARTGSDATGRQDGLLWYKDTXEH

SEQ ID NO: 175155 - protein, 26 aa, Triticum aestivum
  Clone ID: PAT_TA_69573.pep
GGGGGGGCFSCGESGHFSRECPNKAH

SEQ ID NO: 175156 - protein, 206 aa, Triticum aestivum
  unsure (1)..(206): unsure at all Xaa locations
  Clone ID: PAT_TA_69574.pep
FPVLLXHYPRRYYAFFYCNAASFMASVTLILLLVNPKLYRPGIRCYALYVCMLVGTFGLMGAYAAGSSRHLKTSIYVLTLVGAVVAFIALLLVLFRLFPLFGKPKDKVPVTPKSSGSNSNKSSGSKKKEKLQYLTLLGILAASMTYQTGLKPPGGLWQDNNDGHSAGNPILRDINKDRYNAFFYSNSTSFMASIVVVVMLLPLTML

SEQ ID NO: 175157 - protein, 165 aa, Triticum aestivum
  Clone ID: PAT_TA_69575.pep
LSMWIPGNTARSFTSSTNLARLMKKFCIVRLRASSAAPPTRPPRRFFGRRRKKRPSRAPKSPVFAGSGRNWRRRTQPEPGALGALGGAGRIVFGAKSRRPPLPATRLSSHRFVVLIASFPAANQCQSCARCRAGQPPLMPHGRRSEGRTTTAATRWSGSAGPWRR

SEQ ID NO: 175158 - protein, 160 aa, Triticum aestivum
  Clone ID: PAT_TA_69576.pep
MDRRSWPWRRKSISDKAPAPTETETDSSASCPSEALTDEQDTTLKSSPKSPEVASKEAQDNSNVKVKVLSERLSSVVSDIRAKDDLVKQHSKVAEEAVLGWEKAENEMASLKAQLNAATVKNATLDGALKECVRQLRRAKEEQDQKVQGALALQSRQWES

SEQ ID NO: 175159 - protein, 240 aa, Triticum aestivum
  Clone ID: PAT_TA_69577.pep
GHSPVLLAAGSTVTIQTASKMLCLTLDEFLEQPPCDAKTILLSIFVPDWGSDNVIFETSRVAPRPFGNAVSYVNSAFLARTSGDGASGKLIIEDICLAFGAYGVDHTTRARKVEEFLKGKSVSAPVILEAVRLLKDIIMPSEGTTHPEYRVSLAVSFLFSFLSSLGNNLTEPAKAIAPNGSCANGSMNGQVASEDLQIRSRQELVFNDEYKPVGKPITKSGAELQASGEAVYVDDIPAPK

SEQ ID NO: 175160 - protein, 50 aa, Triticum aestivum
  unsure (1)..(50): unsure at all Xaa locations
  Clone ID: PAT_TA_69578.pep
KCFVIICLHQFSYTSTLSVTECKTFLQFKLNCFKRVTLSXXGTTCYYNLY

SEQ ID NO: 175161 - protein, 115 aa, Triticum aestivum
  Clone ID: PAT_TA_69579.pep
GFRRWLQPWRPSESRTPPCSTPSPPSRPTRPPSPPSLPHGAPSIPMPPQSTPPSPPASKASPSSSCSAPGWTGQASARTSPSTGTSSGTPFAHSTPPCWWLPTRGSWCSPRPRGS

SEQ ID NO: 175162 - protein, 183 aa, Triticum aestivum
  unsure (1)..(183): unsure at all Xaa locations
  Clone ID: PAT_TA_69580.pep
SAAAWCCAGVRWSQSEPARCCTLERRSYSATCRSCDGPLEHRVPMSRVAIKHGRRCDGSAALRWSTSCRYRGCSEAWPELRWSTLCQCRGCNEEWPELRRVAGAALEHPHAGVAAAMEHGRSYGGTSALRCSTAAPVLAAAMKHGRSCAGSPALRWSTACXXXGCNETWTDLRRDXXAXXXXP

SEQ ID NO: 175163 - protein, 207 aa, Triticum aestivum
  Clone ID: PAT_TA_69581.pep
MNYSSASLYVGDLHEEISEALLFDLFHEVGPIISIRICRDAMTRKSLGYAYVNFQNPQDAERALDTLNYASVKGIPIRIMWSQRDPSIRKSGIGNIFIKNLDKSIDNKALYDTFSAFGNILSCKVCQATKKGEIESVESAGYGFVHFETQEAAEKAIAKINGMLLNGKQVFVGPFVKKTERLKILSNEDSFTNIYVKNLDASVDEKE

SEQ ID NO: 175164 - protein, 182 aa, Triticum aestivum
  Clone ID: PAT_TA_69582.pep
CRFGTRRSYAYGIVAEEVEARLLPLLADAADNGRVVDLQDVFRRFAFDTICKISFGLDPGCLELDMPMSKLAAAFDTASRLSAMRGAAASPLVWRVKRLLNVGSERELRKSIRLVDELAAAMIRQRRKLGVAGSHDLLSRFMASEAHGTAVDDKYLRDIVVSFLLAGRDTVSSALTTIFMLL

SEQ ID NO: 175165 - protein, 298 aa, Triticum aestivum
  unsure (1)..(298): unsure at all Xaa locations
  Clone ID: PAT_TA_69583.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIXPPDQQRLIFAGKQLEDGRTLADYNIQKESTXHLXLRXXGGMQIFXVKTLTGKTITLEVESSDTIDNXKXKIQDXEGXFPPDQXGXIXXLEAXLRMGRTLXADYNFKKEX

SEQ ID NO: 175166 - protein, 52 aa, Triticum aestivum
  Clone ID: PAT_TA_69584.pep
GGRICAPLFLFFFFCYYLVVLFSLHQSCSYFDPLNIVLDQLTILKEFFMQKK

SEQ ID NO: 175167 - protein, 52 aa, Triticum aestivum
  Clone ID: PAT_TA_69585.pep
ETATTSKKKKSKSKDASADPAAAAADTTSLADAEAKTDGYMIKPQALVPSLD

SEQ ID NO: 175168 - protein, 268 aa, Triticum aestivum
  unsure (1)..(268): unsure at all Xaa locations
  Clone ID: PAT_TA_69586.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIXVKTLTGKTITLEVESSDTIDNVKAKIQDKEGIPPDQQRXLIFAGKQLEDGXTXADYNXQKESTXXLVLRLXXGMQIFREDPHRGRPSLLEVESSDXIDNXKAKIQDKEGFPG

SEQ ID NO: 175169 - protein, 228 aa, Triticum aestivum
  unsure (1)..(228): unsure at all Xaa locations
  Clone ID: PAT_TA_69587.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGXTLADYNIQKEXSTLHLVLRLRGGMQIFVKTLTGKTITLEXESSDTIDNVKXAKIQDKEXIXPDQXRLIFAXXSSXRMAXPLADYNIXKESTLSLVASV

SEQ ID NO: 175170 - protein, 171 aa, Triticum aestivum
  Clone ID: PAT_TA_69588.pep
RGEAVKAEEEAAQQAEASADSSGSEACSSESGSSSDSDSGRDRKRRRKDKRSKRSSSRKDKERDSKKKRSKRSRKDSKRKRSKKDKSEAKLTAGEQYGRFGILRETDANVKRSEFVLWATEVKKVDVELLGRPEERELFRDFMEDYNTGTLPHRKYYNLEIYAREKAVKAA

SEQ ID NO: 175171 - protein, 175 aa, Triticum aestivum
  Clone ID: PAT_TA_69589.pep
RSDVAPASVSALACLKNNSAAYTSCMPDLAQVNAVLAAYSPHVYLHPNDPYLPSSVTWFFENGALLYQKGNPTPTPVTADGSNLPQGGGNDDAYWLDLPADNGQKERVKKGDLAGAKAYVQAKPMLGGTATDLALFFFYPFNGPARAKVGPLTIPLGMIGEHVGDWEHLTLRVSN

SEQ ID NO: 175172 - protein, 78 aa, Triticum aestivum
  Clone ID: PAT_TA_69590.pep
MSCCGGNCGCGSACKCGNGCGGCNMYPEAEAAGATLLVSATATHKASSSGMEMAAENGGCGCTQCKCGTSCGCSCCSC

SEQ ID NO: 175173 - protein, 199 aa, Triticum aestivum
  Clone ID: PAT_TA_69591.pep
RLCCPGDKLLVNYLSDVKYVLQMRSLAAGELLHGIPIDIGSVNGITGRRCDSEVFVEFSSFLTPGIVYRCDLSSGVPEMSIYREITVPGFDRTDFEAKQVFYPSKDGTKIPMFVVSRKNIDLDGSHPALLFGYGGFGMSMTPQFSAARVVLMRNLGFVTCVANIRGGGEYGEEWHKAGSLANKQNCFDDFIAAGEFLVS

SEQ ID NO: 175174 - protein, 70 aa, Triticum aestivum
  unsure (1)..(70): unsure at all Xaa locations
  Clone ID: PAT_TA_69592.pep
LGFKALRVXEHPLIIHPXTIVXSPPFLPXMLSTMNDVGTLISRHNLYHVAVILGGGSFLLVTCIIRVMLI

SEQ ID NO: 175175 - protein, 112 aa, Triticum aestivum
  unsure (1)..(112): unsure at all Xaa locations
  Clone ID: PAT_TA_69593.pep
WVGNPETQCXGACAWPFHQXAYGPQXAPLVAPNXDVGXDXMVMNFASMLAGAATNPFGDGYYQGSSDAPLEAATACPGVFGKGAYPGYAGDLRVDQATGASYNCNGAHGRKY

SEQ ID NO: 175176 - protein, 118 aa, Triticum aestivum
  unsure (1)..(118): unsure at all Xaa locations
  Clone ID: PAT_TA_69594.pep
GGKAGATDPSMDPNTAATXKRYPCPNTALSDNTILYLDDRSXXSKVDNSXYXMLXQXRXVXMVDXNXYNDSSXRWMXDRLANTDHFTWLFPQALVXLGEVKVLTGTXGXVRRXCTKFN

SEQ ID NO: 175177 - protein, 116 aa, Triticum aestivum
  Clone ID: PAT_TA_69595.pep
MEPFIHNFFENTSTVQLNHRILATSTLLSVSALWLAARKVDMHPAVKSLVGSTLGMAALQVTLGISTLLMYVPTSLGSAHQAGALTLLSLMILLTHTLRRPSPALLKSLASAVKST

SEQ ID NO: 175178 - protein, 130 aa, Triticum aestivum
  Clone ID: PAT_TA_69596.pep
TQNSTALRMARLLENHPKIERVYYPGLISSPWHHIANSQMTGCGGVISFKVASDLHGVMRFIDALEIPFIATSLGGCESLVQQPAVMSFWGENDEEKAKNGIKDNLVRFSFGVEKFEDLRDDILQALEKI

SEQ ID NO: 175179 - protein, 49 aa, Triticum aestivum
  unsure (1)..(49): unsure at all Xaa locations
  Clone ID: PAT_TA_69597.pep
VXLFLLGSNGLASGLISFSPLFVCLLLXAGLLTLFVVVEAGPTSCYCCM

SEQ ID NO: 175180 - protein, 112 aa, Triticum aestivum
  Clone ID: PAT_TA_69598.pep
WIGQNSHENDDMPDGSGTINFESCGGLFLISGIVTTGSLLVAMLMSRYKKRQQNAGNKRDDQNESRPGQEKKKMEEQGDQNSNGEGTELTESQTTLSVPHSSNGNGDQLTRQ

SEQ ID NO: 175181 - protein, 107 aa, Triticum aestivum
  Clone ID: PAT_TA_69599.pep
GSFLPSPSYSLLLLPLPTPLTRPSSCLPLPFPLPPPPPSSAGAGSATNRGRGEEKGRLLSGHLSAGSAHAGAGLRDGVGRRRRAGQHASRACHPPVVGLQRHRHHHH

SEQ ID NO: 175182 - protein, 144 aa, Triticum aestivum
  unsure (1)..(144): unsure at all Xaa locations
  Clone ID: PAT_TA_69600.pep
CWWFCSTWMHWYPSSSGRMQQWQEAHGCVHLKHIMDIIHFLINANSIQIIVDAIIHRMTKEAMLLFCLVPALTIAVQRVRRVVHLTTVPALTTEVFVLLKLLRNTSESSESSMLFMTRACETVLYYNCRACYTCRAXKYVYTGP

SEQ ID NO: 175183 - protein, 44 aa, Triticum aestivum
  unsure (1)..(44): unsure at all Xaa locations
  Clone ID: PAT_TA_69601.pep
VSAXPSAAVXMXSSPPSSERSTGKMNPRVPGWNKRLLLDFGHDQ

SEQ ID NO: 175184 - protein, 129 aa, Triticum aestivum
  unsure (1)..(129): unsure at all Xaa locations
  Clone ID: PAT_TA_69602.pep
GPVAWDNNVARFAQDWAAQRAGDCXLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLGAEAK

SEQ ID NO: 175185 - protein, 54 aa, Triticum aestivum
  Clone ID: PAT_TA_69603.pep
QAPFAHKRRKNQSTGSNQVNHTAVLYSLHSLTPSMATERMKRSSSMATERMKRS

SEQ ID NO: 175186 - protein, 151 aa, Triticum aestivum
  Clone ID: PAT_TA_69604.pep
AVNGMRPDGTIDMSSTQSKEIWPGTTYAVAAAMIHEGMLEAAFRTAKGAHDASWSKDGFGYAFQTPEAWTAEGGYRGLHYMRPLSIWAMQWALSPPELHKDLGPVASPGVASVGQDKFEKVASMLRLREEEQHKGFLRALYHILRQVVLPA

SEQ ID NO: 175187 - protein, 109 aa, Triticum aestivum
  Clone ID: PAT_TA_69605.pep
REKISGATIHFLMPPLLQIHNHCPCCFSTPPLSLAPSALTQSSICMPHQLRSRHINYVLMPNLHLGIMYVALFLLYYCSHSYFCLLCLFFAYYWILVWIAHPDSTCFYM

SEQ ID NO: 175188 - protein, 65 aa, Triticum aestivum
  Clone ID: PAT_TA_69606.pep
SNSMQNLEVLKVDCYTASYQLTGLNFLPELKQVLLKGGNGDIKTNLETQLLAGHPSTPPAVELEK

SEQ ID NO: 175189 - protein, 124 aa, Triticum aestivum
  Clone ID: PAT_TA_69607.pep
PSHVDIKISLTDTVHPDELDEEFDTFPTSRSSGLTMMRYDRLRCLASRIQTVMGDVASCGERITALTTWRDPTATAVFGLFTLAAAVIMCFTPWKILVAMVGLYIMRHPKLQRKMPSFVWNFYR

SEQ ID NO: 175190 - protein, 136 aa, Triticum aestivum; identical to SEQ ID NO: 109951
  Clone ID: PAT_TA_69608.pep

SEQ ID NO: 175191 - protein, 56 aa, Triticum aestivum
  unsure (1)..(56): unsure at all Xaa locations
  Clone ID: PAT_TA_69609.pep
PTMYVHGRQKHLLGSNKGEHSSXLCCTDLEAXXFLLHHQQILSFLGRDFXRNQFLX

SEQ ID NO: 175192 - protein, 115 aa, Triticum aestivum
  Clone ID: PAT_TA_69610.pep
GAATYAVMIHGLSCKKGRLEEACGYFVMMVDGGIPPYQATCEVLRDRLTRHGLRDQLEVLIDRMRRSTSCTIQEMASIMRSSKRADETRSASSGQELPGHDLDENEWRGKWKLGD

SEQ ID NO: 175193 - protein, 121 aa, Triticum aestivum
  Clone ID: PAT_TA_69611.pep
GALAVPMTPSPPPLESSQIDFMVCAGLDASVTRLPVTVGHVVPPGGDVVGTNTLAPCSDALFAKELCSLLSSLEAASPGSGKVVACILTEKFNKDKTKKVEKSLKSKNKKSDALGKASAAA

SEQ ID NO: 175194 - protein, 173 aa, Triticum aestivum
  Clone ID: PAT_TA_69612.pep
EAKVVDVETQKHLPPSQLGEICIRGPQIMEGYFNNVEATDFTIKQGWLHTGDLGYFDDEGQLFVVDRLKELIKYKGFQIAPAELEGLLLSHPEILDAVVIPFPDDEAGEVPIAYVVRSPASSLTEVDVQKFIAKQVTHYKRLRRVTFVESVPKSAAGKILRRELIAQVRSSKL

SEQ ID NO: 175195 - protein, 196 aa, Triticum aestivum
  Clone ID: PAT_TA_69613.pep
MLVEFGVDQAPCAPDQTRCQGFALVAFMNRNSFQFPKNASLLQASFDGVPGVYTEDFPSSPPLLPGIRKATSVKRVNHSDVVEVVLQSQAYSSALGTENHPIHLHGFNFFVLAQGLGRFDLNATYNLVNPRVRNTVIVPGGGWTVIRFVANNPGMWFMHCHLDAHLPLGLAMVFEVLNGPAPNILPPPPEDFPKCY

SEQ ID NO: 175196 - protein, 41 aa, Triticum aestivum
  unsure (1)..(41): unsure at all Xaa locations
  Clone ID: PAT_TA_69614.pep
XMFHXXXRSSAXRVRAYXHARWLYXCVCVVCLCCLAXTTPS

SEQ ID NO: 175197 - protein, 45 aa, Triticum aestivum
  unsure (1)..(45): unsure at all Xaa locations
  Clone ID: PAT_TA_69615.pep
MXXXXRPKLNFSYHLSXPDXXQCQXRQXIHHETXLTYXHTQXXTH

SEQ ID NO: 175198 - protein, 45 aa, Triticum aestivum
  unsure (1)..(45): unsure at all Xaa locations
  Clone ID: PAT_TA_69616.pep
XXXIXHXIXXFXKGIXXAXTXLXTLQQLXKKSGXIDDMGIEXMMM

SEQ ID NO: 175199 - protein, 64 aa, Triticum aestivum
  unsure (1)..(64): unsure at all Xaa locations
  Clone ID: PAT_TA_69617.pep
QXXXXNQXEQXXXXXXEQTDNXXXXVXXXXXQVXXXLXXXQHXNXIXIRXGXVRIIXSQHGXAL

SEQ ID NO: 175200 - protein, 81 aa, Triticum aestivum
  unsure (1)..(81): unsure at all Xaa locations
  Clone ID: PAT_TA_69618.pep
SEKEXXAGHASLHTIFGMDSXIXXXDLXXITEAWVXGVLVFSFCFDLVXLAXYGXNCVILMXRMYMYGXXLXLLVTCVGYM

SEQ ID NO: 175201 - protein, 26 aa, Triticum aestivum
  Clone ID: PAT_TA_69619.pep
DAENIADAASEMLGTDFISTQHYYCF

SEQ ID NO: 175202 - protein, 143 aa, Triticum aestivum
  Clone ID: PAT_TA_69620.pep
VVVSALKMICAVVPSWRVIPAPDQLDKVCKDPQFKKEIRSNPYMYKGNLALQTGHELLAVSLDIEKNMHEVTLPFLVLQGEDDVVADPEGSRLLHERASSRDKTLKLYPGMWHVLMAEPPADVERIFTDVISWLEERAASTVK

SEQ ID NO: 175203 - protein, 105 aa, Triticum aestivum
  unsure (1)..(105): unsure at all Xaa locations
  Clone ID: PAT_TA_69621.pep
IVYXESKRCCCFTKSYYCYVKGTGSVLVTSKNLKPVPKEXLEMSSLNELGLRFFTPXREVANLHSFPPSFRFPDHISLRQQYAMLGNSLSVAVVAPSLRYLFAEA

SEQ ID NO: 175204 - protein, 77 aa, Triticum aestivum
  Clone ID: PAT_TA_69622.pep
AGKELEALPKFLKNGDAGIAKMIPTKPMVVETFATYPPLGRFAVRDMRQTVAVGVIKGVEKKDPTGAKVTKAAIKKK

SEQ ID NO: 175205 - protein, 36 aa, Triticum aestivum
  unsure (1)..(36): unsure at all Xaa locations
  Clone ID: PAT_TA_69623.pep
QINPLSLLRVLLNQIINQKGKQSGYQANSCXNFPSA

SEQ ID NO: 175206 - protein, 56 aa, Triticum aestivum
  unsure (1)..(56): unsure at all Xaa locations
  Clone ID: PAT_TA_69624.pep
FTGSPATAELVKLYAANQDIFFQHFAQSXMVKMGNISPITGRNGEIRSNCRRVNHN

SEQ ID NO: 175207 - protein, 146 aa, Triticum aestivum
  Clone ID: PAT_TA_69625.pep
MLVAALVETRRLETAREHELVDNADATVPMCWAWLVPQYVLIGVAGVFAEVGMQEFFYDQMPSELRSLGMALYYSVIGMGNFISGALISLIDRITSSGGGDSWFADNLNRAHLDYFYWLLAGLSATELALFLRCASTYVYSYKRLR

SEQ ID NO: 175208 - protein, 85 aa, Triticum aestivum
  unsure (1)..(85): unsure at all Xaa locations
  Clone ID: PAT_TA_69626.pep
TRACFVSFQILARXRLVVAPLVGLTAHLPDLDLGRVARGGELAELFHGSCRTLCTTCRLYPYSRSPWPWRPPTAPCRMGKAPSSG

SEQ ID NO: 175209 - protein, 129 aa, Triticum aestivum
  unsure (1)..(129): unsure at all Xaa locations
  Clone ID: PAT_TA_69627.pep
MSIFAATASFKPAQXTSSGTIEWSMAELLNHPDAMAKARAELNEVVGMGRLLEEADLPSLPYLQCIITETLRLHPIAPLLAPHESSAACSVAGYDIPAGTMLLVNVHTMHRDALVWXEPTRFSPERFEG

SEQ ID NO: 175210 - protein, 68 aa, Triticum aestivum
  unsure (1)..(68): unsure at all Xaa locations
  Clone ID: PAT_TA_69628.pep
TVKSVHQQYIPRYFSLFSVHKQELSSSRRLLALFVLSXMGEAAAEHAGSVKPWVQAWXPXGVPNTFQK

SEQ ID NO: 175211 - protein, 187 aa, Triticum aestivum
  unsure (1)..(187): unsure at all Xaa locations
  Clone ID: PAT_TA_69629.pep
ATLTEFEQVLKAMKMDSLIPLAPRVFDLFDNNRDGTVDMREILCGLSSLRNSRGDNALRLCFQMYDADRSGCISKEELASMLRALPEECLPGDIAEPGKLDEMFDTMDANGDGEVTFDEFKAAMQKDSALQDVVLSXPAPRAAVGFSIQIQFVLVERAVLSELLSFPPAAVNWEGEQKQYMLRRLVK

SEQ ID NO: 175212 - protein, 45 aa, Triticum aestivum
  Clone ID: PAT_TA_69630.pep
LPQCRSDSFRLVLESATLRLPGCTESFMVRRDRRIPAWTAGASCY

SEQ ID NO: 175213 - protein, 60 aa, Triticum aestivum
  unsure (1)..(60): unsure at all Xaa locations
  Clone ID: PAT_TA_69631.pep
WTYAISXMGIATGIFVYVAINHLMARGYRPQQPNYFDKPIFKFLGVLTGVAVMAVVMIWD

SEQ ID NO: 175214 - protein, 40 aa, Triticum aestivum
  unsure (1)..(40): unsure at all Xaa locations
  Clone ID: PAT_TA_69632.pep
KPTITSREIQTAVRLVLPGELAKHAVSXEGTKAVTKFTSS

SEQ ID NO: 175215 - protein, 91 aa, Triticum aestivum
  unsure (1)..(91): unsure at all Xaa locations
  Clone ID: PAT_TA_69633.pep
FSGRFMRARAHTHTXKQSFMDVIGSAQTRNTFIGPLLRMILSAPSGFTVTLEIGGRSFSFRDRQSIAVCAMRFSASKCIMGCNTGRPSNTA

SEQ ID NO: 175216 - protein, 48 aa, Triticum aestivum
  unsure (1)..(48): unsure at all Xaa locations
  Clone ID: PAT_TA_69634.pep
MXNXCLHLXXTLGLTXHNCFQCSSNNIQXKNTIIRLMLLINIFVVCXQ

SEQ ID NO: 175217 - protein, 146 aa, Triticum aestivum
  Clone ID: PAT_TA_69635.pep
TDYVPDHRENAYEDDEAEAYTYLLPETYDGGLASKSSHKKKQQQRMNGRRPYDNGVDLPYDPCSESKPGNHPFLSNSKRPPDFLSIPTKRIRTAARQRVASPFSAGVAGTPQFTSKTDASSGDTNSCQDDQSSLQGGFCPQEECRY

SEQ ID NO: 175218 - protein, 160 aa, Triticum aestivum
  unsure (1)..(160): unsure at all Xaa locations
  Clone ID: PAT_TA_69636.pep
KYVVGRKLGGGPRKKAVARFVKAGLQFPVGRIGRFLKKGQYAQRVGMGAPVYLASVLDSXEYLAAELLELAGNAAKDNKKSRIIPRHLLLAIRNDQELGRLLAGVTIAHGGVLPNINPVLLPKKTAEKEPKSPKKAAKSPKKAAEKEPKSPKAAKSPKKA

SEQ ID NO: 175219 - protein, 52 aa, Triticum aestivum
  Clone ID: PAT_TA_69637.pep
ELIVASRTTLLTTTRITYRIIPSRYQVFIWRKVMSRKTYPSSQSHIRIKYGS

SEQ ID NO: 175220 - protein, 107 aa, Triticum aestivum
  unsure (1)..(107): unsure at all Xaa locations
  Clone ID: PAT_TA_69638.pep
XEKCKRKILSTVSKLDGLESIDIQHDQDYGGYKLTVVGTVDPLRIVKVLKKRGFAAHVVGIEKGRKKLTPHCGYGYGYYAGMPAAAGGPPPPPYNDAPVHQGSCNTQ

SEQ ID NO: 175221 - protein, 66 aa, Triticum aestivum
  unsure (1)..(66): unsure at all Xaa locations
  Clone ID: PAT_TA_69639.pep
QPQKMLTMCDDSSVSTVVFMGQGTASVIKASITVWDLTLQYSTNKLFFVDFRNAXLAKQLCLELSA

SEQ ID NO: 175222 - protein, 155 aa, Triticum aestivum
  Clone ID: PAT_TA_69640.pep
FDIPISTKFRIFGLQLCDKSFVYLAGLQLLFSSGRRSVIPGLSGILAGLLYRLNIFGIRRLKVPEYVTSLFSRLSWPFSNNSYQRLPIATTDENIPHRQTHQMQGTHTTTPDPTESSIVTLVSMGFDPASAIQALALTNNDVNLASNILLEAQST

SEQ ID NO: 175223 - protein, 127 aa, Triticum aestivum
  unsure (1)..(127): unsure at all Xaa locations
  Clone ID: PAT_TA_69641.pep
STGGLPTGTFGLTGIGAWKXVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 175224 - protein, 48 aa, Triticum aestivum
  unsure (1)..(48): unsure at all Xaa locations
  Clone ID: PAT_TA_69642.pep
XXPTCXRSVSGNSVQXHIHYLGISMHSESXGSCRIXTDXNMLRXKVXT

SEQ ID NO: 175225 - protein, 69 aa, Triticum aestivum
  unsure (1)..(69): unsure at all Xaa locations
  Clone ID: PAT_TA_69643.pep
SKFWYFLRKLKKVKKSXGQMLAINEIFEKNPXTIKNYGIWLRYQSRTGYQKVRPPTRKLYKATRPNLFM

SEQ ID NO: 175226 - protein, 156 aa, Triticum aestivum
  Clone ID: PAT_TA_69644.pep
PTRWPRCQRRPRGEEPTDAGGERRTSKGRRRWTRGRSSSSGSSGRSSSWSASTPSSTTPTRCAAPQGHASRLAGAAKTIVSFVCVERRIFHLLVQNSWVIPAENDATAHSFGLLTVTTYWLRKLPKHRTSLDLPKGRVDDGVAIPQYAYVQGAGAG

SEQ ID NO: 175227 - protein, 103 aa, Triticum aestivum; identical to SEQ ID NO: 107316
  Clone ID: PAT_TA_69645.pep

SEQ ID NO: 175228 - protein, 115 aa, Triticum aestivum
  Clone ID: PAT_TA_69646.pep
GLIIDIVQDIRLINGEAIHASPRKTGAIILGGGLPKHHICNANMFRNGADYAVYINTAQEFDGSDSGAHPDEAVSWGKIKGSAKPVKVHCDATIAFPLLVAATFARRPHSANSTN

SEQ ID NO: 175229 - protein, 55 aa, Triticum aestivum
  Clone ID: PAT_TA_69647.pep
QLIKETQILSTCFKMQKWISSSFFFLVMKFTQFKRWRTKLNNLMTQVSNPFILFL

SEQ ID NO: 175230 - protein, 59 aa, Triticum aestivum
  unsure (1)..(59): unsure at all Xaa locations
  Clone ID: PAT_TA_69648.pep
TTCVSIXXYAPKKEHXIHSXGHILMXETCXTXLXQRTTRASGQAIYLDFSCSPLVPXVX

SEQ ID NO: 175231 - protein, 41 aa, Triticum aestivum
  unsure (1)..(41): unsure at all Xaa locations
  Clone ID: PAT_TA_69649.pep
CVKSLYDYERCVXXVKNXEXXXKLCXGXFFDSWSCVXXCVA

SEQ ID NO: 175232 - protein, 102 aa, Triticum aestivum
  Clone ID: PAT_TA_69650.pep
TGFTDRFCKDKPVVLSTSPFSTPTHWSQTIFTFEEPIAITNEKSVVGSSASVGSAECPAGTIRSRISIVRASEHRSIDISIETTGISSDGRKRSWPAQIFNL

SEQ ID NO: 175233 - protein, 92 aa, Triticum aestivum
  Clone ID: PAT_TA_69651.pep
SETLALRPRSSSSMYSRLSSIRQRHGKQKLAVARNKHLLLPPPKPATSYHTTIINLSLLSRLTAADQPQKGGVAMHCQIILLIYHLTTKYQK

SEQ ID NO: 175234 - protein, 138 aa, Triticum aestivum
  Clone ID: PAT_TA_69652.pep
MFFDPTNTLQLEAITVWFQEAEERIKQLPNPTNWPDFNVASWNKKTIKGLPTQKDGSSCGLYLLKYIMLWTGSKLSKTFSKKDIDMYRRQLAHDILNSDRNSLRKNQQPDQTKAISEDGVSTKKRKRSRTSTRNISTQ

SEQ ID NO: 175235 - protein, 43 aa, Triticum aestivum
  unsure (1)..(43): unsure at all Xaa locations
  Clone ID: PAT_TA_69653.pep
NLFVXXSILIALXKIAIQAMRSGFVRFHFKSSGGATFPTSWGL

SEQ ID NO: 175236 - protein, 86 aa, Triticum aestivum
  Clone ID: PAT_TA_69654.pep
YVGKIKWRLLQIILLICYRNKTPNQQIDLMDGGRAISKRNHHLLPVFFHPPSTLHPPHTSPSMCTLRRPQSTGAIGDHQITTPGSH

SEQ ID NO: 175237 - protein, 102 aa, Triticum aestivum
  unsure (1)..(102): unsure at all Xaa locations
  Clone ID: PAT_TA_69655.pep
XFFXXXQYSXGRGXEYMXIMIMACTLPVTXVHFPQWGSMFFPASADATEEEYYGSEWSEEEKRNGLHIAGQKFAENSRSERGRRNVILATSATPPNNTPQHV

SEQ ID NO: 175238 - protein, 123 aa, Triticum aestivum
  Clone ID: PAT_TA_69656.pep
KSICPANSSQFFPTTTTDMDIITPTVLDNKYYVGLTNNLGMFTSDQALLTNSTLKASVDEFVKSEKRWKSKFVKSMVKMGDIEVLTGTQGEIRLSCRVINKGSAGLEINNGPDYGEFAEIATS

SEQ ID NO: 175239 - protein, 83 aa, Triticum aestivum
  Clone ID: PAT_TA_69657.pep
RRHKYGGQYCVFYSEKSMDDARTRRTYARSAMKALSFCHTPLARKSLMNPKVTAMAASPPTTTRARPRDWGPPKHGSHAAERA

SEQ ID NO: 175240 - protein, 71 aa, Triticum aestivum
  Clone ID: PAT_TA_69658.pep
ITMQSLLLKQYIRTCSLHVKFSLRINLGTRHNKTRVVIVQQKTGSSLCFLYPVASSKIFTASKKTWNKSEL

SEQ ID NO: 175241 - protein, 55 aa, Triticum aestivum
  unsure (1)..(55): unsure at all Xaa locations
  Clone ID: PAT_TA_69659.pep
ACVXSHSIFXPEXNEERRSSFXTXXKXRXQXXAVLVVTSLATHNPSSLRXTHHXA

SEQ ID NO: 175242 - protein, 76 aa, Triticum aestivum
  unsure (1)..(76): unsure at all Xaa locations
  Clone ID: PAT_TA_69660.pep
XXXXXXXXXXXXXXXXILXXXXIGXXVFXVXLXXIXIXXXGIXXXRSXXXXIXXXXKQAWXXXXXXWVGPFXXXXL

SEQ ID NO: 175243 - protein, 145 aa, Triticum aestivum
  Clone ID: PAT_TA_69661.pep
RCCPRKTQKSPKKEPKSVMLLQSMMLPVKDPKSPEKETMLSKKDTESAQKDQKPTDNDPEPTDEGTWPLWPMHTAILLDMMGLLVAYAAGSTRKWETSRNVMVLIVPVLAYIGLYAALSVFCHRKEKPKEDPKVAADTQVGGAGP

SEQ ID NO: 175244 - protein, 106 aa, Triticum aestivum
  Clone ID: PAT_TA_69662.pep
RELVKLPAHSVPELPRYPLLQVISHDRSMLRKAPTLVQPSSKLSDEKNTVLDQIKNKTFNLKPVVTKRPNVMGGPRTNLQVAAILERANAIHQAVADDDDEDSWSE

SEQ ID NO: 175245 - protein, 179 aa, Triticum aestivum
  Clone ID: PAT_TA_69663.pep
LLNSGLEADVTFLVSGKSFAAHKVILAARSPVLMAEFFGHMKETSSQRVEIKDIDAVVFKSLLYFIYTDSVLEFDLQHEAVTMLAQHLLAAADKYGLDRLKEICEGKLSDGISIDTAATTLALAEQHNCLQLKVKCVDFIVSTPAILDAVLATDGYKHLEASCPMVLPELLKSARGRKS

SEQ ID NO: 175246 - protein, 31 aa, Triticum aestivum
  Clone ID: PAT_TA_69664.pep
LVLPTVAKLLVVVLVQITRRGTKTTTSTNLN

SEQ ID NO: 175247 - protein, 135 aa, Triticum aestivum; identical to SEQ ID NO: 130416
  Clone ID: PAT_TA_69665.pep

SEQ ID NO: 175248 - protein, 147 aa, Triticum aestivum
  Clone ID: PAT_TA_69666.pep
VGVPRKIPIPWFLEVQARWVAQVLSGRRELPPEEEMLRCVEENLCAREAAGVPRKLTHNIGGIEPHAIFEFGEKYCDIAPLEEWKKELMVSSVVSMMDDVETFRDLANDSENVHKGLQEWRLGAAALLKVKQNRPITTPVDTEGDGL

SEQ ID NO: 175249 - protein, 36 aa, Triticum aestivum
  unsure (1)..(36): unsure at all Xaa locations
  Clone ID: PAT_TA_69667.pep
NILVNDXGLEXESEYLXMALNLRPACRCSYFIPIGV

SEQ ID NO: 175250 - protein, 76 aa, Triticum aestivum
  unsure (1)..(76): unsure at all Xaa locations
  Clone ID: PAT_TA_69668.pep
CFXXSIGGAVDKEINTRKGPXVFRLHGXNYHHIGTLLPQDTDKPRFAQLYIYDTENEVENRISASRCNDNKPTVDP

SEQ ID NO: 175251 - protein, 34 aa, Triticum aestivum
  Clone ID: PAT_TA_69669.pep
VATKYFGFSMDEQLKVHLGDGIKFIEENAHSERN

SEQ ID NO: 175252 - protein, 71 aa, Triticum aestivum
  unsure (1)..(71): unsure at all Xaa locations
  Clone ID: PAT_TA_69670.pep
XSXXQKFXXKXXSQXXXQXXLXXXGWIVNXXEXKXXEFXMXARILXXPSXSDKXXXSIIXKXDPFPSGXLN

SEQ ID NO: 175253 - protein, 239 aa, Triticum aestivum
  Clone ID: PAT_TA_69671.pep
SSTSGILLGYISNYAFARLPLHLGWRFMLGIGAVPSVLLAVLVSGMPESPRWLVMKGRLADARVVLEKITDTPEEAEERLADIKTAAGIPDDLDGDVVVVPRKRGGEEKQVWRELILSPTPSMRRILVAALGVFLFQQLTGSDSVVLYSPRVFESAGLTGDHQLLAATCAMGVVKTLVILVAMFLLDRVGRRPLLLCSTGGIIVSLVGLATGLTVVDQNPDARIPWAVVLCGRPRVYVS

SEQ ID NO: 175254 - protein, 166 aa, Triticum aestivum
  Clone ID: PAT_TA_69672.pep
STVARAQNRQTQSPRKPNKERPLPSPEPAKSDGTHHGTANVAGGLVTASPAPAIEVHDDFRWLYDVVSVTSSTSPSEVEAADDMLLYGPMFFGKAVVEVDTAALLPDEFGGEAIGGGGGEEEDAMFAGLGELPECAIVFRRHARDGLAAMAGGVKVEQPAEGTAMT

SEQ ID NO: 175255 - protein, 171 aa, Triticum aestivum
  Clone ID: PAT_TA_69673.pep
EKINQRFIELSTVIPGLKKMDKATILSDTTRHVKELQEKIKALEAAAGRSSRSNETVVLVKKPCYAAVADENGSPSSASSGAPAAEKPLPEIEVRFSETGIMVRILCHDVKGVVVRVLSEVEEGLHLTVTHANVMPFTACTVIITITAKASFPSFIPQFGPILIFVIHSKK

SEQ ID NO: 175256 - protein, 64 aa, Triticum aestivum
  unsure (1)..(64): unsure at all Xaa locations
  Clone ID: PAT_TA_69674.pep
MMSKLGVLALFFHLRELEMDEYWVYIGYIVICGTKGNLHGILVGXVYRIEVFPDGILYAFGEPH

SEQ ID NO: 175257 - protein, 44 aa, Triticum aestivum
  unsure (1)..(44): unsure at all Xaa locations
  Clone ID: PAT_TA_69675.pep
DXKVVAXDTDREXYEVGRPFXEKAGMAHKVDFREGVRPGPSRRD

SEQ ID NO: 175258 - protein, 101 aa, Triticum aestivum
  Clone ID: PAT_TA_69676.pep
ELTRCVAGVEHRQGCWSCNEASWRHRKLRRVAMKHRRSCIEAPQRALKLCRGCFEAPLTLQWSAAGRRLCCAVLPCELVRGAGLGLQIVWLGESESGSSRP

SEQ ID NO: 175259 - protein, 180 aa, Triticum aestivum
  Clone ID: PAT_TA_69677.pep
MIPQMMPQFFIAGPQGAFPPVGGQIKPRWQPVAGGRQNNTRGGMSRGGSSQRGGGASRGGNAAKNAGRIKYNNNARNQPREQPQQTTPNTQEAQTTQAPSDQLTAEYLAKLSEQDQKQLLGERLFPLVHLREPKNAPKITGMLLDMEVSDILTLIDSPDALNQKIKEAVKVLVEHGQNDQ

SEQ ID NO: 175260 - protein, 214 aa, Triticum aestivum
  unsure (1)..(214): unsure at all Xaa locations
  Clone ID: PAT_TA_69678.pep
FKGAEIAMASYCSELQFLGNPVTNHVQSAEQHNQDVNSLGLISSRKTAEAIXHLHNARFCEKDLLLTIDREAVFAYADDPCSSNYPLMQKMRAVLVEHALANGEAERDVETSVFAKLATFEQELRAVLPREVEAARTSVENGTAAQQNRITECRSYPLYRFVRKELGTEYLTGEMTRSPGEEVDKVFVAMNQGKHIDALLECLKEWNGEPLPIC

SEQ ID NO: 175261 - protein, 40 aa, Triticum aestivum
  unsure (1)..(40): unsure at all Xaa locations
  Clone ID: PAT_TA_69679.pep
RKLTRSSXNLTTPCLDTSQRLSLTNXVPEAYTKSLGFFFF

SEQ ID NO: 175262 - protein, 100 aa, Triticum aestivum
  Clone ID: PAT_TA_69680.pep
MKKLEGTDEGDDPGTVFKKGVKLGKQLASMPEELQHWKVMGDFWAETIVYVAPSHSTAKQHMQHLENGGQFLTHIWALLSHAGILNINRDKDQGAWTEPV

SEQ ID NO: 175263 - protein, 80 aa, Triticum aestivum
  unsure (1)..(80): unsure at all Xaa locations
  Clone ID: PAT_TA_69681.pep
GGGTSXIEIXREQDQLXSIHKDRXRKGTAXAKAGPAGXAXXSSARVQDIANHLIMCSAGRLSSANRVLXSSTLHAKLSKE

SEQ ID NO: 175264 - protein, 154 aa, Triticum aestivum
  Clone ID: PAT_TA_69682.pep
LWPCSQPWPWVLPLAFLWWCSWLWPRRATGQLSSTFYDTSCPRALATINTAFATSLKANCPQSGGNGNLANLDTTTPNTFDNAYYTNLLSQKGLLHSDQVLFNNDTTDNTVRNFASNAAAFSSAFTTAMIKMGNIAPLTGTQGQIRLSCSKVNS

SEQ ID NO: 175265 - protein, 192 aa, Triticum aestivum
  unsure (1)..(192): unsure at all Xaa locations
  Clone ID: PAT_TA_69683.pep
YSYDXTYYPNMXDXWSFIFSGKTHNVESDIISLXALIHFCSXXXQELTALSELLLLEXPCXXLXSCSQRSXADXXXXPGEXFIXNXXHXGXAXXXTXXGXXXXXKPXXXXXXXRXLGCEXNXXTXPXXEXIGEDLXLMAAXCWRXXQXSLXXAXXXPQSRSFFATXSXPKVYSXLSREIXXXXPXVXXXPXK

SEQ ID NO: 175266 - protein, 37 aa, Triticum aestivum
  unsure (1)..(37): unsure at all Xaa locations
  Clone ID: PAT_TA_69684.pep
MNEXMQGGMGLRDXQISPTEPTKVCIYRAHATRCKSA

SEQ ID NO: 175267 - protein, 95 aa, Triticum aestivum
  Clone ID: PAT_TA_69685.pep
KGAGGDQRRQQYPPTMLLTADHDDRVVPSHTLKFLATMQHVLCTSVEQSPQTNPIVARIDRKSGHGCGRSTQKIIDEAADRYAFAAKTMGVSWID

SEQ ID NO: 175268 - protein, 74 aa, Triticum aestivum
  unsure (1)..(74): unsure at all Xaa locations
  Clone ID: PAT_TA_69686.pep
PLLRTDTESLIQRFKQAITERQGSPTKSSFPKPXRVPAQWSANDPNTILRVLCYRYDEAATKFLKKTYKFPKKL

SEQ ID NO: 175269 - protein, 53 aa, Triticum aestivum
  Clone ID: PAT_TA_69687.pep
VFICTVPCNWLDGKHVVFGEVVEGMDVVKNIEKVGSRSGTCSKQVVIADCGQL

SEQ ID NO: 175270 - protein, 147 aa, Triticum aestivum
  unsure (1)..(147): unsure at all Xaa locations
  Clone ID: PAT_TA_69688.pep
ETTGPNMVVDMCKGVQYLNEIKDSVVAGFQWASKEGALAEENMRXGGIYGVLNQKRGHVFEEMQRQGTPLYNIKAYLPVIESFGFSSTLRAATSGQAFPQCVFDHWDIMASDPLDPGTQSATLVTDIRKRKGLKEQMTPLSDFEDKL

SEQ ID NO: 175271 - protein, 70 aa, Triticum aestivum
  Clone ID: PAT_TA_69689.pep
SLLQCKYNNNIENQNHRLHMSVSIHDLTIIYCWGNKLRTIGTVNLRRQWSKDVCVCVCVCVFGVGSSYLA

SEQ ID NO: 175272 - protein, 103 aa, Triticum aestivum; identical to SEQ ID NO: 107316
  Clone ID: PAT_TA_69690.pep

SEQ ID NO: 175273 - protein, 39 aa, Triticum aestivum
  unsure (1)..(39): unsure at all Xaa locations
  Clone ID: PAT_TA_69691.pep
XGLGHHXRRRGAAQHPHHAPPQEGRQGQGXXXAXLPRSL

SEQ ID NO: 175274 - protein, 82 aa, Triticum aestivum
  unsure (1)..(82): unsure at all Xaa locations
  Clone ID: PAT_TA_69692.pep
QVQGNMPGGPHKLWRAPRLRDGMRAPEAVAASELVEFKRRESGGTRSTXXPFLGYMSCRVGHRDCCFRFRPGLSCRSSSLLF

SEQ ID NO: 175275 - protein, 111 aa, Triticum aestivum
  Clone ID: PAT_TA_69693.pep
GATNINTAFATSLKANCPQSGGNGNLANLDTTTPNTFDNAYYTNLLSQKGLLHSDQVLFNNDTTDNTVRNFASNAAAFSSAFTTAMIKMGNIAPLTGTQGQIRLSCSKVNS

SEQ ID NO: 175276 - protein, 235 aa, Triticum aestivum
  Clone ID: PAT_TA_69694.pep
RHEGERAQGSASSTVAEWGLVCGERYKVGLVQAIFFAGCMIGAGVFGHLSDSFLGRKGSLQVVCFLNALFGLLTALAPSYRVYVVLRLLTGFSTGSIGFCAFVLATEPIGPSRRGTAGMSSFYFFSGGIAALAGVAAMFQSSWRLLYVVTSLPSLVFVLAVMPFISESPRWYLVRRRTDDAMRVLRDIAATNGRRIPDGVTLKLDDEGDDANGGKQIEESSPSSSSGSILDVFRS

SEQ ID NO: 175277 - protein, 138 aa, Triticum aestivum
  unsure (1)..(138): unsure at all Xaa locations
  Clone ID: PAT_TA_69695.pep
AGKAWVRVRNIPIEKRCTEHVAYAGALVGITLEVDESTVHKPEYARILLGCIDVEKIPPSAEGVLGEQIYDFFYEVEKVVTMGAGKSQAYTAVDSSASPSVPKKARMDSYPASSTGQGETSASPPPRTXIREYRGFLQ

SEQ ID NO: 175278 - protein, 171 aa, Triticum aestivum
  Clone ID: PAT_TA_69696.pep
RHEGLPGDLYTMPELQRLSLQDNNLSGDLDNLGNLSQLVQIDLSYNKFTGFIPDVFGRLRKLESLNLATNGFNGTLPGSLSSCPALTVVSVRNNSLSGEITLNFSRLPRLNTFDAGSNRLSGNIPASLTRCAELKTLNLARNKLDGEIPESFKNLSSLLYLSLTGNGFTNL

SEQ ID NO: 175279 - protein, 33 aa, Triticum aestivum
  unsure (1)..(33): unsure at all Xaa locations
  Clone ID: PAT_TA_69697.pep
SLIHDGLARGLREASKALDRREAHMCVXNEACX

SEQ ID NO: 175280 - protein, 196 aa, Triticum aestivum
  Clone ID: PAT_TA_69698.pep
GSYRRVLADGYKRCSCETLAVDARGDSGYHLLMVNGYSRTKELIPTGQSITANSFNVGGHDWLIEYYPNGENPGCADFISLFLNLLYDADDDDEEPVEVRFSFSLVDQVEKQMPTYIRATGETRSFSSTTSIWGNDRFMRRDALEHSADLKCDCLTIRCDVVVVSNSRVDDDDAGGHGHGGTKALLPDIHQHFNSL

SEQ ID NO: 175281 - protein, 92 aa, Triticum aestivum
  unsure (1)..(92): unsure at all Xaa locations
  Clone ID: PAT_TA_69699.pep
ACRGRDATXRRGSVVALLELVDALLEVVELDDEGGDGEEDLDCTHSNYQTLMRPVLLFIVTTSPCQDWVICAPAAFLGCGSRFSGSLSGIEP

SEQ ID NO: 175282 - protein, 50 aa, Triticum aestivum
  Clone ID: PAT_TA_69700.pep
FFFTYVRRYIRSFPHIHRSHELNRRFILLKKYPAWKKLASRSWLLLASQA

SEQ ID NO: 175283 - protein, 64 aa, Triticum aestivum
  unsure (1)..(64): unsure at all Xaa locations
  Clone ID: PAT_TA_69701.pep
ARKQXSGKKGKRHFLHSVTGVLCESYGHLYGLHEDGQYDGVVFLASAAEAEDGDELICGRYDYD

SEQ ID NO: 175284 - protein, 266 aa, Triticum aestivum
  unsure (1)..(266): unsure at all Xaa locations
  Clone ID: PAT_TA_69702.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLADYNXQKESTXHLVLRXRXGMQIFVXTLTGXNITLEVESSEPXKNVKAKXQDXXGFPR

SEQ ID NO: 175285 - protein, 37 aa, Triticum aestivum
  Clone ID: PAT_TA_69703.pep
IQSDISLEQEIQSVIYLLFVSQLLLGYSIIVFFSQKK

SEQ ID NO: 175286 - protein, 185 aa, Triticum aestivum
  Clone ID: PAT_TA_69704.pep
RAVISLLLILSITFVFFAQSIEAAKGPKITHKVYFDITHGDEELGRITIGLYGKTVPKTAENFRALATGEKGFGYEGSTFHRVISNFMIQGGDFTKGDGTGGKSIYGAKFPDENFKLKHTRKGLLSMANSGKDTNGSQFFITTVVTSWLDGRHVVFGEVLEGYDVVEKIENVKKGPGDKPAQTVK

SEQ ID NO: 175287 - protein, 269 aa, Triticum aestivum
  unsure (1)..(269): unsure at all Xaa locations
  Clone ID: PAT_TA_69705.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIXDNVKAKIQDKEGIPPDQQRLIFAGKQLEXDGRTLXADYNIQXESTLYLXAPPPXGDGKFFGKTLTXRTLPLEVXSSDPLEXVRAKXQDXXGIX

SEQ ID NO: 175288 - protein, 299 aa, Triticum aestivum
  unsure (1)..(299): unsure at all Xaa locations
  Clone ID: PAT_TA_69706.pep
IPQPISSPVDSAPPPPVLPHRPGPQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESLDTIDNVKAKIQDKEGIPPDQQRLIFAGKQLEDGRTLADYNIQKESTLHLXLRLRGGMQIFXVKTLTGKTITLEVESSDTIDNVKXKIQDKEGIPPGTSSALIFXGKQLEDGPXPLVXYNIQXGVXPFTLAWVXXXGLXIFGKT

SEQ ID NO: 175289 - protein, 179 aa, Triticum aestivum
  Clone ID: PAT_TA_69707.pep
CPAATPRLLRRAPMMPGCDPALVAASADDARLRPRAAVCLVSASLPSPWLPCPCARHRLPLAVPPTTSLLGASRWRWLLHLCRLPSPNPPPSPHLIPKAPPSASQIKDDQGKLHRIKGFTAGPWPPWPRPMLHAAVAFLLTGRPARLLCQPARTCTARACFSSPAKLPLCVLTLLVLVR

SEQ ID NO: 175290 - protein, 156 aa, Triticum aestivum
  Clone ID: PAT_TA_69708.pep
MATDPSKYKLNHSMIRIKDPKRSVQFYEFLGMKQINQIKNPDAKFDLYFLAYDSPKAVSHGNHWTDREGIVELTHNYGTEDDPNYKISNGNTEPHKGFGHLCISVDNLQAACQRLEDAGYKFQKKLTDGRMRHIAFVLDPDGYWVEVIGQKPLEET

SEQ ID NO: 175291 - protein, 39 aa, Triticum aestivum
  Clone ID: PAT_TA_69709.pep
FFFIYMALHKFYCILSFICSMKIVGYCITVLTTRGARQY

SEQ ID NO: 175292 - protein, 46 aa, Triticum aestivum
  Clone ID: PAT_TA_69710.pep
HPHHPHSPHHHPHSHYQHIHYRCRHPHCQFQHTHSPHHDSSFFSSY

SEQ ID NO: 175293 - protein, 94 aa, Triticum aestivum
  Clone ID: PAT_TA_69711.pep
CNIQTVQCSGDLVHVHSKLQARSNPSFACQATMPARSPSARCASPTLPACADQWRGTEDQATTGSLVATTTPARGLEEQLLAEGAVELVPSCRI

SEQ ID NO: 175294 - protein, 56 aa, Triticum aestivum
  Clone ID: PAT_TA_69712.pep
SSSARVRFRASSFELCCENKLLAGRAHGHGLRREGGTNGVPSRRTGSRPEWGTDRR

SEQ ID NO: 175295 - protein, 97 aa, Triticum aestivum
  Clone ID: PAT_TA_69713.pep
CLPGDLEMQTVVDRTCLICMNFCFKYLGRHQCNSYSADLKQMDAYITGTWPPTPLTLNSSSFNLGSFLMPERDVEDDQTIFSSLGADPLLKSISVMA

SEQ ID NO: 175296 - protein, 266 aa, Triticum aestivum
  unsure (1)..(266): unsure at all Xaa locations
  Clone ID: PAT_TA_69714.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEXFPPDQQRLIFAGKQLEDGRTLADYNXQKGVTLHLVLRLRGGMQIFVKTSPGRXITLXVESXXTFXTXGQIQERXAXPRT

SEQ ID NO: 175297 - protein, 146 aa, Triticum aestivum
  Clone ID: PAT_TA_69715.pep
MHFRGSSIYFGIVALSSTSAVLGAVAPYGQCGGNGFQGETECAQGWSCVKSNDWYSQCINGGGNAPAPPAATGVAPAPVVPSAAPVPSMNASEPVAAPVAVAQPAATGGANGSTPDVAGTGANGAKCSLDAAFKSHGKKYIGVCYR

SEQ ID NO: 175298 - protein, 102 aa, Triticum aestivum
  Clone ID: PAT_TA_69716.pep
MKNAVKDDDEDEAVCDLHFIAGCQSCKAWDKEEEEESDDDAGWMSHSLSFAKDRLGKDLEWKRKNEEELLVIDPLEEAKRHKAATRGKREWDGGKDKKKMKA

SEQ ID NO: 175299 - protein, 61 aa, Triticum aestivum
  unsure (1)..(61): unsure at all Xaa locations
  Clone ID: PAT_TA_69717.pep
FAXTRMFASPIRPRTMTKEWQEATEEYMKSQGTEPITGYKGMMVQSKSEKDLPAGQKLNDE

SEQ ID NO: 175300 - protein, 134 aa, Triticum aestivum
  Clone ID: PAT_TA_69718.pep
GTRERLAAAATGKPPPSPLWSASVHRSCLLRPATATPPALLPSTLCPSGWGDGAGVAILLLPGSRLRPQDLHLPMTTTARRSCSSSSKIQEPSLLFEFCITRTNTKEHPSFAVVFLPNYHGLTMLLSHQLLIYC

SEQ ID NO: 175301 - protein, 196 aa, Triticum aestivum
  Clone ID: PAT_TA_69719.pep
MPSMGRSQTLGGQPPLLPRDQLKRKPIVAHVQKETGNDVMVSTEGLLQAQLELYHHAMAYVKSAALRAAADLRIPDAIHRCGGAATLSDIATEIGVQPTKVSHLRRLMRALTILGIFLVGQGPNGEATDVHYKLTSVSRLLLEGSSCTQSPIVRVLVDPLSLTALCSIGEWFTDERASALTLFEVAHGCTREEMTA

SEQ ID NO: 175302 - protein, 34 aa, Triticum aestivum
  unsure (1)..(34): unsure at all Xaa locations
  Clone ID: PAT_TA_69720.pep
VPAIFTDFCXEAAHLASCCISSITGQPLGLPIQV

SEQ ID NO: 175303 - protein, 214 aa, Triticum aestivum
  unsure (1)..(214): unsure at all Xaa locations
  Clone ID: PAT_TA_69721.pep
EFGTRELSRVFCKXRTRVRKAVRLSREKALKLEASKTALKLEASKTATNVCSLNTEQTPLDIETHAQVVEPLSTLEPLEMFQSSSQLAEAPQSSLQQPEVQQCTATPIPITPTGSIQPTDAKINPDSVQKETKQEEVAPGVESEDKKFLDSIFALMQKEETFSGQVKLMEWILQINNATILSWFLTMGGLTIVSTWLSQAATEEQTTVILVIFK

SEQ ID NO: 175304 - protein, 204 aa, Triticum aestivum
  Clone ID: PAT_TA_69722.pep
IARLEPCIMCQSHQLALAIRRNATRYPTSSCDFATSMRVQNYATKQRIDAPRLRADVDARGRLGFYTLTKHEGIHKIEPRTAMSIYDDFVAHKNTMPHGKNVLRIVNKYNVPLNDVASLAIVTFKIPDIGDAAKRAQLPPSQHKNTAGLLLQGCAQSGDPLAITHILTAVYLGGSGHSSAQEITRLFPKQEIAQYRLSLDAIDL

SEQ ID NO: 175305 - protein, 184 aa, Triticum aestivum
  unsure (1)..(184): unsure at all Xaa locations
  Clone ID: PAT_TA_69723.pep
RNSDEGAMCDGMRRPMYSIIGLLXMVRQAEDMRPEQRLVADAIARTSTLSLALMNDVDTETLTVNRMPFDLRSLMREAMSVAGCLASCGGAGFSYQLENALPEWVVGDETRVFHHLLQMAGDVLGQRRDGAGRLSFSIKSCSADQKDCIPVCPNLSAGCSICVEFQVAMERSTGCSQPPSSPAS

SEQ ID NO: 175306 - protein, 49 aa, Triticum aestivum
  Clone ID: PAT_TA_69724.pep
CFIYYNKAALRLQLDVIIGTKTSHHGLNIVGYRRATCAFTKGCNNANWS

SEQ ID NO: 175307 - protein, 91 aa, Triticum aestivum
  Clone ID: PAT_TA_69725.pep
MEVWLKLVTTTSSWRRRKTRHEGQKMVWNVVVIVRAPLRNKEKGACRETISRVTGGMKVKADRDESSPYAAMLAAQDVAARCKELGITALH

SEQ ID NO: 175308 - protein, 148 aa, Triticum aestivum
  unsure (1)..(148): unsure at all Xaa locations
  Clone ID: PAT_TA_69726.pep
NFDLNKVFDSHAGIAHTRWATHGPPSRVNCHPHRSDPNWEFSVVHNGIITNYKXELKTLLESKGFKFETETDTEAIAKLTKYIYSEHPDLSFPSLVKAVIKELQGAFGLLLKSVHYPHEVVAARKGSPLVIGVRTQKKMKVDFVDVRV

SEQ ID NO: 175309 - protein, 185 aa, Triticum aestivum
  unsure (1)..(185): unsure at all Xaa locations
  Clone ID: PAT_TA_69727.pep
LPTAPCSLEHDRPRHHRQRPLTRRSIQKWLDAGQRTCPKTQQPLAHLSLAPNFALKNLILQWCEKNKVXMQTRADEPPVEEVSKEVLIPSLVKDLSSPNLDVQRXAAKKIRTLSKESPEDRTLIXDXDGIAALXGLLLYPDKKIQDNAXTSXLNLSIDEANKXLIAKGNAIPLIIEXLKNGNXXG

SEQ ID NO: 175310 - protein, 101 aa, Triticum aestivum
  unsure (1)..(101): unsure at all Xaa locations
  Clone ID: PAT_TA_69728.pep
VFXLRRXLGAAPAGHHALPAQRCSARRRGLEDGRQGRQRDPAPASCSSSATSRHLXIRCCKGCSSGAILQEFLRGSRQCPSPLLPLCYXCLVRPATSTEFE

SEQ ID NO: 175311 - protein, 145 aa, Triticum aestivum; identical to SEQ ID NO: 141714
  Clone ID: PAT_TA_69729.pep

SEQ ID NO: 175312 - protein, 196 aa, Triticum aestivum
  Clone ID: PAT_TA_69730.pep
MPGMDNHAAAQGIKDDRSGVNSAAQEAPKKVEVEKQVLDSREKLEYYRTKMQDLVLYKSRCDNRLNEITERASSDKLEVELLSKKYEEKYKQVAELASKLAVEEAAFRDVQERKVELNDALIKMVQGGSVDGLLQVRADRIQHQLEEMEKAFNERCKHFGLQFKPSATVELPFGWEPGQQEGAVEWDEDWDKFEDE

SEQ ID NO: 175313 - protein, 237 aa, Triticum aestivum
  Clone ID: PAT_TA_69731.pep
FDAQDGMQKLLNILQVAASVRSGGNSGALGSSNANQGNDRSPAEILTQSEKQVAYHSCVALRQYFRAHLLQLVDSIRPSKSIRSIARNTSSARAGYKPFDIGNEAMDAIFRQVQRDRKLGPALVRARWPVMDKFLASNGHIILLELCQSLPADRYLHDLAQYAFGVLHIITLMPHSRKLMVHATLTNNRIGMAVILDIANSVVGYVDPEVICPALNVLVNLVCPPPSISNKPSSAVN

SEQ ID NO: 175314 - protein, 281 aa, Triticum aestivum
  unsure (1)..(281): unsure at all Xaa locations
  Clone ID: PAT_TA_69732.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRXRXGMQIFVKTLXGRPLLWEXESSDTIDNVKVKIQDXEGIPPDPQRLXFXGKXLGGW

SEQ ID NO: 175315 - protein, 146 aa, Triticum aestivum
  Clone ID: PAT_TA_69733.pep
QTQHLQPQQPISQQQAQQQQQQQQQQQILQQILQQQQLIPCRDVIVLQQHNIAHESSQVLQQSSYQVLQQLCCQQLRQIPEQSRCQAINNVVHAIILHQQQQQQGQHQQSSQVSYQQPQQQYPSGQGSFQPSQQNPQAQGFVQPQH

SEQ ID NO: 175316 - protein, 92 aa, Triticum aestivum
  unsure (1)..(92): unsure at all Xaa locations
  Clone ID: PAT_TA_69734.pep
FFLRTLPXYIIQETTRRARHKKKTDSTSTHRFIRTQSTNPAPHRCAPPRAYARCTTLDGGRRGRYAYGRSWLSRAAVVTASATPPGVVVRSS

SEQ ID NO: 175317 - protein, 269 aa, Triticum aestivum
  unsure (1)..(269): unsure at all Xaa locations
  Clone ID: PAT_TA_69735.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESFDTIDNVKAKIQDKEGIPPDQQRLIFAGKQLEDGRTLADYNIQKESTLHLVLRLRFCMQXFVKTLTXKTITLEVEXSDTIDNVKAKIQDKEGIPXDQQRXIFAGKQLEDXRTLADYNIXKESTLHLVLRLCFKTLTGKTITLEVESXDTXXXXKAKIQDKXGIPPDXXRXIFXG

SEQ ID NO: 175318 - protein, 92 aa, Triticum aestivum
  unsure (1)..(92): unsure at all Xaa locations
  Clone ID: PAT_TA_69736.pep
FFFAWIKRTEKTRICKLCHPWNKADWEHVAVKMADSRNANNSAINQAVSTRGRRNFCRASLLSTHCPLQTQTCSRHHHRPTRRPPLVPNXLQ

SEQ ID NO: 175319 - protein, 80 aa, Triticum aestivum
  unsure (1)..(80): unsure at all Xaa locations
  Clone ID: PAT_TA_69737.pep
MKSVASIAAAAMLSGSANAFWRMPCHDRTALARLDPIVDEGTAXSHAHTIHGGSNFAETTTYDMLRESECTSCQFDDDKS

SEQ ID NO: 175320 - protein, 196 aa, Triticum aestivum
  Clone ID: PAT_TA_69738.pep
PPAIQPASTNEQHSNTALRMLDELRLASPVLREFLRSLPAVDAIVLDMFCVDALDVAAELAVPAYMFYASAAADLAIYLQVPDVFRAAPFSFKDMGDAALPFSGVPPVRALDMPDTMSDRESDLCKRRVQQLARMPEARGILVNSFEWLESRAVKALRDGLCVSGGRSTPQIYCIGPLVDGGASGQSGERHACLEW

SEQ ID NO: 175321 - protein, 92 aa, Triticum aestivum
  unsure (1)..(92): unsure at all Xaa locations
  Clone ID: PAT_TA_69739.pep
KVTFRHPFRXKHQKELFVAXEGMYTXQFVYCGRRATLSVGNVLPLRSVPEGGVICNVEHHVGDRGVFARASGDYAIVISHNPDNGTSRIKLP

SEQ ID NO: 175322 - protein, 165 aa, Triticum aestivum
  Clone ID: PAT_TA_69740.pep
PQFLAGEHSVLQVIGKEIVALALRQKNTTAVEKLLSAKSGSTIMACISCAEELERKAEQEEQEGGKGEREREEEERERKQREEEERKKREEEERARREKERKQREEEQRKREEEERERREEKERKQREEEERARREKERKEREEEEAARREQEEEEERRRREEEE

SEQ ID NO: 175323 - protein, 52 aa, Triticum aestivum
  Clone ID: PAT_TA_69741.pep
PVSILNHLPTCGLTSLLWDDFYYPSCLFTWVNQVQQVRSELVVEDWALLRRS

SEQ ID NO: 175324 - protein, 195 aa, Triticum aestivum
  Clone ID: PAT_TA_69742.pep
KYKFGKTLGAGTYGIVREAESPQGKCAVKIILKKNVKGNDQMVYDELQMLQRLQHPHIVKFFDWFESRDKYYIVTQLATGGELFDRICEKGRFTEKDASATIRQVLEAVDYLHQNDVVHRDLKPENLLYLTKADDSTLVLADFGIAKHLDSPDGVLKTMAGSFGYAAPEVMLKKGHSKPVDMWSLGVITYTLLCG

SEQ ID NO: 175325 - protein, 125 aa, Triticum aestivum
  unsure (1)..(125): unsure at all Xaa locations
  Clone ID: PAT_TA_69743.pep
SAPPTRPPXSSPPRCTSPCQRXVSXPPTSRRSTRPLLPPPAQSSGPARPCLPPTSDQPLLHLSPPKPAXTPTQPPPSAPIPATSAIVGPXPPPPPPDPAHXLPXLVPTTSVDLVTASGQYSRLDL

SEQ ID NO: 175326 - protein, 287 aa, Triticum aestivum
  unsure (1)..(287): unsure at all Xaa locations
  Clone ID: PAT_TA_69744.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRXIXAGKQLEDGRTLADYNIQKESTLHLVLRLRXGGMQIFVKTLTGKTITLEVESSDTIDNVKAKIQDKEGIPPDQQRLIFAGKQLEDXRTLADYNXQKXESTLHLVLRLGGGGMQNXSXXTLTGEDHHSWRLRGSDTIDNXKGQXSXDKXGHXPRTNSALIFWQATGRM

SEQ ID NO: 175327 - protein, 83 aa, Triticum aestivum
  Clone ID: PAT_TA_69745.pep
ASNGVRRIYFKLPPCHRHRVVVVGRRPPDGRSIPISQEELMEGMTLNGRRHILPPGQAGCDEQGLVLHQFCCKQLLALFSVKN

SEQ ID NO: 175328 - protein, 187 aa, Triticum aestivum
  unsure (1)..(187): unsure at all Xaa locations
  Clone ID: PAT_TA_69746.pep
AVARRVRSSXKAYGSALYWVSPTVISAVVLAGTAAVQSAPLDAGVVFTVLATMRVVSEPMRMLPEVMSVMIQVKVSLDRIGKFLTEDEFQDDAVDRAPASDRSCLDVHHGVFSWEPSKGTATLKDINITATHGQKIAVCGPVGAGKSSLLCATLGEIPRMSGSVAVSGSVAYVSQTSWIQSGTVRDN

SEQ ID NO: 175329 - protein, 44 aa, Triticum aestivum
  unsure (1)..(44): unsure at all Xaa locations
  Clone ID: PAT_TA_69747.pep
FFLNLVTANCDQSVHMRYASRSTSNIQMNFQRKLHGRVXEDXKP

SEQ ID NO: 175330 - protein, 207 aa, Triticum aestivum
  unsure (1)..(207): unsure at all Xaa locations
  Clone ID: PAT_TA_69748.pep
LKLXIQSNIYRYIGILLEGRERFEEEVLADRRKLCQHDPSSSGRPESGFCDEEVTEYSIVPRLKAFSDWILKAMALGNLEDIFPAASREYAPLVEELWKDPAIQATYRRRNELPFLPSAASYFLDRVVDISRTEYELCDIDILYADGITSSDGLASTDISFPQLALDVRXADELDPQDTLLRYQLIRINNKGLRENSKWLQMFDDXS

SEQ ID NO: 175331 - protein, 56 aa, Triticum aestivum
  unsure (1)..(56): unsure at all Xaa locations
  Clone ID: PAT_TA_69749.pep
FGQXKQXXSXXXQPXEGXVAXPWNXLXICXXSICRLQVXATPPLLIXHQSDLKEQA

SEQ ID NO: 175332 - protein, 202 aa, Triticum aestivum
  Clone ID: PAT_TA_69750.pep
IAALAAVAGAQSTTSIDIDAISVAIPTSVFVLPVVYVTAENAPTLTATTLATTATPSSDPKATAVFDSAADVTAAIVSASEAAAASATASVEKRDGTCIQQPLGISHASLPDTAAAFASDAWYGVQAVAAGTPTGFVQTFSNLTASNSADAYMGFTLLSSYDVPTCGAKCSAISGCNSFNIYFERDPQYDPSVAACNNPAST

SEQ ID NO: 175333 - protein, 145 aa, Triticum aestivum
  Clone ID: PAT_TA_69751.pep
KIISLDMDVKWCLCRLFLHLRYQFLDGGTTGPRPGSLDQSGGGGPAAAAAAAAGVGATRPLLPVASNHRPLGVRAPAAAFVQHRCLQGPRWEACSAHRRDDPEAPPPGGAPTPLAWSRITSSRGRPEASEGDGESVREGGAAREH

SEQ ID NO: 175334 - protein, 212 aa, Triticum aestivum
  Clone ID: PAT_TA_69752.pep
TLLIEGTFEELTDEFAQYIDSLKKSQGDESANLQGESADLLKENKKDDVLKKLVVGSQALNQAPEKEFIAAYNLLIHLVNQSPNVSVFIPKMCQNLSTPISSSPQNGGGLALSILSTIFNTTQPESETRYHVLLAILRVIRATSNFETLRPQLKQLDSWIAAWQTGEENARKLYLAVSDVASDAGEDEQAYTYLLRALRTFPSEQASSPEAR

SEQ ID NO: 175335 - protein, 185 aa, Triticum aestivum
  Clone ID: PAT_TA_69753.pep
MESGEKKTKKVKPPKITSRLSRLGIHTRGIKFKSLEQPEACMPNHIFSLSEKAALAIQRTMPKALFTHNKDFLMRTYPHGMRFDSSNFDPVIFWRAGVQVVALNWQSWDAGMILNEGMFAGSDGYILKPKGYRRENPQDSIPAREASAGSDIVSKRLDRLAITIYAAQNLPLYQQGDDPASYAPY

SEQ ID NO: 175336 - protein, 73 aa, Triticum aestivum
  Clone ID: PAT_TA_69754.pep
HHVFLMYYYVSRPITVWRFLSRHRSGRMNIISEKDGRDQLYTPRKLLNSTRYTKRELDSLPNSKLSLCVYSVA

SEQ ID NO: 175337 - protein, 144 aa, Triticum aestivum
  unsure (1)..(144): unsure at all Xaa locations
  Clone ID: PAT_TA_69755.pep
VSFSFPVPRVSFTRGPVASPSSNAKLRXXDVYIGYHNNGNLGRFCKWLKAELELQGIASFVADRAKYSDTQIHEIADRIICSVAFGVVVVTMSSFLNPFSLEEIRFFAQKKNLIPILFDTEPSEIAGLFDGKLEDKEGKEAFEG

SEQ ID NO: 175338 - protein, 196 aa, Triticum aestivum
  Clone ID: PAT_TA_69756.pep
MGSNKEEINVDVLVIGAGPTGLGAAKRLNQIDGPSWMIVDSNPIPGGLASTDTTPEGFLYDVGGHVIFSHYKYFDDVIDEALPKEDDWFTHQRISYVRCKTQWVPYPFQNNLSMLGKDDQAKCVDGLIDAALEARVANTKPKDFDGWILRQMGVGIADLFMRPYNYKVWAVPTTKMQCAWLGERVAAPNVKGVINN

SEQ ID NO: 175339 - protein, 87 aa, Triticum aestivum
  unsure (1)..(87): unsure at all Xaa locations
  Clone ID: PAT_TA_69757.pep
RPPAPPPPPPSATPSPQRDGVHQTXKTRAYSKRFQVKFKRRRQGKTDYRARLRLTNQDKNKYNTPKYRFVVRFTNKDVTAQIVYATI

SEQ ID NO: 175340 - protein, 79 aa, Triticum aestivum
  unsure (1)..(79): unsure at all Xaa locations
  Clone ID: PAT_TA_69758.pep
TTGPPXRPGRRGGAPPRQQHPPXLAATPPLHHRHPSVHHPAPPLHHPPSAPPPEPRTTSNPRRRHPPLPLFPLASPLLL

SEQ ID NO: 175341 - protein, 37 aa, Triticum aestivum
  unsure (1)..(37): unsure at all Xaa locations
  Clone ID: PAT_TA_69759.pep
YTLRLTNNYVNTYYAGRRRLPXHGATATAETMLFDAA

SEQ ID NO: 175342 - protein, 199 aa, Triticum aestivum
  Clone ID: PAT_TA_69760.pep
RELAAGGRTGNMLYDWFIGRELNPRINLPIFGEVDIKAWCELRPGMLGWIILDLAFIMQQYRNFGRVTDSIIIVTVAHTVYTFDALYMEPAILTTIDLIADGFGMMLSFGDLVWVPFTYSIQTRYLSIYPVDLGPMGVVGVLAVQGIGYYIFRSVNNEKNRFRTNPEDPRVKHLKYIETAAGSRLLVSGWWGMARHINY

SEQ ID NO: 175343 - protein, 151 aa, Triticum aestivum
  Clone ID: PAT_TA_69761.pep
MDSPAPNAANPPPAAAEPATQPRRLPDFLQSVRLKYVKLGYHHLISHGTYLLLSPLMALVAVQLSTVSPGDLADLWEQLRFNLVSVLVCSTLLVFLSTVYFLTRPRPVYLVDFACYKPEPERRCTRQTFMRCSEATGSFTDANLDFQRKIL

SEQ ID NO: 175344 - protein, 64 aa, Triticum aestivum
  unsure (1)..(64): unsure at all Xaa locations
  Clone ID: PAT_TA_69762.pep
PXPXXCXPXVRRSAXAASPRSGRXXDRXGSPASPRRRVAACPCPCGTPSCAXPSXAAGXXVLLL

SEQ ID NO: 175345 - protein, 213 aa, Triticum aestivum
  unsure (1)..(213): unsure at all Xaa locations
  Clone ID: PAT_TA_69763.pep
XFGTRKDXTFGRRDFDSTYLSDSDLSDTFSGLRLSNRASFDERSHEKELLDEMLMHRRYFNSNMADDSRLPSAGNAFHSPRSKHMDFRPTRRNCLRRQNSSIDAPNVPRMNHHHMDNFDQLSFAGRLTLMQSGNLRGEANYLRDAATTNMINPLSSRNNTITDLDLARNRRAYLEDQFARQCLQNESSYVPKSGLSYSGNRLYHDEPCFPSSR

SEQ ID NO: 175346 - protein, 109 aa, Triticum aestivum
  unsure (1)..(109): unsure at all Xaa locations
  Clone ID: PAT_TA_69764.pep
NXXXRPXPXXAXXIXGXLXXFXNXWXAXMLXNXXLXXXLXTXXXELXXALYXHDAXXXVIXRXKXERDXXXALXXLXXRQIXXXMXXXAPAXXXXNGKRXXXDEXGPDG

SEQ ID NO: 175347 - protein, 256 aa, Triticum aestivum
  unsure (1)..(256): unsure at all Xaa locations
  Clone ID: PAT_TA_69765.pep
MKTFLILALLAIVATTATIAVRVPVPQLQPQNPSQQQPQEQVPLVQQQQFPGQQQPFPPQQPYPQPQPFPSQQPYLQLQPFPQPQLPYPQPQLPYPQPQLPYPQPQPFRPQQPYPQSQPQYSQPQQPISQQQQQQQQQQQKQQQQQQQQQILQQILQQQLIPCRDVVLQQHSIAYGSSQVLQQSTYQLVQQLCCQQLWQIPEQSRCQAIHNGGHAIILHXQQQQQQQQQQILQQILQQQQLIHAGCHRLATTQHSA

SEQ ID NO: 175348 - protein, 204 aa, Triticum aestivum
  Clone ID: PAT_TA_69766.pep
NLYISGMKLTSATFASAMTNLIPAITFVLAVLFRYERLAIRTLAGLAKVTGTLLGVGGAMLLTFYKGAQVTPWPPTHINLAAQLAARHQHEEHASSSLHPDSGNRAMGCLLCTGSCFFYALWLILQARLSREYPFHYSTTALMCGMSALQSAAFALCFDRDLIQWRLSSGVRLLAVLYTGVVASGVMLVVLSWCVKRRGPLFAS

SEQ ID NO: 175349 - protein, 137 aa, Triticum aestivum
  Clone ID: PAT_TA_69767.pep
MAQKCPDSVIVSSGYSQGAAVNHRAIEELDAAVMDQIAGVVTYGDTQKLQDRDQIPNFPKEKVKIICQPGDAVCLGTLSVLPAHLTYGVRANEGVEFLVQQIKGAQAKIKARNAKREAKAAAAVEDAVKRVAQEMAV

SEQ ID NO: 175350 - protein, 181 aa, Triticum aestivum
  Clone ID: PAT_TA_69768.pep
MRKLFFSELTSCKETKLQSATHSWLPMDKGKLSKFTGHSSSSSSSIESLMKMPEPPVLPHFKPADYVDILAQIHEELEYCPPDEKSCLYLLQFQVFRGLGEAKLSRRSLQAAWEKASTIHEKLIFGAWLKYEKRGEEPISDLLGSCGKCSQEFKLLDFVSQISAESHGISYDDESDEFQGS

SEQ ID NO: 175351 - protein, 93 aa, Triticum aestivum
  Clone ID: PAT_TA_69769.pep
VEAVDRGTVVGEKQQQEVLRTTTCRLSRGATGARANAHGSGAADHRVQLVRVLQLRRVLLFRGRVVQPPPPGPHPDHHARRATRARAIEEDQE

SEQ ID NO: 175352 - protein, 135 aa, Triticum aestivum
  Clone ID: PAT_TA_69770.pep
HARPRRDQHLCPLAASSDRLENLDMLAIHMVLLSGMILPELGEFLASQQVVSILHIYASACNRFLSLLRRALTASACKHTEPCQRPPRMVDLQATCLVLAASESCVPCAGRHHDCQHHRVRPHWPEASPYVVVMP

SEQ ID NO: 175353 - protein, 91 aa, Triticum aestivum
  Clone ID: PAT_TA_69771.pep
MKFTSVIGALGASNLLFTSVGAVELDINSPDSIKQAARAISANLRSYYTGDNVGDTPGNLPDPYYWWECGAMFNALIDYWYYTGDDTYNKI

SEQ ID NO: 175354 - protein, 130 aa, Triticum aestivum
  Clone ID: PAT_TA_69772.pep
MIKVENIEENRRQYRHLLMSTKTDISEYLGGIILFHETLYQKDDSGKLLKDLMVEKGIAIGIKVDKGVVKLLGTKDETTTQGLDGLGDRCAQYKADGCDFAKWRCVLKITDSTPSQLAIDENANVLARYA

SEQ ID NO: 175355 - protein, 109 aa, Triticum aestivum
  unsure (1)..(109): unsure at all Xaa locations
  Clone ID: PAT_TA_69773.pep
LNWRGLCTTAIRRSISSAESSPAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 175356 - protein, 195 aa, Triticum aestivum
  Clone ID: PAT_TA_69774.pep
PYQILPLTRMDVVIGGHLEKNLSIYNPFDDSLYVEEVAVWMSASESTKQSSHVVCQLGPLDEAVELTSLSSNWHTASSTEFGWPVIHIRPSEQWEVLPSESSTVIELKLQPISEGKVFGAIYMKLRNHTTDKVDIVVIPIELEVHTRTYYDSTNLVSVTFERISSCAGNGSIYSLSLRNDATELLKVVSVTGDNR

SEQ ID NO: 175357 - protein, 225 aa, Triticum aestivum
  Clone ID: PAT_TA_69775.pep
ALSVRLVKELVTLCSNPSLTTPDISFAGRHLSAAEFHSVLQTVGTGSDTEAPAGQNDVVVLDARNLYETRIGKFHVPNVETLHPEIRQYSDLPLWIDEHTEKLRGKSIMMYCTGGIRCEMASAYIRSKGEGFENVFQLYGGIQRYLEQYPDGGYFDGKNFVFDHRISVGSNKDNILGTCLICGSTYDDYSSRCRCSNCRMLVLVCSTCQDSNKEYVCELCLKNGK

SEQ ID NO: 175358 - protein, 55 aa, Triticum aestivum
  Clone ID: PAT_TA_69776.pep
EQSRCGCSTCTWSTPNNNCCFCCCPRRYLFFFLRKTCCCSVNKRLYQFMRCCSIK

SEQ ID NO: 175359 - protein, 224 aa, Triticum aestivum
  unsure (1)..(224): unsure at all Xaa locations
  Clone ID: PAT_TA_69777.pep
QQLGQGQQGYYPTSLQQSGQGQPGYYPTSLQQLGQGQSGYYPTSPXQPGQGQQPGQLQQPAQGXQPEQGQQGQQXGQGQQGXAXRYKGSNRLQGXPGYYPTYXHQSGQGHPGXYPTYSQQPXQXQQPGQGXQGXXVGQGQQAHQXGQGHQPXQGQPGYYXTYALQXXQGXXGYYLTSAXQAGQGHXAGXQXHQXAQGQKGXQPGQXQXPGQGQXQGQXAXQGXQ

SEQ ID NO: 175360 - protein, 122 aa, Triticum aestivum
  Clone ID: PAT_TA_69778.pep
SESLLEVLLYELVYSKKQFNKPNPLNMPSVSTILKGLVALAPLVAAAPANYARQESASKSSSMVMSSATPAAAAITETAGEAASPAAAAPAAAATLSDVDILNFALTAEHLESEYYKQGFAK

SEQ ID NO: 175361 - protein, 138 aa, Triticum aestivum
  unsure (1)..(138): unsure at all Xaa locations
  Clone ID: PAT_TA_69779.pep
RGXFVCEXAGEFLTTEEARRRHRLYDELASVGKLSPALLVIREHLPSGRVCMRVNIDATKVGNVARFINHSCDGGNLRPILVRSSGSLLPRLCLFAARDIVDGEELAFSYGDAKPNPKGLPCFCESSCCPGVLPAEET

SEQ ID NO: 175362 - protein, 197 aa, Triticum aestivum
  Clone ID: PAT_TA_69780.pep
EEFGTRNREAEEIFVVPTQKLKEITDHFVKELEKGLSEEGGSIPMNPTWCMAFPDGHETGRYLALDMGGTNLRVCEVTLTEEKGEFEIIQSKYRMPEELKTGTADELWGYVADCLQQFVEYHHEDEELEDLPLGFTFSYPATQEYIDHGVLQRWTKGFDIDGVEGHDVVPPFNKALAERGVPIKLAALVNDTTGTMI

SEQ ID NO: 175363 - protein, 288 aa, Triticum aestivum
  unsure (1)..(288): unsure at all Xaa locations
  Clone ID: PAT_TA_69781.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVXLRLRGGMQIFVKTLTGKTVTLEVESSDTIDNVKAKIQDKEGIPPXDQQRLIFAGKQLEDGRTLXADYNIQKESTLHLXLXLXRGGMQIFVKTLTRQDHLRLRGESXDTIDNVXGQXSXDKXGXPPDQXXPXFXGXXXEEGP

SEQ ID NO: 175364 - protein, 175 aa, Triticum aestivum
  Clone ID: PAT_TA_69782.pep
MATETETFAFQAEINQLLSLIINTFYSNKEIFLRELISNSSEALAAGADVSMIGQFGVGFYSAYLVAERVVVTTKHNDDEQYVWESQAGGSFTVTRDTSGEQLGRGTKMVLYLKDDQMEYLEERRIKDLVKKHSEFISYPISLWTEKTTEKEISDDEDEEEKKDTEEGKVEDVDE

SEQ ID NO: 175365 - protein, 208 aa, Triticum aestivum
  Clone ID: PAT_TA_69783.pep
ANSARGNNQFSQQQQPPYSQQQQPPYSQQQQPPFSQQQQPPFSQQQQPPFLQQQQQPPFTQQQQPSFSQQPPISQQQQQQQQQQQPFTQQQQPPFSQQPPISQQQQPPFSQQQQPPFSQQQQIPVIHPSVLQQLNPCKVFLQQQCIPVAMQRCLARSQMLQQSICHVMQQQCCQQLRQIPEQSRHESIRAIIYSIILQQQQQQQQQQQ

SEQ ID NO: 175366 - protein, 42 aa, Triticum aestivum
  Clone ID: PAT_TA_69784.pep
APQRRRPAIMMSSETRATARQTVMKVSSICATTLAMVGRRPR

SEQ ID NO: 175367 - protein, 153 aa, Triticum aestivum
  Clone ID: PAT_TA_69785.pep
MASIARRIGRYAHRLQKNLPAVCSRVVGPITTSKRTAYWYPNYEYLKDFENMEVPTASDPAPKTDLLQDISDPAEGASKLDTLTINFGPQHPAAHGVLRLILELAGEMVIRADPHIGLLHRGTEKLIEYKTYTQALPYFDRLDYVSMMINEQA

SEQ ID NO: 175368 - protein, 150 aa, Triticum aestivum
  Clone ID: PAT_TA_69786.pep
LRLVIKETLRLHPPAPLLIPREAMESCKILGYDVQKGTTVLVNAWAIGRDPKHWDNPEEFKPERFESGIIDFKGTDFEYIPFGAGRRMCPGMTFAQASMEIVLAALLYHFDWELPSGLKPGEVDMVEDMGITVRRKNDLYLHSIVHVSPV

SEQ ID NO: 175369 - protein, 116 aa, Triticum aestivum; identical to SEQ ID NO: 134378
  Clone ID: PAT_TA_69787.pep

SEQ ID NO: 175370 - protein, 116 aa, Triticum aestivum; identical to SEQ ID NO: 134375
  Clone ID: PAT_TA_69788.pep

SEQ ID NO: 175371 - protein, 95 aa, Triticum aestivum
  unsure (1)..(95): unsure at all Xaa locations
  Clone ID: PAT_TA_69789.pep
CSVYTVESPSGSPIHDCMSGEKXVSHRQKQKLERVENVAANRMRKRNLEGLLKGEDREKLQAGVKRLAHAAAALADRSFPRGRLLLGDNEGIQIG

SEQ ID NO: 175372 - protein, 42 aa, Triticum aestivum
  Clone ID: PAT_TA_69790.pep
YLLLIEILKSNKRGALDPKAACTSGQLNLSLTFPLDSIQYST

SEQ ID NO: 175373 - protein, 116 aa, Triticum aestivum; identical to SEQ ID NO: 134378
  Clone ID: PAT_TA_69791.pep

SEQ ID NO: 175374 - protein, 102 aa, Triticum aestivum
  Clone ID: PAT_TA_69792.pep
CGYCGEEFSNPADWEARSEHLNHVHKFGECNQAKKFFRADHFRQHLKHSHAGTSGKWTNMLENACMRDEPPPQERVGSMGSISGSSSFAPKPGVINEAHDEA

SEQ ID NO: 175375 - protein, 82 aa, Triticum aestivum
  Clone ID: PAT_TA_69793.pep
LKFICVKQLSQRMCVGSVASTLALAEQHHCHGLKVACLKFIQVQSPSCLQTLMTSNGWGHILTTYPSVLNELIAMLASNQRK

SEQ ID NO: 175376 - protein, 44 aa, Triticum aestivum
  unsure (1)..(44): unsure at all Xaa locations
  Clone ID: PAT_TA_69794.pep
KQLSGKKGKRHFXHSXTGVXCESYGHLYXLXEDXQYDGVVFLAS

SEQ ID NO: 175377 - protein, 84 aa, Triticum aestivum
  unsure (1)..(84): unsure at all Xaa locations
  Clone ID: PAT_TA_69795.pep
VHXQLPNPKFYVNNPSQGNHPTLCPCLRELGTVDRQDMRECGSSDPTKYSQTNAKVIYKKCTSALSRCRSRNRNRCQSRSCCQG

SEQ ID NO: 175378 - protein, 98 aa, Triticum aestivum
  unsure (1)..(98): unsure at all Xaa locations
  Clone ID: PAT_TA_69796.pep
LCPFFKIYTELLNLPFLATNSISLRQHHPRRISSTLLRSPRPLPPSPSXPGMAVATGSADGLSMGQKFFFVGAIVAVCVLFLKSRNGGQSNIVGGPRR

SEQ ID NO: 175379 - protein, 148 aa, Triticum aestivum
  Clone ID: PAT_TA_69797.pep
IRVKDKDASLSFYQDVMGMKLKRTSESPNAGFNLYFLGYGVDAPETTANGVNPVSDSEGLLELTWNYGTEKDAEFKYHNGNDEPQGFGHICIAVDDLDAACARFEEKKVNWKKRLTDGRMKNIAFVLDPDNYWIEVVQNEKLKTRSNW

SEQ ID NO: 175380 - protein, 116 aa, Triticum aestivum; identical to SEQ ID NO: 134378
  Clone ID: PAT_TA_69798.pep

SEQ ID NO: 175381 - protein, 116 aa, Triticum aestivum; identical to SEQ ID NO: 134378
  Clone ID: PAT_TA_69799.pep

SEQ ID NO: 175382 - protein, 116 aa, Triticum aestivum; identical to SEQ ID NO: 134378
  Clone ID: PAT_TA_69800.pep

SEQ ID NO: 175383 - protein, 135 aa, Triticum aestivum
  Clone ID: PAT_TA_69801.pep
MKVTVLLAALATAAVADIVNNEHLKTEVLTEAKCTRKTKVGDKVNVHYRGTLLDGSEFDASYNRGSPLNFAVGTGQVIKGWDQGLLDMCPGEKRKLTIQPEWAYGSRGAGPIPANSVLIFESELVSIEGVDKEEL

SEQ ID NO: 175384 - protein, 116 aa, Triticum aestivum; identical to SEQ ID NO: 134375
  Clone ID: PAT_TA_69802.pep

SEQ ID NO: 175385 - protein, 169 aa, Triticum aestivum
  unsure (1)..(169): unsure at all Xaa locations
  Clone ID: PAT_TA_69803.pep
ANELAMXIIPNGKSIPADKKGEADISVLQLETAVGAAIKHFKNAHGVNVPRKRFLPVKTCSDLMLVKSDLYTLQHGQLVIDPNRFGPAPLIKLGSDFKKVSSFQSRIPSIPKIVELDHLTITGPVNLGRGVTLKGTVIIVATEGSTIDIPPGSILENVVVQGSLRLLEH

SEQ ID NO: 175386 - protein, 68 aa, Triticum aestivum
  unsure (1)..(68): unsure at all Xaa locations
  Clone ID: PAT_TA_69804.pep
SPRASPLPTPRSLPVPPLSSPHRCLHQHDDFTXXSISIFHQRQGLSNQGERAERHRSKMRDCRKRVCV

SEQ ID NO: 175387 - protein, 199 aa, Triticum aestivum
  Clone ID: PAT_TA_69805.pep
AGLYLGEIFRLVLLDLHKGHECTMFEGQDVSKLEKPYSLDAGFLSAIEEDPFENLLETGDLFQNKLSITCTKPELELIRRLAELIGTRAARLTACGVAAICKHKNWDQTHVGADGSVFTKYPHFKIRNAQALKEILDWPAKYGKGKNDPIEILPAEDGSGVGAALIAALTIKRVKEGQLAGIQDREAMMKMAGQKPRGA

SEQ ID NO: 175388 - protein, 49 aa, Triticum aestivum
  unsure (1)..(49): unsure at all Xaa locations
  Clone ID: PAT_TA_69806.pep
PPPXXPXPPPXPXPPXKPXPXXPPXXPXXPXPPXXKPPPPPPPGRSLAF

SEQ ID NO: 175389 - protein, 116 aa, Triticum aestivum; identical to SEQ ID NO: 134375
  Clone ID: PAT_TA_69807.pep

SEQ ID NO: 175390 - protein, 116 aa, Triticum aestivum; identical to SEQ ID NO: 134375
  Clone ID: PAT_TA_69808.pep

SEQ ID NO: 175391 - protein, 116 aa, Triticum aestivum; identical to SEQ ID NO: 134375
  Clone ID: PAT_TA_69809.pep

SEQ ID NO: 175392 - protein, 120 aa, Triticum aestivum
  unsure (1)..(120): unsure at all Xaa locations
  Clone ID: PAT_TA_69810.pep
VQVCSYNDLPXXYKSCLLYLAIFSPRQKIRRSTLIARWVAEGLTSKEDWPSSVRQANRCFDTLVGRCLVDPADIDAMGKVKSCLVSDSXHGFITTIXRKQHIVETRLXHHLXRHXSIXND

SEQ ID NO: 175393 - protein, 146 aa, Triticum aestivum
  unsure (1)..(146): unsure at all Xaa locations
  Clone ID: PAT_TA_69811.pep
LGXKMLCNGAPWFPLCRTLFCPSYSYIAALETLVPRCCSAPTKVCDQTRLPITCSTGSPRPRSDHPLLCVLSSHPHRIASIACGGDRSGCVGAERRVRNLSPGAKGPNIVSSEKLPSRLFFHEEVVSSILLFLVELGVQLVDTGTV

SEQ ID NO: 175394 - protein, 127 aa, Triticum aestivum
  unsure (1)..(127): unsure at all Xaa locations
  Clone ID: PAT_TA_69812.pep
PAKXAANFTSQVIIMNHPGQIGNGYAPVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 175395 - protein, 89 aa, Triticum aestivum
  Clone ID: PAT_TA_69813.pep
ASAILLLPCAGTAPGRARHLLQSPPMPSPSSEMAGAAREPRRTSRPRPASAHRRDGEGRREGRREREVSRPHQSVTQEPARVDPACQHG

SEQ ID NO: 175396 - protein, 170 aa, Triticum aestivum
  unsure (1)..(170): unsure at all Xaa locations
  Clone ID: PAT_TA_69814.pep
XRHCRRPPLLSYQRPHSALSTPRPVFLTSSSPNPSAPGAHPTGSSSRSPCRPHARQAAGALSKTTQEALQLSVTLPPCELQHRARMAAASPSLSRSCVLPARALHRMLPACAGCRCIACVHGSRAAAVSCSVCDAWLGAVCSTLSVFVCVLRGGCVCPCLLLLPGGWVHT

SEQ ID NO: 175397 - protein, 150 aa, Triticum aestivum
  unsure (1)..(150): unsure at all Xaa locations
  Clone ID: PAT_TA_69815.pep
TAFATAKAADPEAKLYINDYNLDSPXSYAKTKAMASNVKKWVAAGVPIDGIGSQSHLSGSWPISDYPAALKLLCESASECAMTELDIKGGAAADYKTAVTACLDVENCVGVTVWGVSDTDSWIGAAATPLLFDGSFQAKESYNGLCSALA

SEQ ID NO: 175398 - protein, 52 aa, Triticum aestivum
  Clone ID: PAT_TA_69816.pep
AERLYVCDGSVLPSAVGVNPMITIQSVAYCLATGIAEQLKRDPSSGRNHSTD

SEQ ID NO: 175399 - protein, 134 aa, Triticum aestivum
  Clone ID: PAT_TA_69817.pep
MPIQWSQAEMKERLLAAVIASSSGLNMNEVARIFGKGATYDAVEGQLRKVKRLAAELKEEAKDRSAPTATPSRSKKTKDLADSPIKTPVKSGRVTKPKKPATPKVKAELFEDAGVFFTAALGKATSEEPMEEFI

SEQ ID NO: 175400 - protein, 151 aa, Triticum aestivum
  Clone ID: PAT_TA_69818.pep
MAASPKFSEGSDEPRLTKELDGLLDNKWALTADGKGIERSFKFKTFAKTWDFMTAVSLQCKIKNHHPEWSNVYNTTFIRWTTHSPPGLSAKDTELAALCDGYAQSFGEVKEEAAPAAAPSSTSDRQSCQLKGLADHVASTSGDCCMPKKSS

SEQ ID NO: 175401 - protein, 45 aa, Triticum aestivum
  unsure (1)..(45): unsure at all Xaa locations
  Clone ID: PAT_TA_69819.pep
SCSATIISQENIASLAYLVPLMYTCFCHGVHVHLGRSCKPXYRKF

SEQ ID NO: 175402 - protein, 116 aa, Triticum aestivum; identical to SEQ ID NO: 134375
  Clone ID: PAT_TA_69820.pep

SEQ ID NO: 175403 - protein, 37 aa, Triticum aestivum
  unsure (1)..(37): unsure at all Xaa locations
  Clone ID: PAT_TA_69821.pep
MTMADRQPFVTLXILXXVTQTVPNGNXPKENXXSVLV

SEQ ID NO: 175404 - protein, 184 aa, Triticum aestivum
  Clone ID: PAT_TA_69822.pep
SHLLMETIIKDHRNIFEGVSSLVDAGGAHGATAEAIAKAFPHIKCTVLDLPHAIAGAPAIANVEFVAGDLFEYVPPVDVVLLKWVLCLWQDEDAVKVLRRCKEAITSRGAVGKVIIVDVVIDFGMSQDDVLLRETQVLFDVQMMRVDGGERDEQQWRKIFFEAGFRDYKITPMLGFRSIIEVYP

SEQ ID NO: 175405 - protein, 116 aa, Triticum aestivum; identical to SEQ ID NO: 134375
  Clone ID: PAT_TA_69823.pep

SEQ ID NO: 175406 - protein, 168 aa, Triticum aestivum
  Clone ID: PAT_TA_69824.pep
KADKDPKVQAEAKFYFQKGALEGDDPLSYYELAAFEPRTSQKWLQYTSKAAASGHEQAILNLTDFYQEVATVEPTILKSDSIRKALNWVLSWRQGSTAALAREWQQVASVIGHKPSMLQLADYYDSIGNNERARRYLHQIIETPNTTNQKEGSSQLLQVARKRLAGFR

SEQ ID NO: 175407 - protein, 74 aa, Triticum aestivum
  Clone ID: PAT_TA_69825.pep
FQLLLLDLDMDAFEVALQIRGLKNRRWLLIVAALAVTVDDNIREMCRHSGINGLIQKPLTLTALGAQLHRVLRN

SEQ ID NO: 175408 - protein, 148 aa, Triticum aestivum
  Clone ID: PAT_TA_69826.pep
MEVWLKLVTTTSSWRRRKTRHEGQKMVWNVVVIVRAPLRNKEKGACRETISRVTGGMKVKADRDESSPYAAMLAAQDVAARCKELGITALHVKIRATGGNGTKTPGPGAQSALRALARAGMRIGRIEDVTPTPSDSTRRKGGRRGRRL

SEQ ID NO: 175409 - protein, 116 aa, Triticum aestivum; identical to SEQ ID NO: 134375
  Clone ID: PAT_TA_69827.pep

SEQ ID NO: 175410 - protein, 143 aa, Triticum aestivum
  unsure (1)..(143): unsure at all Xaa locations
  Clone ID: PAT_TA_69828.pep
LLLLGRGSXQHATALEGALKIKEISYLHCEAVMSGELKHGVLALVDENLPIVMILTRDDIFAKSLNAYQQVIARSGRPIIICNENDPEFPTDKTDKIEVPKNVDVLQGLINVVPLQLMSYWMAVAEGVNVDMPRNLAKSVTVE

SEQ ID NO: 175411 - protein, 52 aa, Triticum aestivum
  unsure (1)..(52): unsure at all Xaa locations
  Clone ID: PAT_TA_69829.pep
GGRLNXVGCXXWQRREXACXLWLLWCXYCYXETXLVVVIVLXPSXRGLCCAS

SEQ ID NO: 175412 - protein, 55 aa, Triticum aestivum
  unsure (1)..(55): unsure at all Xaa locations
  Clone ID: PAT_TA_69830.pep
HLLXCSGAKSPPLFYYFLSSSYIXSQXNILXXKXNWXXXFGSLDGTGXLGVXXTX

SEQ ID NO: 175413 - protein, 113 aa, Triticum aestivum
  Clone ID: PAT_TA_69831.pep
LCRFKKKKLAAAGAAGRRRSLSGDVSFIVKYLCSYLELADLDCAALPMALQGRLCSHLAASLLPAPLEAAQCGGVRESSARPYGSAASPFFTAPRRRPMHMAALYSPAPLVTL

SEQ ID NO: 175414 - protein, 116 aa, Triticum aestivum; identical to SEQ ID NO: 134375
  Clone ID: PAT_TA_69832.pep

SEQ ID NO: 175415 - protein, 116 aa, Triticum aestivum; identical to SEQ ID NO: 134375
  Clone ID: PAT_TA_69833.pep

SEQ ID NO: 175416 - protein, 116 aa, Triticum aestivum; identical to SEQ ID NO: 134378
  Clone ID: PAT_TA_69834.pep

SEQ ID NO: 175417 - protein, 116 aa, Triticum aestivum; identical to SEQ ID NO: 134375
  Clone ID: PAT_TA_69835.pep

SEQ ID NO: 175418 - protein, 139 aa, Triticum aestivum
  Clone ID: PAT_TA_69836.pep
QQHSIAYGSSQVLQQSTYQLVQQLCCQQLWQIPEQSRCQAIHNVVHAIILHQQQQQQQQQQQQPLSQVSFQQPQQQYPSGQGSFQPSQQNPQAQGSVQPQQLPQFEEIRNLALETLPAMCNVYIPPYCTIAPVGIFGTN

SEQ ID NO: 175419 - protein, 116 aa, Triticum aestivum; identical to SEQ ID NO: 134375
  Clone ID: PAT_TA_69837.pep

SEQ ID NO: 175420 - protein, 122 aa, Triticum aestivum
  Clone ID: PAT_TA_69838.pep
GHFQPMRDEHQTGRGILHRSGSSSSSSSEDDGMGGRRKKGIKEKIKEKLPGGHGDQQHTGGTYGQQGTGMAGTGGTYGQQGHTGMTGTGAHGTGGAYGQHGTDTGEKKGIMDKIKEKLPGQH

SEQ ID NO: 175421 - protein, 127 aa, Triticum aestivum
  Clone ID: PAT_TA_69839.pep
ARREGARDVGLREAEHGVVGTVADLRWSRGGCRHVPGITSRTQKVGLANGDVVGIQSMYAGNPSFKGVMQSETRSSYEINSCAAAAFCTPSSGFAGVATAAALPCMRAYQLHANYSDLWIRYIQNQR

SEQ ID NO: 175422 - protein, 99 aa, Triticum aestivum
  Clone ID: PAT_TA_69840.pep
LSSKQWMIDFDAVCKYLFAATSIGSSRGPALTINVSQGQGSISEFGLTRLPITSIGVFSWPKTTRPYCCINTPVLRLRRPFTTNFKCSFLSSFRSGCFR

SEQ ID NO: 175423 - protein, 85 aa, Triticum aestivum
  unsure (1)..(85): unsure at all Xaa locations
  Clone ID: PAT_TA_69841.pep
KKTXSNXHTPFYSDTKYKSCTAPXRATSGVRSLYDSRWREERALRLRALLVEPRRRGHRLRHAARXGRQVQLVPHXRRHDPXXTR

SEQ ID NO: 175424 - protein, 34 aa, Triticum aestivum
  unsure (1)..(34): unsure at all Xaa locations
  Clone ID: PAT_TA_69842.pep
VSXHVIGXHVXRDRVCFSVPXSXLLAGSXCRCKL

SEQ ID NO: 175425 - protein, 48 aa, Triticum aestivum
  unsure (1)..(48): unsure at all Xaa locations
  Clone ID: PAT_TA_69843.pep
DDLKLPTDDVLLGQIKXGFADGKDLILSVMSAMGEXQICXVKEIGGGK

SEQ ID NO: 175426 - protein, 117 aa, Triticum aestivum; identical to SEQ ID NO: 124363
  unsure (1)..(117): unsure at all Xaa locations
  Clone ID: PAT_TA_69844.pep

SEQ ID NO: 175427 - protein, 69 aa, Triticum aestivum
  Clone ID: PAT_TA_69845.pep
NGVLVLDHDNSAMCTYTYIHTHALPSYSPCITTCVQRASLYYPCTLLHPALSCGPPPDTWAWGSRRGRH

SEQ ID NO: 175428 - protein, 39 aa, Triticum aestivum
  unsure (1)..(39): unsure at all Xaa locations
  Clone ID: PAT_TA_69846.pep
VXGXXXCRSSGXRXLXXXRMXXVXXCXVXVCALVSXXAS

SEQ ID NO: 175429 - protein, 109 aa, Triticum aestivum
  unsure (1)..(109): unsure at all Xaa locations
  Clone ID: PAT_TA_69847.pep
GSSXPXKXIQGTXXXHQXXHRRRDXLHLXEAXNTXEAPTXXXRXXRDPHSMRIIHSXNXXTYRXRTHXAXRXXSXRRXQXXMXXXRXPXXXXXLCXAXXTAALXRXXLX

SEQ ID NO: 175430 - protein, 45 aa, Triticum aestivum
  unsure (1)..(45): unsure at all Xaa locations
  Clone ID: PAT_TA_69848.pep
CPNADCGAXTXMANXXXRHYCGKKKPHLRLQPEGLEVACDCSALF

SEQ ID NO: 175431 - protein, 46 aa, Triticum aestivum
  unsure (1)..(46): unsure at all Xaa locations
  Clone ID: PAT_TA_69849.pep
XIQKESXKXLVLRLRXXQSLPWRWTCCVYPXSSXVAAHLXSXLFAS

SEQ ID NO: 175432 - protein, 96 aa, Triticum aestivum
  unsure (1)..(96): unsure at all Xaa locations
  Clone ID: PAT_TA_69850.pep
RXLXXXXXIXKGXXWLQSLSIFXFGFEGLXVNXVXXLSLVDKKXGLNIEVPGSAILSSFGFDVLALWRDVAGLGVVSAVFAVLGYVALYLFLVERR

SEQ ID NO: 175433 - protein, 64 aa, Triticum aestivum
  unsure (1)..(64): unsure at all Xaa locations
  Clone ID: PAT_TA_69851.pep
SCTTHLXXKSTTLXLXQKITRKTMSCSAGRAXRQRERERAGEQGRSLWEGSQGMSGRXXXGPEA

SEQ ID NO: 175434 - protein, 38 aa, Triticum aestivum
  unsure (1)..(38): unsure at all Xaa locations
  Clone ID: PAT_TA_69852.pep
MPPLADGAPKAQXDPVTXPXVADLXPPXLLLRRXHRHR

SEQ ID NO: 175435 - protein, 37 aa, Triticum aestivum
  unsure (1)..(37): unsure at all Xaa locations
  Clone ID: PAT_TA_69853.pep
AASVDXIMPRQAVXQSWFRYESFGLRADLSREXXYXX

SEQ ID NO: 175436 - protein, 143 aa, Triticum aestivum
  Clone ID: PAT_TA_69854.pep
CSKYFQEWQSSHDHYDTRIANVMIKAYLDKGMIDEAEAIRQSTMAQGHCDEGMVYIFAEFYLDKSDVNTALEILRDANNMVTTHKWVPSKELVSRFLKHYEESKDVAGAESFLECLKKFECLDPDAYEAMMQTYVVAGRTWDD

SEQ ID NO: 175437 - protein, 124 aa, Triticum aestivum
  Clone ID: PAT_TA_69855.pep
LALVCLAPLFSHEGNTIDKTQLSPAPLSAVCSCEIPGSSPGGTGVVGGLHRPGDSTVAAKARISLLVMHTEQDYATFYPCIELPARGYTTLCLNNWTSNSGSDERSRKDFQMFICPRRIKQAVV

SEQ ID NO: 175438 - protein, 37 aa, Triticum aestivum
  unsure (1)..(37): unsure at all Xaa locations
  Clone ID: PAT_TA_69856.pep
SHNLSAIRTIAXXVXGYXHSPXRKTXTDGGRIKXLTS

SEQ ID NO: 175439 - protein, 34 aa, Triticum aestivum
  Clone ID: PAT_TA_69857.pep
RYIIYLTLDASKWLQRQKGPYRTHNRTTTRLTLE

SEQ ID NO: 175440 - protein, 137 aa, Triticum aestivum
  Clone ID: PAT_TA_69858.pep
GISQPMRDEHQTGRGILHRSGSSSSSSSEDDGMGGRRKKGIKEKIKEKLPGGHGDQQHTGGTYGQQGTGMAGTGGTYGQQGHTGMAGTGGTYGQQGHTGMTGTGAHGTGGAYGQHGTDTGEKKGIMDKIKEKLPGQH

SEQ ID NO: 175441 - protein, 168 aa, Triticum aestivum
  Clone ID: PAT_TA_69859.pep
DVSKEAKDFIMTLLVPKPEKRATSAEALKNAWIAGKGATDHNLLPEIKAYMTKARLKRGIELVKLANRIEALKMQEDEEEDVPQAGDVPAGAKQAAGDALAHQEEKPLEAGLKVPEDKGVTHKRSLSKIAKGAIFREVVLAKVREMKADEEAQKITSTGSFEKEKENK

SEQ ID NO: 175442 - protein, 54 aa, Triticum aestivum
  unsure (1)..(54): unsure at all Xaa locations
  Clone ID: PAT_TA_69860.pep
KAXIXMLRXXEPYVAYGYXNLKSXXXXIYKXGYGKLNKQRIPXTNXKVXXXGLX

SEQ ID NO: 175443 - protein, 152 aa, Triticum aestivum
  Clone ID: PAT_TA_69861.pep
GHFQPMRDEHQTGRGILHRSGSSSSSSSEDDGMGGRRKKGIKEKIKEKLPGGHGDQQHTGGTYGQQGTGMAGTGGTYGQQGHTGMTGTGGTYGQQGHTGMAGTGGTYGQQGHTGMTGTGAHGTGGAYGQHGTDTGEKKGIMDKIKEKLPGQH

SEQ ID NO: 175444 - protein, 72 aa, Triticum aestivum
  Clone ID: PAT_TA_69862.pep
ASGQYSRLDLVAALSSTQPQCTIQLGNPTACSTVGRSARRLERSSKCRLVRRRALLLHGRPQREFMCCAVHV

SEQ ID NO: 175445 - protein, 49 aa, Triticum aestivum
  unsure (1)..(49): unsure at all Xaa locations
  Clone ID: PAT_TA_69863.pep
XXXSAGQKKLWLSVXSVXXASRXMRVLSXGYXSAHRRYACWMGDVMPGF

SEQ ID NO: 175446 - protein, 37 aa, Triticum aestivum
  unsure (1)..(37): unsure at all Xaa locations
  Clone ID: PAT_TA_69864.pep
VFGEVVEGMDVVKNIEKVGSRSGTCSKQVVIAAXGQL

SEQ ID NO: 175447 - protein, 46 aa, Triticum aestivum
  unsure (1)..(46): unsure at all Xaa locations
  Clone ID: PAT_TA_69865.pep
RSEKEIXQLLLACGPPSXHCFSSKIRTXCDGXXSPVCAKSSYGCVS

SEQ ID NO: 175448 - protein, 30 aa, Triticum aestivum
  unsure (1)..(30): unsure at all Xaa locations
  Clone ID: PAT_TA_69866.pep
TKQXKXHSKVKGNKAGHLFLPSKCTRYDTT

SEQ ID NO: 175449 - protein, 35 aa, Triticum aestivum
  Clone ID: PAT_TA_69867.pep
SGSRIHLLARLVCFSAPCAHPLIWWFLRRFVGVYC

SEQ ID NO: 175450 - protein, 180 aa, Triticum aestivum
  Clone ID: PAT_TA_69868.pep
NVKDGVTSTVNDVKNIDAHADALDKSVDAALTRRQLPDVNGLVGGVEGAVPGVKAVEDAATPIVNDVKDNVVGGVTGVVSPIVNDVKDGVTSAVTPIVNGVTGAVDPIVKPVKDAATGAVKGVEGAVAPVVSNVQGAVDPVVNGAKGAVEPAVKNVTDGALPVVNNLKDGVTSGVGSTGL

SEQ ID NO: 175451 - protein, 164 aa, Triticum aestivum
  Clone ID: PAT_TA_69869.pep
WCVPYTTAKSQKFKDTNKAINHSGKDKIQTPSTVICITIQASPGPLDSSGLAVKTDPAAVTGDSRTKVQRRVAIGRASVSLLELTTSRAHKITSILVNGALDVVVGNSTGGVPQELLLDLDTLGHAGSVARRCCHWLRSGIQLWCQAGTWWQVIGMSRWLRRWS

SEQ ID NO: 175452 - protein, 49 aa, Triticum aestivum
  unsure (1)..(49): unsure at all Xaa locations
  Clone ID: PAT_TA_69870.pep
RLTGRAGLXXPLXLPXPFXFLVACYRXLLLXLXXPXLVXPMKEXLLFSV

SEQ ID NO: 175453 - protein, 144 aa, Triticum aestivum
  unsure (1)..(144): unsure at all Xaa locations
  Clone ID: PAT_TA_69871.pep
TAXMRLLTLASMAASAGQTRSLPYEKIANKLQVPSEDVEMWVIDVIRAGLVEGKLSQLNQTFLIHRSTYRVFGENQWREVDSRLNLWRNSLQGVLDVIKQEKQRFLQEKEDEANKADQKADMSSRFGGRGGQRKQHRAIDEDMD

SEQ ID NO: 175454 - protein, 48 aa, Triticum aestivum
  unsure (1)..(48): unsure at all Xaa locations
  Clone ID: PAT_TA_69872.pep
KKRIRERXXFLKXQXLARESEGRXRDHTHQPHXPRHCLLXXVQPSLSX

SEQ ID NO: 175455 - protein, 113 aa, Triticum aestivum
  Clone ID: PAT_TA_69873.pep
KCYTESFLPFDLESTWSAAVLTVVANVVDPSMSDGCHNALQIAYSLLGEMLMRGNHVAGLYRDELTLLQIFLGKFETDSTHPASVTDPAAASLHDSMNLTTTNGDANDWWSDD

SEQ ID NO: 175456 - protein, 33 aa, Triticum aestivum
  unsure (1)..(33): unsure at all Xaa locations
  Clone ID: PAT_TA_69874.pep
MLPQNVKLPXRSPFYKMGIRTHYSTSSASIRQS

SEQ ID NO: 175457 - protein, 98 aa, Triticum aestivum
  Clone ID: PAT_TA_69875.pep
EGGKAAQKTDVDEEEEDDKPAKRRAKGAKALPKKVVNTRADDHEEGEDEDEESKPAKRGRKRPAKGPSKKEGCSSDDEDSAGKEETVVAAKRPQRKKR

SEQ ID NO: 175458 - protein, 45 aa, Triticum aestivum
  unsure (1)..(45): unsure at all Xaa locations
  Clone ID: PAT_TA_69876.pep
SKVQGACRGKASXERARPVLPXPQAVISAQSXRERDKREREREAV

SEQ ID NO: 175459 - protein, 71 aa, Triticum aestivum
  unsure (1)..(71): unsure at all Xaa locations
  Clone ID: PAT_TA_69877.pep
XPXPGELAGXSSLXVVXVSGNXLCXAIPATXPFEXIPLSXFERXPRLEGXDXLGLAXYXTXCTATGRWLRK

SEQ ID NO: 175460 - protein, 46 aa, Triticum aestivum
  unsure (1)..(46): unsure at all Xaa locations
  Clone ID: PAT_TA_69878.pep
PWXQXXQXLQVHRTLXLLQXGVPASQXGESXYSYSXXTRITRDHTT

SEQ ID NO: 175461 - protein, 89 aa, Triticum aestivum
  unsure (1)..(89): unsure at all Xaa locations
  Clone ID: PAT_TA_69879.pep
GTFQTXMKDQFGXYVVQKVLQTCDDKHLEMILSSIKVHLNELKNYTYGKHIVARVEKLIITGENRVRMASKPCRCQQAAKCADADADSS

SEQ ID NO: 175462 - protein, 117 aa, Triticum aestivum
  unsure (1)..(117): unsure at all Xaa locations
  Clone ID: PAT_TA_69880.pep
MARAQVMLMAVALVLMLAAVPRAAVAIDCGXHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 175463 - protein, 83 aa, Triticum aestivum
  unsure (1)..(83): unsure at all Xaa locations
  Clone ID: PAT_TA_69881.pep
THFALICVMLLILVVTSYFTTCLFFFIYCLPHHLFYLDMCDVTTYITXIVASLSEQIQSIGTCKCSLCRCATWQCYCLATTPT

SEQ ID NO: 175464 - protein, 110 aa, Triticum aestivum
  unsure (1)..(110): unsure at all Xaa locations
  Clone ID: PAT_TA_69882.pep
GNNRSVMPLDVXGRTRATXMYSXSIXPWPTGPGNLGKFHRDGDRSLQLLVFNEECLVSASHQLALTTSLPFVHTARRSYRLNGPXKCSDRXRRGRFAAPDVARSPLNLII

SEQ ID NO: 175465 - protein, 84 aa, Triticum aestivum
  Clone ID: PAT_TA_69883.pep
NPPAELRPGGHRLADRNHRHQDDGPMLQRRGYHQRHFRHGEDGQRRRSTERTSTPTSRGRRVGRSKKRLKYAIIPLKKVRHHRC

SEQ ID NO: 175466 - protein, 169 aa, Triticum aestivum
  unsure (1)..(169): unsure at all Xaa locations
  Clone ID: PAT_TA_69884.pep
WPLGGYPGPQGPYYCAAGAEKSYGRDIVDAHYKACLYAXGINIGGINAEVMPGQWEFQVGPSVGISAGDELWAARYILERITEIAGVVVSFDPKPIPGEWNGAGAHTNYSTKSMRSEGGYEVIKKXDTEKEGKGYFEDRRPASNMDPYVVTSMIAETTILSKAGLSNGK

SEQ ID NO: 175467 - protein, 93 aa, Triticum aestivum
  unsure (1)..(93): unsure at all Xaa locations
  Clone ID: PAT_TA_69885.pep
SGGQSEXSATAHLNAINQVKALKPWALSFSYGRALQASVLKAWKGKPENVAAAKDALMHRAKMNSLAAVGKYEASMETSAADAGSLHVANHQY

SEQ ID NO: 175468 - protein, 61 aa, Triticum aestivum
  unsure (1)..(61): unsure at all Xaa locations
  Clone ID: PAT_TA_69886.pep
MKVTFALVLVVLLAASSVDXLPKCFIPCPRHXKPVCGSDGSNLVWYANECGMRVAACHLGS

SEQ ID NO: 175469 - protein, 116 aa, Triticum aestivum
  Clone ID: PAT_TA_69887.pep
KSHRLSDQIYTKLKAMTARLKQEGYCPNTSFVLHDMEQEQKEAMLVTHSERLALAFGLIATPPGTPLQIVKNLRVCGDCHVVMKMVSAVEDREIIMRDCSRFHHFKSGACSCGDFW

SEQ ID NO: 175470 - protein, 66 aa, Triticum aestivum
  Clone ID: PAT_TA_69888.pep
SINDGNIAMIIRDTCMKASLDKFRPASRQCLVLATATVRLIRWSIYYYYFRGEWRFGGRASWRSLI

SEQ ID NO: 175471 - protein, 44 aa, Triticum aestivum
  unsure (1)..(44): unsure at all Xaa locations
  Clone ID: PAT_TA_69889.pep
PVLXTWAERGQVLIALYAXIYAXLQYXLLLXYGCTVDXFQCWCQ

SEQ ID NO: 175472 - protein, 47 aa, Triticum aestivum
  unsure (1)..(47): unsure at all Xaa locations
  Clone ID: PAT_TA_69890.pep
XHHAKLKLKXITSKLGGSXLHWASAXATATAATTAKATDRHHGQSRR

SEQ ID NO: 175473 - protein, 133 aa, Triticum aestivum
  Clone ID: PAT_TA_69891.pep
SAVLSFLGDKLSVPEVNCPRFWLAERRRELLLIVEVEFDPCVYHVFYLHSGKKKWERTTSLGGCSLFFNLHEFAGCLGPDHPAVRRDCLYFTGCSGKWSEYSLADGSYHEFVIDHPGRTEDYGSPVWVLPSIC

SEQ ID NO: 175474 - protein, 122 aa, Triticum aestivum
  Clone ID: PAT_TA_69892.pep
HCCRKHGQGSCAPHDGAAPGTFSWEVEAGKGGGRWQPPRRPRPTSCSRIRSRSSCPACLSASPAHCHGVPCSASPRLRGLLICSLKVSLLHSVLVLHCPQFLLLLVVSCPGFLSHCIMCADY

SEQ ID NO: 175475 - protein, 114 aa, Triticum aestivum
  Clone ID: PAT_TA_69893.pep
SEEHLDLKFYEYVEAAKLTGDNLVPAGQVVFRAKVGKHYQLPHKGVIPRELGVVARYKGQRRIADAGFKNPRWVDGELLILDGKFIRDGPVIAFFYWTSNLHLFEFFRRLSLPD

SEQ ID NO: 175476 - protein, 188 aa, Triticum aestivum
  unsure (1)..(188): unsure at all Xaa locations
  Clone ID: PAT_TA_69894.pep
IDEMEEMLTGNRIWRLRCVDIGILSTDDALNXGCSGVMLRGSGIKWDLRKTQPYDSYEDFDFDIPIGSNGDTFDRYLCRVEEMRQSLRIINQCLNNMPPGEIKIDDNKIVPPSRAEMKNSMEAVIHHFKLFSEGYQVPPGATYTAVEAPKGEFGVYLVXDGSSKPYKCKIKAPGFAHWAATDHICSGL

SEQ ID NO: 175477 - protein, 90 aa, Triticum aestivum
  Clone ID: PAT_TA_69895.pep
FGTRASSPLHLSRPRRLSPSSSLARVVGIPPSLTLSNTSSIVKNAISPPPALRSAVAVLDLLRRLSRRHDGAVTACRLPRASVAGCLPGA

SEQ ID NO: 175478 - protein, 129 aa, Triticum aestivum
  Clone ID: PAT_TA_69896.pep
RHGPDCGRIDGKQHFPSSRARPTSSFSDWCEVSTHLLIVSLPLASCSLHYFLPAVPLVRCCLLMLLSVHMSDSMLLLDWFIVWMGWRSSGVCAYAPHMTCFKNCLVRICIHCTPRCRSEQAPCILPFAL

SEQ ID NO: 175479 - protein, 201 aa, Triticum aestivum
  unsure (1)..(201): unsure at all Xaa locations
  Clone ID: PAT_TA_69897.pep
IDFAGSDVEEKLIESLCKRLSKLRVLAIALSNRDHGVINYTKKFLFPESIRQLKHLRYLAFRTLHMGMVVLPSALTKLDHIQLLDFGDNVIEFPSTGVIKLRHIICRYDAKVPNIGRFKSLQTLQNFQVRNEEGYEVKQLMDLDKLCGSLAIHGLENVKSKREALEANLATKKWLKELETXWTGGCTRRSPEVEEEVLEGL

SEQ ID NO: 175480 - protein, 236 aa, Triticum aestivum
  unsure (1)..(236): unsure at all Xaa locations
  Clone ID: PAT_TA_69898.pep
RHEAQPXXPDLDELERAFPIVEPDYGHTKLRLSEQGLEAIRRIENPIAIVGVIGPYRSGKSFLLNQLLSLSCDKGFGVGHMRDTKTKGIWIWGKPVEMDVDGTKVSVLYLDTEGFESVGKSNVYDDRIFALATVLSSVLIYNLPETVREADISRLSFAVEIAEEFYGRVKGEEIAFEPAKLLWLIQRDFLQGKSVQQMVNEALQRVPNDNGNKYIDEVNQIRDSLAVMGNNSTAFS

SEQ ID NO: 175481 - protein, 222 aa, Triticum aestivum
  Clone ID: PAT_TA_69899.pep
GLTSMWPHRLNVILGDQMGAGGVIPTLVFLDRLKENGQHGPYLIVSSLDKDNGIGDWLRQIRLFPSMKELLYFGNQQGRATMRKQFARKAVGPDFPIILTTYNMVMVEKQWLAQYDWKYVVVDEGYQLKKREHEVLEAVKRQPMDHKLLLIREPFQNNLAELWSLLNFALLNAFSSREEFDSWFDKSGKEGEEQQIEEERRALLSKLHAILRPFLLRDMKGA

SEQ ID NO: 175482 - protein, 208 aa, Triticum aestivum
  Clone ID: PAT_TA_69900.pep
AGTGNGVVKKQEPWPFTLVQGPPGTGKTHTVWGMLNVIHLVQYQHYYAALLKKLAPESYEQVGGSASSTSEAVAAGSMDEVLQSMNQNLFRTLPKLCPKPRMLVCAPSNAATDELLARVLDRGFIDGEMRVYRPDVARVGVDSQSRAAQAVSVERRTEQLLMKGREEVIGWLHQLKVREQQLSQEIALLQRELNMVAEAGRSQGSFGV

SEQ ID NO: 175483 - protein, 90 aa, Triticum aestivum
  Clone ID: PAT_TA_69901.pep
SALDTRIRTLMRLLCILAEGSSRALIREGHCARSSHALPSRSLCIQPDACGLTLSVDCADLVGDALRPRRAPSRALPIPSSPTFSAQPDP

SEQ ID NO: 175484 - protein, 160 aa, Triticum aestivum
  Clone ID: PAT_TA_69902.pep
SERWRTPMGMMEVDSARRCEMERGKSWSGHGGARPGMEPSRAGAGHAQEGKVESQSSGCRSRAEAHSSVLGVVEQRLGVEARGSCGEGGARQASWREVEGARWMLARRAAARTVRGRADQSCAPGPVGWRSRKDGEDRRSPSRRAATSAGRSRADRGGAQ

SEQ ID NO: 175485 - protein, 49 aa, Triticum aestivum
  Clone ID: PAT_TA_69903.pep
MAGRKGGDRKKAVTRSVKAGLQFPVGRIGRYLKKKTATKSPKKKVAAKE

SEQ ID NO: 175486 - protein, 240 aa, Triticum aestivum
  unsure (1)..(240): unsure at all Xaa locations
  Clone ID: PAT_TA_69904.pep
SARGNVWHVSLXXSVEGYGSYGFRCGLFGMGHPLLDPYAKVIGDLVAANPLHVKGITAPSMSCLGSLATPPSYNWGRDKWPRLPLEKLVVYRANVALFTKDKSSGLPDNVAGTFSGVASKIQRFRSLGVNAVLLEPVFQFDQVKGPYFPYHFFSPMDSYGGEGCSASAITAMKDMVKAMHRNGIEVLLEVVFTHTAEGEADGQMISISGVDNSSYYIADEIAGCKSGILNCNSPVTQNLI

SEQ ID NO: 175487 - protein, 103 aa, Triticum aestivum
  Clone ID: PAT_TA_69905.pep
IRPSPWFLVSDPATVSQIRRLASCPVNFRHLAVSRSTGRHRRAPIFHPCTRSCSGRRPPNAARLPLPCSSGAAFSPFRSPCCLGRNGAATEERAHGGGRREQV

SEQ ID NO: 175488 - protein, 35 aa, Triticum aestivum
  Clone ID: PAT_TA_69906.pep
FFLTKTQPHQFHDYHYKANTTIIRKFSRHLTSDSY

SEQ ID NO: 175489 - protein, 223 aa, Triticum aestivum
  Clone ID: PAT_TA_69907.pep
EGSPRISDALEEVFVQARQLGELRQRYEQETRDSDAGASVDPRVMALYTDVTKLVGVEEPRDKLIDMLIEGDDWSKHPLKTVSIVGFGGMGKTTLAKAVYDKLKVQFDCGAFVSVSQNPDIKKVFKNILYEFDKCKYAHIHNTEWQERHLIDEIIEFLNDKRYLIVIDDIWNEKSWELIKCAFSKKSHGSKLITTTRIVSVSEACCSSSDDIYRMKPLSNDLS

SEQ ID NO: 175490 - protein, 85 aa, Triticum aestivum
  unsure (1)..(85): unsure at all Xaa locations
  Clone ID: PAT_TA_69908.pep
RHEXVLKQVHPDIGISSKAMSIMNSFINDIFEKLAGESAKLARYNKKPTITSREIQTSVRLVLPGELAKHAVSEGTKAVTKFTSS

SEQ ID NO: 175491 - protein, 208 aa, Triticum aestivum
  Clone ID: PAT_TA_69909.pep
YIRKRLFSDLDKTSVQHVLRQLRKLPWAECEEYLVKCFLKVHKGKYSQVHLIALLTAGLSHYHDDFHVAVVDEVLEEIRVGLELNDYAMQQRQLAHMRFLGELYNYEHIDSSVIFDTLYLITVFGHGTLEQDLLDPPEDFFRIRMIVTLLQTCGHYFDRGSSKRKLDRFLLHFQRYILNKGPLPLDVEFDVQDMFAELRPNMTRYSSP

SEQ ID NO: 175492 - protein, 110 aa, Triticum aestivum
  Clone ID: PAT_TA_69910.pep
SVQCLNKIGGINQQLLHGVPMALRSHFFLHDHVLHFHGYHLLIHNRSAETMLSFCIVTFSFPVSFQHTFMLFLVVQRALLQLGQQIASKAERIEREEANEYIFVGSFVQD

SEQ ID NO: 175493 - protein, 97 aa, Triticum aestivum
  Clone ID: PAT_TA_69911.pep
AIWGEEDIPCISLSMLSASVMHKLRPQPAWDRTCTAAAAAGLLSELHMRPELSAFKLEEQAEAVECSLDILLDALIARRVRLGRSITRKQRHRRDCI

SEQ ID NO: 175494 - protein, 136 aa, Triticum aestivum
  unsure (1)..(136): unsure at all Xaa locations
  Clone ID: PAT_TA_69912.pep
CPLPLDXVSYIDPISHMHHLSXLTARPHSMLFPSASFAGXAGXMVFVXXDDRSTPTSIGHTXATPXATSAHXDHCSTSSLXLFMDYASYTCLPLALXACLHVTSSPPSASADDTCYATPPYLSASTLASMMACTFS

SEQ ID NO: 175495 - protein, 232 aa, Triticum aestivum
  unsure (1)..(232): unsure at all Xaa locations
  Clone ID: PAT_TA_69913.pep
XIEKVAERIKDTGVSVRKRAIKIIRDLCASNPNADTSHAFVEIISRVNDEESSVQDLVCKTFYELWFDEPSGSHKHLVADGSSVPMEIATKTEQIVDMLRKMPNHQPLITIIKRSLTLEFLPQSSKAAGINSSMMTSLRKRCELICRRLLERILQVEEGADNETKIHTLPYVLVLQAFCIVDPTLCTPVTDPSQFVVTLQPYLKNKVDSKSTAQLLESIIFVIDAVIPLIRK

SEQ ID NO: 175496 - protein, 205 aa, Triticum aestivum
  Clone ID: PAT_TA_69914.pep
LGSGGSAPSSNAAGGSAPSAVNPAGGGTAAAKSDSPTNNPATSGSAPVSSADRNKGNSTGGGSSSQAGGGGGSPTSDSAGERTVAKADEESDGSNKQSGSVAPTNNGAAGNVSAVKADTKDSVVVSAGDGSTAKSDSKIGSDSQAVTAGGAPSSGSAAGNSTTAKAGGKDSVGAASSGSAATDTVVKADPNNESDGASGSGNVDE

SEQ ID NO: 175497 - protein, 163 aa, Triticum aestivum
  Clone ID: PAT_TA_69915.pep
PVPDSAKMSTHVQITDQKLRLCDICGAFLSVYDSDRRLADHFGGKLHMGYMLIREKLSELQEEKNKRRKVDRTEHDRRSKERSTERDRASSRDRHRVDRSSSRDRHRDYDRRSSHDRYHDRESRYDHDKESGRSRSYDSRSRRRSRSPRDSSRDYDRHGRRDR

SEQ ID NO: 175498 - protein, 219 aa, Triticum aestivum
  Clone ID: PAT_TA_69916.pep
GLPLLRVALWPMAEDLRDQAEVQRLRPHGVRRGHDQQEPGGRMVQGHLHQNGEGVAARVVLHHRTARPWSGRGSCLFGRASEEDQVLEGEGRCLWEPSRGGSHDQEDQVVVHYKDPSARRRHQRHAQPPYAPAPASGYPDVGVKARGHGPPHRFSSAPPWQSCGRGSYSWPRTRSLRRGRTSASRIATKPPEVVGLGAESAVHGPTTRGAKNPSAHDAP

SEQ ID NO: 175499 - protein, 165 aa, Triticum aestivum
  Clone ID: PAT_TA_69917.pep
MALWCENMALPPRVLVAPRPSGANGQGNILLLRHPKLEEETQYLFTDGQLHEFNWFKERYGSWFLGDYVCEDGSIYYCTLVDPIFVLLPLFEAARMSNGKDLGKFRQLDEILYIEGYPGYQHLMSIAGKHMELVCEVKEVANMKFFRLDDSKVLTWMCCKVHSIK

SEQ ID NO: 175500 - protein, 226 aa, Triticum aestivum
  unsure (1)..(226): unsure at all Xaa locations
  Clone ID: PAT_TA_69918.pep
GTKTGIQCFKYKLLREPGQPEGMSIWKMSRKWVENPATRGRVLHPDLSSGTENLPVCLVNDIDSEKGPGLFTYITQVKYPKPLSSMKPLQGCSCLNACLPSDTDCGCAEFNGGNLPYSSTGLLVCRKNRLYECGESCQCSVNCXNRVTQKGIRVHFEIFRTGNRGWGLRSWDPIRAGSFICEYVGEVIDESKLNLNGEDDYLFQTVSPCEKTLKWKYVPELMGEQI

SEQ ID NO: 175501 - protein, 128 aa, Triticum aestivum
  Clone ID: PAT_TA_69919.pep
LYKERETEQKGMDPHRYVRIYKTNADLMAHLDISSISRRENSSIAMGENKLESSGKGRTFLKLERNHKETDQIIKRKFCKRKELPARSRLCKSPITREQKRGPKVEAINEAQSVSSVQPLWPLNDAND

SEQ ID NO: 175502 - protein, 201 aa, Triticum aestivum
  Clone ID: PAT_TA_69920.pep
ANSARGKEEMQNGLQNLSTAEEQCLMLERANQDLHVELDKLKYASKEKHEELNEKQIELEKLSISIQEEQLKSMQAEMARLSLEKQLAQVQEKLRLLSLEKHGETSKFKDVEASKLMLQKELEMIREENRKLDDQNHSSTSVIIRLQDEIISLKNAQRKLEEEVSRHVEEKKVLQNELSHIKNDRGDVERKHFSIKEQIQV

SEQ ID NO: 175503 - protein, 125 aa, Triticum aestivum
  Clone ID: PAT_TA_69921.pep
GLLVYYPFQVAKFSKLVFVVHVKQSTFIKVHCVQDKFFYIQSVAKALHAMKLPTLLLKVASFDTVLWPFLFTLLLFGVSATLEETGSLVSGLLRIILNGVSGQKIRHGRGLRQGDLLSLILLSSW

SEQ ID NO: 175504 - protein, 97 aa, Triticum aestivum
  unsure (1)..(97): unsure at all Xaa locations
  Clone ID: PAT_TA_69922.pep
PTPPSSSSPSRQGTHLSPPKWQCEQRKPPGHTPTHFSSFLLQPQPPAPIHENHKPSSQHAKTWMQEEIXRAQSTHQAVLDAYGASLFGSQKHRGGGA

SEQ ID NO: 175505 - protein, 194 aa, Triticum aestivum
  Clone ID: PAT_TA_69923.pep
MDDLSSLSIWPTNLGWVMGPIQLFSCFLNGATLALYHGSPLGRGFCKFVQDARVSVLGSVPSLVKSWKAGNLTKGLDWTKIRVLATTGEASDIDDNLWLSSRTCYKPIVECCGGTELASSYIQGSLLQPQAFGAFSGASMSTGFVILDEQGNPYPDNLPCSGEVGLFPLYFGATNRLLNADHDKVYFDGMPIYR

SEQ ID NO: 175506 - protein, 153 aa, Triticum aestivum; identical to SEQ ID NO: 168119
  Clone ID: PAT_TA_69924.pep

SEQ ID NO: 175507 - protein, 210 aa, Triticum aestivum
  Clone ID: PAT_TA_69925.pep
LVLELDWLSTRTRKDEPLVLCIAGADSSFRLVEVNTDTKINSASRLLTTKERFRPMPLCLPILFPTAHALALRMILQLGVKPSWFECNNSDKLASNSFKEGPSTFGDLRSYMIETTLPPIGDSVVAELLLKVLEPYRKDGCILDDGRASLYSAIVNKGTCARFAFAAAIFGDFQEALFWLQLPQALQHSLDKSTSRSSEGFESSVRADSE

SEQ ID NO: 175508 - protein, 171 aa, Triticum aestivum; identical to SEQ ID NO: 141856
  Clone ID: PAT_TA_69926.pep

SEQ ID NO: 175509 - protein, 79 aa, Triticum aestivum
  Clone ID: PAT_TA_69927.pep
LFQNTKFHDEKISLSIFFYGLTLFNLTEKGTVFFFCDMTGSKVMCKTEEETDLALHHVETVAAMGDVSISMMGQRVESG

SEQ ID NO: 175510 - protein, 96 aa, Triticum aestivum; identical to SEQ ID NO: 117442
  unsure (1)..(96): unsure at all Xaa locations
  Clone ID: PAT_TA_69928.pep

SEQ ID NO: 175511 - protein, 144 aa, Triticum aestivum
  Clone ID: PAT_TA_69929.pep
PAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 175512 - protein, 182 aa, Triticum aestivum
  unsure (1)..(182): unsure at all Xaa locations
  Clone ID: PAT_TA_69930.pep
KQGEVDAEACQERWLVSGHRYEGREEAISGFLVVGRLLSPFQVNPWIITNELRATSAWKLQGAVTAQDLASGDGRFVLNFSAEEDRRFILKAQPWHYKRDGVIFAEFDGKGNPVEVDLXVMAIWVQVRDLPFELKTEYGXSFGDQLGDVIAVSHRNHMIVEKFLRLRVEIPLHEPLKTSVEF

SEQ ID NO: 175513 - protein, 62 aa, Triticum aestivum
  unsure (1)..(62): unsure at all Xaa locations
  Clone ID: PAT_TA_69931.pep
YIYIYICXFLTCXXAXFQLFQYVXMXYSNGIVXSLEVKCIELYXNITXTSLLCTXSICRCKS

SEQ ID NO: 175514 - protein, 78 aa, Triticum aestivum
  Clone ID: PAT_TA_69932.pep
ESPPFSITAPHSSFLSFSCSSKMCERRNGEWRAASPTDARDPFLPFFTAMGRAAAAALQATAARRRGIRRRDGPLHQL

SEQ ID NO: 175515 - protein, 171 aa, Triticum aestivum
  Clone ID: PAT_TA_69933.pep
MEAPPDWPSARVREEFIGFFESKAHTPWPSSPVVPVDDPTLLFANAGMNQFKPVFLGTAAPDSPLGRLRRACNTQKCIRAGGKHNDLDDVGKDTYHHTFFEMLGNWSFGDYFKDGAIAYAWQLLTQVYKLPTDRIYATYFGGDDKAGLAPDTESKDIWLKYLPNERVLPFG

SEQ ID NO: 175516 - protein, 208 aa, Triticum aestivum
  unsure (1)..(208): unsure at all Xaa locations
  Clone ID: PAT_TA_69934.pep
GRPRSYXKFGPPSFAGNILLCGYSASSAPCPVSPSPAPASPGQEPTGPRGGRTKKELILIIGGIVLGILILLSLCCLLLCCLIRKKRSSGSTGARSGKQTSSKEAGAGAAAAAAGRGEKPGTSEAESGGDVGGKLVHFDGPLAFTADDLLCATAEIMGKSTYGTVYKATLEDGSLVAVKRLREKITKGHKEFEAEAAALGKIRHPNLL

SEQ ID NO: 175517 - protein, 81 aa, Triticum aestivum
  Clone ID: PAT_TA_69935.pep
ASWTNSCVNEHCCFRSWPVIKRLFGVPLLHAAAPGADGVLVQNCGVSESVLPRFLKSRELVDCRTGPNTELDPSSILKYLT

SEQ ID NO: 175518 - protein, 82 aa, Triticum aestivum
  Clone ID: PAT_TA_69936.pep
MAGRKGGDRKKAVTRSVKAGLQFPVGRIGRYLKKGRYAQRVGSGAPVYLAAVLEYLAAEKEAKSPKKKTATKSPKKKVAAKE

SEQ ID NO: 175519 - protein, 210 aa, Triticum aestivum
  unsure (1)..(210): unsure at all Xaa locations
  Clone ID: PAT_TA_69937.pep
MFIGADVNHPPPGDTVSLSIAAVVASMDCPSASQYVPRIRAQKRGTEEIDNLGTMCKELIQVYMERNGGFKPDKIIYFRDGVSDEQFKMVLDKELVSMEKGXITVVVAKKRHNTRLFPKDENELQTTNGNVLPGTVVDTVVVDGSHDDFFLCSHDGLHGTSRPTHYYMLKNGHAFKPVDLQKLVYSMCFMFARCTKPVSLTAPIKYADTA

SEQ ID NO: 175520 - protein, 216 aa, Triticum aestivum
  Clone ID: PAT_TA_69938.pep
MTTRRAKKRKWQEAELVAGVSPPANDKREVGEGPELISDLHVDVLRRIISLLPTKDGARTQILSTRWRPLFRSAPLNLGVVLRREDEPVPSSLVSRILADHQAPCRRLSLTWYGYKSDYVSPLLNGWLQSPAFKGLSEFDLWQNRKEIGKELWLVPREEVPYALPPSVLQFLPALHILSIKCTGYMIHFPSAATLAGDLHFPKLKQLTLKGVVVSE

SEQ ID NO: 175521 - protein, 49 aa, Triticum aestivum
  Clone ID: PAT_TA_69939.pep
SARGHTSRRHHRREPESEADTAAAMRAKWKKKRMRRLKRKRRKMRQRSK

SEQ ID NO: 175522 - protein, 217 aa, Triticum aestivum
  unsure (1)..(217): unsure at all Xaa locations
  Clone ID: PAT_TA_69940.pep
CRFTRPSLPLPLPPATGRPTTQPASLPLPPPVGRPPPHTAGYLSRHPRLPNSGLTPPRPTQPPTAQPPPQRPPAVLLRPDPPTTAGIWPLTTSAQPGGALHLLRHRAVPPAAPTMPSWIWPDHTQRLPLPHTRPAEPPSSLRRVPPHPPPVVLRPLPPIQXPSSTSRTAHKPPIHQPPTHLPAHQPESSPPPLPTTARCLPNPPPKSSTPSPYPASR

SEQ ID NO: 175523 - protein, 156 aa, Triticum aestivum
  Clone ID: PAT_TA_69941.pep
ESTRRRNSASMSSATWSVKLSNTNAWIPDSFHAAIPDSFHAAPPAISMSICSSTLLRDVHPVDESGAACATALQSRRWWSEPGETSRAGRGGACRRQPSERTAGRRRGWPWVVGGCAGVVGGGGYGWMEGAWKSTMSSLSREHRSGRKGRGLLPRA

SEQ ID NO: 175524 - protein, 107 aa, Triticum aestivum
  Clone ID: PAT_TA_69942.pep
LSSSKQQQQQHPNLVLMELEQAKSNLNRTTGDLAAIRASIESLRHDIATEKVLVERSRAKVSSDATLVSSLKEELDQTTKKLQTLKDLQRRREDPSDIFFEIKRMTS

SEQ ID NO: 175525 - protein, 135 aa, Triticum aestivum
  Clone ID: PAT_TA_69943.pep
MDVDTHESMCASSGEKNVVGSPHNSVLEFTRTNRNTELNLKGEKVDDSSVSLVLRIADLCGQARNIHFLFYLESDTAMSVAAEMVEQLELADCDVTFIADFIDLLIVNLVPGRKLANDAAMSPYVESKTCGSEQV

SEQ ID NO: 175526 - protein, 186 aa, Triticum aestivum
  Clone ID: PAT_TA_69944.pep
ARTVLSKLLEMGIVCTMNILQYRRPGPKNVLKDGNITEHGIRCRCCDTIFTMSNFRCHAGLKQETLTLNLFLGSGKSYSLCQLQAWFIEQKKRKESAKDTMSVQADENDDTCGLCGDVGELICCDNCPASYHQACLPCQEVPDGSWYCSSCLCNVCGEVVNSKAPGGLLHALECSQCEYRYHVKCI

SEQ ID NO: 175527 - protein, 69 aa, Triticum aestivum
  unsure (1)..(69): unsure at all Xaa locations
  Clone ID: PAT_TA_69945.pep
KXKXGGRXGGGGRSLYPPAPRRSEKDGARGFHEEDHPEAVGLCAPLLAGDPGDRKHTVKEESAGGCLVP

SEQ ID NO: 175528 - protein, 79 aa, Triticum aestivum
  Clone ID: PAT_TA_69946.pep
MGSIRDISRSHITVSLSRRLRLPGSSSLLEQGDLQRELWRIDKDEFSSSFATMRFNLVQLFSQKPQNTKLRKLVVDLEV

SEQ ID NO: 175529 - protein, 156 aa, Triticum aestivum
  Clone ID: PAT_TA_69947.pep
RLRMARLDDPLWATTVDQALALDEEEYARMFIDPRGGLGPKQYGLVSEASRDAAVVIMTPASLVEILMDVNQYAAVFSSIVSRAATLEVLSTGVAGCYDGALQVMSVEFQVPSPLVPTRESYFVRYCKRNADGAWAVVDVSLDGLQGVKCRRRPSG

SEQ ID NO: 175530 - protein, 175 aa, Triticum aestivum
  Clone ID: PAT_TA_69948.pep
ILREVITMPGQHEKCFLCGQVGHLAAECQGPGPADNVVELPPIHKKKYQFLNIWVLREYLEKDLEIVDPPFKINLERILDDFVFLCFFVGNDFLPHMPTLEIREGAINLLMNIYRAEFKPMGGYLTDGGEVLLERVEHFIQAVAIHEEQIFRKRARIQKAYENNEDRRRAQGENS

SEQ ID NO: 175531 - protein, 103 aa, Triticum aestivum; identical to SEQ ID NO: 107316
  Clone ID: PAT_TA_69949.pep

SEQ ID NO: 175532 - protein, 59 aa, Triticum aestivum
  Clone ID: PAT_TA_69950.pep
PGRPCTLTVPPSLPLPCLPPRRTPPPPSPRPRVDPTVEPSHPPHSGRAPPVEAGHHGRR

SEQ ID NO: 175533 - protein, 115 aa, Triticum aestivum
  Clone ID: PAT_TA_69951.pep
RHRSSRAPRPTSLKRLRGCRWVSEGHLHLRQDRTMPDLLVLQNAPQQVLMSGDRVRQAERHANIAVGWTLTTPHARRPEALLRRSSVEPWHVDADAAHHPRLDVGPWWSSGGCRA

SEQ ID NO: 175534 - protein, 210 aa, Triticum aestivum
  unsure (1)..(210): unsure at all Xaa locations
  Clone ID: PAT_TA_69952.pep
TLARGGFLLAIAAVFLVFLSAVNPLTIWDPHDDPNLGLRGFWLLLESTLDLHGFDWLSNMISSFIFTQDKDNSEHQPCNGGRILLQCHTTSHPAAGTRRTGVRRRNSGDCQNTFRCTRGTPDRAATLASLPGNRAEQLLMNREGDGSRARGGRGGGGGGWTRQGREGRAGQLRMLASFLRPPPHAQDFSMGLLAGFRDEVAEXPRAEXPA

SEQ ID NO: 175535 - protein, 105 aa, Triticum aestivum
  unsure (1)..(105): unsure at all Xaa locations
  Clone ID: PAT_TA_69953.pep
GIPYTFAXCIAVCRDPRWGRCYESYSEDHKIVQQMTDIILGLQGEIPVNHTKGVPYVAKNKVAACAKHFVGDGGTHNGINENNTIIDEHGLLGIHMPPYYDSIIK

SEQ ID NO: 175536 - protein, 63 aa, Triticum aestivum
  unsure (1)..(63): unsure at all Xaa locations
  Clone ID: PAT_TA_69954.pep
RAEEGGGAVAGRRLRDPDRGGARPRQHVVPVQLELGQAVVRRGGRGXQPRRAQEEEERCLAAG

SEQ ID NO: 175537 - protein, 187 aa, Triticum aestivum
  Clone ID: PAT_TA_69955.pep
MSAAAVDSAAVAVRNTCGCKNTGCKTRKCACFRDGLPCIRGRCKCEGCANNSRGLAIDVLPTKCSCKSTRCKTRVCACFREDSRCTGLCKCVGCENNPRGLVNEADSRPKKCKCKRTKCKTNMCTCFCADSHCTGLCKCEGCENTPQGLVNEGDSGPKKCKCKRTKCKTNMCTCFSADFALHWAMQV

SEQ ID NO: 175538 - protein, 231 aa, Triticum aestivum
  unsure (1)..(231): unsure at all Xaa locations
  Clone ID: PAT_TA_69956.pep
LQIRHEGLVDMYTKLQMEQSMECARKVFKRMPTHNVMSWTALISGYVQCGAQENSAIELLCEMLNESIEPNHITYSSLLKACANLSDQDSGRQIHARVMKTSIGNVNVVGNALVSMYAESGCMEEARKVFDQLYESNILSTSSDIGGTESSNASWSSQIESMGVGVSTFTFASLLSAATTVGLPTKGQQLHALSIKAGFESDKGISNSLVSMYSRCGYXDDACRAFDEMDD

SEQ ID NO: 175539 - protein, 228 aa, Triticum aestivum
  unsure (1)..(228): unsure at all Xaa locations
  Clone ID: PAT_TA_69957.pep
MQIFVKTLTGKTITLEVESSDTIDNVKAKIQDKEGIPPDQQRXIFAGKQLEDGRTLADYNIQKESTLHLXLRLRGGMQIFXKTLTGKTITLEVESSDTIDNVKAKIQDKEGIPPDQQXLIFAGKQLEDXXTLXDYNXQKESTLHLVXXXXXGXXXFXKTXTXXTXTXEXESSXXXXXXXXXIRXGXGXXXXQXXXXFXXXXXXXXXXXXXXXXXKEXXXXLXLXXXXX

SEQ ID NO: 175540 - protein, 136 aa, Triticum aestivum
  Clone ID: PAT_TA_69958.pep
GIPASAASTHLHGKVKCFVTQMDRHSRHSMAIPERFVNYFAWKLSGTIKLEAHNGNLYDVGITERRNKTLLRSGWEAFVDANYIEESDSLMFRYRGSSRFKVVVFDSSGCEKVVSSARSRRQSNINDQEPSTNSAD

SEQ ID NO: 175541 - protein, 155 aa, Triticum aestivum
  unsure (1)..(155): unsure at all Xaa locations
  Clone ID: PAT_TA_69959.pep
AHPWRPRPXKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 175542 - protein, 41 aa, Triticum aestivum
  unsure (1)..(41): unsure at all Xaa locations
  Clone ID: PAT_TA_69960.pep
GTGLHTIVHLPQQXPAFDLLSRMLEYDPRKRITAAQALEHE

SEQ ID NO: 175543 - protein, 93 aa, Triticum aestivum
  unsure (1)..(93): unsure at all Xaa locations
  Clone ID: PAT_TA_69961.pep
GEARGXQDKNVGVGRAGGSRPGXLQISGIFXVDIAPENGIRRAGTIAAGAGAERARDEPQGGPDPAHRGVARRLQXNNVRVDRSGGRRPRDLQ

SEQ ID NO: 175544 - protein, 206 aa, Triticum aestivum
  Clone ID: PAT_TA_69962.pep
LQIRHEGEGETEAPPSPRTPAPPSHFAHTSSRLFDEMSTCSSKRARGASDGVDRLSSLPNELLHRVMSFLPMPEVVRTSLLSPRWRYLWVSTPYIRIDHQDFMDDSKFKNFGNRLLILRDGATSLDEARISAHNVVRGTSWCEWIRHAIMHKVRLLHVSAYAPLDSTAMFPSQHLKIVRLQFNLLEHGFFRQLNCVCSVLEHLELE

SEQ ID NO: 175545 - protein, 82 aa, Triticum aestivum
  unsure (1)..(82): unsure at all Xaa locations
  Clone ID: PAT_TA_69963.pep
VPITHTMTRFPCVSVHRPISDNINIVSLSIRHLWTQTTPLTPSLPLSLSLSLSLSLSLSXXXALSXSXXHTXLTHTHXXXVS

SEQ ID NO: 175546 - protein, 103 aa, Triticum aestivum; identical to SEQ ID NO: 107316
  Clone ID: PAT_TA_69964.pep

SEQ ID NO: 175547 - protein, 198 aa, Triticum aestivum
  Clone ID: PAT_TA_69965.pep
GSSKETDPLSAAPKAHPVSSEPQRIQTDIERTLGLVRRLDTEKGIQGNVLSSGDHEKSDVDKSHMGSMGPIVIVRGLTTVKGLEGVELLDTLLTYLWRIHGVDYYGMSETNEAKGLRHVRTDNKTPSTTNINAADWEKKLDTYWQERLTGQDPMVILTAKDKIDAAAAEVLEPHVRKIRDEKYGWKYGCGAKGCTKLF

SEQ ID NO: 175548 - protein, 193 aa, Triticum aestivum
  Clone ID: PAT_TA_69966.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECL

SEQ ID NO: 175549 - protein, 235 aa, Triticum aestivum
  Clone ID: PAT_TA_69967.pep
FFSQHGQSLESYLSSNGDEETKETMKSLNEKLAAALLAISDKEDLVKQHTKVTEEAVAGWEQAEVEATAIKKLLEAASHRNDYLEGQVSHLDKALKECVRQLRLVREEQEEIIRDALTKKSQELESENSKLQNHIAELKKQLAATKSEASTVSAQPDLQEKLQTIEKENLDLKAKLLVQSKDLKILSLEKDLSNQAAETASKQHLESIKKIARVEAECRRLHYLAQKTALVNDSR

SEQ ID NO: 175550 - protein, 172 aa, Triticum aestivum
  Clone ID: PAT_TA_69968.pep
FPPPTTLPLPLSSIFSASRQEPSNRSWSRALVEAAVFMAGGVEGEVRGKVLTLLKEAKAAIKQIKLLLGQTPKVDGPDGQRFCKRQWEFEETEEEEEEEVPGEGCGGDWLDALSKEDLLEYVNGFDVGDTNQGSLVTQDADVCVRVEDVSPMLLNFVQDDVHVLGGCPRSGT

SEQ ID NO: 175551 - protein, 77 aa, Triticum aestivum
  Clone ID: PAT_TA_69969.pep
APLEKNYKRDQKLVWFHAWEVNHGTHFLGMTTYGEIHGAKERPAYDKIPQNVMWWALEKQQVQTKYIASSRTCTMML

SEQ ID NO: 175552 - protein, 130 aa, Triticum aestivum
  unsure (1)..(130): unsure at all Xaa locations
  Clone ID: PAT_TA_69970.pep
PSKKPVEKTPXGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 175553 - protein, 97 aa, Triticum aestivum
  unsure (1)..(97): unsure at all Xaa locations
  Clone ID: PAT_TA_69971.pep
IYAIGAGITAXAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 175554 - protein, 53 aa, Triticum aestivum
  unsure (1)..(53): unsure at all Xaa locations
  Clone ID: PAT_TA_69972.pep
XXLXXTVPXXHTEENKSIXTMVKXMRLXVXPRXGFGLSAXXIWRGLXRWGWSG

SEQ ID NO: 175555 - protein, 108 aa, Triticum aestivum
  Clone ID: PAT_TA_69973.pep
KRTCWIFMALRVETMSDADGRSDTPVPMLIPTNAPEALKSMSMNSVATASGLLGDIIYDLLGASCRLWIQAWYELRSILRAEKEEPSDHGRMGLGQYSGVPGRKQIGE

SEQ ID NO: 175556 - protein, 102 aa, Triticum aestivum
  unsure (1)..(102): unsure at all Xaa locations
  Clone ID: PAT_TA_69974.pep
ETLXPAASPSSTSSLLPAPAHMGNYCSASPAIKQRPRPGSRAPCGIVSSFPAVICQRHRRGLALRATTVEDSDRVGRFVQISSPPSPSASKLLGASIQHLQI

SEQ ID NO: 175557 - protein, 59 aa, Triticum aestivum
  Clone ID: PAT_TA_69975.pep
LCHQYQNIIRGLDALSSHLGPIQIGKTHWSSHLSKHIQEYLTVSVQSVATNNYSLCKQM

SEQ ID NO: 175558 - protein, 218 aa, Triticum aestivum
  Clone ID: PAT_TA_69976.pep
RREFDDDLSCIFNDDNADKLILRVRITNDEAPKGEIQDESAEDDVFLKKIEGNMLTEMALRGIPDINKVFIKYGKVNKFDESEGFKPDNEWMLDTEGVNLLAVMCHEDVDSTRTTSNHLIEVIEVLGIEAVRRSLLDELRVVISFDGSYVNYRHLAILCDTMTYRGHLMAITRHGINRNDTGPLMRCSFEETVDILLDAAVYAESDYLRGVTENIMLG

SEQ ID NO: 175559 - protein, 152 aa, Triticum aestivum; identical to SEQ ID NO: 117759
  Clone ID: PAT_TA_69977.pep

SEQ ID NO: 175560 - protein, 176 aa, Triticum aestivum
  unsure (1)..(176): unsure at all Xaa locations
  Clone ID: PAT_TA_69978.pep
MKGAKSKGXKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDKGGSGCCARTRRELCAVVS

SEQ ID NO: 175561 - protein, 230 aa, Triticum aestivum
  unsure (1)..(230): unsure at all Xaa locations
  Clone ID: PAT_TA_69979.pep
GIRHEGXLENGGCSSMSIPNSQNKTPLHLCIETWNASLVKRWVEVASKEQIVEAVDVPSPVGTALCMAAALKKEHEKEGRELVRILLAVGADPTAQDDPHCRTALHTAAMINDAELVKIILDAGVDVNIRNAQNTTPLHVALNRGANSCVGLLLAAGADCNLQDDDGDNSFHIAADASKMIRENLTWVVQMLEHPSPAVDVRNHRGWTLRDFLERLPREWISEELMEKLE

SEQ ID NO: 175562 - protein, 215 aa, Triticum aestivum
  Clone ID: PAT_TA_69980.pep
MIVAGKDKDAHNSHKHSTSLRGRPAESKDGNHGEIRARNGDATRSDSLKGPGKRWNGEPVHNDRIMERSDKLRNEAKRKIHSFDEEKPSYVDRPVLKKHDSARFQVSKHYDINDARREYGKPYREEPRSKRRRSRSRDHDQGRRDRSLSLSPREQRRSYHGNDHDNYPPGRKYAENDRYRTSDNVGQGGGSYQRYESRLGGYSPRKRKTVPQDEQ

SEQ ID NO: 175563 - protein, 147 aa, Triticum aestivum
  unsure (1)..(147): unsure at all Xaa locations
  Clone ID: PAT_TA_69981.pep
ILFVLLAFIAAXSAYGYGGYGYGYNKCYTRYTNCYSYRKFYVYPKPQVFCYNIPYKKSWCSYKYYEPVLHVYPGSECGKEGWTEKTIAELEIEMTNLLKESLLKITTEMNKAKATFVEQLNKCIEQYKLNVKNKLFNYYAYYIECAK

SEQ ID NO: 175564 - protein, 80 aa, Triticum aestivum
  unsure (1)..(80): unsure at all Xaa locations
  Clone ID: PAT_TA_69982.pep
SGTPIRRSCGQTXPEXEPPVFGPCRLMDFELEMGFFVGSGNKLGDXVDVKNAQDHIFGMVLVNDWSARDIQKWEYXPLGP

SEQ ID NO: 175565 - protein, 280 aa, Triticum aestivum
  unsure (1)..(280): unsure at all Xaa locations
  Clone ID: PAT_TA_69983.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQXXVKTLTGKTITLEVESSDTXDNAKAKIXDKEGIPXDQXRLIFAGKQLXDGRTLADYNIQKEXXLXHLXXXXXGGMQIFXKTLTXKNLTLEVEXSDTIDNVKARXXXXGGXSPXQKXPDXXCKXLE

SEQ ID NO: 175566 - protein, 233 aa, Triticum aestivum
  Clone ID: PAT_TA_69984.pep
NSARGPLCLKEFGLTITVLSPAEIENAFARKPQFIVPLQRSFMEKMPIPPEFLQRGYISEEDLNRPRPIATFLTSWHIELKKDGPNVFFTGSEWPKFLAYFEIAETDVLLIKYQGCMNFSFETFQNGNNENIEEKISSSQQSEQSQCQEDEHVSTRRRTQSNGITPGAQSQEEEHVSTQTRKQSNGKTPGAQSEEEEPVSTQKRKQSNGKTPGAQSQEEEHVCTREKETKRSQ

SEQ ID NO: 175567 - protein, 146 aa, Triticum aestivum; identical to SEQ ID NO: 135007
  Clone ID: PAT_TA_69985.pep

SEQ ID NO: 175568 - protein, 194 aa, Triticum aestivum
  Clone ID: PAT_TA_69986.pep
SPDCARRFLTLTRRIRLDPPLVKQRKTSRRDSISWTLERMNTRFVNLIVQDLSRRMYSLHRLDPLKYLFYPSTEARKAALAKTEKNKPPMLERLSVLPKPEINFHPMSSLTHSSMNRDSFSLLGKDSIVFSDSFSKTILYNIELGTVASIPRINSCMVPFGMSLPMIQDNLVDRTEDQSLYVMDLSRDANISSC

SEQ ID NO: 175569 - protein, 148 aa, Triticum aestivum
  Clone ID: PAT_TA_69987.pep
FLLVICWAEHHEHQTKSLGRERGGGADGPRGLAGAVEEPAELVPAAALTSSLQPPPHQPGRHCVPLLLLLHPEAGHLLVILERTSLQIQSLPAIPNTCWIGGRGWPSLLLWPLSMAAAHSREIRREAAAAPTHLRHAVSPTPPLPRPR

SEQ ID NO: 175570 - protein, 75 aa, Triticum aestivum
  Clone ID: PAT_TA_69988.pep
ETATTSKEGSRKCMEPVEKCLRDAKMDKSTVHDVVLVGGSTRIPRVQQLLQDFFNGKELCKSINPDEAVAYGAAV

SEQ ID NO: 175571 - protein, 143 aa, Triticum aestivum
  Clone ID: PAT_TA_69989.pep
MDQSSFGNLGAGEGGSSSSKASSSFLQLQPLSTTTVASGPGPMGGTYYGTPLALHQAAAAAGSSQYQFHHHKSRGEEISQAEAEAIKAKIMAHPQYTALLVAYLDCQKVGAPPDVLERLTAMAAKIDAHPPGRLHEARDPELD

SEQ ID NO: 175572 - protein, 187 aa, Triticum aestivum
  Clone ID: PAT_TA_69990.pep
CRFGTRPDLSKMIEAVRALVAQCDDLKMKYHEEMAKRKKLHNIVQETKGNIRVFCRCRPLSKDETSSGYKCVVDFDGANDGDIGIMNGGTAKKTFKFDRVYTPKDDQAEVYADASPLVTSVLDGYNVCIFAYGQTGTGKTFTMEGTERNRGVNYRTLEELFKIAEERKDTVTYNISVSVLEVYNEQI

SEQ ID NO: 175573 - protein, 237 aa, Triticum aestivum
  unsure (1)..(237): unsure at all Xaa locations
  Clone ID: PAT_TA_69991.pep
ERCTEASPCMLSTSKSSGSDDELLRSTVKPCKRTSSGPICSICKSGAGSCLLIQCQNSSCSRSFHTFCLSPPMQDSRGTLECPLCKINQASLANGTEVYAPKKVQRLVGCRRVILQESDFSYQMLVKWQSLSHHHDCWVPLDWLLVVERQRARSYISKNTLPKEAYSEDQRKPEWLEVDRAIACRRKFGRDGLCDVLASFHNNEDFEGYEFLVKWKGLDYCDVTWESYCTEXVASAV

SEQ ID NO: 175574 - protein, 89 aa, Triticum aestivum
  Clone ID: PAT_TA_69992.pep
LSYSDIFFHSLYLYHDFVQVLKIRFSHGSHPTECIFLPSKTKGKKNVYSLLFFVWLGLFLCPQNKTNAITSQPKMVKMVTTGKQSHTQA

SEQ ID NO: 175575 - protein, 228 aa, Triticum aestivum
  Clone ID: PAT_TA_69993.pep
MMDSMYGYVLKDGGPVGVKVMWDCPKIFLYWDEPKTCMIKIIHGPGNKLLEDAPSASTSALLLPGFICKQSTSVHVYDNLSITNIPPPPDGSGWQSQRWCRVERCPKLHTVFNIRQGSGASSFRRLETLWLSQLLTAQTFTTSTLTFCSLEFLHLDCCPRLLHVFTLASRNSGRFFCSYLQTLEIVYCDDLREVFPLAPGPQKQDTVIEFPYLRSIHLHEVPKLQHIY

SEQ ID NO: 175576 - protein, 133 aa, Triticum aestivum
  Clone ID: PAT_TA_69994.pep
TVPSTLAPQPLLRPRLEHDGAAVLRTNPLTLRHRCPLALQHRPLQFPHPPPATSTLPLAFFPYIGPRWSRSDGSPRSAIATAHTRPSTSSSRDSSLAATEVLEVFSFPTIVRRGRCPRAFLLGRRHSHAVGGI

SEQ ID NO: 175577 - protein, 74 aa, Triticum aestivum
  Clone ID: PAT_TA_69995.pep
ETATTSKEGSRKCMEPVEKCLRDAKMDKSTVHDVVLVGGSTRIPRVQQLLQDFFNGKELCKSINPDEAVAYGAA

SEQ ID NO: 175578 - protein, 204 aa, Triticum aestivum
  unsure (1)..(204): unsure at all Xaa locations
  Clone ID: PAT_TA_69996.pep
EGXKVAKHDDDDAGPRLNNDITAPFLRLVTDQGHDVVPRHEALQMAARMGLDLVEVDRKSDPPVCKIIDFHKEKYIKDVKDKERLKAKSAITLRCGDIKEVRFKAKTEIKDLKVKADAITRLMDRGYRVKCMAMPAGNEAEDLGGPLSRLLGLIQDVCTVESGPHLDSKHAYVIVRHVKFATKKGGKKASKAMEDASKGSPRTA

SEQ ID NO: 175579 - protein, 110 aa, Triticum aestivum
  unsure (1)..(110): unsure at all Xaa locations
  Clone ID: PAT_TA_69997.pep
SPLPAASTHRRPHRPPHPPPPTSSLPPLTISPYPIPQIESTXARVPSLRPSPTPLPSPPPPCSLPWLTPSPPLSSSLPRSPSGPRSSRPTRRRWWRRPPPRPWRSTRHLC

SEQ ID NO: 175580 - protein, 43 aa, Triticum aestivum
  unsure (1)..(43): unsure at all Xaa locations
  Clone ID: PAT_TA_69998.pep
EIDDDQKLRNLYDKRISQEVVGDLLGEEXKGYIFXIMGGCDKQ

SEQ ID NO: 175581 - protein, 229 aa, Triticum aestivum
  unsure (1)..(229): unsure at all Xaa locations
  Clone ID: PAT_TA_69999.pep
GIRHEAFXVVNLVQQDFQLKRPITNAVLKNQQVLLDFMHMVCIDSSMTTNKPIAWIDVHGNRFFPELCAGLVTSKPSQHGKSDPSGKSKAGECAGTLILTAEAESSSSDSVDAVLPHAKKVNNILEEGQEVHNYAAVENKAGPAICLNEPASGNIHAATYKQKIGQPVDSAVRKLLLEGAGQPFSEENIIGIYRTPLVDQQGRARFNLFQKELEATKMHRGNANVRYAW

SEQ ID NO: 175582 - protein, 93 aa, Triticum aestivum
  unsure (1)..(93): unsure at all Xaa locations
  Clone ID: PAT_TA_70000.pep
PGXXALREIRKYQKXTELLIXKLXFQRLVREXAQDFKTDLXXQSSXVSALQEAAEAYLVGLFEDTNLCAIHAKRVTIMPKDIQLARRIRGERA

SEQ ID NO: 175583 - protein, 227 aa, Triticum aestivum
  Clone ID: PAT_TA_70001.pep
FQCRNGEHLVLSDVYYIPKLCSNIVSIGQLDELAYETHISFGVLQLRDPGGRLLARVHRNEGRLYVLQLTPARPVCFVAHAGEDAWRWHARYGHVNFRALRQLARNDLVRGLPLFDEADRVCEACLAGKQRRAPFPQAALRRAGEVLELVHADLCGPISPPTPGGKRYFLLLVDDKSRHMWLYLLATKDEAQPALKRFQAMAELESGRQLKALRTDRGGEFPRAEFL

SEQ ID NO: 175584 - protein, 233 aa, Triticum aestivum
  Clone ID: PAT_TA_70002.pep
RNSARGLPGTESLARCEFSFRYLKEHLAVTAEEMAVYLTGHYGEQVTPAEAWRARQMALEKEFGTFYDSYNFAPRLLKEIARKNPGGFVEIKDSLVSGCKDFRVLQRICWAFGQSLQAFSACRPVLCIKGTPLCGKYQGVLLTAVALDANNFSIPVAYAIVECETKESWLWFLRNLERAVVHQADVCIIHDYKKELIDAVEDLLNSRRRQGLKAESRWCMEHLAENFYAYFGD

SEQ ID NO: 175585 - protein, 51 aa, Triticum aestivum
  unsure (1)..(51): unsure at all Xaa locations
  Clone ID: PAT_TA_70003.pep
XVRSXLGVAQLPLAHADAPALGQLQHXQSPFLDFAEISFVRTCRRRQHAAA

SEQ ID NO: 175586 - protein, 181 aa, Triticum aestivum
  Clone ID: PAT_TA_70004.pep
MARLWGRRLLLGGGGLLLGGLGGRLLLGRLGLLLGGGGGLLGEQHGVDVGDHATVGDGDGEDEEVEPLNEEEQEEKEQLLEEGFSTWTRRDFNTFIRACEKYGRDDIKSIASEMEGKTEEEVQRYAEVFKERYTELNDYDRIIKNIEKGESKISRKDEIMKAIAKKMDRYKNPWLELKIQY

SEQ ID NO: 175587 - protein, 93 aa, Triticum aestivum
  Clone ID: PAT_TA_70005.pep
PPSLQVPHKLPIFLSFHPLASLPLPVLAPLPITNNPELTIQKFMEDETGIIGGNISYRRGDRQLWRGAGEVRCRRRACAGPLQRPHRLQIAAA

SEQ ID NO: 175588 - protein, 76 aa, Triticum aestivum
  Clone ID: PAT_TA_70006.pep
PWYLLRISCWFCVLLSMDVEIKIWMYSHLPLVLHYVMVNSNALFLFEYLFHLMRLKPITRFYALILTDKDKMNKSH

SEQ ID NO: 175589 - protein, 196 aa, Triticum aestivum
  unsure (1)..(196): unsure at all Xaa locations
  Clone ID: PAT_TA_70007.pep
ALSLSLSLSAHPSLSCLLLPPPXTTTVHHHHLFLSLPSGGPQKTTLAEAAAATHFFLSCLVAERPAARMVVRLLFLLFLLACSLLFLELPSVSGTSSSSFSNCSVAIKPCHHYHSCLDPRPGGSSAQVSRTFLDSQMYSCASTCGCSTRFPFLEVIYATDERLILNLTSPSICTQILYCFSICVSIWDWGRLIMLI

SEQ ID NO: 175590 - protein, 187 aa, Triticum aestivum
  unsure (1)..(187): unsure at all Xaa locations
  Clone ID: PAT_TA_70008.pep
PAHLLRASLASKLWLGLLSSPRFRGRYHEHHXAPPMLGFLHTWHYGSHPTKVEDPIPYFKSTAKFGARIPDDEWGDIYYTAWDCRHGRVLLDCFDAYQLRTALVVWDPMTGCRRELPRPWIWDRRRAAAVLCAVSGCDHRTCHSAPFQLVFVGLDEDDHDDCVARACVSLPETGDWSKPVPQFDAWV

SEQ ID NO: 175591 - protein, 175 aa, Triticum aestivum
  Clone ID: PAT_TA_70009.pep
RLHLLPRAPPCAATAHHAGTFTPARPATRRRRSSLQGLGADPEARVGGDDEEGLSTGGSMASAAPRHKGDGEAGERRRKKGGVVRRPSEELAGAGRRRTGAGDGGVRRGGAKSLQVEAGVEAEDERIPGLILACTQLPRSIPSYPSGPSSMARMRRTPTRGKKGDHARWSTPAPS

SEQ ID NO: 175592 - protein, 165 aa, Triticum aestivum
  unsure (1)..(165): unsure at all Xaa locations
  Clone ID: PAT_TA_70010.pep
SRXPVTGDRHVLPAPGIVWLICTAAVFCAADGCQHLDCQGGPFRVAFLATDDDDRQVKASVYSSVTGAWSAPVSLDDGCECYSQHIRDDIAENLYHLPYVXPGRVAVIGDEVYFTLRSAHKIVKYNLPNNCLSMIDPPPHTRSPIALMVMEDSSLGFACTESSSL

SEQ ID NO: 175593 - protein, 175 aa, Triticum aestivum
  unsure (1)..(175): unsure at all Xaa locations
  Clone ID: PAT_TA_70011.pep
SGGWLRGIRHLAGTVAXXGRRGSTEVRDREKEKKEREARRLSSATDDSLDGSSTRSAGRVKVRQYGKTCKELTGMFMTQELAAHSGSVWCINFSLDGRYLASAGEDRVIHVWEVSEGERKGELLGEGAVSKESGGGGSPFVAVAGNGSPEVAMLPLNSADKGYGEKKRRPRVQSS

SEQ ID NO: 175594 - protein, 39 aa, Triticum aestivum
  unsure (1)..(39): unsure at all Xaa locations
  Clone ID: PAT_TA_70012.pep
SVIHHFPRLRLPVQAQQFPCQGHHLRLXWPCSTTXLVLL

SEQ ID NO: 175595 - protein, 181 aa, Triticum aestivum
  unsure (1)..(181): unsure at all Xaa locations
  Clone ID: PAT_TA_70013.pep
GGTLIVCPMALLGQWKDELEAHSTPGAISVFVYYGGDRTGDLKLMAEHTVVLTTYGVLQSAHKADGSSAFHRIDWYRIVLDEAHTIKSPRTKAAQAAYMLSSQCRWCLTGTPLQNNLEDLYSLLCFLCVEPWCNSNWWQKLIQRPYENGDERGLKLVKAILRPXMLRRTKETKDKMGKPIL

SEQ ID NO: 175596 - protein, 92 aa, Triticum aestivum
  unsure (1)..(92): unsure at all Xaa locations
  Clone ID: PAT_TA_70014.pep
ATMLTAWHLFVPFYXLHVALCMKPFEHKSFYGRTFMGFGVLNGISIWLLNQSLCFNSVGFYQGKSSALVGSRFLILHRTCQKVSIYSIMWVT

SEQ ID NO: 175597 - protein, 36 aa, Triticum aestivum
  unsure (1)..(36): unsure at all Xaa locations
  Clone ID: PAT_TA_70015.pep
RXXSPQPPRXRPXLSSARPWLXPRSXXQPRKGRWRG

SEQ ID NO: 175598 - protein, 101 aa, Triticum aestivum
  Clone ID: PAT_TA_70016.pep
MEGDEAGAAAAAAARIRVVRCPKCDKFLPELPAYSVYVCGGCGATLQAKRKNSAQALDTSDNGNMKYLEVLETVPETSEAMAGASIDHKSVPNRMPPLHSR

SEQ ID NO: 175599 - protein, 202 aa, Triticum aestivum
  unsure (1)..(202): unsure at all Xaa locations
  Clone ID: PAT_TA_70017.pep
GLXXVAMCCKXKLQVLRVLPLDAHEDADELVSEVGLTAISEGCRDLRSILYFCQRMTNAAVISMSHNCPELKVFRLCIMGRHRPDHVTGEPMDEGFGAIVRNCSKLTRLSTSGHLTDRAFEYIGNYGSSLRTLSVAFAGDSDLALQHILQGCSKLEKLEIRDCPFGDAGLLSGMHHFYNMRFVWMSGCSLTLQGCQEVARQL

SEQ ID NO: 175600 - protein, 193 aa, Triticum aestivum
  unsure (1)..(193): unsure at all Xaa locations
  Clone ID: PAT_TA_70018.pep
XXRCVPVFLSEELRDQYYSGYCNNILWPLFHYLGLPQGYKVNKTKDFKSQLKAYTEANKMFADTLCEISKEGDIIWCHDYHLMLLPKLLKQSNLNMKVGWFLHTPFPSYEVYQALPNRKELLQAVLEADLVGFHTYEYARHFVSACTSLLGLEGRLGGIKFKGRIVKVDAFPIGIDAQHFKESLDLNAVKGEI

SEQ ID NO: 175601 - protein, 54 aa, Triticum aestivum
  Clone ID: PAT_TA_70019.pep
KKISMGLALLVEYKAPSASFCPPITKKINCKAKSHLKERDEEFTYLTSKIFSIR

SEQ ID NO: 175602 - protein, 153 aa, Triticum aestivum
  unsure (1)..(153): unsure at all Xaa locations
  Clone ID: PAT_TA_70020.pep
MATXXSVGTLGXXRXLKGKKVFVRADLNVPLDDAQKITDDTRIRASIPTIKYLLEKGAKVILASHLGRPKGVTPKFSLKPLVARLSELLENVRFYKEEEKNDPEFAKKLASVADLYVNDAFGTAHRAHASTEGVTKFLRPSVAGFLMQKELDY

SEQ ID NO: 175603 - protein, 200 aa, Triticum aestivum
  unsure (1)..(200): unsure at all Xaa locations
  Clone ID: PAT_TA_70021.pep
HRLTLSGISLGGQLGXXLANFTSIITLELSNNNIGGTIPDNLPVTLQRFFLSGNQLXGSLPSTLSTLTLLTDMSLSSNRLSGDIPDVFSALTGLINLDFSSNNLTGPLPPSMGNLKALTTLHIQDNQISGTLNVLQDLPLKDLNIQNNLFSGPVPTKLFNVPNFQRDGNPFNTSIAPSPLPAAPAPSPSLSPSTGHVPSK

SEQ ID NO: 175604 - protein, 196 aa, Triticum aestivum
  Clone ID: PAT_TA_70022.pep
GLLLLLLSLRVPPAAAPPPQAAAGNPTPILPGSPALLPSVQAPTPSVAVKPNLPLPPPASLPSVQAPTPSVAVKPNVPLAPPPSLPSTQAPTPSVAVKPNVPLVPPASLPSVQAPTPSVAVKPNVPLVPPPSLSSVQAPAPSVAVKPNVPLAPPPSVNNQPGTPIGSGNDVPPYPPPEGIFPAVPPSASVPPQHVK

SEQ ID NO: 175605 - protein, 43 aa, Triticum aestivum
  unsure (1)..(43): unsure at all Xaa locations
  Clone ID: PAT_TA_70023.pep
STNFLRANACVXQRSEYMQSERLQMHISHQVLTFTXRFLSWHK

SEQ ID NO: 175606 - protein, 71 aa, Triticum aestivum
  Clone ID: PAT_TA_70024.pep
KRVKIYTAYTEPIYRFETSTPDITRRNRYILYTTWSQIHSPLNRCYLRRFLARFRATVNGTSTLSPSVSRA

SEQ ID NO: 175607 - protein, 103 aa, Triticum aestivum; identical to SEQ ID NO: 107316
  Clone ID: PAT_TA_70025.pep

SEQ ID NO: 175608 - protein, 130 aa, Triticum aestivum
  Clone ID: PAT_TA_70026.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARR

SEQ ID NO: 175609 - protein, 94 aa, Triticum aestivum
  Clone ID: PAT_TA_70027.pep
AKMQIFVKTLTGKTITLEVESSDTIDNVKAKIQDKEGIPPDQQRLIFAGKQLEDGRTLADYNIQKESTLHLVLRLRGGAKKRKKNWPGQRKMNL

SEQ ID NO: 175610 - protein, 94 aa, Triticum aestivum
  Clone ID: PAT_TA_70028.pep
FPHSRRRKVQRYPLSSNTCYRVQSNRIGSFMVRASLHLQEPAKRNPCSANESTTSADKTTNLKMNPQICAPNFTSSTPKKVEHRPTPSTIRRRS

SEQ ID NO: 175611 - protein, 116 aa, Triticum aestivum
  Clone ID: PAT_TA_70029.pep
RHEGGHSLPAPPRSRTPCDPLLLCQVILLTPRAPLRAEIRRAVRSFSIAARRERNPWLIPDLLLANSAVLFGARASGARLAILLPTLNFGLPEFVALAECSYFSRSARPSFRGIDS

SEQ ID NO: 175612 - protein, 60 aa, Triticum aestivum
  Clone ID: PAT_TA_70030.pep
SLRVALVRRAGWILVEMLRWGWSLDVDDVDYHASSSFIFLNLFLACSCPFVAVVFLATEA

SEQ ID NO: 175613 - protein, 170 aa, Triticum aestivum
  Clone ID: PAT_TA_70031.pep
RHEEASAREKMGLQKLIEDHEVKLEARRRDFELELESERKSFDEKMKHREADLVKKEKDLSSRENKISKREQALNESKKKLEELQNDLDTKSKALKKWDESLKLEKDKLSEEKLQVDHERKQAEMYRSDVERLKATIEAEKKQILEEQNNLKVTEEERQEHSMLTAQLKK

SEQ ID NO: 175614 - protein, 123 aa, Triticum aestivum
  Clone ID: PAT_TA_70032.pep
RGRGDDSSGGRLLPWRHPNLPDFPPRQLSGEERWIRLLLDLAPDPRCAGADELPLPARGSGDLQAKGKGQATAEREKMRGRRRKERREKEREERGEGGAASDGRGSPPAEACAWRFDVILAPS

SEQ ID NO: 175615 - protein, 219 aa, Triticum aestivum
  unsure (1)..(219): unsure at all Xaa locations
  Clone ID: PAT_TA_70033.pep
ANSARGKHCLNCXELKGSEVAAGYDVFKTHIARAALVSANTASVLVSTAIGFDERMLLHSEMEIKPNPHPERPNRLRAIAASLAAAGIFPSKCALVPPREITKEELVMVHTSDHVESVEQTKNMLYSYFTSDTYANGHSACAAKLAAGLCADLASLIVSEHVQNGFALVRPPGHHAGVKQAMGFCLHNNAAVAALAAQKAGAKKVLIVDWDVHHGNGTQ

SEQ ID NO: 175616 - protein, 124 aa, Triticum aestivum
  Clone ID: PAT_TA_70034.pep
MSLIAGEEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLR

SEQ ID NO: 175617 - protein, 93 aa, Triticum aestivum
  Clone ID: PAT_TA_70035.pep
PVAAGGGEDKSSTAKRGREIREVGASRAVGEDSMGREVARCFPGERAAVEEAEDQGEAEVAASGGRRLSFHRRRWRPLCDVGRRLCASLAAVG

SEQ ID NO: 175618 - protein, 185 aa, Triticum aestivum
  Clone ID: PAT_TA_70036.pep
MFEDFSAKVCEQIIVKLVGWEPADIQVLDIKPWAMHAEVAEKYVGCDNRVILVGDAAHRFPPAGGFGMNTGVQDAHNLAWKLCLLLNGIADPSIIQTYESERKPVATFNTELSLENFKAAMSIPATLGLDPTIANSVHRVINSSLGSIIPRNLQKVVLEGLFSIGRTQVSDYILSENNPLGSLRL

SEQ ID NO: 175619 - protein, 112 aa, Triticum aestivum
  unsure (1)..(112): unsure at all Xaa locations
  Clone ID: PAT_TA_70037.pep
PPRRSPWEGLLPTPARALPPLQPAERFCPVVRDIRLLRLKSTSTARSFFYPQDPEGKKMEDPMEQEXEDLKAGEKKTKDPVEKEIEDLKAKKVRLTPQLVHSMXNYCWMLGG

SEQ ID NO: 175620 - protein, 181 aa, Triticum aestivum
  unsure (1)..(181): unsure at all Xaa locations
  Clone ID: PAT_TA_70038.pep
MNSNVRVTHPCAEGNSRLCVSVRDYYCYMLQTXLGIFNPILXGARLLQQWGVDMYIKIESCRLKWXKKNQTKIRADLYKGVVDAITSGETRASAVGVRIVLPGTYPGGDCDMKRRHMDAMAIVHTYGKPDIFLTMTCNPNWEEITNELFPGQTAQDRPDLVARVFHGKIEAMKEMLFKKNI

SEQ ID NO: 175621 - protein, 234 aa, Triticum aestivum
  unsure (1)..(234): unsure at all Xaa locations
  Clone ID: PAT_TA_70039.pep
SLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFXKTXTGKTXTLEVEXXDTXDNVKAKXXDKXXIXXXQXXXXFXXKXXXDXXXLXXYXIXXXXXXXLXXXXXX

SEQ ID NO: 175622 - protein, 53 aa, Triticum aestivum
  unsure (1)..(53): unsure at all Xaa locations
  Clone ID: PAT_TA_70040.pep
ACDAPQGRATSXIQSTPAIHLKFEQAAXYPTSSFKTRSTGIKKSIVQECLXFL

SEQ ID NO: 175623 - protein, 97 aa, Triticum aestivum
  unsure (1)..(97): unsure at all Xaa locations
  Clone ID: PAT_TA_70041.pep
ALVGSRGKVGMRGRGTPDIPKFRALRRDNTPSPAEFSWMIDSTMLLLELYGGGRKLAKAWDAPSLRCCRWVASPMLSCVSLVSHTYASSLMXRCCRS

SEQ ID NO: 175624 - protein, 85 aa, Triticum aestivum
  unsure (1)..(85): unsure at all Xaa locations
  Clone ID: PAT_TA_70042.pep
FSYILDHAHAHPYSNKNTSVWRARASAVWKHQLICNWSEGELLILAAVEARHLAATYVSCXCAIGPWGWVRQLXTRRHFXHVLPC

SEQ ID NO: 175625 - protein, 50 aa, Triticum aestivum
  unsure (1)..(50): unsure at all Xaa locations
  Clone ID: PAT_TA_70043.pep
FEAVVTFFLGSSSELSSELSSSLVLSFLAXLGVXFAASFSFFWGGSSSLS

SEQ ID NO: 175626 - protein, 70 aa, Triticum aestivum
  unsure (1)..(70): unsure at all Xaa locations
  Clone ID: PAT_TA_70044.pep
AWKINISGXXXDAPADLEFPRSPGQNATEISRGHAPRSPGINRIGSDNQIAQGAETRGRKRRGRLGTCLG

SEQ ID NO: 175627 - protein, 216 aa, Triticum aestivum
  Clone ID: PAT_TA_70045.pep
EKKAMWRREMDWLLCISDHIVELVPTWQSFPDGTRLEIMTSRPRSDLYINLPALRKLDHMLLEILDSFRDTEFWYVDQGICAADCDGSASFRAAFHHRDDKWWLPVPRVPPGGLRDKTRKQLQHKRDCANQILKAAMAINSNALAEMDVPVSYLDSLPKNGRATLGDVIYRYITSDHFSPECLLDSLDLSTEYQALEIASRVEASVHVWRRRVPAK

SEQ ID NO: 175628 - protein, 88 aa, Triticum aestivum
  Clone ID: PAT_TA_70046.pep
AKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 175629 - protein, 73 aa, Triticum aestivum
  unsure (1)..(73): unsure at all Xaa locations
  Clone ID: PAT_TA_70047.pep
VSNVAPTPKTLAICISVVSALVNNVXALNICXXTTDVTNXTXXXXXKTTXSFLTISXXMHVQXIKXNXSMKTN

SEQ ID NO: 175630 - protein, 79 aa, Triticum aestivum
  unsure (1)..(79): unsure at all Xaa locations
  Clone ID: PAT_TA_70048.pep
TRSAPSPHTNPGKPLALRRCPAMPSXATRSSSMGAGDIEFALDLEDIAARAAKADCIGALACGRTSFSYHRLPEPPLXL

SEQ ID NO: 175631 - protein, 138 aa, Triticum aestivum
  Clone ID: PAT_TA_70049.pep
SRSTSFSDYFLNGKYISKPLVSTPLKEGQGQLSPSNQIDRSTSTNDSVHSRSRSDNPQENDVKKVARSNEANAARKAFGAFLGMLTRTKENIACATRLAIDCAKHGIAWEAIDIIVECMEKENLYKRVDLFFLIDSIT

SEQ ID NO: 175632 - protein, 151 aa, Triticum aestivum
  Clone ID: PAT_TA_70050.pep
MAPKAAEKKPVATAEKTTAGKKPKAEKRAPATKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSSAGFVVVS

SEQ ID NO: 175633 - protein, 39 aa, Triticum aestivum
  unsure (1)..(39): unsure at all Xaa locations
  Clone ID: PAT_TA_70051.pep
DKNELSSVVSSLGGFEHGLYVERWTTFAKELSVIVARSX

SEQ ID NO: 175634 - protein, 93 aa, Triticum aestivum
  Clone ID: PAT_TA_70052.pep
GEHLSLSDREAAPILALLWPWRLSRQEVRTPPRLPKPTPGFPVDDRGTRMTVIQYLKDIYNCNLRILFNYMIDQHSFLWHGSSFWFWRSILHC

SEQ ID NO: 175635 - protein, 157 aa, Triticum aestivum
  Clone ID: PAT_TA_70053.pep
GATDVDDRHRHRGRDHRRRQRDRRGGQLRRSQVFLFSFPLLAPFYLGAKDLNLTNITSQDDRIRRRVKLRWEVTLALHFYAYKMPPSGCQRADLPWGSSGSEDRKNPSILPCPSISFCSRVLQKAIFFLFLTCTMALQDGGRRLRGQLRRQRRGDGG

SEQ ID NO: 175636 - protein, 101 aa, Triticum aestivum
  unsure (1)..(101): unsure at all Xaa locations
  Clone ID: PAT_TA_70054.pep
FCSXKLVXCKXXIREEIESIFNYCTXKXKLILLIQATENMLQKFCLPTNSRKQQVSLVEHFVVIQQVLLQFERFVFLQKKKKTIDGVPNLIQHCNFNSKKN

SEQ ID NO: 175637 - protein, 136 aa, Triticum aestivum
  Clone ID: PAT_TA_70055.pep
ILAPKAAEKKPVEKTPAGKKPKAEKKVPASKEGGDKKGKKKAKKSVETYKIFIFKVLKQVHPDIGISSKAMSIMNSFINDIFEKLAGESAKLARYNKKPTITSREIQTSVRLVLPGELAKHAVSEGTKAVTKFTSS

SEQ ID NO: 175638 - protein, 94 aa, Triticum aestivum
  Clone ID: PAT_TA_70056.pep
PTVWITQQYASCNNLILPPYQNKCCTYFGSEGVLNCAPEVKMPIHSSASKRCLVHYYFLLRAFTSIAKVNSHFKYYSLYNWQLMVKRQEIGSSW

SEQ ID NO: 175639 - protein, 191 aa, Triticum aestivum
  unsure (1)..(191): unsure at all Xaa locations
  Clone ID: PAT_TA_70057.pep
FVKTLTGKTITLEVESSDTIDNVKAKIQDKEGIPPDQQXLIFAGKQLEDGRTLADYXXQKESTLHLVLRXXGGMHXXVKTLTGKTITLEXESXNXIDNVKAKIQDKEGXPPDQXRLXFAGKQLEDGRTLADYNXQKEXTXHLVXXLRGXMXXXXXXPXPXXPSPLXXXXXDTIDNXVXAXIQDXXGIXPXX

SEQ ID NO: 175640 - protein, 143 aa, Triticum aestivum
  unsure (1)..(143): unsure at all Xaa locations
  Clone ID: PAT_TA_70058.pep
GFFTTLHSPATNSPRVGWVLSCXWRRHRPSAAGGHDLQLATRLPRNPPSYPPPSISFPAMVTTDMDPSLLPPLLPLLFPDSTDSLPPLARSVLLASSHPLLCIVPVASPFVIRSLPLGLILSTTGAQVPWHCATVRPCALASV

SEQ ID NO: 175641 - protein, 112 aa, Triticum aestivum
  Clone ID: PAT_TA_70059.pep
KVVLIGDSGVGKSNLLSRFTRNEFCLESKSTIGVEFATRTLHVSPSIHRFHSLLCLLAARSDGINRIRGLFPSSLRSRSISLLPNSSKSIAAGTDSEARIDFSAFMISTVPR

SEQ ID NO: 175642 - protein, 115 aa, Triticum aestivum
  unsure (1)..(115): unsure at all Xaa locations
  Clone ID: PAT_TA_70060.pep
TCDLLAAAATVATTCNLPATATTAHTLPNGRLYHPFSPPLSFSSPSATSPPPRTRSTSRPGIAEWSGRACQNQHNTVAGGEGEAESLAAAGPIWAGMTDGLREQRXGAGSRRLFM

SEQ ID NO: 175643 - protein, 103 aa, Triticum aestivum; identical to SEQ ID NO: 107316
  Clone ID: PAT_TA_70061.pep

SEQ ID NO: 175644 - protein, 198 aa, Triticum aestivum
  unsure (1)..(198): unsure at all Xaa locations
  Clone ID: PAT_TA_70062.pep
RAEEFGRGPRHPSSLAAPRHLAPVRXILPRYPTFLRTTGTPNHGRPATPPAPTWRRIGSGLAAPLEKHXPQPRPDHPLSTFWKRSRPSTNPRPLSLCPSPHGQGAPEPPSSPCATKAPHGSAPPCPPHRIHFGPSLTTNVSLLDPPRPMAFDRGSNVEVPGHPLPLPSARSTTVREQLQRRWLGAAGLGAPPRQQLRA

SEQ ID NO: 175645 - protein, 70 aa, Triticum aestivum
  unsure (1)..(70): unsure at all Xaa locations
  Clone ID: PAT_TA_70063.pep
LSAKRVFCLPAMSFHFXCGGLFGSSPLIIFFXFISSEVWVPLFCYFLVLIIKVCIFPPLLDCCILIVSHR

SEQ ID NO: 175646 - protein, 94 aa, Triticum aestivum
  unsure (1)..(94): unsure at all Xaa locations
  Clone ID: PAT_TA_70064.pep
XXXXXXXPPXEXVXXXXXXXXRARAXXPPXXIXXLXXXYXSXXXXSFXXXXXXLFXXSVXXLXXXHTPXXXSLFXSLSLSLXSLSLSLXXSLSL

SEQ ID NO: 175647 - protein, 167 aa, Triticum aestivum
  Clone ID: PAT_TA_70065.pep
FGRGYSWSPTPPLLRLPASASTSTSTSTTTSPRRCLSSTSTSTAASSPPPRGPRDPRVPGLPTPPTIFTYGILMNCCCRAHCPDLGLAFFGRLLRTGLKADLIVANTLLKCLCHAKRTDEAVNVLLHRMSKLGCVPDTFSYNIVLKSLCDNGMSQQALDLLHMMAKE

SEQ ID NO: 175648 - protein, 131 aa, Triticum aestivum
  unsure (1)..(131): unsure at all Xaa locations
  Clone ID: PAT_TA_70066.pep
ECDIENKRECGYNGITSEQCEDSGCCWVESDTEGDPWCFVKRNXLEQCQVXSSERVDCGHYGITKXQCETRQCCWDESVXRVPWCFVKRNMLXQCQVDSSERVNCGHNGITQEQCETRXCCWDKSVAGSPG

SEQ ID NO: 175649 - protein, 215 aa, Triticum aestivum
  Clone ID: PAT_TA_70067.pep
FRGRGWTGDGRRDVAVPQNPGFDREEHGSKGVGGAAEWVDRGGDGLIGLSLGRQRSFADMFQDNLGRRTPTSEHPSRAASRNSVDPSENQYSLHNDTMDAQRSVGNAQSVGSLSSINASASQTFASVLGSSASRNATPDSHYIPRVPSPGLPPVGARISSNEKRLNCSSSSFNTVSSKALEPDDILTALSSMNLSKGGTLNNNSNISQSKFQREI

SEQ ID NO: 175650 - protein, 147 aa, Triticum aestivum; identical to SEQ ID NO: 134853
  Clone ID: PAT_TA_70068.pep

SEQ ID NO: 175651 - protein, 90 aa, Triticum aestivum
  Clone ID: PAT_TA_70069.pep
MPAKYLQAFERRGDRSCTGVDCACRILTGNVPFGLPISRTLVISLPKVCKSLSVQLMCRDTATQIPAPPLYGLLHFAPGKLINTARKPFA

SEQ ID NO: 175652 - protein, 137 aa, Triticum aestivum
  Clone ID: PAT_TA_70070.pep
MMEVGMAMAMKVLLSLCCVGACSLALYLYHTVWVVPQRLLAGFRRQGIGGPRPSFPYGNIADMREAVAAGKSAPRAGGRIVHDYRPAVLPFYEKWRKEHGPVFTYSMGNAVFLHVSRADVVRDINLCVSLDLGKSSY

SEQ ID NO: 175653 - protein, 48 aa, Triticum aestivum
  Clone ID: PAT_TA_70071.pep
LESDYIFYGVVYTTLMDSIPGWSMDHPCHPTTTLLCVSHLLLLNYMSS

SEQ ID NO: 175654 - protein, 164 aa, Triticum aestivum
  unsure (1)..(164): unsure at all Xaa locations
  Clone ID: PAT_TA_70072.pep
ELGPVLGRAVAVERPCGIPSAGHHPNIIMHVCLPKFLRSSVQNHFSCCLFCSCGHAGKNCTSELGGIXTPDGPAGGARLSGCSSRSSLSPPALLGRAWLGLVRSVWWRNQSRGTGEREREELVRRWLEGGWWIGREGERGERSGGASKQMAAVAVGGCVASXTF

SEQ ID NO: 175655 - protein, 149 aa, Triticum aestivum
  unsure (1)..(149): unsure at all Xaa locations
  Clone ID: PAT_TA_70073.pep
RHESPQSRASPPTWXRTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 175656 - protein, 137 aa, Triticum aestivum
  Clone ID: PAT_TA_70074.pep
DVFLPQRRRRSLPPPWSGCGDQQRNSSGRGGILPCFLVHHEPHTGRGGAAASNLHRRPKPANHLTQAVEGARPSRGCRAMDMSERRTFLADVEAAGEEGSDLDGCHAMEGRQGSQWDGGDELCCSHGRLCFCLRGGL

SEQ ID NO: 175657 - protein, 193 aa, Triticum aestivum
  Clone ID: PAT_TA_70075.pep
HLKLHQCGLPSLPVGFTGFPMLKVLKLGLVDFPENGESQLEAILVGSPLLETLNLHFVDVRGNDAYSNAWVIRGANLRSLTISSDFDYDWQVKELPCIDEVAIDVGNYVSNIKFRGFLASFAQVRKLSLCACYTSFTGGGLLETLPCTFDNLKSLTLWTHFYEMPAIVLTFCLLRNAPNLEELEITSSKYTMD

SEQ ID NO: 175658 - protein, 96 aa, Triticum aestivum
  unsure (1)..(96): unsure at all Xaa locations
  Clone ID: PAT_TA_70076.pep
APRHRRERLPPFTFVRRGRRFPTAPKIANGQQYPSINLKFKNHRDRFAKCVASQRVAGSPXTSPPSFSLXTSPRFSSPGSPPFPPRPDSPPPRISS

SEQ ID NO: 175659 - protein, 114 aa, Triticum aestivum
  Clone ID: PAT_TA_70077.pep
AEVVGETDGEGSPNTQIGQLGLEVEVNKVIKRPRTNDAPISPVGESNPAVHVQVPNSSSPEIIFEALKNIPDLARSDILRAYSALTRDDRRFESLMALPMDMRKDWLLMEIGNN

SEQ ID NO: 175660 - protein, 82 aa, Triticum aestivum
  Clone ID: PAT_TA_70078.pep
GESIWTPRRKHYLASKPRDHHHKSREEVVCHRGNTIPTLNNYPNAPHLHAYQPLGTTEEQHQSTSDPSRTLTGNSATASRHD

SEQ ID NO: 175661 - protein, 128 aa, Triticum aestivum
  Clone ID: PAT_TA_70079.pep
AEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 175662 - protein, 123 aa, Triticum aestivum
  Clone ID: PAT_TA_70080.pep
MINVQNKNSSYFVEWIPNNVKSSVCDIAPRGLSMASTFIGNSTSIQEGGEKKGKKKSKKSVETYKIYIFKVLKQVHPDIGISSKAMSITSREIQTSVRLVLPGELAKHAVSEGTKAVTKFTSA

SEQ ID NO: 175663 - protein, 36 aa, Triticum aestivum
  unsure (1)..(36): unsure at all Xaa locations
  Clone ID: PAT_TA_70081.pep
MSYNIHAFTXXHIINKGNXGXTAAPFFFCINXAYTE

SEQ ID NO: 175664 - protein, 58 aa, Triticum aestivum
  unsure (1)..(58): unsure at all Xaa locations
  Clone ID: PAT_TA_70082.pep
KQFLPNCLCPVMQMLGKIVXVPKIKWTRQGLRLKISTYNATFVSGYLCTSPSLVRRKK

SEQ ID NO: 175665 - protein, 103 aa, Triticum aestivum; identical to SEQ ID NO: 107316
  Clone ID: PAT_TA_70083.pep

SEQ ID NO: 175666 - protein, 101 aa, Triticum aestivum
  Clone ID: PAT_TA_70084.pep
VLMGGDLGKKNKMANAISKSSDNFFYVFVWLHKSSNHSPFYDFFSWNQTCCYRSGYSPRHVLPFLGVFPYLWDSQAIVFVTRMLCGNLKAAGYKCFQLLIF

SEQ ID NO: 175667 - protein, 117 aa, Triticum aestivum
  Clone ID: PAT_TA_70085.pep
PRNSKNINQAFRDYVPLLVTLRNMSFMFFDPTSGFSFFAGLPLLDLALLFPTPPSEGRAGAGTGELSAQNDVSLVLAISFISLMSNCNFLQSTISHGSSFRFSRIIWTASFNSSLSP

SEQ ID NO: 175668 - protein, 53 aa, Triticum aestivum
  unsure (1)..(53): unsure at all Xaa locations
  Clone ID: PAT_TA_70086.pep
XLYLCFFWXTDISXXRIRFISLWXLSLPHDCPDILHQVSXVQSAGLISXCHYC

SEQ ID NO: 175669 - protein, 42 aa, Triticum aestivum
  unsure (1)..(42): unsure at all Xaa locations
  Clone ID: PAT_TA_70087.pep
QHTATERMEVEQSCRSXLIIFSNALSAAGLPAGIPVXSVGHI

SEQ ID NO: 175670 - protein, 99 aa, Triticum aestivum
  Clone ID: PAT_TA_70088.pep
NKNISDPHPCPGKKQVVAAAVLPQSPLPRCFCRVVSNRGLSPERGSLGSDEESSLPAEPLWLPSPSLTWRTPCRRRQTSSMPLGLAMCLNQLVRPSSGC

SEQ ID NO: 175671 - protein, 64 aa, Triticum aestivum
  unsure (1)..(64): unsure at all Xaa locations
  Clone ID: PAT_TA_70089.pep
AKAPLKCRXFLWFDLPHCCXTTDKLESHHLPSHTTCPFCSLEQETVKHLFMRYMWSKKLWGLSI

SEQ ID NO: 175672 - protein, 58 aa, Triticum aestivum
  Clone ID: PAT_TA_70090.pep
ETATTSKEGSRRANYPILENVIRDAVTYTEHARRKTVTAMDVVYALKRQGRTLYGFGG

SEQ ID NO: 175673 - protein, 86 aa, Triticum aestivum
  Clone ID: PAT_TA_70091.pep
CPEAGNLAAAGSSSRLKHSQKNFTSLDSSVCLVVLNYHLIELELFEPPTDDTSGGVLLTVDDALTVVRCSTQDGTVITGNALVVAC

SEQ ID NO: 175674 - protein, 88 aa, Triticum aestivum
  unsure (1)..(88): unsure at all Xaa locations
  Clone ID: PAT_TA_70092.pep
NTLCNNSRMVLCPHTHTHTHTHXEXDGCDYSNTSPLTXXWGTVGGDSXGLLVLCISRGEAYNTRXXSXQIXSFHXIDANSATXAAYGQ

SEQ ID NO: 175675 - protein, 149 aa, Triticum aestivum
  Clone ID: PAT_TA_70093.pep
TNPGADAVHLQSVTDAGTHAHANKRRGSFLVWAESGKEQRRGSRTGGRRRSRFRDSDEQRGAMTATQHAGRHRRSKRWNWNWNRVWCRPPSVTALLVAATGRRQGRCCQSRDAHASHFLALKRVQASRGYNNSLIRLFMIKAPLTGMDS

SEQ ID NO: 175676 - protein, 60 aa, Triticum aestivum
  Clone ID: PAT_TA_70094.pep
QSPPLHFKTPTSAVSALQEAAEAYLVGLFEDTNLCAIHAKRVTIMPKDIQLARRIRGERA

SEQ ID NO: 175677 - protein, 109 aa, Triticum aestivum
  Clone ID: PAT_TA_70095.pep
RDSACMIKQVEDQVVHETLMDQQNQDASPMSTKSLNHWMGRWCQGGTPSFHGASSPGKQSQKSNTPPDCLEGQFPSIAAMAMMGRVMNKLRPCELEKRGPSVVWKTEGL

SEQ ID NO: 175678 - protein, 135 aa, Triticum aestivum
  Clone ID: PAT_TA_70096.pep
RGASSGKQQQQQVKCCPHPMDGSPGPPGQRDTPCVQQQNAAPEWNWTTLGASAQDPPGRVLHSSRPPSPGPPGQSRQVLSEAPTGPPDRCQHLVQLAGEPQVPRPPGRVGGPPMAATPVVMVAVAILSVTVSSPT

SEQ ID NO: 175679 - protein, 74 aa, Triticum aestivum
  unsure (1)..(74): unsure at all Xaa locations
  Clone ID: PAT_TA_70097.pep
LXLGYVCAXQLXXLVLEVTIAXTVXFXAXSKYGLXFSGTIFXTIKILKCYVXRXNPVFFXGVWXCNSXPWXFFF

SEQ ID NO: 175680 - protein, 34 aa, Triticum aestivum
  unsure (1)..(34): unsure at all Xaa locations
  Clone ID: PAT_TA_70098.pep
TKHHINTTVKPGXHPYNQIAXHELLRXNLGALPT

SEQ ID NO: 175681 - protein, 53 aa, Triticum aestivum
  Clone ID: PAT_TA_70099.pep
SNYVVFLIAVGMVFFWVVDPQVHQYFHSRPHIIEKINYHEESPYVIACFIDPC

SEQ ID NO: 175682 - protein, 171 aa, Triticum aestivum
  Clone ID: PAT_TA_70100.pep
PDKAKENMVINGDFEEGPWMFPNTSFGVLLPTNLDEQTSALPGWMIESNRAVRFVDSDQYTVPQGKRAIELLSGKEGIISQMVETTPQKAYTLTFTLGSAGDSCQPPMAVMAFAGDQAQNFHYNTRSDDHSSLCGPVIDDVRVWGLNGAAGLKASIALLIAMASVIVLVLF

SEQ ID NO: 175683 - protein, 195 aa, Triticum aestivum
  Clone ID: PAT_TA_70101.pep
SLPEGFTKGKLETNVLQGFLAVNLMNVVRAVKVLVLRISPPSVDDAIDFVTFFPCLEKLYVLLYRTGASKRARHSFPLGYIECLELHLKKVVLINYQGTPRDVDFARYFLLNAKVLEHMEFASRTAINRKKYISEWRAGQHRKLQLDNRVSQGAQFNFSCDSYYGDEIHIGHIHDLTISDPFDRSSCRCHDVDFL

SEQ ID NO: 175684 - protein, 123 aa, Triticum aestivum
  Clone ID: PAT_TA_70102.pep
GHGSWIHCVAADLAFRQRNKAEVEVRGADGEVDGGCRRCLQRGSSPRHHTRSRTFHCSEVVLNGDGACVDSPQRQPSRSRSNVQFPRGSSCTTHAVAGDPITPHRQANRRRCLHLPATCDSPK

SEQ ID NO: 175685 - protein, 91 aa, Triticum aestivum
  unsure (1)..(91): unsure at all Xaa locations
  Clone ID: PAT_TA_70103.pep
GTRRSTKAQITSPLPCLPTKRTAHTLPFYRGRLKARVMTTPWRGFRLFYHLFLLCTMAFAMSLXFHCTKLICSSGPECRPQVGSSLESSIR

SEQ ID NO: 175686 - protein, 68 aa, Triticum aestivum
  unsure (1)..(68): unsure at all Xaa locations
  Clone ID: PAT_TA_70104.pep
FIAGIDSSKRNRSIRYNQRIQPXDKLYKIDMFSVFLIHSSCSTSPYGLSIDNXLSNPPLQVEFLSWLW

SEQ ID NO: 175687 - protein, 141 aa, Triticum aestivum
  Clone ID: PAT_TA_70105.pep
MEDDKMEEDEAAAVEEGQEEEATEDEMSEVAEQGQREKPPETVQWLQGLLVAADRYDLQRLRFICERQLSLRIGVSSVASTLALAEQHHCRPLKAACLKFIQAQSPSCLQIVMATDGWEHLITTYPFVLNELFAMFALNQK

SEQ ID NO: 175688 - protein, 66 aa, Triticum aestivum
  Clone ID: PAT_TA_70106.pep
KTEQKFLLSKLCALDPRDAHSSTRTPSELFVGQSWMTKVEGTYVIFFENHTNLIKQAGYNLYSESL

SEQ ID NO: 175689 - protein, 147 aa, Triticum aestivum
  Clone ID: PAT_TA_70107.pep
KKTVAENKVEKAAEKTPAGKKPKAEKRLPAGKTASKEAGGEAKTRGRKKGSKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 175690 - protein, 57 aa, Triticum aestivum
  unsure (1)..(57): unsure at all Xaa locations
  Clone ID: PAT_TA_70108.pep
AVRXHQPVXHPRQARHHHXQGQPARXPHPXXARLGSXWXXVMLXSCXCRVIPXVXLV

SEQ ID NO: 175691 - protein, 76 aa, Triticum aestivum
  unsure (1)..(76): unsure at all Xaa locations
  Clone ID: PAT_TA_70109.pep
CEMSRTHTSTQSSCDKSLSPPKAMNNEGRRHTFVTKIERXRSPAPPKSQLMLRRSRSEDPRSXIGQQYIFRRWHHI

SEQ ID NO: 175692 - protein, 57 aa, Triticum aestivum
  Clone ID: PAT_TA_70110.pep
KLMRACISSEYVTQCRNNATRASLSMHTSTSGFQFSNTIRKFLKFIREKSFAASMYA

SEQ ID NO: 175693 - protein, 118 aa, Triticum aestivum
  Clone ID: PAT_TA_70111.pep
GILLYRPLEHQALLRPAIGPDQIRSGGGDLAGLLGGRGADGLRLRLGLGSGRLLGLGDQLLLLGRLALGALQWILVKGFRLYSFQLPDTNAPGIVIYCHYLPVSGLGNLRACCLPWMW

SEQ ID NO: 175694 - protein, 103 aa, Triticum aestivum
  Clone ID: PAT_TA_70112.pep
CGIGAHGGTTLCCNCTLLLDQETSSNARLAPRRSNKKNLRRRQLVVDPDRGSDIKFPEVLTAHIVQRAPTHSSLSAVTMLPPLVSYRRGTGSRQDAELCPPGE

SEQ ID NO: 175695 - protein, 36 aa, Triticum aestivum
  unsure (1)..(36): unsure at all Xaa locations
  Clone ID: PAT_TA_70113.pep
HLGPRKCXRSTPXKXERVCIPXELYILVVSCVIVVY

SEQ ID NO: 175696 - protein, 139 aa, Triticum aestivum
  Clone ID: PAT_TA_70114.pep
VGAFLFPLHHDAPGCPDAYVSRGQLYLTIQGASELSFWVLEDSISENCWTLKLNISYLRLFGIDYSSSGRFYGVISAHPEHNVIFIIKEFISRCRSLRKLYSYEMDSGELHFICDLPRNSRLPYLSYVPLFSESLADGH

SEQ ID NO: 175697 - protein, 121 aa, Triticum aestivum
  unsure (1)..(121): unsure at all Xaa locations
  Clone ID: PAT_TA_70115.pep
YXXXGDXGNIXKXXIDHADDXGKCPSXGDNQXEFGGXCHLNFTSGPXKXKFCWERQPEWSAFRESSFGHGILEVVNSTYALWTWHRNQDTYGEHSVGDQIYIVREPDKCLLQPRGVISQDW

SEQ ID NO: 175698 - protein, 145 aa, Triticum aestivum
  Clone ID: PAT_TA_70116.pep
LGSQLSGLKAKVHAFSVCYGPKYFYDCVQGLIDELQSGLNSHDIVSIEDAKGLGYAKSTGDELRFVKDVAAATGIVLDPVYTGKVAYCMVKNMSDNPGRWEGRRVLFVHTGGLLGLYDKVDQLSSLAGGWRRMDLEEPVLHANFN

SEQ ID NO: 175699 - protein, 118 aa, Triticum aestivum
  Clone ID: PAT_TA_70117.pep
RDLPSLVTALVSLRSDNFHYKENTILGHGLLDGLSHATTLQLHAPLPELTLERGLRTCPVFSSLTSLVLGDWCMAADFYPLRRILHRSPKPKELSFKLEMECTAIFKGSVGLRQLSLH

SEQ ID NO: 175700 - protein, 128 aa, Triticum aestivum
  Clone ID: PAT_TA_70118.pep
SWINPTMENSYEAWGEPECTVRAAEVTIKTDMISHSTGMLLRPSDESSDDSEEDADYLRHLVVSDPSPSLDGDGFVYLIAREKLYHPKSWILALDMNTKTLQSADLFGIVEDPRDSVMYCTGRSSSNT

SEQ ID NO: 175701 - protein, 200 aa, Triticum aestivum
  Clone ID: PAT_TA_70119.pep
GSTPEKTLKWCDRLHVLIGIARAVHFLHTGIIPGSLYNRLKTSNILLDEHHIGKLSDYGLSIITEEIYKHEAIGEGQRYIQNNAEELETLQDDVCSFGCILLEALMGSKLHRKGDPFILSELVMSLSCQEEREHVLDPVVLGTSSQDSLSMVVSITIKCLSVESSTRPSIEEVLWNLQYAAQVQATADGDLRSEVSSQAC

SEQ ID NO: 175702 - protein, 165 aa, Triticum aestivum
  Clone ID: PAT_TA_70120.pep
AGIESGTKDTSLSASSGSAASPSSGSNSTPSSVWASWSSNSTPSSVWASWSSNSTPSSVWASSGSNSMPSSVWASSSSTSTLSPVSASSGNMCPPSVSAPSGSTSPPSVSASSGSTSLPSWVSASSGSTSSPAKMGKLPVLRTCTPLLGKQLSLLPHMHHVPDLG

SEQ ID NO: 175703 - protein, 68 aa, Triticum aestivum
  unsure (1)..(68): unsure at all Xaa locations
  Clone ID: PAT_TA_70121.pep
SFVKGSSWSTPVGTRKMVNYAXAGRSQRKLWWRLEAILTCKSFVXLGYRGERLIEPSSSWFPPKFPSG

SEQ ID NO: 175704 - protein, 163 aa, Triticum aestivum
  Clone ID: PAT_TA_70122.pep
GELSNVKKAAGMDSDSLASCVSKLSAGVSKISDVLQLNQQLGSDERCKRFRASIGEFLQKAEAEITAVQAQEGLALSLVRETTEFFHGNSAKEEGHPLRIFMVVRDFLAVLDRVCKDVSRMNERKAPVGFSTSRRVEAAAVPPQFSAAAQSSSSEEETSSSSS

SEQ ID NO: 175705 - protein, 91 aa, Triticum aestivum
  Clone ID: PAT_TA_70123.pep
PPPDAPSRLAQGCKQDGLVHHVRRMEWSAGCHWLYEHGSAAAITVNRMLFLRCNKNDFLGSLYFLNGCNFFASEVSQDTKNLDDILVTCSP

SEQ ID NO: 175706 - protein, 112 aa, Triticum aestivum
  Clone ID: PAT_TA_70124.pep
SALCFLSISHQLSASTSTSTRGWSGGDDDIDTGLLQRPRRHCDGAVAPTTMTTTSSRCCGANNDDDNMVTVLQWQRCRRHQHGLVEAPTLTTYTRGVYCIYMRINCLYQICR

SEQ ID NO: 175707 - protein, 87 aa, Triticum aestivum
  unsure (1)..(87): unsure at all Xaa locations
  Clone ID: PAT_TA_70125.pep
XLQWSXDSIXDMVSDXVVAXXXNIGREGPKAVXXEAAAKTXXETXKVAXKVVYALMXSLFGDVKXAXEXKLVISVDGXXAXLDGRSG

SEQ ID NO: 175708 - protein, 46 aa, Triticum aestivum
  unsure (1)..(46): unsure at all Xaa locations
  Clone ID: PAT_TA_70126.pep
GTIAGGGVIPXIXKSLIXKTCQGVNXMXXRVVVVRCILXSXPXYXC

SEQ ID NO: 175709 - protein, 115 aa, Triticum aestivum
  Clone ID: PAT_TA_70127.pep
LLTIDANFLSVEANFLVARNKFLLHWRYRVNIYNEHIFPNEFVLDQNYFGYCLLKQNYIEFMEAHMWETNHMKKTKVSILEGLIDGRTRSEANWNQTLIPCSLRASRFRINIIRV

SEQ ID NO: 175710 - protein, 156 aa, Triticum aestivum
  Clone ID: PAT_TA_70128.pep
AACSKVARQAALYYEEAYAALVIPPLQNHFERSWLSHIQLKAAQFNAEACYRYAIELHEKMEIGEEIARLQFGVNAVVDAKRTARGAPASLYDSVSRLEQDMNQNLEKAVNENNRIYLMRVPAAKLLSPLPSASLVRSASKSEVLDAKAETGLQSS

SEQ ID NO: 175711 - protein, 151 aa, Triticum aestivum
  unsure (1)..(151): unsure at all Xaa locations
  Clone ID: PAT_TA_70129.pep
HLXNLLLNAYCAKGLMXKAEALLDEAIAKGRTPHRSTWYSLASGFFQDGQVSKAVDMTRKALACASSRWEPDLTNVLMSLEHFMEQKNVEAAEEMASLLRNLVPLTRDVYHILLQTYVHAGQPVSDLLDRMKKDGFEADEETDKIIAGICQ

SEQ ID NO: 175712 - protein, 118 aa, Triticum aestivum
  unsure (1)..(118): unsure at all Xaa locations
  Clone ID: PAT_TA_70130.pep
SVSIQGEGMNXPAVVCNSNFKNMYWTMKXQLAHXTVNGCNSXTXDLYGSGTISGEDETSXGSMLELCXKGTKEVDLGSGNKRKFLKDGDNVVMSGYCQGSGFRVGFGTCEGKILPAAL

SEQ ID NO: 175713 - protein, 110 aa, Triticum aestivum
  unsure (1)..(110): unsure at all Xaa locations
  Clone ID: PAT_TA_70131.pep
AAHLAEYVSITSKDAPTDQKNANRVARITARSSPLKQKILPTRCTAGGTWAWIPDAELSCTLLESKPHAAAGDELHRTFQEQCELLFLSKTAADAKKFKQNTCGLHRGHX

SEQ ID NO: 175714 - protein, 60 aa, Triticum aestivum
  unsure (1)..(60): unsure at all Xaa locations
  Clone ID: PAT_TA_70132.pep
PPLGLGEKVPEQPAILGIPMXGEKXXQQXILXLXVYLRRXDLXQXEVKSALXELKSTPPT

SEQ ID NO: 175715 - protein, 172 aa, Triticum aestivum
  unsure (1)..(172): unsure at all Xaa locations
  Clone ID: PAT_TA_70133.pep
DQGIGTYXFDTASRVWRQVGKWVLXPFYGKAEYVPELKLWFGLSECNGSPRLCALDLSAMDAEQPPTLQNTWDYLDLFEDKKTVISEHHLVNLGSGMFCIATLLRTILHTFSPDSPCSSGEEIMMDMMDGEFIFLTGVEVERCCNEGQAPFKMIKHKSIYYDLKHRTIKSVL

SEQ ID NO: 175716 - protein, 234 aa, Triticum aestivum
  Clone ID: PAT_TA_70134.pep
QIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSCRCHTCRSNKTEVNDNIATPSHNKILNSLQQFPRGSTRGVLLAELENLPCRLIKLVV

SEQ ID NO: 175717 - protein, 41 aa, Triticum aestivum; identical to SEQ ID NO: 133945
  Clone ID: PAT_TA_70135.pep

SEQ ID NO: 175718 - protein, 50 aa, Triticum aestivum
  unsure (1)..(50): unsure at all Xaa locations
  Clone ID: PAT_TA_70136.pep
WEFAKLLALSIIDHAEVTTPGAPFQGIPGGTFHVPXVIHGSISEAESVWR

SEQ ID NO: 175719 - protein, 175 aa, Triticum aestivum
  unsure (1)..(175): unsure at all Xaa locations
  Clone ID: PAT_TA_70137.pep
WGNHSSSQYPDVNHATVKTPQGEKPVRELVQDDEWLNGEFIATVQQRGAAIIKARKLSSALSAASSACDHIRDWVLGTAEVCLSPWTFLVFGLFTCSLLTRXVCGSQGTFVSMGVYSDGSYGVPAGLIYSFPVTCSGGEWTIVQGLPIDEFSRKKMDATAQELSEEKALAYSCLA

SEQ ID NO: 175720 - protein, 118 aa, Triticum aestivum
  unsure (1)..(118): unsure at all Xaa locations
  Clone ID: PAT_TA_70138.pep
CATXCPLKLQYLRTPVLLSGGSSSSSSIRDSYPYTKYSSIYAHFPLYPAFLRAGAYPPIALPSPLFDSSQKLIHGRSHMIVLDGIPYGLPMQITMIHCNFSGRWFPYKIGLLHARFQT

SEQ ID NO: 175721 - protein, 110 aa, Triticum aestivum
  Clone ID: PAT_TA_70139.pep
NSWIYERRTTAKAFAKDVFINQERKLGARRRSDTVLVSTISSKAMSIMNSFINDIFEKLAGEAAKLARYNKKPTITSREIQTSVRLVLPGELAKHAVSEGTKAVTKFTSS

SEQ ID NO: 175722 - protein, 139 aa, Triticum aestivum
  Clone ID: PAT_TA_70140.pep
DASGRENEPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGQFMADGMYRLGS

SEQ ID NO: 175723 - protein, 61 aa, Triticum aestivum
  unsure (1)..(61): unsure at all Xaa locations
  Clone ID: PAT_TA_70141.pep
SSHLLQHRHTPKRRAAYLTSPTPWSCCCSPPXPAAAVAVEGRAGIDAXFDLTSPPCRLLFL

SEQ ID NO: 175724 - protein, 62 aa, Triticum aestivum
  unsure (1)..(62): unsure at all Xaa locations
  Clone ID: PAT_TA_70142.pep
SPQQPKSWPRTGSFQMRRPLGEXCAFCNSIMILLERLKFLGARGEKLGDVNHWMLFCCNLFY

SEQ ID NO: 175725 - protein, 115 aa, Triticum aestivum
  Clone ID: PAT_TA_70143.pep
MYAPEASSESSSSSSDDETDEEIPEVARARTEVDMKAETVSVVKPEVAPVPGSPLTSSESESGSSSSDDEMEEVKPIVAGVKPQASGSSSSESDSGSSSSESGSSSSESDSGSSS

SEQ ID NO: 175726 - protein, 170 aa, Triticum aestivum
  unsure (1)..(170): unsure at all Xaa locations
  Clone ID: PAT_TA_70144.pep
FRSRKEQRAAAAADLELSVGVEGDGQRGIRGQRGRIRSCGGAGNRWGKAAAGEGAPDRGEGAFDRGGEGRPEGIELSIGAAQATGGEGRRRCGRRRSLAKGRSDGVLAEGRSNGGRRRPVRFQVGGWGRGSLVISLVFTWSENPSNDNYFGTKGVYLSEXNLNTNRKERT

SEQ ID NO: 175727 - protein, 52 aa, Triticum aestivum
  Clone ID: PAT_TA_70145.pep
GRDTKPPKVDCEKDWWDNLEWDGLNKYHHPSLYEPSHSLYYKTDLPRGTILR

SEQ ID NO: 175728 - protein, 138 aa, Triticum aestivum
  Clone ID: PAT_TA_70146.pep
QTKEEAGNNRQHRTLDTIRKPCSLLQIVFCVTYAPYPLMSILSDIISHDHFSKNLSARLHPYLSRGMGKPARETSVEDDAPRQSTISNQSMNKYTGRSRRRRRGKRRPIAGRRRAPPPAGSGALHPAESHDGESESHG

SEQ ID NO: 175729 - protein, 186 aa, Triticum aestivum
  Clone ID: PAT_TA_70147.pep
MIIDGVDLCALGLHDLRSRFGIIPQEPVLFEGTIRSNIDPVGQYSDAEIWLALERCQLKDVVASKAEKLDALVADSGENWSVGQRQLLCLGRVILKQNQILFMDEATASVDSQTDATIQKITREQFSSCTIISIAHRIPTVMDCDRVLVLDAGLVKEFDAPSRLLEQPESLFVAMVQEYADRSSNL

SEQ ID NO: 175730 - protein, 34 aa, Triticum aestivum
  unsure (1)..(34): unsure at all Xaa locations
  Clone ID: PAT_TA_70148.pep
ASSXXHEXXXVXLCVVSSXHVYRCSCKNCADLWV

SEQ ID NO: 175731 - protein, 144 aa, Triticum aestivum
  Clone ID: PAT_TA_70149.pep
LGLYTDQDIWEALDKCQLKKTISVLPELLEAPVSDDGENWSAGQRQLFCLARVLLSRNRILVLDEATASIDSATDAILQRVIKQEFSGCTVITIAHRVPTVTDSDMVMVLSYGKLIEYDRPSRLMENEDSSFFKLVSEYWSNYK

SEQ ID NO: 175732 - protein, 110 aa, Triticum aestivum; identical to SEQ ID NO: 128883
  unsure (1)..(110): unsure at all Xaa locations
  Clone ID: PAT_TA_70150.pep

SEQ ID NO: 175733 - protein, 51 aa, Triticum aestivum
  unsure (1)..(51): unsure at all Xaa locations
  Clone ID: PAT_TA_70151.pep
HLAIITXQXXXHXXDXXSDXXHIXXXXGGSPXRRPXNXPAHPXXPLPXXPX

SEQ ID NO: 175734 - protein, 128 aa, Triticum aestivum
  Clone ID: PAT_TA_70152.pep
QKYRPYASNERATASERTLLCSASLLYLQTLHPWSDSNKTDLLFFYSCNVKQTTAHRKAKAAPRKLHLYQIIRLPYSRSLQYYLLPPSQIKCRRFSTGGSRSQKMHHKHVSVNIGYSMPQHTDVVYVP

SEQ ID NO: 175735 - protein, 208 aa, Triticum aestivum
  Clone ID: PAT_TA_70153.pep
AEVTPHRSNHPYRVMDNLSFPLICPDWNADEEILLLEGIEMYGLGNWAEVAEHVGTKSKAQCIEHYTTAYMNSPCYPLPDMSHVNGKNRKELLAMAKVQGESKKGIPLLSGDLTPKAESPFSPSRIKMEDALGEGPASRSPSHIPGGANKKASTVGHFKDSANLSKVEDGHMDRSIGVKKPRYSADEGPSLTELSGYNAKRHEFDPEY

SEQ ID NO: 175736 - protein, 69 aa, Triticum aestivum
  Clone ID: PAT_TA_70154.pep
NSFELVIQENFKTYCTCSVHRSNFTKHKPETNQLISCTLSCLPSPRDRSPHSLIAGPNPEGFRPQFSFL

SEQ ID NO: 175737 - protein, 35 aa, Triticum aestivum
  unsure (1)..(35): unsure at all Xaa locations
  Clone ID: PAT_TA_70155.pep
XMCCXYHNXNRXSEFVMGLAFGNLLXRESXWATCN

SEQ ID NO: 175738 - protein, 36 aa, Triticum aestivum
  unsure (1)..(36): unsure at all Xaa locations
  Clone ID: PAT_TA_70156.pep
ACVRXSXMVXLGPLHHSLECISGCHPHXXXPNXCSP

SEQ ID NO: 175739 - protein, 110 aa, Triticum aestivum
  Clone ID: PAT_TA_70157.pep
MAGRKGGDRKKAVTRSVKAGLQFPVGRIGRYLKDNKKTRIIPRHLLLAVRNDQELGRLLAGVTIAHGGVIPNINSVLLPKKSPAAAEKEAKSPKKKTATKSPKKKVAAKE

SEQ ID NO: 175740 - protein, 59 aa, Triticum aestivum
  unsure (1)..(59): unsure at all Xaa locations
  Clone ID: PAT_TA_70158.pep
HTNCHXXAKXXHWKGNSTTNTHXHTXPKNRQERNGXFXPKTTMTSRGXXQQTNNAXXNT

SEQ ID NO: 175741 - protein, 138 aa, Triticum aestivum; identical to SEQ ID NO: 141364
  Clone ID: PAT_TA_70159.pep

SEQ ID NO: 175742 - protein, 137 aa, Triticum aestivum
  Clone ID: PAT_TA_70160.pep
LHTTYLELILYCASVESFMLDFYQVKYKNMTPTTAFEHVRSKRARVLLTRSQRKVVQEFSTKVAGTAAATSSSPSGDAVPQTEDGSGLPGVVREDASLPSHTATPSGPMMKKMLACLLPSPTRSGGDSPSHADLRAP

SEQ ID NO: 175743 - protein, 91 aa, Triticum aestivum
  Clone ID: PAT_TA_70161.pep
LPTPSIIFHLLQNANTIRSWGCGSVTEEWDSLYPQKVQLLTLLSTLPEPALSYGPSVKTNMANSIEQREQKKSDIIILHSDDDDESTGAHK

SEQ ID NO: 175744 - protein, 102 aa, Triticum aestivum
  Clone ID: PAT_TA_70162.pep
LYIWSRLMDSNRVASWSQCRITNLSSLLPIQNPEEIYLILVGSVEGSDTVFVTTDLGIYEINVKSQRWKKIWKREIFRALIPYMSFYNPQERVTPTPCDAAH

SEQ ID NO: 175745 - protein, 63 aa, Triticum aestivum
  Clone ID: PAT_TA_70163.pep
SGKHGVERISTGRKPLQKKIVEEEREEQQSRLGLVASTPMTSSMPSLASPGYYVICFHGFTGV

SEQ ID NO: 175746 - protein, 91 aa, Triticum aestivum
  Clone ID: PAT_TA_70164.pep
DYICAQNYIWKHMYNKLTTDQGSFALHATDFPEHNSTHLLYMLLNLVRIDEISGWSLGKKTANQHYLVSSASAAKYKQQHKHVTRTFELVQ

SEQ ID NO: 175747 - protein, 112 aa, Triticum aestivum
  unsure (1)..(112): unsure at all Xaa locations
  Clone ID: PAT_TA_70165.pep
RWGLPALRSSSLYLWSRKVNSEAAAEWVKCRNIEXLETIVPVVDPDYQPFVVGSAEGVGVIFINTDAGLFTLELKSGRVRKVDEPAQYFXVLPYMSFYTPDRGILLALAKTH

SEQ ID NO: 175748 - protein, 173 aa, Triticum aestivum
  unsure (1)..(173): unsure at all Xaa locations
  Clone ID: PAT_TA_70166.pep
KAPVPLKINIFVXQLLRNRLPSRTEVLKRSSPGDGMCPLCSVLETGTHILFSCSAARALWSFIREALGPDWEAGDLAEFLQGRVTQLGHKRRLFWCIFVALMWTLWTTLNKMVIEQIFPRRTSDSFFKFLTFLQYWHLLARHRVCDLLGMMLDALVAAAQHLSAPWACFGVCH

SEQ ID NO: 175749 - protein, 170 aa, Triticum aestivum
  Clone ID: PAT_TA_70167.pep
GNDGVFTTQESVNVFDFRVPSGIGLKMARNGGTANSVFSRGDSVFIGSTEGRLQIKGGPKSRVQQYSLKKGRLVATYELPEFNAHFHHSSITQVWGNSNVVLASCCMGLFAFDTFNEEGVQQTYSFDRGNTIGAREVIGSDDLYCPTFDYSSSRVLLVSKDRPAHWRYLP

SEQ ID NO: 175750 - protein, 136 aa, Triticum aestivum
  unsure (1)..(136): unsure at all Xaa locations
  Clone ID: PAT_TA_70168.pep
DENSPMILLFPEGTTTNGDYLLPFKTGAFLARAPFXPVILRYPCRRFSPAWDSMDGARHVFLLLCQFANYIEVVRLPVYYPSEQEKQDPRVYANNVRKLLATEGNLVLSNLGLAEKRAYHAALNGNSPRALHQKDD

SEQ ID NO: 175751 - protein, 141 aa, Triticum aestivum
  unsure (1)..(141): unsure at all Xaa locations
  Clone ID: PAT_TA_70169.pep
RSIEVRPVGVTKGXAIDKIMQELGHRKIITTPIDYVLCIGHFLAKDEDVYTLPQFDVEPESERKAKVWQADIMNIKFNLKRDKYFSCTVGRECSLARYKLEGASEVASLLHNLASADRGERDDSRPTKRQKEDHDSGAMSE

SEQ ID NO: 175752 - protein, 82 aa, Triticum aestivum
  unsure (1)..(82): unsure at all Xaa locations
  Clone ID: PAT_TA_70170.pep
AIXVPPPGLLSHGXQASSKVPVPPTHXGVSRPSPPPAPQPPHILIPGWAPPXRCXGRSMTQPRPHHLEGRPMKDRGTDALAS

SEQ ID NO: 175753 - protein, 108 aa, Triticum aestivum
  Clone ID: PAT_TA_70171.pep
SAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 175754 - protein, 183 aa, Triticum aestivum
  unsure (1)..(183): unsure at all Xaa locations
  Clone ID: PAT_TA_70172.pep
RYRSRLAAQTNTSLSCAFCPHSCAPRVNFRVGHPSXIAPSQARLTLRFLADGLLENKEFLVDMSSLSFLLSQDVTLRLAGAERGWQDWLRKAGAGFGTRRPDGSGIQAQLCSDLASMVSSDGSWGIGDVSVASCRQVLLLGECPRSCQVGAQGLASPSSSLLEEWRMPVVQGTVVAATEQHGG

SEQ ID NO: 175755 - protein, 122 aa, Triticum aestivum
  Clone ID: PAT_TA_70173.pep
LYVIFSEGKDMNIAGKYDQLDPIECLELHLKEVVLKNYCGGHRLYIDFAKFFLSNAKVLRKMEIGGRYNYKSNCNIDDWMCYLRRQLQLVNRASEDARIEVKVNKFTRHVRTHDLSVADPFD

SEQ ID NO: 175756 - protein, 59 aa, Triticum aestivum
  unsure (1)..(59): unsure at all Xaa locations
  Clone ID: PAT_TA_70174.pep
CALEVRVDMYASIYVLLPRIPLVIRDCMPFPVDCMSSLCMYILIRTIMLMQCTVXPDTX

SEQ ID NO: 175757 - protein, 66 aa, Triticum aestivum
  Clone ID: PAT_TA_70175.pep
SLQKNLSLHELSTSQQWKQLVLARSSELVFPVFVKLKLIEQALVDQWGGGSGSSDVRYGTSAALDL

SEQ ID NO: 175758 - protein, 126 aa, Triticum aestivum
  unsure (1)..(126): unsure at all Xaa locations
  Clone ID: PAT_TA_70176.pep
AEKTPXGKKPKXEKKVPASKXGGGEKKXKKKSKKSVXTYKIYIFKVXKQVHPDIGISSKAMSIMNSFIXDIFEKLAGESAKLARYNKKPXITSREIQXSVRLVLPGELAKHAVSEGTKAVTKFTSA

SEQ ID NO: 175759 - protein, 75 aa, Triticum aestivum
  Clone ID: PAT_TA_70177.pep
NSNLRAIGAVVYKVPKLNNDEMLKISLRSLGQEDTTSISQEFGGGGHRNASSFLLSVAEFEKWKVGAEPSNAETA

SEQ ID NO: 175760 - protein, 89 aa, Triticum aestivum
  unsure (1)..(89): unsure at all Xaa locations
  Clone ID: PAT_TA_70178.pep
TVECIEQLNXVELCTFRPFQATGERERERERERERERERSXVXXPHDRRIXCLPXXQXRXXXLYSXAXVQXTFXXXSQXTXEXXXIFSV

SEQ ID NO: 175761 - protein, 68 aa, Triticum aestivum
  Clone ID: PAT_TA_70179.pep
DNLSSSPSVDPCMTSYLHDHCGGTRASGRVDTCRDVEVGGGRLMSMMLTTTRLHPSFFSIFSSLVPVP

SEQ ID NO: 175762 - protein, 112 aa, Triticum aestivum
  Clone ID: PAT_TA_70180.pep
HPRPPCLHQLEGRIPLITCSSLTVAPDQIDLSFPVPPPPGFAPIRASLRPLHRLVAGVEAPFAKRRAPASSRCKRSSESAPSRPKARTATSPPSPVDRCARPSCPASTSSWA

SEQ ID NO: 175763 - protein, 126 aa, Triticum aestivum
  Clone ID: PAT_TA_70181.pep
MYDLYGVVEHSGLPNYGHYVCTIRSSPSTWHLMNDSNVDSITETCALNQEAYILFYVRQGMFPWFSSLLEEARSGASPVSVLDNIDADRLTSSNRSPGDKFEIGETSECKTSLLAEEPTKRSSSSN

SEQ ID NO: 175764 - protein, 59 aa, Triticum aestivum
  Clone ID: PAT_TA_70182.pep
VHKSSTTSHHTYIDIHLVLHHNIHTYKYICRLTSSVLPHSQKGNNPSCIHTYMGICLRF

SEQ ID NO: 175765 - protein, 49 aa, Triticum aestivum
  unsure (1)..(49): unsure at all Xaa locations
  Clone ID: PAT_TA_70183.pep
PDSXPXKVXLMCSCCXRHXXSVVPDPXYGGAKXFXXVLYLLEDACESXL

SEQ ID NO: 175766 - protein, 98 aa, Triticum aestivum
  Clone ID: PAT_TA_70184.pep
FTRGNGTGGESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 175767 - protein, 119 aa, Triticum aestivum
  Clone ID: PAT_TA_70185.pep
VFEKIRRLNSSRKDSYVGTKGNKKKRKRNHDEENEYVETESEDDDEENEYVDNESEDDDGVSEDDEDDQQDQQETQMQVEEETQVQAEKETAASVGNLEARRSGRLVRKKTKEVNSLYS

SEQ ID NO: 175768 - protein, 176 aa, Triticum aestivum
  unsure (1)..(176): unsure at all Xaa locations
  Clone ID: PAT_TA_70186.pep
MVTPPYITFYYHSLDGEQGFPGALDVYVKYQLSRPYDLSIRMNVTARNKATPXNLANHAYWNLAGHGSGDVLKHELQMFASHYTPVDGSMIPTGEVAPVAGTMYDFGVQFYTASWLINEKGKAGKVYGQYGALCLETQAYPDAVNHPNFPSSIVRPGQVYKHDMVFRFSYQATYDA

SEQ ID NO: 175769 - protein, 206 aa, Triticum aestivum
  unsure (1)..(206): unsure at all Xaa locations
  Clone ID: PAT_TA_70187.pep
SGEMFAAHRXVLAARSKVFMAQFLXGPMKEGTAASGAIQIKDMEAKVFRALLSFIYTDSLPLLEEDDMEEDEGEAMEEGQEEEAAEDEMAEVAEQGQGEDAAEDATELQWLQDLLVAADRYDLQRLKFICEKRLSERIGVTSVASTLALAEQRHCRGLKEACLKFIQVQSPLCLQKVMATDGWEPLITTYPSVLNELIAKLASNQK

SEQ ID NO: 175770 - protein, 122 aa, Triticum aestivum
  Clone ID: PAT_TA_70188.pep
AHLPIPWLRLPTSIALDKSWIQRPPPLIAPGWASLNLPPPPKRRPAIDPSQQPPERASWPRIQASNYSSPPPRLVASTTLPSSLGSGEPQPPRSLFPLLYFKIEGTLEYMEAQKLQALPGFF

SEQ ID NO: 175771 - protein, 118 aa, Triticum aestivum
  Clone ID: PAT_TA_70189.pep
SSENCLSRSHQELHRPMTSKAHLPGRLWLFQHTEALERDLSVESPDDIRDLVLVWLHIHLQEPFHFSHEDLAQLMIPLWLPFLPQQCEHRTPPAMALQAPHQHARIGHDIFQAQTRLS

SEQ ID NO: 175772 - protein, 122 aa, Triticum aestivum
  unsure (1)..(122): unsure at all Xaa locations
  Clone ID: PAT_TA_70190.pep
AKXRGLEVIIAGAGGAAHLPGMVASLTTLPVIGVPIWTKSLQGMDSLLSIVQMPKGIPVATVAIGNAENAGLLAVRMLASRDPELSDRVNEYQQDLEDSVLVKARLLEELGSDKYLQQYKQP

SEQ ID NO: 175773 - protein, 165 aa, Triticum aestivum
  unsure (1)..(165): unsure at all Xaa locations
  Clone ID: PAT_TA_70191.pep
PGAQXAPHRSFSEEVDVLNRYFGHLKSGGNAYVIGDPAKPGQKWHIYYATEQPEQPMVTLEMCMTGLDKKKASVFFKTQADGHVSCAKEMTKLSGISDIIPEMEVCDFDFEXEVAVSAGSPRSVFHCFEAESVQSHPLVKEGKLANLLAWRAEEDSLEEGAVLCE

SEQ ID NO: 175774 - protein, 85 aa, Triticum aestivum
  Clone ID: PAT_TA_70192.pep
VQSKSLNEDPLEGKSGASSRGNSNSFINDIFEKLAGESAKLARYNKKPTITSREIQTSVRLVLPGELAKHAVSEGTKAVTKFTSS

SEQ ID NO: 175775 - protein, 37 aa, Triticum aestivum
  unsure (1)..(37): unsure at all Xaa locations
  Clone ID: PAT_TA_70193.pep
LARWEXXXCAAXXAGXKHFXLXXXQDVXFNLLEPYWK

SEQ ID NO: 175776 - protein, 174 aa, Triticum aestivum
  Clone ID: PAT_TA_70194.pep
ELLAERAEGLLICLKQRFPALTQTSLDMSKIQYNKDVGKSILESYSRVLESLASNIVARIDDLLNIDELNRHVEQLSTGEADLKMACGRAVVPPYQQVPASGTPFVTAYATPSFSPGRLSSPRTSVGAGRRSQGNRAAAAAKKALTDHLGPSEVRGMIIVNRSTMIDVSTTTDL

SEQ ID NO: 175777 - protein, 63 aa, Triticum aestivum
  unsure (1)..(63): unsure at all Xaa locations
  Clone ID: PAT_TA_70195.pep
NRXXTYKVLTTHQVVKQTPXXKCSNRQIXDKATRADHRIXAACLGQSTXRQAXXLXALVTXLT

SEQ ID NO: 175778 - protein, 222 aa, Triticum aestivum
  Clone ID: PAT_TA_70196.pep
KTMGPVKKAMDDAGLEKTQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITNFCNGVSRVREETWIIGTAAAYFGSAVVGGG

SEQ ID NO: 175779 - protein, 37 aa, Triticum aestivum
  unsure (1)..(37): unsure at all Xaa locations
  Clone ID: PAT_TA_70197.pep
LXHLQSFFYCNGGVISAXXVCNFVIYNCEYTXLVDXN

SEQ ID NO: 175780 - protein, 74 aa, Triticum aestivum
  unsure (1)..(74): unsure at all Xaa locations
  Clone ID: PAT_TA_70198.pep
GLXRNRIMXMVMPPVAGPPRRPAGLDPWXCLLALFSGSTTALGRKLLLANKNCFCFYFGCGALTNLVDQTVXVL

SEQ ID NO: 175781 - protein, 71 aa, Triticum aestivum
  unsure (1)..(71): unsure at all Xaa locations
  Clone ID: PAT_TA_70199.pep
GKQQGDEGPRTRRSEDQKKKRNSPNGCNRTLQTIHIRQRSXDSDDEPQRNEXRLASRGSPNEPPNXRXRIP

SEQ ID NO: 175782 - protein, 79 aa, Triticum aestivum
  Clone ID: PAT_TA_70200.pep
IVCCSLVPDNMFRKEHRQIPGVVSSRIIKVINSNLKNFTCVGSKYIIFQELCFFRFICRCYIASRTMIGIGQYHSNSIN

SEQ ID NO: 175783 - protein, 45 aa, Triticum aestivum
  unsure (1)..(45): unsure at all Xaa locations
  Clone ID: PAT_TA_70201.pep
XXXXPXFXGGGXXXGGGPPPPPPPCRESSLLAMSVSVVCLVRSNF

SEQ ID NO: 175784 - protein, 186 aa, Triticum aestivum
  Clone ID: PAT_TA_70202.pep
DSLFVNGVLYVEHLWRHYLLALDAPDTCTQQLNHRTIQLPGFPYGPERFYCFDGRLWQSSGVLCYAQQELDGCMIRIWSLEGYDRWVVKHRLNMNNVFGRNIMLRTNNEGLWYFDYEILAFDLERELVILADTIADNKIISYSISTGKVCQILNIPSFVNLYRSLLYVPYYGKFPACVLQAAQDKC

SEQ ID NO: 175785 - protein, 38 aa, Triticum aestivum
  unsure (1)..(38): unsure at all Xaa locations
  Clone ID: PAT_TA_70203.pep
XRNGLATKVEKSRKQIKERKXRXKKXXGVXKXXAAGDA

SEQ ID NO: 175786 - protein, 119 aa, Triticum aestivum
  Clone ID: PAT_TA_70204.pep
DTLHYVAHLKIRESNFDNNIHDRRASWCRNFARRAMYMRFVATSSMLFEAMYGEQSNVCLVFESKSIHLAFLHVGVLKELGPFCGYCRSVLSRCDETSNCVRASDSELDGQIFQRTSSS

SEQ ID NO: 175787 - protein, 103 aa, Triticum aestivum
  Clone ID: PAT_TA_70205.pep
WYPSGFVPCAWRFSTPHLAVHLAHLPHAGPVLCCHRQCSPLHGHCSQHWWWMPMRRRRGASQRGSCSSLHRHQRGRPTYLLLASMALQKMERECLQFFLFSFL

SEQ ID NO: 175788 - protein, 53 aa, Triticum aestivum
  unsure (1)..(53): unsure at all Xaa locations
  Clone ID: PAT_TA_70206.pep
NIRFLNWIIRIVLMFTNPRIHQFKSSVSARTSKSPLXXTGTNDGLYFKNGAEA

SEQ ID NO: 175789 - protein, 43 aa, Triticum aestivum
  unsure (1)..(43): unsure at all Xaa locations
  Clone ID: PAT_TA_70207.pep
FIXKAHKTKPFXPSXXXIXDDTCXXRPXQSFXTPXSXNDRXXP

SEQ ID NO: 175790 - protein, 212 aa, Triticum aestivum
  unsure (1)..(212): unsure at all Xaa locations
  Clone ID: PAT_TA_70208.pep
XNTVTYGIMLGGLFRAGRTVAAMKMFHEMIESGATVRISTYNIILGGLCQTNCVDEAIALFQKLRAMNVKFNIETLNTMINAMYKVQRKEEAKDLFAAIPASGLVPNESTYAVMIRNLLKDGAVEDADNMFSSMDNSGIVPSSRLINDIIRMLLEKGEIAKAGNYLSKVDGKSISLEASTTSLMLSLFSRKGKHLEDIKLLPAKYQFFDGFG

SEQ ID NO: 175791 - protein, 70 aa, Triticum aestivum
  unsure (1)..(70): unsure at all Xaa locations
  Clone ID: PAT_TA_70209.pep
AHTXRRPWSPSSPGCTTCRRRRRRRGXAQGRRWGSRPSVNKGGISLGGKFFFLSRIRTYFHIRSFFXVLI

SEQ ID NO: 175792 - protein, 182 aa, Triticum aestivum
  unsure (1)..(182): unsure at all Xaa locations
  Clone ID: PAT_TA_70210.pep
DYGKKSKLGFTVYPSXQVSTSVVEPYNSVLSTHSLLEHTDVAVLLDNEAIYDICRRSLDIERPTYTNLNXTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 175793 - protein, 110 aa, Triticum aestivum
  Clone ID: PAT_TA_70211.pep
APPARHPASPCPPRLDSPPPRISSSLPSFLLIKEPHRRPQEGTSPAAGPSSTSPARSSSPRTTSLLPRVARRSSSPGARGEDQELLIRDHLQARCSLPACPLATVADPQL

SEQ ID NO: 175794 - protein, 77 aa, Triticum aestivum
  Clone ID: PAT_TA_70212.pep
PPRNQPCFRFPFVRPPNLSCQLAAPSRARPKLPRTRTGLSLPMDPDHPLTSIKHLRFLIWTSLAYFFVRPITIRGTR

SEQ ID NO: 175795 - protein, 145 aa, Triticum aestivum; identical to SEQ ID NO: 131257
  Clone ID: PAT_TA_70213.pep

SEQ ID NO: 175796 - protein, 106 aa, Triticum aestivum
  Clone ID: PAT_TA_70214.pep
MLSMQCLSRAVRNENPGLLMAASTLLLPFQPFMVSAVHTGMMEVSFAKRASVEPELRTVHNLHKMSSLLGGALFIADDYFPETPYIHAAWHLAAAIGIGTCNKLLG

SEQ ID NO: 175797 - protein, 177 aa, Triticum aestivum
  Clone ID: PAT_TA_70215.pep
FNATSLLFRGSLYWYLWQHESESNKIIVFDTTTESFRLLCGAVVPGCHELFEMDGMLGMSIFNMEGTVIDIWVLQQDYEREVWTFKCQIEMPVMEIRAQCGSHEDFWNVLVVPRDGELFVLLRFAGWLLQVDMNGKLVASLHRKGVGPTRLQLKQTLVPHAFFPTLEGYVVNDFPFI

SEQ ID NO: 175798 - protein, 49 aa, Triticum aestivum
  unsure (1)..(49): unsure at all Xaa locations
  Clone ID: PAT_TA_70216.pep
MFIXLXKSYXCXXXIKGKFXIEIISYRIPMRFLQTKXLTXSNPLGXRIN

SEQ ID NO: 175799 - protein, 120 aa, Triticum aestivum
  Clone ID: PAT_TA_70217.pep
NGMPLQRSHVHGWELSPSVLSARDGQITRSVNRRHTQLVFNKKNAVEFPSCRRRHCHHETSFFAEVKVYCGSMQAASMLNLQYRMQALETIQLQSELIAILTRISRTVKHQQHSVYYIVI

SEQ ID NO: 175800 - protein, 83 aa, Triticum aestivum
  Clone ID: PAT_TA_70218.pep
TPSKSKGKTAVKDAKGTPKTAVEIKKEGKEKATGSANKTKDDLAKDSSNQKLKEVGSKSGDGSVKGRPGRETKKRCHYYSSGG

SEQ ID NO: 175801 - protein, 103 aa, Triticum aestivum; identical to SEQ ID NO: 107316
  Clone ID: PAT_TA_70219.pep

SEQ ID NO: 175802 - protein, 106 aa, Triticum aestivum
  unsure (1)..(106): unsure at all Xaa locations
  Clone ID: PAT_TA_70220.pep
SKHMNHLLKAXFCIHPKTGRVCVPIDPNNCEDFDPTAVPTLSQLLGELNAAGMQIDSENDWERTSLEKYIRFFRTSFLQPMLKACKEELETAYSAKLQQSKNTLSW

SEQ ID NO: 175803 - protein, 98 aa, Triticum aestivum
  Clone ID: PAT_TA_70221.pep
IHSFEREAWDKPFRTEGVQGFQQFTRVDFMEERKHKGKTRGGDHEVKPKLSTVFLFSSAIACLPVSDSATECSTLPHNTLPSSIAVRVTPPLHLKSKS

SEQ ID NO: 175804 - protein, 204 aa, Triticum aestivum
  unsure (1)..(204): unsure at all Xaa locations
  Clone ID: PAT_TA_70222.pep
GFRCIXMXNKIRLXXDAXNGDKDHGGVHDGTXVVXWXWAKGDXQSWKILPWGEEAYAXGSANAPRGGSSEPTVRIFCKADDGFSATVRNGAVVLAPTNPRDEEGYPAFALVNKVTGEAIKHSQGEGHPVKLVPYNANYQDESVLWTESRDVGAGFRCIRMVNNIYLNFDALHGDKEHGGVRDGTSLVLWKWCEGDNQRWKILPW

SEQ ID NO: 175805 - protein, 106 aa, Triticum aestivum
  unsure (1)..(106): unsure at all Xaa locations
  Clone ID: PAT_TA_70223.pep
QVLTXDGVDPDNMTYEELQQLGETIGTESKGLPEDVIALLKSSTYKIGIFSRKEKHDECVICCMAYKNRDKLTTLPCQHQYHRTCVAKWLKINKVCPVCNKEVFGS

SEQ ID NO: 175806 - protein, 161 aa, Triticum aestivum
  unsure (1)..(161): unsure at all Xaa locations
  Clone ID: PAT_TA_70224.pep
GNKGRKWRKNMKAVEKAEATWAFTLLDYIGKLIFGIVGLIVSIAWVAHIIIXIVSSFPNEIFIKMDSVWGLLGTAAFAFFCYLLIAVIAGEMMLGLKLVFISIHPIWGGTLMNSFLFNVGLILLCSISVIQFCETAFAYYAQATAAQEIFGHTLQSLHGIN

SEQ ID NO: 175807 - protein, 72 aa, Triticum aestivum
  unsure (1)..(72): unsure at all Xaa locations
  Clone ID: PAT_TA_70225.pep
XKNADMLLHAMXNIGVSPDDITYNILLDGQCKHRKVXDCEELKSXKGMVPDFGVYTSLIXXLVKKKPKYHDR

SEQ ID NO: 175808 - protein, 136 aa, Triticum aestivum
  unsure (1)..(136): unsure at all Xaa locations
  Clone ID: PAT_TA_70226.pep
ICNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHXRRDAPPGQKVGLIAARRTGRLRGQAAASAAKADKAT

SEQ ID NO: 175809 - protein, 49 aa, Triticum aestivum
  unsure (1)..(49): unsure at all Xaa locations
  Clone ID: PAT_TA_70227.pep
RXALILVAXXTXLTXXKTQHQLXHSPXXXQQDXHGPXRTXPXXCPHXLX

SEQ ID NO: 175810 - protein, 136 aa, Triticum aestivum
  Clone ID: PAT_TA_70228.pep
CLNLIMQRKMVFLGHDTALRTSDYNHRRTSIQTLTKRHHRAKYDEMMQQLLATILVMTSCFFESLSTDGQVSLPVLNRTTESGSVRLRYRYISSKAQNKRNFSYASAMGYFPEISNVPALCLMEHSQQTAGDLGPV

SEQ ID NO: 175811 - protein, 59 aa, Triticum aestivum
  unsure (1)..(59): unsure at all Xaa locations
  Clone ID: PAT_TA_70229.pep
SILXTLXXAAGGVTSILSTLASAXGGVTXIXXTFSSATLXYXDSXSMNSLXXRXTLXFV

SEQ ID NO: 175812 - protein, 44 aa, Triticum aestivum
  unsure (1)..(44): unsure at all Xaa locations
  Clone ID: PAT_TA_70230.pep
ATTDQLKRNNMMKKIFIELLLELGXXTCTXSXAPTNXXPXRKXN

SEQ ID NO: 175813 - protein, 58 aa, Triticum aestivum
  unsure (1)..(58): unsure at all Xaa locations
  Clone ID: PAT_TA_70231.pep
SDGRNSSTGSDSDAQRQSLLVLLSRPILAPGVQXPCGCTSXAPKVVAPHPKEEXKLXY

SEQ ID NO: 175814 - protein, 225 aa, Triticum aestivum
  unsure (1)..(225): unsure at all Xaa locations
  Clone ID: PAT_TA_70232.pep
SARGKXPLVTSYGSCYSNAGMQPLSLSMSPRSQSSSCVSAAPQQHQMAAAAAAASLAASQGGSNGGGEQEQCVGKKRGTGKGGQKQPVHRKSIDTFGQRTSQYRGVTSRHRWTGRYEAHLWDNSCKKDGQTRKGRQVYLGGYDNEDKAARAYDLAALKYWGPSTNTNFPLENYREEVEEMKSMTRQEFVAHLRRRSSGFSRGASIYRGVTRHHQHGRWQARIGRV

SEQ ID NO: 175815 - protein, 40 aa, Triticum aestivum
  unsure (1)..(40): unsure at all Xaa locations
  Clone ID: PAT_TA_70233.pep
SRMEPSDAATTPSSLVGATPLKADLGPGAXVPXMRVVLGS

SEQ ID NO: 175816 - protein, 294 aa, Triticum aestivum
  unsure (1)..(294): unsure at all Xaa locations
  Clone ID: PAT_TA_70234.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXESTLHLXXRLRXGMQIFVKTLTGKTITLEXVESSGTIDNVKXKIQDKXGXPRDQXTXLFFAGKQLEDXPTLXGYNIQXG

SEQ ID NO: 175817 - protein, 71 aa, Triticum aestivum
  Clone ID: PAT_TA_70235.pep
PHPVKAKTSMVFLVILVGEGTIEYVKDIVVDIRQWCGGYGGEIYNIGIRCYNVRPTYGNSSKSNPLKTNLC

SEQ ID NO: 175818 - protein, 33 aa, Triticum aestivum
  Clone ID: PAT_TA_70236.pep
LLCLSLTCYMSCFSYFVSHVADLIVLPNVSKKK

SEQ ID NO: 175819 - protein, 222 aa, Triticum aestivum
  Clone ID: PAT_TA_70237.pep
MVEKLRTFITDLLEPPSIPVQVQPENSTRGTNFQKLRTYLLLLGILAATVTFQAGLNPPGGFWTDTSDGHIAGDPILEAISPKRYKAFFYCNATAFVASLAIIILLQSQLITIHAMKRHVLQTAMTLVLFGLMGAYVAGSSRKFSTSIYVFVLVLLVFAYVVLHILYERTLGNTGSTAGNAESTARNTESTAGNSESTAGNTEITEGNTESTAGNTESTSGN

SEQ ID NO: 175820 - protein, 132 aa, Triticum aestivum
  unsure (1)..(132): unsure at all Xaa locations
  Clone ID: PAT_TA_70238.pep
GVSYAPPPAVRPSXPSRRRNRRRMPRMRIQSCLRTGDQISSSPFGSRSTQSKQQEQQLFWERRSAIKQLCSRQSKQSSGSSPSRSRKSKQSSGSSLSRSRKSKRLPFLVANPESKQSFLSNSVSESPLVART

SEQ ID NO: 175821 - protein, 191 aa, Triticum aestivum
  Clone ID: PAT_TA_70239.pep
IKSALGFYGGHWEPDGKSILAHGYGGFFHMWRDVGLDSENWQPQIVPSGHFAPVSDLTWSRSGEYLLTVSHDQTARIFAPWRSHVNPGDVICWREIARPQIHGHDINCVAFIQGTGNHRFVCGADEKVCRVFEATLSFLKTLQEATLLKPDNEDFDNVQVLGANMSALGLSQKPIYTHGKESPSSASNDGP

SEQ ID NO: 175822 - protein, 178 aa, Triticum aestivum
  Clone ID: PAT_TA_70240.pep
PEDSERERRREVVVVWWIYRSFGAYCRLARSHTAALGAPRLPGWFLLLPPILGRCRAMEVEAHEKKGHRAFAKAIKSFGSHRRSNSDLDKMCGKDALYASDKTFVPPKQVEGVKAKVKSDLSKEVQPGRGAQSSLRKEILQLEKHLKDQQVVRGALEKAMGPDAAPVNNLLHEMPMPK

SEQ ID NO: 175823 - protein, 228 aa, Triticum aestivum
  Clone ID: PAT_TA_70241.pep
ANSARGVQSALVAEAVSAAVSFLFTGRGEKASPERLMERMEMAHTRLSLGLERTRRMPMTIIPLFCLKKKLKDAFEECDGLLDKARDLRQVVPSFPTKIMQAVLPSFVVPKPKQDVLSSSVVARFEWLAEEADKFVRDVESGSSLSHYRFLNPLIGQLLEGKNILYHKVQRSQSCSLGIWPVFVEEYGRVARLAFLYEDRMAPHKSFRLMLALRLYESTNIVGVAAQC

SEQ ID NO: 175824 - protein, 229 aa, Triticum aestivum
  unsure (1)..(229): unsure at all Xaa locations
  Clone ID: PAT_TA_70242.pep
RGSRXFVFEELDEVLSYYPQGYHGVDRQGRPVYIERLGKVDPNKLMNITTVDRYIKYHVQEFERAFLDKFPACSIAAKRHIGSTTTILDVEGVGFKNFSKTAREMLTRMQKIDSDYYPETLHQMFVVNAGGGFKLLWNSVKGFLDPKTVSKIHVLGTKFQSKLLEVIDGSQLPEFLGGTCTCAGEAGCLKSNKGPWNDPNIMKVAHNKEAKFSRHTRRLSEIEQRRGSF

SEQ ID NO: 175825 - protein, 49 aa, Triticum aestivum
  Clone ID: PAT_TA_70243.pep
TTPAIQPPAPLSSLLSAARISSVPSDALFFCCLYPNLTLFLDWISACFL

SEQ ID NO: 175826 - protein, 219 aa, Triticum aestivum
  Clone ID: PAT_TA_70244.pep
TVHERKRGDGGNFLVTRSHRLSSPSTTMHRATQDKDKGKDKGVLLPNHHFSSAALLLRKHHEDMPALCKTDLRFVDAGETRWFPFGQPPTRALFISPPRQARGAASPPSFHLLATHAAPSAPMWVVEARQRASPDQAERAELAGKPSSATQTCAPPAHEQIPHHTSPSLFLYHCAPSSKLGPCGSCGASPRGWEAVTAGGGLAAEAAGGERAWTRREGA

SEQ ID NO: 175827 - protein, 144 aa, Triticum aestivum
  Clone ID: PAT_TA_70245.pep
RASVRIRQTPGPGPWPPHRTSSCGRGTRSPSPRRSSSTCRQRRRPRAPPPPTTSTSSRACSWRRTSTTGSSTSTPTTPPSSPRSTASPRSSPTPTPTHPPTTPPSPAPPSPPTLLPPDRPPPAPTLPQTPPNRPPPPTPPPPTP

SEQ ID NO: 175828 - protein, 153 aa, Triticum aestivum; identical to SEQ ID NO: 109663
  Clone ID: PAT_TA_70246.pep

SEQ ID NO: 175829 - protein, 87 aa, Triticum aestivum
  Clone ID: PAT_TA_70247.pep
GGTLNNLFGGISLKFSQRNIKHLVWPPGFICSTMYNNIFLAFPDIATCHHHSCMEPGGTLFSTSLDSLLALLTHTLHPSLRYIIVAS

SEQ ID NO: 175830 - protein, 175 aa, Triticum aestivum
  Clone ID: PAT_TA_70248.pep
EKRGSSRGMGKKGAAAALGSEKKKWQQQVKVQRKVQQQVSGKKKGSGRVKRRRGKQQRRKKSSSGDAGRISSSRFELRSGGAAARRGKIEEQQQGRGYPDVLSGGSRRSFLRSGAWVLVVALEWMGWCWWCGVEWRLEAMVLLVDGWRAATPAWPRRRPVMRRRDEGERSSCRIP

SEQ ID NO: 175831 - protein, 85 aa, Triticum aestivum
  Clone ID: PAT_TA_70249.pep
EEFGRGHYGPTTPTFLPLQPPPPLISSIRGSRHRPWISTSPTSHLQSRAQPAPPPCSSSRGDHALQPPQPYRIRRDPAAPAPPSR

SEQ ID NO: 175832 - protein, 215 aa, Triticum aestivum
  unsure (1)..(215): unsure at all Xaa locations
  Clone ID: PAT_TA_70250.pep
RAAPRAPLGMMQTPSSFFPASPPHHDGPMLPILVARLPCSFTRCERRRAGGTPSGDPLLSAVNPLSSFLSLSPSSHVLPSLSPSHILSPADQIERRRRRPLSAGRHAPSGDPLSSAITPRSPLSSIFLPPLLPCLSPSHLFSSADRIERRRRLPFVGRSLPPLERAVKRRKRRHGGEQGRRGGGGGAVEREGSGAARVEGRGLGVRGXGDLVPNS

SEQ ID NO: 175833 - protein, 203 aa, Triticum aestivum
  Clone ID: PAT_TA_70251.pep
MAADMEMPDPEELEWMESNGLLPEEEEYAYFDDPDEGFLPAAGDACKPHAPPQETATSPAKPADEVSEANLKRPPPPPPPEQEEERSKRRNVDRVDSVDEDWLRYSPPPAAEAVAEKIVSRFASEIQGDSMPVTAPNGERVYAKLATEKLVSEVIEGTRRRTSISNHDGLLSESFHSLTMQAEQEAIAKALMESTEAQYVEGC

SEQ ID NO: 175834 - protein, 208 aa, Triticum aestivum
  Clone ID: PAT_TA_70252.pep
IARLQYLETLHVRRTLIRELPSEIGDLQQLKTLVMSRNLKLAELPREIGDLKNLETLDLSYNQELTELPREIRKLQNLKQLLLTFIPVTKLPKEMVGLKKLKKLALDSAISALPWETSQLSNLEGVAECVRQAWKNSDLVSEFSAEILSIQMDAWTTERGGLTVGTKHMHIPWWIKDHFNDLAYLDIRICKLEEQDLKILREMPSLKD

SEQ ID NO: 175835 - protein, 116 aa, Triticum aestivum
  unsure (1)..(116): unsure at all Xaa locations
  Clone ID: PAT_TA_70253.pep
RLPAPPPPPSAAPSPRARWCTSRTXKTRAYSKRFQVKFKRRRQGXKTDYRARLRLTNQXTRNKYNTPKYRFVVRFTNKDVTAQIVYATIAGDIVMAAAYSHELPRYGLEVGLTNYA

SEQ ID NO: 175836 - protein, 103 aa, Triticum aestivum
  unsure (1)..(103): unsure at all Xaa locations
  Clone ID: PAT_TA_70254.pep
SGRGKGGKGLGKGGAKRHRXKVLRDNIQGITKPAIRRLARRGGVKRISGLIYEETRGVLKIFLENVIRDAVTYTEHARRKTVTAMDVVYALKRQGRTLYGFGG

SEQ ID NO: 175837 - protein, 57 aa, Triticum aestivum
  Clone ID: PAT_TA_70255.pep
CNHPFLLSSFDIKIIKQNHAGCTFSLAILRTYTILILGFFVLIAVAQSPASSFPVSM

SEQ ID NO: 175838 - protein, 117 aa, Triticum aestivum
  Clone ID: PAT_TA_70256.pep
MECNKDEALRAKQIAERKFESKDLQGAKKFALKAKSLFPDLEGIMQLIITFDVYLTSELKVAGENDYYSILSVDTSADDETVKKQYRKLALLLHPDKNKSVGAEGAFQLVKEAWTVL

SEQ ID NO: 175839 - protein, 184 aa, Triticum aestivum
  Clone ID: PAT_TA_70257.pep
VHIPLAPLVAEPVLVPRHLNCAIEGSIRRNGGCRAPAPGGALVVVPPWHPHLWYPNAREKKRNVFLHVGPTNSGKTHNALKRLEASSSGVYCGPLRLLAREVAERLNKANVPCNLTTGQEREEIEGAKHSSVTVEMADVTTEYQCAVIDEIQMVGCRTRGCSFTRALLGLCSDELHVCGDPAVV

SEQ ID NO: 175840 - protein, 99 aa, Triticum aestivum
  unsure (1)..(99): unsure at all Xaa locations
  Clone ID: PAT_TA_70258.pep
RQGGKGLGKGGAXGTXKVLRDNIQGITKPAIRRLARRGGVKRISGLIYEETRGVLKIFLENVIRDAVTYTEHARRKTVTAMDVVYALKRQGRTLYGFGG

SEQ ID NO: 175841 - protein, 123 aa, Triticum aestivum
  Clone ID: PAT_TA_70259.pep
MAIGAALFFFFLAVALTAAPGGGGGDAALVEHTFVCFVSEIMLNHLCNDTPVIVVNGQLPGPAIEATEGDSVVVHVINKSPHGVTIHWHGVKQQLNCWADGAGMITQCPIQPNKNFTYRFNVI

SEQ ID NO: 175842 - protein, 140 aa, Triticum aestivum
  unsure (1)..(140): unsure at all Xaa locations
  Clone ID: PAT_TA_70260.pep
AAPXDSGRKGMVLPFAPLAVAFNNMRYSVDMPAEMKAQGVDEDRLLLLKGVSGSFKPGVLTALMGVSGAGKTTLMDVLAGRKTGGYIEGDISISGYPKKQETFARISGYCEQNDIHSPNVTVYESLVYSAWLRLPSDVES

SEQ ID NO: 175843 - protein, 153 aa, Triticum aestivum; identical to SEQ ID NO: 168119
  Clone ID: PAT_TA_70261.pep

SEQ ID NO: 175844 - protein, 102 aa, Triticum aestivum
  unsure (1)..(102): unsure at all Xaa locations
  Clone ID: PAT_TA_70262.pep
AAPRRRAAPRAAIGPVPFFFFFFFFFFFFFFFFFFTQAAATGTLAAPRRDSSGAAASIGRSTKQQQARARTAPAXRRCCSSSSATTATGGQARVXAASVRWF

SEQ ID NO: 175845 - protein, 96 aa, Triticum aestivum
  Clone ID: PAT_TA_70263.pep
TYAFPNLFEPESLHESYSSGVLPDKISTLQLHRKREVNGKLCIREMRVDLEPCVHAHGPDVELIMEASCYNNNPLVISSSVIYIWSFPNCGFDHIV

SEQ ID NO: 175846 - protein, 127 aa, Triticum aestivum
  unsure (1)..(127): unsure at all Xaa locations
  Clone ID: PAT_TA_70264.pep
MVIDSLXRLITAWEDRKESVVVEGVHLSLNFVMGLMKKHPSIIPFMIYISNEGKHTERFAVRAKYMTLDPTKNKYVKYINNIRTIQEYLCSRADKYLVPKVNNTNVDRSVASIHATVFSCLRRRATG

SEQ ID NO: 175847 - protein, 55 aa, Triticum aestivum
  unsure (1)..(55): unsure at all Xaa locations
  Clone ID: PAT_TA_70265.pep
RPPAAGPXCCPPTSRCRTPPSSPAAPRASRKXRPPQGQEKEGERLGRXWWCRSAA

SEQ ID NO: 175848 - protein, 198 aa, Triticum aestivum
  unsure (1)..(198): unsure at all Xaa locations
  Clone ID: PAT_TA_70266.pep
TLPPRVQSTPRLQWRRRXPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAII

SEQ ID NO: 175849 - protein, 83 aa, Triticum aestivum
  Clone ID: PAT_TA_70267.pep
LKKSTPSSRLAPNRKGSTSTVRSSSNSNLQLRSELQQATTLGRTSSGSEHWSGQSLRIVLSVVCNLLCSSIGLSAYHWERPIS

SEQ ID NO: 175850 - protein, 112 aa, Triticum aestivum
  Clone ID: PAT_TA_70268.pep
LREFYRIGLLELEVVSFRGHKQGVGLQQTDHGHQMQHPDHLISSIHHGHYLESFQSKNDLESVLESSPTLDASAILRACWCRGSKPRGSRALGSSAMADGGFRERGRRGCRK

SEQ ID NO: 175851 - protein, 271 aa, Triticum aestivum
  unsure (1)..(271): unsure at all Xaa locations
  Clone ID: PAT_TA_70269.pep
MQIFVKTLTGKTITLEVESSDTIDNVKAKIQDKXGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKXESTLHLVLRLRGGMQIFVKTXLTGKTITLEVESSDTIDXVKAKXIQDKEGXIPPDQQRSHLLLGKQLEGWAAPLRIYNIQKEXXLPPLSFRLSGEGMXIFVRTXTGQXYSLGGGSLTPTGSPESQRGNPGP

SEQ ID NO: 175852 - protein, 81 aa, Triticum aestivum
  Clone ID: PAT_TA_70270.pep
FSACKKLKEAISNVKAQVVKRKEIIMRTEMLKLAIDQSMPLANIEGFIQVIKRQVDVLVQDEGKPYIYDCEDINSILDKLQ

SEQ ID NO: 175853 - protein, 187 aa, Triticum aestivum
  Clone ID: PAT_TA_70271.pep
DGSTEAPASEGGTSEVSETAQSSTHPSVAEETYDGSVETSNSIKKETQGHQDTEYSDPNGEALPSQPGKSVRDMPVGRTSSPEKLDQSSVMGTEESMDAGKEDIDDGNTSLSQPADSMLASSDDVNEAKVNVVQAFDVQKEIISSPESSDIADEASHGEVKAHDGETNTAENGEESNQTEAHAVSVV

SEQ ID NO: 175854 - protein, 75 aa, Triticum aestivum; identical to SEQ ID NO: 116116
  Clone ID: PAT_TA_70272.pep

SEQ ID NO: 175855 - protein, 96 aa, Triticum aestivum
  unsure (1)..(96): unsure at all Xaa locations
  Clone ID: PAT_TA_70273.pep
RGNGTGGESIYGEXFADEXFVHKHTKPGILSMANAGPNTNGSQFFICTVPCNWLDGKHVVFGEVVEGMDVVKNIEKVGSRSGTCSKQVVIADCGQL

SEQ ID NO: 175856 - protein, 103 aa, Triticum aestivum
  Clone ID: PAT_TA_70274.pep
MAVVSAAHGAFGPLVGKLTALLADECGRLKGVRREVQSLRSELASMHAALKEYTKLEDPNEQVKFWISLVRELAYDTEDVFDKFIHHLGDTRDHGGFKDFFRK

SEQ ID NO: 175857 - protein, 158 aa, Triticum aestivum
  Clone ID: PAT_TA_70275.pep
MMGTECITASLGDDPEPSVPPGFGPPPGFGPFAAYALQGTQKDAKLADARPSPAQVFQNEKKHVESLEGQPHSAQSRNDTHCSTSGSHTCRQSLRNRPPVDYSRFDNMSDEDSDVEVVEKAATSLVRRRQQLPKGVFRGCAACSDCQKVVASWNPAGA

SEQ ID NO: 175858 - protein, 188 aa, Triticum aestivum
  unsure (1)..(188): unsure at all Xaa locations
  Clone ID: PAT_TA_70276.pep
PLLHKXEVISSSGQDEPPXXHMIYLPYSXDVRYPEEVHLTSGDAPRATDEQIKKASNLLRRIDLKHFSVRHFANPGLQKHYGILEALALGEDEMPDIKDETLPDEEGLARPGVVKAIEEFKAAVFGENYDQDEAEAAAAKGGASKKRKAIADAASQKSAAYDWADLADNGKLKDMTVMDLKTYLTAHG

SEQ ID NO: 175859 - protein, 209 aa, Triticum aestivum
  Clone ID: PAT_TA_70277.pep
TVASFDRDGLRPRRQPPSPAKETKAAGSGPNTSKKRKLAGHQRREEVPTAAVGLHIHGEVLAPPPGALDPKSTGKPPAGGEVDGGAVDRISNLHDDNLRHIVSLLPVKDGARTQILASRWRHLWRSAPLNLDYREFPSGCLPPYIDSRIDVISHILSSHPGPGRRFCIEPCYLHAPEATVDAWLRSAALDKLQELETGSTICIDPPPAS

SEQ ID NO: 175860 - protein, 153 aa, Triticum aestivum
  Clone ID: PAT_TA_70278.pep
ALLLSPSSPPPPASCCSPVDDGQEDFLQHQVSRMDTLAGIAIKYGVEISDIKRANSLVTDSQMYAHKALLIPLPGRPMPSSVKLNGSSLRSKRAWAPNNQQNRDIMDSLDSVKSRQQQSSLAMSSLQSYYGLSSERGDDMDCSTEMSLYSKGG

SEQ ID NO: 175861 - protein, 119 aa, Triticum aestivum
  unsure (1)..(119): unsure at all Xaa locations
  Clone ID: PAT_TA_70279.pep
MAAKGDGPAIGIDLGTTYSCVGVWQHDRVEIIANDQGNRTTPSYVAFTDSERLIGDAXKNQVAMNPINTVFDAKRLIGRRFTDSTVQSDIKLWPFKVVAGPGDKPMINVQYKGEEKQFA

SEQ ID NO: 175862 - protein, 138 aa, Triticum aestivum
  Clone ID: PAT_TA_70280.pep
EGSIHGTQPPKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 175863 - protein, 121 aa, Triticum aestivum
  unsure (1)..(121): unsure at all Xaa locations
  Clone ID: PAT_TA_70281.pep
IFSLAPSLPRHTPSCPDPPSXTPSAPPSVSTRTTGNHRARSSSPRAPPPSPTPPETTSSSPPWXRPRPPRPPPLLHRATAPHRPSRLQPRGPAPFAVVSVAPAAPNLSTGLLVPPRPRDRC

SEQ ID NO: 175864 - protein, 182 aa, Triticum aestivum
  unsure (1)..(182): unsure at all Xaa locations
  Clone ID: PAT_TA_70282.pep
INNEHYYRVDCFFAVLDLLGEEFNDRFNEVNSELLLCMSALSPSDLFSRFDKAKLLKLAKHYPDDFNHQDMVTLEHELGLYIDNILHDTRFSSLDKIGDLAKLMVDTRKHLSYPLVYRLLKLALTLPVATATVERFXSAMKIVKNALRNKIGDDYLSHSLICFVEKGLLDEITNEVIVDRFS

SEQ ID NO: 175865 - protein, 50 aa, Triticum aestivum
  Clone ID: PAT_TA_70283.pep
GCRFGTRHLAVAYRASCRERRRLLVYRIDVEAVRLKGGHQTPKGLKQCSV

SEQ ID NO: 175866 - protein, 160 aa, Triticum aestivum
  Clone ID: PAT_TA_70284.pep
MSDPCECCQIKLKFLRQINGNFMHSLVIPEWFVNQFGGKIWRTVKLESPNGNVYDVGVTENMNRTILKSGWASFVDANKIEENYSLMFRYLGNTRFKVTIFDSSGKQKASCCARMGTAASDVRNPSTFDVDNSSSSCGGTTQSSPSERSDSDGSQKESSY

SEQ ID NO: 175867 - protein, 120 aa, Triticum aestivum
  Clone ID: PAT_TA_70285.pep
LGTYKVLKCRQLLALLHSPMLPYHPNPHGFWISREPPAQVPNPASGFAMAPPAHLDHQIQHYDHFFPGHGNQFNSETLEAVLMRPRPPAPPLVEMPPANEARTGAVQAAGTGHARARKRP

SEQ ID NO: 175868 - protein, 85 aa, Triticum aestivum
  Clone ID: PAT_TA_70286.pep
RLCRTPRRTRYQTKPSPPPAVPPPPPTGAYQERPAAPPNPASQLPTLPPRRRHRPKRMPPSAPPDHWPPTSFRIRVPAPPQLKSP

SEQ ID NO: 175869 - protein, 220 aa, Triticum aestivum
  Clone ID: PAT_TA_70287.pep
RNSEDGLNFREEERESQQSLLASILSIYDMVVMDYPRQYEGCPLLTMEMVHHFLRSGESWLSLGQHNVLIMHCERGGWNVLAFMLAGLLLYRKQFIGEQRTLEMVYRQAPRELIQLLSPLNPMPSQIRYLHYISRRNVSAEWPPGDRPLTLDCVILRNTPGCNGEDGCRPIFRIYGQDPLLGTDNSPKVLFSTPKRSKYVRHYKRADCQLIKIDIHCHIQ

SEQ ID NO: 175870 - protein, 216 aa, Triticum aestivum
  Clone ID: PAT_TA_70288.pep
DADDPAAVGGGYAGGDEAGGSVEGEEQLEPDDGDGRRLGEELEDSLLIAGDQECHDSDGGQQSSENTMSQSNQSRRLQIRTHTGWMECRHDIGTFAPGLLSIYESLKPSEDHMSKQSRLIDSLTKSVSKEWPNAQLHLYGSCANSFGTSHSDVDVCLEIDIGTGSEVELLLRLAEILRGDNFDSVEAITSARVPIVRMLDAGSGFSCDICINNLLA

SEQ ID NO: 175871 - protein, 212 aa, Triticum aestivum
  Clone ID: PAT_TA_70289.pep
YWGKRRGVYSNVMGFLGGINWAILVARICQLYPNASPSMLISRFFRVYSQWKWPNPVTLCHIEEGPLGLPVWDPRRNFRDRGHQMPIITPAYPCMNSSYNVSTSTRYVMIQEFTRGYEICQAIDENRATWDDLFEPYPFFELYKNYLEVGITARNEDDLRNWKGWVESRLRTLVLKFERYTHEMLLAHPHPRDFSDGSRPRHSFYFMGLWRK

SEQ ID NO: 175872 - protein, 104 aa, Triticum aestivum
  Clone ID: PAT_TA_70290.pep
FSLIASFEQKGVPPLPQIPAHYLRIKDGSIAASSIQRYIMQKLSLGSESEVELSCCGQSINPIQPVHNLMDRWLRVGPSRHLQTSVGSSGGEYVMVITYGRPKS

SEQ ID NO: 175873 - protein, 166 aa, Triticum aestivum
  Clone ID: PAT_TA_70291.pep
MDSIPSICKQSLQIFVIVREVDCFEHILPCSVAICSDSGPLSKKVIINLDVSILGVLTAYPGLKFGIVLTNFIVGTHTSIISHHFLIHLLFWRRNQVRVLELQGLEVRRGITVIIDHTGKDPTLGEFCFTMIGRADIEGSKSNVAMNAWLPQASYPCGNFSDTSSF

SEQ ID NO: 175874 - protein, 89 aa, Triticum aestivum
  Clone ID: PAT_TA_70292.pep
LNSTFCSKRTIIMLELYSFVPRDDFLRESLCYKYNGVFDGLLVAAGLLASLVTNAQGNIHIQCASAIEKAPGSSGKRGHHLALAVCGCD

SEQ ID NO: 175875 - protein, 78 aa, Triticum aestivum
  Clone ID: PAT_TA_70293.pep
MHLTQFHLFFNATEFIHLFRLPECSNSSSSEPSPSWQKCYLNFQVFPMFSFHNCRARKGLSKDHHHAAAWQRLSQTPP

SEQ ID NO: 175876 - protein, 146 aa, Triticum aestivum
  Clone ID: PAT_TA_70294.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTAKSPKKKVAAKE

SEQ ID NO: 175877 - protein, 115 aa, Triticum aestivum
  unsure (1)..(115): unsure at all Xaa locations
  Clone ID: PAT_TA_70295.pep
IEKKVLIFDLGGGTFDVSLLTIEEGIFEVKATAGDTHLGGEDFDXIEIDSLFEGVDFYSTITRARFEELNMDLFRKCMEPVEKCLRDAKMDKSTIHDVVLVGGSTRMQGVSCRIC

SEQ ID NO: 175878 - protein, 215 aa, Triticum aestivum; identical to SEQ ID NO: 174519
  Clone ID: PAT_TA_70296.pep

SEQ ID NO: 175879 - protein, 281 aa, Triticum aestivum
  unsure (1)..(281): unsure at all Xaa locations
  Clone ID: PAT_TA_70297.pep
GIRHEDPIELESGDGIIVQGQSSLHPTDMDVDDTPSKDEEAEAYNKMDDEPSSSSKQNQSNADDLRNNIPNWTGYNLRTPDLNDMLFHNEDDAGPSSSYYHPSPFPCDDPASPASPEYVSAQAPATPGLMEETVPSRVHESPVLSPQRKASPSSNEEAAKVDNFAAPPSDFLHSAAANANDAVGAGMAEFGLAKPVQVESSGAVQENLAAPSSDILHSATANANDAVGAEMAEFSLVKPVQVESSGAAQENLAAPSSDLXHSAAANANDAASAEIAEFGIG

SEQ ID NO: 175880 - protein, 83 aa, Triticum aestivum
  Clone ID: PAT_TA_70298.pep
IPWRISGCLSEPATHLLPPPSPVSLLRRSIRRASSPRHSQQRRRGRMGRPPSSGGPAFRFTHAEVAEMEEHLRHLNNAIPQRN

SEQ ID NO: 175881 - protein, 131 aa, Triticum aestivum
  Clone ID: PAT_TA_70299.pep
MAEAVLLALGKIGKVLTDEVAKALVAKVLAKVGNLIDLNDKIGQIEVQLKAMNNIIREIGTMYLTNEFMKGWIGEVRKLAYRVEDVLDKYSYHSLQMAEEGFLKKRFLKGSHYLLVFSQITEEVVKIEKDI

SEQ ID NO: 175882 - protein, 66 aa, Triticum aestivum
  Clone ID: PAT_TA_70300.pep
FCCPDKFIPFAQKVFFLRNENTCMELIILCLYRTVESLIFFLKKSIVDITINTRLYSIYKNRQPYQ

SEQ ID NO: 175883 - protein, 163 aa, Triticum aestivum
  Clone ID: PAT_TA_70301.pep
MDDLPDGEGQSDIHSTDANWLSSHEEHKFQSISLAKQDHNSDLADSSLNCMKGDHSFCASQELWSTGSLSSPIPNGFYSIIPDKKLKECFDAIPSPDDLYSLGIEGFKAEIILVDLEKDKKLSAIRQLCVALVKGLSSNPAAMIKKLAGLVCDFYKRPNPQLS

SEQ ID NO: 175884 - protein, 94 aa, Triticum aestivum
  Clone ID: PAT_TA_70302.pep
STRGGGNNKYKNLYIMDAEAGENAGEAERITDGDWTGTHTLPMISEQRLDRVFSSNHDRPADAPELDHGLDPGNFVVYLVNTIDRSVVRVIQSG

SEQ ID NO: 175885 - protein, 141 aa, Triticum aestivum
  Clone ID: PAT_TA_70303.pep
SITQGSHDASAAPVACILLNIDLLHGVKDEEERGSRLASEPTAAPFTDPARPRPPSHPHRRRLPLPDANTSTPADPSPYSNGESNGSKSSDTGMSGPSAWDLLHLTSLWRLRSSSRPRAPSEEKRGGQGGGDEQGWREERG

SEQ ID NO: 175886 - protein, 125 aa, Triticum aestivum
  unsure (1)..(125): unsure at all Xaa locations
  Clone ID: PAT_TA_70304.pep
WASRLVCIVQDTFLHRRTRTQPIGRLQAMAKTLRQKKIPAVMLKLDISKAFDSVAWEYLLKLLQCLALGQXWRGRISALFYSASKRILVNSNTTEQILRRRGLRQGDPLSPYXFVFVVDCLGRLM

SEQ ID NO: 175887 - protein, 64 aa, Triticum aestivum
  unsure (1)..(64): unsure at all Xaa locations
  Clone ID: PAT_TA_70305.pep
MPLDVLGRTRATLMGFRGDDLPVTGGGISEKGRFSYGFASCAGKRAXMEDFYXTRVDDVDGETX

SEQ ID NO: 175888 - protein, 205 aa, Triticum aestivum
  Clone ID: PAT_TA_70306.pep
RERLSFDDFMLDPLVEQFSIILNSPVLSPNPDDWSMQMEVLKCLLQLIQNFPRLPEAKISAVLAPLWQTFVSSFKVYHLSIIQASEDVDNVGYDSDGSERSLESFEIQLFELWTTIVGNSMLAKVIAGNIKELAYYTISFQQITEEQVQNWSRDANQYVADEDDVTYSCRVSGSLLLEEIVTAYEDYGIDAILEASQVCFRESRE

SEQ ID NO: 175889 - protein, 115 aa, Triticum aestivum
  Clone ID: PAT_TA_70307.pep
IRHEAPPGLLDGGGGVGDPAGSEACGHRGGRLRQRRRPAATAGALDLVQRHGPVPAEVREDEGEREGRRGASMVVRALPPPSSHHLRHTQPPPSAPLFFAHGNRGKSCQGIILFR

SEQ ID NO: 175890 - protein, 215 aa, Triticum aestivum
  Clone ID: PAT_TA_70308.pep
GKQKQELVAWAMREHLLSNNVKSLGSSTSKKGDDSQKAIVLSAAPRSRRLKRKQSSVTSEEHGLFSPGRSCNNANSPRSNTSRKDVQRFSVQPSASQKKPKLGQGLAALEKHISRPAATQSTVKQPAKSSSSMKTRRQHRPEDSPMITVQPAAPLTRSKRKQSNRAAPARQAARSEARGSAKEKEYVCFSLWLNFYESECSSGSAEPLVNKRTVQ

SEQ ID NO: 175891 - protein, 99 aa, Triticum aestivum
  Clone ID: PAT_TA_70309.pep
MPRAEVAFAMHAGDGEVEAGFAKLQGEDFEYYMQTYSIMLGRSSKKSMVDVDLSSLGGGMNISRHHARIFYDFQRRRFALDVIGKNGCHVEGVLHLPGN

SEQ ID NO: 175892 - protein, 168 aa, Triticum aestivum
  Clone ID: PAT_TA_70310.pep
MAVSSWVPPSLPESSAAASGSGESGLVLLDMWCYIADLPNNTTAEGTTSTGLPIKVTLRAARPPHLSHFCVHCPGLDFRITGPKIVATDAHLVLLCVPIHPNSATGALDWDYFVYSPRAQRLDLLPNPDPICLNDSATALISRQDGAWYAVAALGYANPLYDGGALIR

SEQ ID NO: 175893 - protein, 153 aa, Triticum aestivum; identical to SEQ ID NO: 168119
  Clone ID: PAT_TA_70311.pep

SEQ ID NO: 175894 - protein, 86 aa, Triticum aestivum
  Clone ID: PAT_TA_70312.pep
WMPGSLFLILPLCIYASSRLTFLTPATEHPSAWCSSRFPSVFIFYHPCTIFASSTQLVQVLFKLGDGRLIRPDIGNWFSHFFSEIL

SEQ ID NO: 175895 - protein, 144 aa, Triticum aestivum; identical to SEQ ID NO: 131264
  Clone ID: PAT_TA_70313.pep

SEQ ID NO: 175896 - protein, 68 aa, Triticum aestivum
  Clone ID: PAT_TA_70314.pep
LRPRGGAESPRRRDEMASRQHNPKSKTLGNKYMLGDEIGKGAYGRVYKGLDLENGDFVAIKQVSLENI

SEQ ID NO: 175897 - protein, 220 aa, Triticum aestivum
  Clone ID: PAT_TA_70315.pep
GYYRSTCYSDDDSYFWISLDWLRQWADNATPPSSIDNSPIQCEHGKVPASKVTSMKRLSAKAWEKLLSKYGGGPTLSKDDVCKECLKDVAKTAVSADVYRDRKASLKNLAEAALAGSIPEGPSYFISKAWLSHWLRRKNVDITFDADKGPTSALRCSHGNLLPEHASGAKRVSVPESLWLFLYETIAREADDIVTFPSDTQPCEICDDKLSAVASVEDNL

SEQ ID NO: 175898 - protein, 42 aa, Triticum aestivum
  unsure (1)..(42): unsure at all Xaa locations
  Clone ID: PAT_TA_70316.pep
VGQGILPSKXWCFGPETXGPNMXXDMXKGXQXXNEIKDSXGA

SEQ ID NO: 175899 - protein, 54 aa, Triticum aestivum
  unsure (1)..(54): unsure at all Xaa locations
  Clone ID: PAT_TA_70317.pep
DRKXELGTFLSFCMFXLHHKRSXDCVECITKAQEEKGRISQNLTRCKGTYXVWA

SEQ ID NO: 175900 - protein, 201 aa, Triticum aestivum
  Clone ID: PAT_TA_70318.pep
RNSARGAAGLSRECRRRLETLVGRMLDQATLDDLLVSGDGGGVYDVSLVMRLVRVFASSVEEDGSPSSSQRMRKAGKLVDKYLAEISPDQGLRVSRFLAVAESLPDSARDCYDGVYRALDIYLESHAELTVEERATLCRCLNYEKLTLEACKELARNRRIPPRIAVQALSLQRPPNSLQSPLSSPTPKRVMSDDEKEKETL

SEQ ID NO: 175901 - protein, 213 aa, Triticum aestivum
  Clone ID: PAT_TA_70319.pep
LQIRHEETTQIPKTSRSARRKKIKRQLRKQEKEKLKENVDCQESANAADCPSSSNHNDLPCPSSNENGPHLSHEAEEEESDASEDIVPVVVRPGHIRFEPAGEPNTSSAKEAQANFTWGGTMSKKKGQKWGMNSSNKKSADTGNLGKIVGSNTEVNHLVVDSRDEENVFSGASNQKVDEINHDLLAKEKSVAEEGKSTSEPLDFEALYPLTRL

SEQ ID NO: 175902 - protein, 36 aa, Triticum aestivum
  Clone ID: PAT_TA_70320.pep
FFFSESIYYYPTLMGEGNKPSNDGAPYKVSTQPSCR

SEQ ID NO: 175903 - protein, 207 aa, Triticum aestivum
  Clone ID: PAT_TA_70321.pep
MSRMLQRKEYDVCYRRRTEEIYDFLVELINLKPYVKQTDCSDDVMDRLVESCQPQSDLWRSYALRAVDIFLDSLLIFWEPQFHPLIRERHKEQLLISARELAEGCAIIEPLEPDPDDFLAHLRPYASVYFESKKEQFGYYTAKKQVRLHEEFDNYLATCTWDDAIDLSSFMESARRDDEKFAELDPDLAKMSFERMTNIAERKHKMN

SEQ ID NO: 175904 - protein, 228 aa, Triticum aestivum
  Clone ID: PAT_TA_70322.pep
ANSARGWKLLQNMAHKGVDNTQLEGLLIVENSKGSHDDGSFELPCMSEITPEVDFIKDVPNSLSASSSANYATDLGNSSMSEGSVTGTSEEPKNSEGGLEASQIKSLILEELEGSCVTQASPRVQSKSELEAETYGREKFSFVGESYLHNENEKIIEVPRESLISEVEKAEGEVELRPHAHSEESVPDEDVECPEESDITQQTNNPVVSTMLNVFEIASKFIKGDLDQ

SEQ ID NO: 175905 - protein, 221 aa, Triticum aestivum
  Clone ID: PAT_TA_70323.pep
MEGNPSLYLLAVWFNKIHEKTVAWYAKGSQDTPVQVPSSSVLQLTADGLLSLRNPSGDEVWSPRVPGAAYARMLDTGDFRLVDADGKAKWETFDVPADTILPTQVLPVGQQDKVLRSRLIPTDYANGRFLLAVQSDGDLVFYPIAEHSTFRYDPYWASNTVGNGSQLVFNETGMVYFTLTNGTQTNITSAEGYPMGDFFHRATLDPDGVFRQYPRRAARRR

SEQ ID NO: 175906 - protein, 161 aa, Triticum aestivum
  Clone ID: PAT_TA_70324.pep
MANTGLSRRNSCPKVHSALCSELTMMLDKISSILPSIEAARPGCRAGIQELCNLYHIVEKGRLITQHCIECSKLYLAITGEAILSRCERVRDSLKRSLFLIQNMVPTVLANQIADVHNDLRDVKFSVDPLEQEAGKSILEMLRQSDATEELLLQTFMQAAS

SEQ ID NO: 175907 - protein, 49 aa, Triticum aestivum
  unsure (1)..(49): unsure at all Xaa locations
  Clone ID: PAT_TA_70325.pep
GRRYTWXSLAAARLGRPRSNPLPCSLRRIEGGCVVEEGAGRRRGRGGAG

SEQ ID NO: 175908 - protein, 134 aa, Triticum aestivum
  Clone ID: PAT_TA_70326.pep
MWCCQQNKSENRACTRCGEIGHSTSTHGLSCSSCDEYHEDGECRLGGVKCFLCECQDHYLAKCPLNSVLTEAFQSQRENFQAALRLALSKQRDPSSTPPKCSAKSEGKVLAANKPKSIVRCVRCGEEGHRRKKC

SEQ ID NO: 175909 - protein, 76 aa, Triticum aestivum
  Clone ID: PAT_TA_70327.pep
TTNIMDIRYVTSRCVLNRPVTYLLYYLKKRSVSFFLSRFLQPLRDFVPSPTYAASLSSSDFSPPPIFKQEGLPGPC

SEQ ID NO: 175910 - protein, 173 aa, Triticum aestivum
  Clone ID: PAT_TA_70328.pep
MQSPECYPQVMPKPVLTILELSFPLASSDLGANSLENEFMTRKLHLSQIQKKIEEIAALGLDTTAFEDEAFNTEAALDRCILRLISTCCNGDKLVRATELAKLLTLEKSMKGALTLVTRLKLPTLQEKFSSLLEERMLNDARTAGTVGVCLNPASTNHSPALHTIQPAKIVQN

SEQ ID NO: 175911 - protein, 83 aa, Triticum aestivum
  unsure (1)..(83): unsure at all Xaa locations
  Clone ID: PAT_TA_70329.pep
FKVLKQVHPXIGISSKAMSIMNSFINDIFEKLAGESAKLARYNKKPTITSREIQTSVRLVLPGELAKHAVSEGTKAVTKFTSS

SEQ ID NO: 175912 - protein, 115 aa, Triticum aestivum
  Clone ID: PAT_TA_70330.pep
EEGAVVSSASSPATPSLVAPPVLAHGRANPAPRCPRSEARVGWGQAGDGEKRTRRSSSLWCRRSRPHPSCVLPERRSAGSSTICARISFLPFLRMSFFVSFSSLFSENALGVAAF

SEQ ID NO: 175913 - protein, 158 aa, Triticum aestivum
  unsure (1)..(158): unsure at all Xaa locations
  Clone ID: PAT_TA_70331.pep
QXIRHEAPVHLFPSHLLATHQRPAATRLRRRWLDSGHRRLIPPLPAPPHSTQHLHPRPPVSPSAPPRNVSAYSSAARRPATDLLSYGDDRFERSNTSSPPPPTPHHAPRSKRSTVGSEDPPLFSPATLAAAKTPAAPPAAMSISGEVPDEGSDGEEVF

SEQ ID NO: 175914 - protein, 41 aa, Triticum aestivum
  unsure (1)..(41): unsure at all Xaa locations
  Clone ID: PAT_TA_70332.pep
KVXXVRXLXSXSVTLXVSTTSXXXNXPLQXXXHXPFSLXNC

SEQ ID NO: 175915 - protein, 56 aa, Triticum aestivum
  Clone ID: PAT_TA_70333.pep
ARHERKLYQHSSCKFSSSCEISIWLYNCAIKQGMRENYINTAVIFWCTIELLSYEI

SEQ ID NO: 175916 - protein, 226 aa, Triticum aestivum
  Clone ID: PAT_TA_70334.pep
RNSARGIVGDSGPDVVLKEAIRIIPTASSAALAAAKILHLEAELTKLAGDKVAMAERIGKLGAVVERLVGEHGGVVLDLGDLKWMVEGPAASSSEGGKAAIAEMGRLLRRFGRGEVWAVATAACATYLRCKIYYPGMEDEWDLQAMPIARSTPLAGAALRPGSSGSLSNSVGMLSPMLRPLPVTPTPLRWPPGGGHTQMVKPAMCMLCKGGYESELTKLAAERTAV

SEQ ID NO: 175917 - protein, 192 aa, Triticum aestivum
  unsure (1)..(192): unsure at all Xaa locations
  Clone ID: PAT_TA_70335.pep
AGIRHEGRYGPLKKPXTEVHKNTNTAKVVFRKRVDAERAFSVAGNFGSFGPSLRSFRLANMPFSLTTELNYPKLRSEDGGMEIPACRVSGVALDSAQIGIVDKADKGETVGNPSVEHTEMVKLAGQYEGNTERALHAGGRNEESPDVLSDTMQTGIVDDTPKHKLVCVHGVVEASEDTMEVDNTDETRGGAR

SEQ ID NO: 175918 - protein, 211 aa, Triticum aestivum
  Clone ID: PAT_TA_70336.pep
SIEKSSASKDGDVPLCNTKLFEMNAQKSFGARFGLEAAQVVIDLVQARNKDKPKICLESLVIDVLDCIANSALNAKPIATPKVSSSDVQSLNNFSFGNKFISIHSFILERNIETIVEKPSPQVQHPIPNLNEASTFVAGVISDGDFLNPVVLSSSSPVPKSVVNEANAEGAIPMDPLSCGKSASDAIGISPSTMQCPIPAIGSSLMHSAGP

SEQ ID NO: 175919 - protein, 135 aa, Triticum aestivum
  unsure (1)..(135): unsure at all Xaa locations
  Clone ID: PAT_TA_70337.pep
QAGEGPEREAAGSNLSAPELRFSYGAWYGRWRRRARKAPQIWNRFAAGFDGIPDSEQGSPQIWDRIERQAGGKRGTPPPISPAGDHARIRLGLDRKPLPQRMNGTEGAMPLLTHHGELARVGCPRTESPEXLWGF

SEQ ID NO: 175920 - protein, 166 aa, Triticum aestivum
  Clone ID: PAT_TA_70338.pep
MLHHSNSRQQRNRGSKIKTLLKVTLLLGVAVWLAYQVKHSYDKKNEYYNATEDQLSHDDRSMFQGRKERLGTNGDGNAEKAIETTDVIGKQEEEKSGESVFEKDNTDSHDDDSGNTERSEAEEGQASRADDNAEAHRNETSESKSSDAETKSDVHPTGDDVPHEEE

SEQ ID NO: 175921 - protein, 186 aa, Triticum aestivum
  unsure (1)..(186): unsure at all Xaa locations
  Clone ID: PAT_TA_70339.pep
PSDNVQXLXXQVQXRASLRXQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNXQKECTLHLXLRLRGGMXILXKTLTXKTITXLEVEYXDTIXNXQXXRIQXQGRASPPVPADVSLLKQRM

SEQ ID NO: 175922 - protein, 98 aa, Triticum aestivum
  Clone ID: PAT_TA_70340.pep
MVFQAASDDNLPLFKALVMVLDMGRGCPKEAIEGLRVEEAGKLQGFSALHIAATRGSLRVCRYLVEELLIDVDLVDKEGPSIFRTLVYRFRTPRTHSV

SEQ ID NO: 175923 - protein, 242 aa, Triticum aestivum
  unsure (1)..(242): unsure at all Xaa locations
  Clone ID: PAT_TA_70341.pep
RRQRLIFAGKQLGXAAPLQXYNIQKESTLHLVLRLRGGMQIFVKTLTGKTITLEVESSDTIDNVKAKIQDKEGIPPXQQRLIFAGKQLEDGRTLADYNIQKESTLHLVLRLRGGMQIFVKTLTGKTITLEVESSDTIDNVKAKIQDKEGIPPXQQRLIFAGKQLEDGRTLADYNIQKESTLHLVLRLRGGMQIFVKTLTGKTITLEXVESSDTIXNNVKGERXRTRXGIPPDQQRLIFAGKQ

SEQ ID NO: 175924 - protein, 126 aa, Triticum aestivum
  unsure (1)..(126): unsure at all Xaa locations
  Clone ID: PAT_TA_70342.pep
QATLXFSCSQFXTSSGDNSDATGLACVSGGGVHLLPRAAVVAWDTAGSAAKMDFSGGAFKNADVPMNPRLCSSTSRQGRICPYDRSSSWSVTQSRRHGSRCRCSSTGRLNHRKRALKATEATSPKE

SEQ ID NO: 175925 - protein, 83 aa, Triticum aestivum
  unsure (1)..(83): unsure at all Xaa locations
  Clone ID: PAT_TA_70343.pep
LNNGDXXTSTGKIKTESSAKIKASKDIYKKWQQKSHRAIGSGGKDGAXGGISTPAGYQRGNRRYPAAGRGRSSIPNADVPSEI

SEQ ID NO: 175926 - protein, 78 aa, Triticum aestivum
  unsure (1)..(78): unsure at all Xaa locations
  Clone ID: PAT_TA_70344.pep
FFPSKQGXEALNSLKKGFAKDXELDLIVAEVHPGXTEVGTLRLFHHILNELEVPLITMCAYXEAAXARMTLENMXQCG

SEQ ID NO: 175927 - protein, 159 aa, Triticum aestivum
  Clone ID: PAT_TA_70345.pep
GLLLGSPENAAAGSFDRLAYHFAQGLRSRISSASTSCSLPEPLPSDRMSVQHIIQELSPFAKFAHFTANQAILDATKGDTHVHIVDLNIGEGIQWPSLMSDLARHGGMSFHLTAVTADADYSDGVHHASARRLSEFADSLNLPFQYSSLCLHSDEDLHE

SEQ ID NO: 175928 - protein, 73 aa, Triticum aestivum
  unsure (1)..(73): unsure at all Xaa locations
  Clone ID: PAT_TA_70346.pep
LRPRXPPSLGSXSGAPXHFLXFGPPVQKDFREYXLVVNSXRLPRIDSIQQNLIFSLPHYGIIHYLCNHTCICA

SEQ ID NO: 175929 - protein, 47 aa, Triticum aestivum
  unsure (1)..(47): unsure at all Xaa locations
  Clone ID: PAT_TA_70347.pep
NPRPQVLLPGPTPXPPPTPPPSALRPRPRXPTCATPSGYTPVDSSLX

SEQ ID NO: 175930 - protein, 88 aa, Triticum aestivum
  Clone ID: PAT_TA_70348.pep
LISPLAPWNSKFRGDGQEVLVAGYGIPHQDLEPDLVEEEPEAVAPSLGPCSSRRAPRRRVRGGGGRGRPELAPKVIGEEEAAEKAGRR

SEQ ID NO: 175931 - protein, 84 aa, Triticum aestivum
  unsure (1)..(84): unsure at all Xaa locations
  Clone ID: PAT_TA_70349.pep
ALXILPYEFLLLKWXMPVMSKLCSSCTIEDKADDPDAEARVNSVRGLILVCETLTSNVDQSSDIGESVYAYIKVEVMPALFRAL

SEQ ID NO: 175932 - protein, 143 aa, Triticum aestivum
  unsure (1)..(143): unsure at all Xaa locations
  Clone ID: PAT_TA_70350.pep
NTHKQLSLYPHPAAVPXSRXSSSSASRSRPPPPPLPLIMCPSCPGTRTRWYVSGTDRNPGIRFYKCPNQAYGGPCRFWLWEDQYAYYIIGVGINLLIEAAGGGSNVMFEMGRAIDEIRTAARNTMTICMLMLFVLLAKAAGWQ

SEQ ID NO: 175933 - protein, 85 aa, Triticum aestivum
  Clone ID: PAT_TA_70351.pep
ESMEFEVDFLEEGGERMIVGFMGKRSPLSATLSLRGTSQICLGSLKHEIPWTSHLSLQACVLPPLMRSSCANMLELYSLCKLIVI

SEQ ID NO: 175934 - protein, 57 aa, Triticum aestivum
  unsure (1)..(57): unsure at all Xaa locations
  Clone ID: PAT_TA_70352.pep
ARLLTSYSLFKQMQGRFRSLLYSVIKCLTFVYSGSTICRMKKKFXGIYNSCVIVTQK

SEQ ID NO: 175935 - protein, 159 aa, Triticum aestivum
  unsure (1)..(159): unsure at all Xaa locations
  Clone ID: PAT_TA_70353.pep
RRKRLPTVAWQRGTSLSTKTRVVSARLFLPSNAAAAAATGGERLPVIMYVHGGIXSAPXSAFCRTYNNYARSLAARAGALVVSVEYRLAPEHPVPAAYDDAWAALQWVASVSDPWLSDYADPGRTFLAGDSAGGNXVYXTGGACGQRWWHWKPHRRRGP

SEQ ID NO: 175936 - protein, 231 aa, Triticum aestivum
  unsure (1)..(231): unsure at all Xaa locations
  Clone ID: PAT_TA_70354.pep
GSLVLLPXIFVKTLTGKTITLEVESSDTIDNVKAKIXDKEDISLDQQRLIFAGKQLEDGCTFADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTIMLEVXESLDTIXYVKAKIQDKEGIPLDHQHLIFAGKQPEEXARTLADYNIQKXESTLHLV

SEQ ID NO: 175937 - protein, 61 aa, Triticum aestivum
  unsure (1)..(61): unsure at all Xaa locations
  Clone ID: PAT_TA_70355.pep
XSWLNSLSIQGSVDVPTILKDSIRYGNPPPLFILSGLYLLTLPHTLVFAYTASYTCICSIH

SEQ ID NO: 175938 - protein, 218 aa, Triticum aestivum
  Clone ID: PAT_TA_70356.pep
ERLRKQQKSVVVPIGRLSIGFCRHRAILFKALADFIGLPCRIAQGCKYCSAPHRSSCLVKIENDRRYSREYVVDLVVAPGSICSPDSSINGQLLSSVSSPFKTSCTASLENYAAPVAAWNRAIADDRCNSVFSDSQYSVAGDKNPVQADTKCGQVMQNDNCNNMSVFQVSRQFKAMEVGTEGVNKENIPGLTLPKHLLAESSFAMDWLEISWDELELK

SEQ ID NO: 175939 - protein, 206 aa, Triticum aestivum
  Clone ID: PAT_TA_70357.pep
STPRSRPAAPPLNPPPAADPSLPVSQRRRAYSQHTSVATSYQPREKRETKIQMSEIVNNLLGKLADLLSDECQKLKGVERHVQHLGDELSSMKALLEALDLRDKLDPLTKDWRDHVRDMAYDMEDCIGDFLLNVGSANANAGFIEKTTQLVKDLWARHQFTIQIQELKDRAIEANHRRKRYKLDDSSSSSSALVPVDPRVSALYTE

SEQ ID NO: 175940 - protein, 198 aa, Triticum aestivum
  Clone ID: PAT_TA_70358.pep
RGAAVIPYALAEGGWLSLVLLLLVAMVCCYTGQLLQTCMGASPDVRGYPDIGALAFGTKGRFAVSAFMYAELYLVAIGFLILEGDNLDKLFPGTSLSLGGVLVLSGKHLFIVLVSIFILPTTWLRNLGVLAYVSASGVLASVVLVFCVLWAAVVDGVGFQGKGTMLKVSGLPTALGLYTFCYCGHAIFPTLCNSMKEK

SEQ ID NO: 175941 - protein, 139 aa, Triticum aestivum
  Clone ID: PAT_TA_70359.pep
PLPLSLRVRAHRRHSSRSPPLPCRLHRLGTMDHGRWESTPSLIHCLGWWRMGRVWAEGRHLQGKTAGVGAAESEDGLVVEGGSPAKTTGARRQCRHGGRPTGRSSRSNCSRWSARRTASSAAARTVKRGSCTVAGGEFG

SEQ ID NO: 175942 - protein, 118 aa, Triticum aestivum
  unsure (1)..(118): unsure at all Xaa locations
  Clone ID: PAT_TA_70360.pep
MGNCWGAKISSDTSSSSSPSGTNSKYATRNGAALSSSSSYASAASVPRSEGEILESANVKAFSFNELRTATRNFRPDSVLGEGGFGSVFKGWIDEKTXLTPTKPGTGMVIAVKKLNQE

SEQ ID NO: 175943 - protein, 151 aa, Triticum aestivum
  unsure (1)..(151): unsure at all Xaa locations
  Clone ID: PAT_TA_70361.pep
LSASLPKHLCEAPSPAXTITLEVESSDTIDNVKAKIXDKEDISLDQQRLIFAGKQLEDGXTFADYNIQKESTLHLVLRLRGGMQIFXKTLTGKTXTLEVESSDTIXXVKAXIQDKEGXPPDQXRLIFAGKXXXDGRPLXDYNXPXRXPXXV

SEQ ID NO: 175944 - protein, 92 aa, Triticum aestivum
  Clone ID: PAT_TA_70362.pep
RNRCSVNTYFVPCKRKTVALILCGYIVGCLAIYIKDPDKALTFGMGDPGPNNSFATGRRSTEPTRSGGKHPSANAPIIRPYRPLSCKKENKE

SEQ ID NO: 175945 - protein, 151 aa, Triticum aestivum
  Clone ID: PAT_TA_70363.pep
SLLAGGLAPLALKPSFLEQPLLPLHHRPRPKRGHTGAAPRYSIGSANRRCHPRSSTTLPHPCTNDHGTDPQLISISLFYDASHLIHVVIAAAADPWRDDLGGMFCMLALHTCYCSFNFHSFNLWNLEKHEIFICQISSFSCCKKIPLPMGE

SEQ ID NO: 175946 - protein, 75 aa, Triticum aestivum
  Clone ID: PAT_TA_70364.pep
MAPLPLLAAAVIAVVALGSVGAYAAAGQEQEAGGGNDLRQPPVARGLSFDFYRQSCPRAESIVRDFVRDAVSKDV

SEQ ID NO: 175947 - protein, 48 aa, Triticum aestivum
  Clone ID: PAT_TA_70365.pep
HLQCEGRRCLLDLMDENRLRKLADEYLSSQRGFEDFVSPLKAKSSKLS

SEQ ID NO: 175948 - protein, 95 aa, Triticum aestivum
  unsure (1)..(95): unsure at all Xaa locations
  Clone ID: PAT_TA_70366.pep
KGLXKGGAKRHRKVLRDNIQGITKPAIRRLARRGGVKRISGLIYEETRGVLKIFLENVIRDAXTYTEHARRKTVTAMDVVYALKRQGRTLYGFGG

SEQ ID NO: 175949 - protein, 129 aa, Triticum aestivum
  unsure (1)..(129): unsure at all Xaa locations
  Clone ID: PAT_TA_70367.pep
APAPPSPPXPLAPPPLPPSPSPPGLLPSRSPLSTLPIWRRPNPNAPXPAPAPTGGKEEWRGEAKPHPRLTSRPPPRPRPRLTSRPRSPSARTREPRRGRRSRRPSPLLLHALSSRLSSSSRSAEGGRGR

SEQ ID NO: 175950 - protein, 102 aa, Triticum aestivum
  unsure (1)..(102): unsure at all Xaa locations
  Clone ID: PAT_TA_70368.pep
ALDLIRDRNFSMLIDSCLEGQFSNEEGTDLMRLASRCLHYEPRERPNVRSLVLALASLXKDVESQSYDLXDXPXXGAFTLQSXXXSPLAEAXSXXDLTXXXX

SEQ ID NO: 175951 - protein, 106 aa, Triticum aestivum
  unsure (1)..(106): unsure at all Xaa locations
  Clone ID: PAT_TA_70369.pep
LKRCGGVPLAILTIASLLSSXMERAHTHEYWSKVHKSMGSGLDNSHDDVXXXXQILSVSYSDLPPHLKTCLLHLSVXPEDYEIXXXXLXWXWVGXGFVXXXXGXXS

SEQ ID NO: 175952 - protein, 158 aa, Triticum aestivum
  Clone ID: PAT_TA_70370.pep
PTRCITSPNPGTASYRRRPQILCIPSLTSLPRRGAQHQQETNASRHGRHRRPPRSGNHGGAVLPKSRYIRGGGDESREWRKGRKAQGGVGGLGMAAIRRSSYPGWRGEPGDGRDPALCGSKGDGETGVGTGDRIRGAAHRRKVGVAPSDPSGGRRWRG

SEQ ID NO: 175953 - protein, 267 aa, Triticum aestivum
  unsure (1)..(267): unsure at all Xaa locations
  Clone ID: PAT_TA_70371.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRXIXXGKQLEDGRTLADYNXQKXXPPXHLXLRLXGGMXXFXXTLTGXXIXXXXGXXXTIXQXXGXXSXXXXGXX

SEQ ID NO: 175954 - protein, 155 aa, Triticum aestivum
  Clone ID: PAT_TA_70372.pep
EGTLAAALLSHDPQPPPLLSPLPRLPTIQPKLRRPPIPPAPPLQPHLPSSPKEGKGSEGEGRPQIERSDAQIRSGTGTSAPSSTWSSRKAMDGGRTLAPHPSITAVAFSRWGGERSFLMWWPSTPATGCSTLASKVGHHNGNRRMSTMAGVQVQA

SEQ ID NO: 175955 - protein, 61 aa, Triticum aestivum
  unsure (1)..(61): unsure at all Xaa locations
  Clone ID: PAT_TA_70373.pep
GHKIPSSTNPGKKKNQYVSNGSISSSPNFNCTIEVSNLRMNLYTKLIEDQPQLLECXXARS

SEQ ID NO: 175956 - protein, 117 aa, Triticum aestivum
  Clone ID: PAT_TA_70374.pep
MPAPVCRCRPLAMAVLLLIASLCHLGSCNGGAGGGRITRLPGQPEVNFGQYSGYVEVDGKGSRALFYYFVEAELDPATKPLVLWLNGGPGCSSLGVGAFSENGPFRPSGQALVRNEY

SEQ ID NO: 175957 - protein, 135 aa, Triticum aestivum
  Clone ID: PAT_TA_70375.pep
MGMAATRLTDDLLVEILARVPAKSLARFKCVSKHWLGLTFDRSHRRRLPQTLSGFFYSSAGEECFLESPVHFTSVEGSRRPLVRTSSAFLPSHRRVDLLDCCNGLLLCRWYEVSARADEFRYVVCNPATEKWVVL

SEQ ID NO: 175958 - protein, 95 aa, Triticum aestivum
  unsure (1)..(95): unsure at all Xaa locations
  Clone ID: PAT_TA_70376.pep
NATTAVXQIKSPVRIIKVTFYLADPPAVSHFCVHGPDVDPGHFAVEPRVLFSEKDLVLLCFAFTSGSRSSVQDCNLXEYFIYKAGRCNPSLRSIP

SEQ ID NO: 175959 - protein, 281 aa, Triticum aestivum
  unsure (1)..(281): unsure at all Xaa locations
  Clone ID: PAT_TA_70377.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNXQKESTLHLVLRLRGGMQIFVKTLTGKTITLEVESSXDTXDNVXAKIQDKEGIPPDXQRLIFAGKQLEDXXTLXDYNIQKXEXTLHLVLRXXGXMQIFXKTLTXXITLEVEXXXXIXNXXAXSGQGXXSPDQQXXXFXXKXXXDG

SEQ ID NO: 175960 - protein, 129 aa, Triticum aestivum
  Clone ID: PAT_TA_70378.pep
KTKHAPQSAHEITAHVRSNPLRCIQQSTLHQTDLRFKTNVLPADSPVQDATQPHHATILHDQRRHHATNLTSASRPGGDRRRRGKAVVVVVVVVVWVGGGAGRRRGGRGCGLLQRRRRVTEEAAGGGRK

SEQ ID NO: 175961 - protein, 90 aa, Triticum aestivum
  Clone ID: PAT_TA_70379.pep
GRYMMGLWYRRGANMLLFELTRKIIYTIILTLILTYFPIKSDTGTITKNCCHEHVRPQVFLSMTKITRKYTSSINQIIFPSMLTLLAYIH

SEQ ID NO: 175962 - protein, 195 aa, Triticum aestivum
  Clone ID: PAT_TA_70380.pep
RHSPNVTVYESLVYSAWLRLPSDVESETRKMFIEQVMELVELNSLRDALVGLPGVNGLSTEQRKRLTIAVELVANPSIIFMDEPTSGLDARAAAIVMRTVRNTVDTGRTVVCTIHQPSIDIFEAFDELFLMKRGGEEIYVGPLGHQSCDLIQYFEGIERVSKIKPGYNPATWMLEVTSQAQEDILGVSFAEVYKN

SEQ ID NO: 175963 - protein, 186 aa, Triticum aestivum
  unsure (1)..(186): unsure at all Xaa locations
  Clone ID: PAT_TA_70381.pep
GCRXFGTRSRQXGVEELTRGEAAGNRFTVKRRALPSQSNGGDGGARLIRIALKGLVFQLLRHWVLTVVTEETKSMKQINEKCIINHLPGDLVERVFFGLPVSTLLTCVGVCKHWHNIIRDPQFVALHLQCAPSYALLFFPSGLVSGKHYPSDAVLIDEAWSPSTYIVPVIGPGDFLFGSCNGLLGL

SEQ ID NO: 175964 - protein, 188 aa, Triticum aestivum
  Clone ID: PAT_TA_70382.pep
EEEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHS

SEQ ID NO: 175965 - protein, 112 aa, Triticum aestivum
  Clone ID: PAT_TA_70383.pep
LYAKNSKGASHFTGANKPIPRISSAPGAEASFPAMAAALDSICRRDREVRLQMGEGLETASQVFMMIICMILPSSYRACRSAGRSSGKQQQRWQVEAVGSRSPYASARLREL

SEQ ID NO: 175966 - protein, 61 aa, Triticum aestivum
  unsure (1)..(61): unsure at all Xaa locations
  Clone ID: PAT_TA_70384.pep
LVLDQKLLEESLKXEAKRXKEEMDERKRKYNVXWNDEVTXXDMEAYRMTRVRHDDPMKDFL

SEQ ID NO: 175967 - protein, 47 aa, Triticum aestivum
  unsure (1)..(47): unsure at all Xaa locations
  Clone ID: PAT_TA_70385.pep
PFNSXTEPLISRLNPSHLINNKRPFSISIFITSLHQIIHLGEWVRTS

SEQ ID NO: 175968 - protein, 112 aa, Triticum aestivum
  unsure (1)..(112): unsure at all Xaa locations
  Clone ID: PAT_TA_70386.pep
MEKTALSVGKSVLNGAIRYATSALAEEVALQLGXRRDQVFITNELEMMQAFLESAHDEGDGNRVVKVWVKQVRDVAYDVEDTLQEFAVRLQKQSWWRIRRNLLDRRRVAMQM

SEQ ID NO: 175969 - protein, 52 aa, Triticum aestivum
  Clone ID: PAT_TA_70387.pep
RVYFLKHKIAEKIQVFPTSCSFGELREISVCRLHRLSFFQLLKYHLLMLHDM

SEQ ID NO: 175970 - protein, 90 aa, Triticum aestivum
  Clone ID: PAT_TA_70388.pep
MGATKVQEAKVHRAHVRTTLTKDGCVQRLEPLALRSAGAGWPIQGEMVARLKAAGLLPLARMMEGIPRDFLDRDLLSALVDRWNPRTHTF

SEQ ID NO: 175971 - protein, 153 aa, Triticum aestivum; identical to SEQ ID NO: 168119
  Clone ID: PAT_TA_70389.pep

SEQ ID NO: 175972 - protein, 87 aa, Triticum aestivum
  Clone ID: PAT_TA_70390.pep
RSPTPEFSVKGEEERSRREPSLGDGRSSIGTGAQRDRRRRPAAAPPQASSMTQRPAALMCRSTSAALSPQIGEGGVAFVYLDKVQDT

SEQ ID NO: 175973 - protein, 187 aa, Triticum aestivum
  Clone ID: PAT_TA_70391.pep
DVSSYFSMYGPVQDVRIPHQPKRMFGFVSFVYPETVRLVLAKGNPHFVCDARVLVKPYKEKGKVPDRFRHGGGGGPCLSPHHREFASVGNATPPAGLLDSRDPFDLQQPQIGQRMLYGSMAGHEAAFLRRRLEEQQEAAELQHAIELQGRRLMGLQFLDLKNRGHHLLGSPVGSPSDGNGGCFSGNG

SEQ ID NO: 175974 - protein, 206 aa, Triticum aestivum
  Clone ID: PAT_TA_70392.pep
KGTPNVPSNDNSGFTFQHVPPADRPKGTVSAVPLASNKDDKQTSASPFMFGAKPSNTSDLETSTTAGVKTKGRLGESVTKPASLDTPNLEQGNGREGAGDIHKSSDKVLPTAAPTLTPPLHFASAASTSPGLSNGLSHTSPPKLSNTTPTDKPAVSTAPLTTIAGFSVSSNSPPVSSSVPAFPTINFGSSTPTVAAPKPETTSTET

SEQ ID NO: 175975 - protein, 166 aa, Triticum aestivum
  Clone ID: PAT_TA_70393.pep
MDMDGPDDWVWVRRPAEEESWRPWTAEEEEERPLKVTFSSPAEYFTDAAPIGNGSLGAMVWGGVSSDKLQLNHDTVWTGVPGNYTDPKAPGVLAEVRGLVDQGRFADATASAKGLFGGQSEVYQPLGDLNIEFSTSDEVYDSYKRELDLHTATALVTYVVGGVQYT

SEQ ID NO: 175976 - protein, 233 aa, Triticum aestivum
  Clone ID: PAT_TA_70394.pep
NLSTAVSLEVLGIIDKFSVAAASRSISTDYAKLDCVTSILMGLLSRSQPLTFWKAFLPVVYNIFSLHGATLMARENDRFLKQIAFHLLRLAVFRNDSVRKRAVVGLQILVRNSFNYFKSTTRLRVMLTITLSELLSDVQVTQMKSDGSLEESGEARRLRKSLEEMADVRSKDQLNDCGLPVTALEVAAEGSTDNRWSWVEVKHLSKCLVQALDAGLEHALLGSVMSVDRCAAA

SEQ ID NO: 175977 - protein, 126 aa, Triticum aestivum
  Clone ID: PAT_TA_70395.pep
RLRQRRQQCVPASVSNGSIISDSEYLTKTLPRSHVKDFLLDDAAPLAVVVVSSNKSYQVSSIALQILPLLLGKQIQLESISRIRLVPLYASVVWHAKSISCIAHCCSSATLTSNHPLLPIILSSQI

SEQ ID NO: 175978 - protein, 69 aa, Triticum aestivum
  Clone ID: PAT_TA_70396.pep
LATDGRLPFPGCCLLIFHSITVMQKSALMVALFVKCISLVASLPFNGISCSVLEVFMNQHIVIYFYLVT

SEQ ID NO: 175979 - protein, 217 aa, Triticum aestivum
  Clone ID: PAT_TA_70397.pep
PSASASASAAATSPPPRRTPSPPPHSSAPPLSICPSSSGRRRRWRTWSPCVPSPPRLPVRRRPRLPQTPSWAPTTTTRRSCPISPSSSSSRRRRRTPSPCAPSPPPLPPPGRRRHRLLPRNLAGSRGCASGRSGSGAPRSAPRHPAPTYRRQWSHSHSQPNRQRRSKQSSSPMRMRIPSTGRCKWWAPSPTPPPQPGAAAAAMRMPSRTCSRSPAVA

SEQ ID NO: 175980 - protein, 187 aa, Triticum aestivum
  Clone ID: PAT_TA_70398.pep
MPPRRRDRRSHRDPSPSPSRPSGPRASPSSPRLRLAFIVPPLLLLVLTVLHFTGLLSRSPPYPQTPGKTPLSVYDRGLVKRQVSAGEILAEHARVSENRSRRHFPNPVLAYVTPWNSKGYDMAKLFSMKLTHVSPVWYDLKSDRNKLSLEGQHNYDAGWVSELQNSGSLVVPRVVLEAFPGVVLLKK

SEQ ID NO: 175981 - protein, 217 aa, Triticum aestivum
  Clone ID: PAT_TA_70399.pep
VASSTSSDMIKSLDVKAAKQAKRSDHSPQFPAILQMNDVPFIGSGDLHTTGFTVTNGYPNDPRYTSQFLRMPYLSSPSSVSSESLESFRDANELLKQEVQKLKEEVNSLRQQRELQDAELKKSEAKASEAAALAAEEASKSKAAKEVIKSLTAQVKEMAERLPAGDSDVKPPRVPYLPAGGVVSPEMGREGQKRYEPVSIHYSQTPTSVTSSWSNGL

SEQ ID NO: 175982 - protein, 123 aa, Triticum aestivum
  Clone ID: PAT_TA_70400.pep
GRFDGDQRMSARMVVGGLDRRQFRCPHRRHQQAYVLHVSRAAGGCRRGAAIDRRGCDGSSTVDMDCRRIRIPLSLFKVRGPPLFILTRMDPTGVMPFFSLHAAASPSSYTMSNSSFFLPPYSY

SEQ ID NO: 175983 - protein, 210 aa, Triticum aestivum
  unsure (1)..(210): unsure at all Xaa locations
  Clone ID: PAT_TA_70401.pep
GGCPPNIVTYNVLIGXLCDATEFEEVRQVLMESRTEGXTPNTVTYNTFMDGLCKKGRANEALEQWDVMAGQGLEPTDFTFSILLNCLCHALRIAYAIHLLEWSASLERYAGAVAYXLMSRLCEMGRWKRVLKLLTDMIKRGVTPNTRAFNIAIRALCSGGKLSIARGVVRNPGVSANVVTYNTLIYYWFHYCRDLHEVWRLISDMAAEKI

SEQ ID NO: 175984 - protein, 143 aa, Triticum aestivum
  unsure (1)..(143): unsure at all Xaa locations
  Clone ID: PAT_TA_70402.pep
MEGGSQLGACLPSLYALDPYASPPLLAPLPNQHKLHQLPLVLQEQPGNHGVMFSSDHGGGLYPLLPGIPFCHSAAACEKSTGFAPLGGTGEAGTSAARAGNEFASATTTTTASCHGPSSWWKGAEKGKMKVRRKMREXPRFCF

SEQ ID NO: 175985 - protein, 200 aa, Triticum aestivum
  Clone ID: PAT_TA_70403.pep
MHVRGRTMGLGVFGFRGVKGEEFMTMFSNMVRRVVSEEVEKAMFRQFSAAAAAAAPPRLLVGQSQRPRYQLTFLNDLKPVYTMMKLEAKDGSALKVAMVENLENDQKNVVRFGHLSSVRVEVVVLHGNFNAKKEECWTPEEFSKHIVWGREKSAKLLNGDLTLKLSGGEAFLGSANFTDNSSFTSTKKFRLGLRLVNASG

SEQ ID NO: 175986 - protein, 191 aa, Triticum aestivum
  Clone ID: PAT_TA_70404.pep
MAAKETERRSFGDLPEELIPEILACVPPKHLLRFRAACKAWCDLAADPAFIRKHHSRQPAQPLLLAYDEHCLEAVNLSTNRRRAVMRVTVSGRVPSIGSDVLALHGSCDGLLLLGFRETFLVCNPATRQGAHLRLLFRDGPEFLGFYKHAASGEYRVLYHLVEGLDGEYSYYVLSLGSQQAIRDIELLTSS

SEQ ID NO: 175987 - protein, 111 aa, Triticum aestivum
  Clone ID: PAT_TA_70405.pep
EYFKNLIREEARSFAYMRTVMIQLAHQLIVALEMKKSKLSTSRCYRCYLSTSPIFLTHSLSPSAPVQTHKFPSTYPSHFVSSPVTTVRLLRRPAGLYRDAAYCPACESYHA

SEQ ID NO: 175988 - protein, 74 aa, Triticum aestivum
  unsure (1)..(74): unsure at all Xaa locations
  Clone ID: PAT_TA_70406.pep
ERKDTXTYNISXSVLEVXNEQIRDLLXTSPSSKKLEIKQAGEGSHHVPGIXXAKVEDINEVWDVLQTGSNSRAV

SEQ ID NO: 175989 - protein, 284 aa, Triticum aestivum
  unsure (1)..(284): unsure at all Xaa locations
  Clone ID: PAT_TA_70407.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKQLEDGRTLADYNIQKESTLHLVLRLRGGMQIFVKTLTGKTITLEVESSDTIDNVKAKIQDKEGIPPDQQRLIFAGKQLEDGRTLADYNIQKXESTXHLVLRLRGGMQIFVKTLTGKTITLXEVESXDTIDNVKGQIQDKXGIXPPDQQRLIFXAGKQLEDGRTLADYTXKKESXXXLVL

SEQ ID NO: 175990 - protein, 153 aa, Triticum aestivum
  Clone ID: PAT_TA_70408.pep
MDVATGAIGSLLPKLDELLNEKYKLQVSIREDIVSLSREMKSMYAALGKVAEVPRDQLDEQVKLVKLWAGEVRQLSYITEVILDKLLMGVPDSQGSTGPMEKKCSWFKKRKLRDEIADTIKDIRVRIQKAADRCDRYRVHDIVNNYRAPVAID

SEQ ID NO: 175991 - protein, 99 aa, Triticum aestivum
  Clone ID: PAT_TA_70409.pep
ARRLSIAPTRAYQILCLYTTNSLLLCLKFIHPRHASGSTRATHASVRLCKDSNRILGETPRIRRRGHGTPEICKDCLEFVWTDFGMQRVERGLGGGAAA

SEQ ID NO: 175992 - protein, 131 aa, Triticum aestivum
  unsure (1)..(131): unsure at all Xaa locations
  Clone ID: PAT_TA_70410.pep
FGTREMRRATXNFSTTLGGNDNATIFKGQLSNGSVVAIKRIESSPKQDLLAFCKEMEFLGRLHHRHLVGLKGYCLTKFERFQVYEYMENGSLKDHLHCNTSRLMFHSHSMSYATSFVELCAEKHSSLCSVR

SEQ ID NO: 175993 - protein, 218 aa, Triticum aestivum
  unsure (1)..(218): unsure at all Xaa locations
  Clone ID: PAT_TA_70411.pep
QIGADXRKFSYRTRIRVHSKMKGKMQKCQLEAGIDIVVSTPRRLINMVRTTQVSLEAIKYLVICELGLMLDMGFEKTLRKIVDDMHIPPKSARHTLLSSGTFQPAVQKLAWDFLSDYLFITDGRLEFSIGLTKQKIELASEEEKRGLLLNLLQKQSVSSAGMSQLRTVVFVETKGKADSLKNWLCNEGFPATVIFADSSQQERESASLPFQISGISIL

SEQ ID NO: 175994 - protein, 189 aa, Triticum aestivum
  unsure (1)..(189): unsure at all Xaa locations
  Clone ID: PAT_TA_70412.pep
VFSCALLLVTVVSPLANASSKAIHQVYIVYLGEKHDDPSMVTASHHDLLTSVLGSKAEALKSIVYSYKHGFSGFAAMLTESQAETLAEFPQVINVNPNTYHQVHTTXRSWDFLGLDYKNNHQQQPSLLRRAKYGEDVIIGVIDTGIWPESPSFEDNGYGSIPERWRGTCQTGQSFDNTKCNRKIIGARW

SEQ ID NO: 175995 - protein, 163 aa, Triticum aestivum
  Clone ID: PAT_TA_70413.pep
AAHLFHDPVARRFATAAPRDAGHLSPISIFSHPTRQERGGGRPPFLSPSPPSASPVSVSSPAPPTRPHASRRSPGRRQPPQQSSVPVWARGAGCFRCLTRRSPTRSSTAVSAPRCRRKGIEAERFTVEGISVSRHETCVTAPAPYCSSVWIDKLSSTHGTIIK

SEQ ID NO: 175996 - protein, 223 aa, Triticum aestivum
  unsure (1)..(223): unsure at all Xaa locations
  Clone ID: PAT_TA_70414.pep
XGGKGYNPEDVHHLLVENYDAELITKMIHGMGNLRTLLIYDDRKDILVEEKFIGNLCMRLPKLREFAVTYTGGRTGEPNKFFFPEAISMLKHLRDFVFWIEGPCTVVFPVALTKLHHLRLLNLGASEKVEFTSLDLLNLQHIIWKCMNFPNVGKLTSLQTLSYFIVRNEKGYEVNQLRDLNKLRGKLNISGLENVKSKEEALEANLTAKEGIATLVLEWDGDD

SEQ ID NO: 175997 - protein, 179 aa, Triticum aestivum
  Clone ID: PAT_TA_70415.pep
STKGGDRQADSGTSTLPESSPSFPLRPTGQLYGQRLLSVWSRARHTLKAVPRTLKARPHTLKPASEGHDGLLWWYNLVPCNAGELSMAYVQANRLMEDHCRVDSSPTLGTFVGIFDGHGGAEAARFTAEHLFPNIQSEATSSWQGVTEETIRKAFLDTDESFIAHVEKQWLVKPQLAAV

SEQ ID NO: 175998 - protein, 34 aa, Triticum aestivum
  unsure (1)..(34): unsure at all Xaa locations
  Clone ID: PAT_TA_70416.pep
TRAYPLGSSQPLGKRTLLSATXAIXRFRSXPHRL

SEQ ID NO: 175999 - protein, 77 aa, Triticum aestivum
  unsure (1)..(77): unsure at all Xaa locations
  Clone ID: PAT_TA_70417.pep
GSSLRDLDCTHSNYQTLNAPGIVIYCHYLPVSGLGNLRACCLXLDVVAVSQAPSPESNPNSPSPVTTMVGPYPTIES

SEQ ID NO: 176000 - protein, 175 aa, Triticum aestivum
  Clone ID: PAT_TA_70418.pep
MAAVKLEEVRRAQRAVGLATVLAIGTAVPANCVYQATYPDYYFRVTKSEHLPDLKEKFERMCEKSTIRKRHMHLTEEILTKNPSICSHMEPSLDTRHDIVVVEVPKLRKEAAERAIKEWGQPQSKITHVVFCTTSGVDMPGADYQLTRLLGLSPTVKRLMMYQQGCFGGATVLRM

SEQ ID NO: 176001 - protein, 34 aa, Triticum aestivum
  unsure (1)..(34): unsure at all Xaa locations
  Clone ID: PAT_TA_70419.pep
YQFDYREHXYVEYYTIADASXRPRXKIRGMVLHS

SEQ ID NO: 176002 - protein, 129 aa, Triticum aestivum
  Clone ID: PAT_TA_70420.pep
WRMVLHGTPQQAAQCTPEVADLQKGFMGGGDPRSSLHGIAGFDVESAAHDIDVSGKINYSNPSSLVTSLSNSREGSPERFSLPSLYAKHPNAVSVASMSPWMAMPAPAAAHVLRGPNSSMPVFAAWTDA

SEQ ID NO: 176003 - protein, 54 aa, Triticum aestivum
  unsure (1)..(54): unsure at all Xaa locations
  Clone ID: PAT_TA_70421.pep
YTCTGAKREKCPKDSSAENTLCXFPSLXPTTPXTLXIXRRTTTGGHSDAFLEVD

SEQ ID NO: 176004 - protein, 52 aa, Triticum aestivum
  unsure (1)..(52): unsure at all Xaa locations
  Clone ID: PAT_TA_70422.pep
AAXGHXXXFHPXXCXSSFLALVCSSMFVXFVPLSCHMXAQDACXPMXXGVAF

SEQ ID NO: 176005 - protein, 143 aa, Triticum aestivum
  Clone ID: PAT_TA_70423.pep
MHNFHFANSTMFVTSSAERLDPREPNWKMLPAMSTVRGCHTVAVLDEKIYVMGGYDADAGAMASTVELYEPRMPSWVMVEPMNYTRGYHSSAVLGGSIFTLGGVKGEADTILDVVERYKEGCGWVNTGMKSIGSRCYCSAIVL

SEQ ID NO: 176006 - protein, 41 aa, Triticum aestivum
  unsure (1)..(41): unsure at all Xaa locations
  Clone ID: PAT_TA_70424.pep
GSGXEIXVXFGVDSASPSSXDVDXLAGSRCSXWLVTCXVCH

SEQ ID NO: 176007 - protein, 69 aa, Triticum aestivum
  Clone ID: PAT_TA_70425.pep
SEGCISLVAMCLEVIISCLARILENDCLDLKFTQDFVGSICIGTVYWLIISPQVVHHGLPGMHIDIPRL

SEQ ID NO: 176008 - protein, 37 aa, Triticum aestivum
  unsure (1)..(37): unsure at all Xaa locations
  Clone ID: PAT_TA_70426.pep
SITYIFGTTLFSLSYYLQIGAICLIASTVHVHMLQPX

SEQ ID NO: 176009 - protein, 97 aa, Triticum aestivum
  Clone ID: PAT_TA_70427.pep
DTKHSDRTRHEKSPERSRGDRQRGDDRGREERSDIKDRDRNGYEKSPERPRGDKQRGDDRGREDRSESKRSRHDRDSGGRYERRGNEEGKNGTGNQR

SEQ ID NO: 176010 - protein, 35 aa, Triticum aestivum
  Clone ID: PAT_TA_70428.pep
FPVNILYDSVIYHAIVSLEKAHLQLSVGTLCYFSC

SEQ ID NO: 176011 - protein, 68 aa, Triticum aestivum
  unsure (1)..(68): unsure at all Xaa locations
  Clone ID: PAT_TA_70429.pep
LNFXVILFRFXRXGGRCRVVCMCXCCSIGGCACPLDRGLRLLARLHLGLVLLQLLLLFLSLFLEIICM

SEQ ID NO: 176012 - protein, 81 aa, Triticum aestivum
  Clone ID: PAT_TA_70430.pep
CPSPSLFIVMCSSLRRFEHDYLRIELFIDWLQHVAVVVAAAPLVTVYVGSRKESPWPSLTWGGVEVKRREQNGVARGGRCL

SEQ ID NO: 176013 - protein, 86 aa, Triticum aestivum
  Clone ID: PAT_TA_70431.pep
QVIWNGGSTNLEVQFCVFFHWAFFNLFMNLHMLTHKQRNILWRKQRVYTNEFMLLSVFRWELSCVFVLMHLYSFSCLCPSCRRWRH

SEQ ID NO: 176014 - protein, 110 aa, Triticum aestivum
  Clone ID: PAT_TA_70432.pep
SEVCIQPHQGSSIRKSNSQFDGKIILKKIRHWCTQQEKHGHEGGILSCGLANKEFTGFKRLYVLKPKKRLFLQHVLVLVHCSLYIFKGFFRASPFSIAIVRKHALLHQTV

SEQ ID NO: 176015 - protein, 84 aa, Triticum aestivum
  unsure (1)..(84): unsure at all Xaa locations
  Clone ID: PAT_TA_70433.pep
IFTPDXXRNXXYNMATHLATSAEAHSTLLVRXSSTXTCXFFILXPYGXHAQXIXXPIADLXCTLXIYEARVXFSAXTATFCTLP

SEQ ID NO: 176016 - protein, 144 aa, Triticum aestivum
  Clone ID: PAT_TA_70434.pep
GPPIPFPVMPPSIWPLVSPWPNGAWSAPWLGPAYNMSAAPPTSSSTCSDSGSPVLGKHPRDSEPQGGEKAERSLWIPKTLRIDDPDEAAKSSIWTTLGIEPGERGMFRAFQPKSGGREQMSNAARVMQANPAAQSRFASFQETT

SEQ ID NO: 176017 - protein, 177 aa, Triticum aestivum
  Clone ID: PAT_TA_70435.pep
MNHTRSIHDTDSKRTEHKWRKDLMLIGTLAVTVTYQAGLLPPGGVWPDDRDGHFAGDPILHDTNLTRYKVFFYCNATAFMASMVMVILLLNNTISKYKRSLFAMKIAMVLDLLGLLGAYAAGSCRKLKTSAYIFALVIAVIIYIVIHVVLSFDEVARLVKEKWKKWVRCLERCFCCN

SEQ ID NO: 176018 - protein, 53 aa, Triticum aestivum
  unsure (1)..(53): unsure at all Xaa locations
  Clone ID: PAT_TA_70436.pep
HCRHRDNIAGFHHCFVGFVXHKQKAHVGIDLGFLCCRLGPSXPAGVLSLRMIX

SEQ ID NO: 176019 - protein, 119 aa, Triticum aestivum
  Clone ID: PAT_TA_70437.pep
WQRPPRTQELGFLVNQACLGLRFEGAVSGEDITAIPQVVKHPPPGECSPRLGPHLRPAARQGGAGDATTNSSSSMEGQQEGAGGANDGPPLGPGPQRAAHQEGVGDAVAASSRSSWLFL

SEQ ID NO: 176020 - protein, 162 aa, Triticum aestivum
  Clone ID: PAT_TA_70438.pep
MYCDSVDSLCWDEIVRMTTKWSPDPMCCIANGINKPCANNTISSELTGRFPQEVMFVLFKCCFSASDHCSRSSSNEAYINTIRAWPPLKLSVGFAPHISPNLPDESSLHQIEEGIRREAIDYFIQHPELTDYEMDWNSAHGWASFRVSKPITETRRGLKRRR

SEQ ID NO: 176021 - protein, 68 aa, Triticum aestivum
  Clone ID: PAT_TA_70439.pep
YVVLNTQGARVLLQNTLRTAHCTFAFPNCSEVKRIAGSQIKKQTAIYVHRNRIKKPDQLTSHGISQLV

SEQ ID NO: 176022 - protein, 145 aa, Triticum aestivum; identical to SEQ ID NO: 131257
  Clone ID: PAT_TA_70440.pep

SEQ ID NO: 176023 - protein, 52 aa, Triticum aestivum
  unsure (1)..(52): unsure at all Xaa locations
  Clone ID: PAT_TA_70441.pep
LSMXCFLSXHVSMSXXAFALLVXLXDMXLCLFFXFAXPLVHLXCVVCVVSFX

SEQ ID NO: 176024 - protein, 77 aa, Triticum aestivum
  Clone ID: PAT_TA_70442.pep
CCNPESKFCDNRVVYFQCCLLFTAGLSSVESVMLCQYLLQELSFSVTRVVNLRCRSCQLQPFSLCQACDLRCIRLVT

SEQ ID NO: 176025 - protein, 116 aa, Triticum aestivum
  Clone ID: PAT_TA_70443.pep
EVYHKLKGRFHCGAFVPVSQKPNIPKLLHSLLTQHGRGQSFHDCELNVLLDQLRENLKKRVFCQDGYSTVATCSGLEGATAIRTRTCGSDGGENGGGRSGGGQHGQAREEEGSDMI

SEQ ID NO: 176026 - protein, 49 aa, Triticum aestivum
  unsure (1)..(49): unsure at all Xaa locations
  Clone ID: PAT_TA_70444.pep
FFVSLKKKXSXQRISVCVRVCSCACVCXXGCVCPGCAXCVLRCMMCRVF

SEQ ID NO: 176027 - protein, 130 aa, Triticum aestivum
  Clone ID: PAT_TA_70445.pep
VEVQPCEGLPPCYTSSGRWCSSSRTSSALEHHLWPDPTGKKPAHLPSSMPRTTAWLRLPMVTCVHHQPEGMRPCAMYRRQWTTPLGGAATPVAAGPEAGDAGSEAGAMRGAMPARVHCIHTPIGLHGGGG

SEQ ID NO: 176028 - protein, 102 aa, Triticum aestivum
  Clone ID: PAT_TA_70446.pep
SGTYDDEITNHTEGLPRRLHRQRRNRSRCFQGLLLDLSATPITAGNLLCALLPWKTLPLSARDQNLDPAGMLLGFFPHDVNHRAHTRAALCCSFIPFLVASE

SEQ ID NO: 176029 - protein, 110 aa, Triticum aestivum
  unsure (1)..(110): unsure at all Xaa locations
  Clone ID: PAT_TA_70447.pep
MSKRFSMVHSIKMPMPSSNGNGGGKPADFDHARWLFETKGTYSNGNGAFFSFWVLCHLYPFAKGLLGRRXRVPTIVFVWSGLICMIVSLLWVYISPPAGARPGIGGFSFP

SEQ ID NO: 176030 - protein, 55 aa, Triticum aestivum
  unsure (1)..(55): unsure at all Xaa locations
  Clone ID: PAT_TA_70448.pep
LDMLHDGLXCNGXRXKRVELDFXXXXVXXXQDXSRPMGFDHIIDSIPLNXXASTX

SEQ ID NO: 176031 - protein, 115 aa, Triticum aestivum
  Clone ID: PAT_TA_70449.pep
EWDGDTPDNVLHVYDLVEVLDDYDEDHGISVIPLVKVTGFRTVFQRHQNRNVIKRIPKEEMFRFSHQVPFYRLSGEEAPNVPKDSYEVDPAAIPKELLQGITETAEEAEGTSKSS

SEQ ID NO: 176032 - protein, 46 aa, Triticum aestivum
  Clone ID: PAT_TA_70450.pep
SNTKSTGASPKSKLLCPRQSTVKLTPDQRRSDLHCPKTIQKSCVHM

SEQ ID NO: 176033 - protein, 103 aa, Triticum aestivum
  unsure (1)..(103): unsure at all Xaa locations
  Clone ID: PAT_TA_70451.pep
PSIVXKRPISRLCNPEMSPRFPASSKRPNVPLLSTDQPHLNKFSMNLLIIPCTSSRRLSAHDGTLGQIWQEQTLPVHINTIFGWKKVAEFTGSSLPAFSGRPQ

SEQ ID NO: 176034 - protein, 103 aa, Triticum aestivum
  Clone ID: PAT_TA_70452.pep
FSSQIKHLFVQGESHQTPICARTRLAGKRLPASASWQPPVLSRFRSPCPDLESERVHRLLRLSSTQREGALSTRRSHALLLLLPTPLSSLAPHLKVPVMACSS

SEQ ID NO: 176035 - protein, 140 aa, Triticum aestivum
  unsure (1)..(140): unsure at all Xaa locations
  Clone ID: PAT_TA_70453.pep
DEMEGSVDEDCNRSDEEYDDLAMRDSMENGYXSDDGIMVHTGLSKCLSNRFPDGSQHNNRGTPRKLRSLSKVDTTTHVPDTARSCAAAAAATPGGNRSTGXKWRRSLSDKISSRXRXCPSLAEVAAKPKGSAAVPVVPQS

SEQ ID NO: 176036 - protein, 100 aa, Triticum aestivum
  unsure (1)..(100): unsure at all Xaa locations
  Clone ID: PAT_TA_70454.pep
DMPPXXLPQVQQDEVHGTQIDPGLVLYPLQPVKGNLLNFNAKVKQVNKETVIKVIIIQIATQLQSSEPFSWMCDQGWWSVVSRGGACMPPIHCWASVSFS

SEQ ID NO: 176037 - protein, 92 aa, Triticum aestivum
  unsure (1)..(92): unsure at all Xaa locations
  Clone ID: PAT_TA_70455.pep
SGSPLIPLSEFSHPXLQKKYGVKPDAETLDMLNTIAKQKEVSVVSKVLFGDPREKLCQAIHDMPISSLVIGSRGLGKLKRLRPPAKRPPSCS

SEQ ID NO: 176038 - protein, 162 aa, Triticum aestivum
  unsure (1)..(162): unsure at all Xaa locations
  Clone ID: PAT_TA_70456.pep
RALSQKXQDIQMMLAADVHLGTKNCDFQMERYAYKRRSDGIYIINLGKTWEKLQLAARVIVAIENPQDIIVQSARPYGQRAVLKFAQHTGANAIAGRHTPGTFTNQMQTSFSEPRLLILTDPRTDHQPIKESALGNIPTIAFCDTDSPMRYAAVQPPAQGWE

SEQ ID NO: 176039 - protein, 42 aa, Triticum aestivum
  unsure (1)..(42): unsure at all Xaa locations
  Clone ID: PAT_TA_70457.pep
RALQTSXXXIQDXIXVHXKWIXATXARLWGRRLLFRGGRLXL

SEQ ID NO: 176040 - protein, 34 aa, Triticum aestivum
  unsure (1)..(34): unsure at all Xaa locations
  Clone ID: PAT_TA_70458.pep
XPASLAAQVSNQPVILLVSPTAATATSTTIHTHT

SEQ ID NO: 176041 - protein, 209 aa, Triticum aestivum
  Clone ID: PAT_TA_70459.pep
GPHLIIVPNAVLVNWKSELLNWLPSASCIFYVGAKDQRQKLFSQEVLAVKFNVLVTTYEFVMFDRSKLSRIDWKYIIIDEAQRMKDRESVLARDLDRYRCQRRLLLTGTPLQNDLKELWSLLNLLLPEVFDNRKAFQDWFSKPFQRDAPTPNEEDDWLETEKKVIIIHRLHQILEPFMLRRRVEDVEGSLPRKDSIVLRCKMSAIQGAI

SEQ ID NO: 176042 - protein, 209 aa, Triticum aestivum
  unsure (1)..(209): unsure at all Xaa locations
  Clone ID: PAT_TA_70460.pep
XAAAKIVIHDXNEGKVXYFTLPPKRDVVEDANAVIITEDGSEFNVDEIYKAESSYISGLKSMEEFSHIEIPSNAPPEIDEAMLEDPLTQSAPVKDESMSDANDREGSKAAASGGTQHDKLYTAEGILDPRKKKAEKKRRKGNKFSVLNDMDADYDFKVDYQMKDASPADDEDGDGSKAEGEEPKGEDDKKDAPAAECEPMTSAGFGGAN

SEQ ID NO: 176043 - protein, 111 aa, Triticum aestivum
  Clone ID: PAT_TA_70461.pep
MREVHISTLNSCQMVPNGTRILPKKIQTCCGFLWGVGRQYMCSAGKTIVICVHIGSYLSVAVFFSRQQIFFRGQYCNICAPIAIFSICFSSVGNILRGRGQVIYVSEQATP

SEQ ID NO: 176044 - protein, 95 aa, Triticum aestivum
  Clone ID: PAT_TA_70462.pep
PPPRGVPYVHARVYMFLGEWLLMHLHMGAHACVMCGVNFAVPLPPSPVMDNSTMRYAKLRKASRYFSQCFYEKFWLILIPDLVVSFFEMHICIAK

SEQ ID NO: 176045 - protein, 53 aa, Triticum aestivum
  Clone ID: PAT_TA_70463.pep
HRGKLHSYSLLIRIGRREKAGRLVASAEKIRHQRSRSRDHQVLELQLPSRASP

SEQ ID NO: 176046 - protein, 202 aa, Triticum aestivum
  Clone ID: PAT_TA_70464.pep
SLDFMDSWSPLPSSLQKLCIYGKMHSATVPKWISPGLTSLSHVTIGLDELREEDLHTLGELPSLLDLHMYLATGPKKKLTVTGFPCLRRFGLLSLDGAYITFQKGTMPKLEKLEQSFDVSVAKAYGFYLGIEHLPCLKVIQVTLCNEGATLSESKAAAAWIRNEAGGHPNHPIFLGVQAFLHDEDNVETGNVEEKSKEEGSY

SEQ ID NO: 176047 - protein, 95 aa, Triticum aestivum
  Clone ID: PAT_TA_70465.pep
EDEYLAELSYHLGAAQQPVHGSSQAGSYLNRRVRVREQMRSVPAVAQVFRAQPWVNQGGTSTAALRVLVFLDGAILFVGVLILLALVKVVFLLSR

SEQ ID NO: 176048 - protein, 165 aa, Triticum aestivum
  unsure (1)..(165): unsure at all Xaa locations
  Clone ID: PAT_TA_70466.pep
SEPGKVXISKAEFESLSRKVKESEKLSEMKVAAAMAQVEAVRASENEAIQKMKTARREMEDMELATEEALKRAETAEAAKKAVEGELKRWREKEQKKAAESVSSAEAQAHATTLSSVHKAPAGKPTEKNDGHQRNNRTLLRKGFVLPNITGMFHKKKGHADGSSP

SEQ ID NO: 176049 - protein, 155 aa, Triticum aestivum
  Clone ID: PAT_TA_70467.pep
ERERERERDCFARLRRRRRRRRRPGGRTPYHIATGYCEVSFERSLRTCPMFSNLTSLVLGEWCMAADFYPLLRILQRSCKLKELKLKLTKEEFSTCKDSEPALSSTRGALPSGSGSHPCIERVKICCHEHDPRVSSLVQALQLIVGDVKISIEHR

SEQ ID NO: 176050 - protein, 205 aa, Triticum aestivum
  Clone ID: PAT_TA_70468.pep
MEGEAKEIKSEEVKKIKSEEPGQAGVSDNPIVSQDSEQSIKKVYVGGIPYYSSEDDIRSFFEGCGSITALDCMTFPDTGKFRGIAILTFKTDAAAKRALALDGADMGGFLLKVQPYKANREKVKSNHEKEDFAPKMIEGYNRTYVGNLAWDVTEDDLRKFFSDCKISSIRFGTDKETGEFKGFAHVDFSDSTSLAIGLKLDQNVI

SEQ ID NO: 176051 - protein, 85 aa, Triticum aestivum
  Clone ID: PAT_TA_70469.pep
KSAKMSHTTRQLDLDTKSHLSHLRPLHLTFDKVTPKHTQRMTKPCPATPIDMEEGTPKHFWPESSDNLVIVINSLIFSRYNLYKY

SEQ ID NO: 176052 - protein, 114 aa, Triticum aestivum
  Clone ID: PAT_TA_70470.pep
PFHVLSYSVDSNKLVHLGGKREVDGWHTIRFAGGKSSPTKFELTLFWSSNGTHASAKETKAENFSPLVKLRTDVNRVTPMVETVLEKLPRWSTPFGKSTSPYTLAFLTALPINI

SEQ ID NO: 176053 - protein, 204 aa, Triticum aestivum
  Clone ID: PAT_TA_70471.pep
VGVNNHFQSVTLAGVLVRDETEDSFVWVFSEFLRMMGGSPPVTILTDQNRAMELAIKNVMPNTTDRWCKWHILKKAKETLGSLYTKKSEFRAEFYKVIKHMLSEDEFEKGWEMLLDKYKLRSHPYMTNLFEIRKKWAKPYFKGVFCAKMTSTQRSESANHMLNGPDFARFVVGKVTRTVVGSQLDARTVASKVIDETIFIKQWQ

SEQ ID NO: 176054 - protein, 115 aa, Triticum aestivum
  Clone ID: PAT_TA_70472.pep
LYFIVIAAADTATMGTCNFYFARHQRPPPRSISSQPCRHGGQGRLQPVRTCVLLLSSLRRDEAVGGEGHAHDGSAQAPQAAHLQGTAAININVAMLEDGTEMFMPLKAICMKHYY

SEQ ID NO: 176055 - protein, 136 aa, Triticum aestivum
  Clone ID: PAT_TA_70473.pep
MVSSTPAFFLIPSAEDYDVCSPSCSFAAPLTSYSGSILSGRPVTGGGLLIGGVPPSPAELQPVAMAAAIPNRRVVAVTGGQAPAREGKTAIHCTWTDGVRWMGRPRPSSSRAAGGGGRSWFGGGGRWTAGGGGAPR

SEQ ID NO: 176056 - protein, 74 aa, Triticum aestivum
  Clone ID: PAT_TA_70474.pep
HKMRRKLDNEMAKHDEVVRHVHFAASATLPVGFVPALEQIVGFFHGNLQVYARIRTNGAGAHGAPTEVRRPHLG

SEQ ID NO: 176057 - protein, 54 aa, Triticum aestivum
  Clone ID: PAT_TA_70475.pep
SRVFSFYIVLLLVMLLTPTHSLSRRQPLYISLLRALFLCYGCTSRYYNLFVQLI

SEQ ID NO: 176058 - protein, 41 aa, Triticum aestivum
  unsure (1)..(41): unsure at all Xaa locations
  Clone ID: PAT_TA_70476.pep
XPHYNQXXTPEFVIXILQFLVPXXXLGLAVXXRIYXKAESV

SEQ ID NO: 176059 - protein, 199 aa, Triticum aestivum
  Clone ID: PAT_TA_70477.pep
VLITRNTTIPTKKEQVFSTYSDNQPGVLIQVFEGERTRTRDNNLLGKFELSGIPPAPRGVPQITVCFDIDANGILNVSAEDKTTGQKNKITITNDKGRLSKDDIEKMVQDAEKYKSEDEEHKKKVDAKNSLENYAYNMRNTIQDEKIASKLPADDKKKIEDAVDAAIQWLDANQLGEVDEFEDAPAASGGAGPKIEEVD

SEQ ID NO: 176060 - protein, 97 aa, Triticum aestivum
  Clone ID: PAT_TA_70478.pep
MPNVEQELLASERKNKRGRSTTSRDKAPYEKDSAKRSRFCSICRGKGHKASTCPDRGDIPKKERKVATCGKCGVPGHRRTTCSKPLVSMMPGVPPSH

SEQ ID NO: 176061 - protein, 108 aa, Triticum aestivum
  unsure (1)..(108): unsure at all Xaa locations
  Clone ID: PAT_TA_70479.pep
CDIFTVDIDPDDMEENQDVEKFARVTHNRYENSTPAWSVFSTHDPHAQWNLLVMEXSYTLSCPYAXDGGESWHMTGQXCILKRLCFLLVWDSFFEMLEFLFGLLLNCI

SEQ ID NO: 176062 - protein, 157 aa, Triticum aestivum
  Clone ID: PAT_TA_70480.pep
NSCFFLVQMPSDIYMSKRKIGKMQCGKCSKVIVLSVPAVNHANANASKELTQKLSKADNRKVARTESASYPVSVSEEYGPSFTRSLSTRAGPSLAATQSSKKVSDSALHLLMGYDSASQLLRHSRAFERRSRVFDDGYESFESMVPVSNRVSRRKNM

SEQ ID NO: 176063 - protein, 73 aa, Triticum aestivum
  Clone ID: PAT_TA_70481.pep
GLGLRAAWIGIVMRRRPPDLLPIIALWELAYEVILHFKSYPFLIYVPVHSGLSSLGIGGSDFIPHFLSLCSDF

SEQ ID NO: 176064 - protein, 152 aa, Triticum aestivum; identical to SEQ ID NO: 126264
  Clone ID: PAT_TA_70482.pep

SEQ ID NO: 176065 - protein, 68 aa, Triticum aestivum
  unsure (1)..(68): unsure at all Xaa locations
  Clone ID: PAT_TA_70483.pep
RRLARRXGVKRXXGLIYXEXRGVLKIFLENVIRDXVTYTXHARXXXVTAMDVVYALKRQGRTLXGFGG

SEQ ID NO: 176066 - protein, 39 aa, Triticum aestivum
  unsure (1)..(39): unsure at all Xaa locations
  Clone ID: PAT_TA_70484.pep
IAEXXGXRXDLRVKLXIVFPEQLTDEQRAGLAXILKDCT

SEQ ID NO: 176067 - protein, 114 aa, Triticum aestivum
  Clone ID: PAT_TA_70485.pep
SDQKKKNRKHNMKALAEIYLLSMSDVLITSGFSTFGYVAQGLAGLTPWIMYRPENHVVPEPPCGRAMSIEPCFHQAPYFDCRAKRDADLGKVVPYVRHCEDVSWGLKIVNETRL

SEQ ID NO: 176068 - protein, 174 aa, Triticum aestivum
  Clone ID: PAT_TA_70486.pep
RRRSDTVLVSTIKMLPYFNMFIFSNIGGVVADHLITKRILSVTKTRKLLNTIGFVVSALALMALPSFGTPSGTVICSSVSLGFLALGRAGFAVNHMDVAPKFAGIVMGVSNTAGTLAGIVGVGLTGNILEAAKASNMDLTNSETWKTVFFVPAYLCIFSSVIFLVFSTGEKIFE

SEQ ID NO: 176069 - protein, 36 aa, Triticum aestivum
  unsure (1)..(36): unsure at all Xaa locations
  Clone ID: PAT_TA_70487.pep
EEAVAGEARPIEIRREWAXRIRELELRVQQLLXKHQ

SEQ ID NO: 176070 - protein, 75 aa, Triticum aestivum
  Clone ID: PAT_TA_70488.pep
MAFMVEDVSSNMHFPANAPPPDDAPCKKCNNSQPPPDLKCLVCGLCIHRQCSPWDESDLPVESADWACGACREWR

SEQ ID NO: 176071 - protein, 60 aa, Triticum aestivum
  unsure (1)..(60): unsure at all Xaa locations
  Clone ID: PAT_TA_70489.pep
GSIKLLLSHRQIXTPLGLXDTALQVRNETQXKLRISLCCSVXPPRXAXKPXRQTPEIXLX

SEQ ID NO: 176072 - protein, 81 aa, Triticum aestivum
  unsure (1)..(81): unsure at all Xaa locations
  Clone ID: PAT_TA_70490.pep
KKKTLQRIEXKKRVKLHDSIIPPFFSVXEXASXSKASPYHPRPCCPWPQQPGATTSXSLSFXCTPSPAPPPGPASVLGXTL

SEQ ID NO: 176073 - protein, 159 aa, Triticum aestivum
  Clone ID: PAT_TA_70491.pep
MLVYQDKLSGDELLSDSFPYRELENGVLWEVDGHWVVQGAVDVDIGANPSAEGGGDDEGVDDQAVKVVDIVDTFRLQFISHMKRYIKNLSAKLEGDDLDAFKKNVESATKYLLSKLKDLQFFVGESMHDDGGVVFAYYKEGAADPTFLYFAHGLKEVKC

SEQ ID NO: 176074 - protein, 95 aa, Triticum aestivum
  unsure (1)..(95): unsure at all Xaa locations
  Clone ID: PAT_TA_70492.pep
AHFRXIASNVSSYIGMVSDTXKNTIPKAVVHCQVREAKRSLLNYFYIQVGSKDAKQLALLLDEDRALMGRRQQCFKRLELYKSARDEIDAVSWSR

SEQ ID NO: 176075 - protein, 67 aa, Triticum aestivum
  Clone ID: PAT_TA_70493.pep
VIKLLVYFNKLFRFMVTQISFDFVASLSSCRPTASSGWLWVRASKLWICLKEICERSEITSTSSTSD

SEQ ID NO: 176076 - protein, 41 aa, Triticum aestivum
  unsure (1)..(41): unsure at all Xaa locations
  Clone ID: PAT_TA_70494.pep
XQRXLHXSEPRXYKXSDSXHXXIYTXKNLDITQDQTXNTRY

SEQ ID NO: 176077 - protein, 76 aa, Triticum aestivum
  unsure (1)..(76): unsure at all Xaa locations
  Clone ID: PAT_TA_70495.pep
IXHXVFRXSFVWSXYCALVFXCVFHRCMLVLASLLFSLLXGICCLVIPXXGFCWXWLXFSSLAVSVLCVFIPSVXS

SEQ ID NO: 176078 - protein, 59 aa, Triticum aestivum
  unsure (1)..(59): unsure at all Xaa locations
  Clone ID: PAT_TA_70496.pep
RYRRKQFDSSITVIFPKFLILAQLLGHLXSCGSVTYDKVLRSLVTPNKNTQNYHLLEDG

SEQ ID NO: 176079 - protein, 146 aa, Triticum aestivum
  Clone ID: PAT_TA_70497.pep
MYMQAMELVRMGDSSVAAYERLTTLFNQCAAEMKPLTEVRDGLGLEDRLAANNTVPSRVEANTIPSRFEADPDAFEAVEGTQMIIGNDDSISANVSVTRLDNLLAPAKRKQVGRPTSSKEKAPYEGLSKRTRFCGICRQQGHKRTT

SEQ ID NO: 176080 - protein, 61 aa, Triticum aestivum
  unsure (1)..(61): unsure at all Xaa locations
  Clone ID: PAT_TA_70498.pep
RRHERMTQXVAQPXPSXPVGSSAASALGEGKILSPEVRHKQQSCXSCVXSCKLWXLVDXHG

SEQ ID NO: 176081 - protein, 168 aa, Triticum aestivum
  unsure (1)..(168): unsure at all Xaa locations
  Clone ID: PAT_TA_70499.pep
KRQRLXRTRLMELQKRQAMVIRKISRLKPTHQPVASTMNIRVLMPVPGRAAQMTLTLNKLEKLRPSDSTKRTRTLFSIRDCSWTRRGATAHRKIVCLFRSRLHPLVGKLLVQNCGADYVIHALKDYLHVMFFLPSCYLNNVTLAAMFQSLQGNLFFRSIPRWRPLFLM

SEQ ID NO: 176082 - protein, 103 aa, Triticum aestivum; identical to SEQ ID NO: 107316
  Clone ID: PAT_TA_70500.pep

SEQ ID NO: 176083 - protein, 80 aa, Triticum aestivum
  Clone ID: PAT_TA_70501.pep
GLSRRGRPRRHKLAETHAHTWSTDRVSMVFARFFLGLANNHFFYSLSPMSCMCAVLFCFVTDYLPHVPSLFSRPNSSMNW

SEQ ID NO: 176084 - protein, 57 aa, Triticum aestivum
  Clone ID: PAT_TA_70502.pep
IGAGRRSSSGYDGAWPFSQHLSGGSRERERERERERERERERERDRERDRHYYSNRR

SEQ ID NO: 176085 - protein, 128 aa, Triticum aestivum
  Clone ID: PAT_TA_70503.pep
KNETLSSSARYQIYVFYAFVSSSPVQFKAELHAMELPTYKMVKILEIGCSSSSLSVKFGSETMKSLELLKLDCSSGASYDLDGLDCLPELKEVLIIGNNNETLETELSNKLLNHPNKPVLKKELPRSS

SEQ ID NO: 176086 - protein, 75 aa, Triticum aestivum
  unsure (1)..(75): unsure at all Xaa locations
  Clone ID: PAT_TA_70504.pep
KNYIHSTEHXEQPXLKSXTACYRXHGAFXLPXXXLXRNMSXLMXQARCXINXTYEFLVFFXXXQXHLLXKLXAWH

SEQ ID NO: 176087 - protein, 117 aa, Triticum aestivum
  unsure (1)..(117): unsure at all Xaa locations
  Clone ID: PAT_TA_70505.pep
KKXTSHXXPIGSPMLQNGKEEIPTTVSLSPRLSEQTPIEQTMAKTGYRYYNLHASESAPRKYSFHDATHGLIHTREMDESAGSFHSSFQILPVTLNLSSFLSPPEKNKAMFRWIISP

SEQ ID NO: 176088 - protein, 118 aa, Triticum aestivum
  unsure (1)..(118): unsure at all Xaa locations
  Clone ID: PAT_TA_70506.pep
AERXPRTTCTPPVTLQXDTMDEVHAAVTLQKDTMNEVYAAVTLQKDTMDEAHAAVTPHEVNEVPAANMGAGYLVDLAGNYHPAVENAQSKPSVTWIGKRWRNSGRTRWKDSRSSKALT

SEQ ID NO: 176089 - protein, 169 aa, Triticum aestivum
  unsure (1)..(169): unsure at all Xaa locations
  Clone ID: PAT_TA_70507.pep
MPYKLLSKLPALLPACVKLLQPKLMVIVEEELVRVGKEASLCKASFVDFFFEALHHFTXVFESLASCFFGGNQGACLRLVEREMVGPRIQDFVGQYGSVTVEVTTPVVLERYGACDLSGCNVAQARMLVGLFNRGFEVVHEKGRLVLCWKSRPLTSVSVWAPILKERSS

SEQ ID NO: 176090 - protein, 73 aa, Triticum aestivum
  unsure (1)..(73): unsure at all Xaa locations
  Clone ID: PAT_TA_70508.pep
WRRXPMXGNXXXHATPGXGXAIXAFXIYLVXEAAYNRXYRPAGXNXXXXSPXGKVXGXNFTEAPMXIFSGXIS

SEQ ID NO: 176091 - protein, 195 aa, Triticum aestivum
  Clone ID: PAT_TA_70509.pep
CPTPRRSRREGKRHQRPITKDLGFPPEPNLCGRGATAMLHASKVYNDHSHRNHRSPTEAKTYRVFTKASKHPTRTAINNSTEVKEARRRRDQPHLAEANGRPHAAPAVKSVNRRPEARPSDTAQTTMPCREPCRRVTRGVQPEGKNHLGFQPRPSSIRVPTGGQRQQIRRTKMQPCSITTRLLHHAAPTAAPSPC

SEQ ID NO: 176092 - protein, 170 aa, Triticum aestivum
  unsure (1)..(170): unsure at all Xaa locations
  Clone ID: PAT_TA_70510.pep
CXXXXXXXXXXXXXXXXIXPQXXXXGMXXXXXXEFNSALXXIXGTMGYLAPEWISGLPITKKADVYSFGIVLFEIISGRRSTEVVKFGSHRYFPVYAAAQVSEGEVLCLLDARLEGDANVKELDVTCRVACWCIQDEENDRPSMGQVVRMXPASFQNLMEGDDSVIYSDF

SEQ ID NO: 176093 - protein, 57 aa, Triticum aestivum
  unsure (1)..(57): unsure at all Xaa locations
  Clone ID: PAT_TA_70511.pep
XXKRPPPXPNRXDXRRXXXMXRXMXSRXIGFDAFFAQXTSRSMTXXALRASAAASRT

SEQ ID NO: 176094 - protein, 83 aa, Triticum aestivum
  unsure (1)..(83): unsure at all Xaa locations
  Clone ID: PAT_TA_70512.pep
XXKYXXXXVXXGSWFIGLXVNHIXERNMXCGTPPDCEWKGQAGNICVASFDWSCSGICKSVERLKDVHARCGEGDSSVWSDLI

SEQ ID NO: 176095 - protein, 53 aa, Triticum aestivum
  unsure (1)..(53): unsure at all Xaa locations
  Clone ID: PAT_TA_70513.pep
LAXKNPHLCQAPKKXGHXXLHDDPHRSLMLLVYLHXGXRESDHLRKXXGXXXX

SEQ ID NO: 176096 - protein, 41 aa, Triticum aestivum
  unsure (1)..(41): unsure at all Xaa locations
  Clone ID: PAT_TA_70514.pep
HLRDEGQVXEEEDXXXQEEAPKDEAAIQVGXQRGESLTXYH

SEQ ID NO: 176097 - protein, 121 aa, Triticum aestivum
  Clone ID: PAT_TA_70515.pep
FTCKADASSHTHSVFHLLCRPFPNRCPSCLKLHVSPRAHLAPTPIPQCQNLQASWLCLPQVRPRRRLIPCPILGEKERKSDDYGAISISQEPDGEQRHGRKRQRQQQQVLVVHGDRLLKQP

SEQ ID NO: 176098 - protein, 50 aa, Triticum aestivum
  unsure (1)..(50): unsure at all Xaa locations
  Clone ID: PAT_TA_70516.pep
ICTAXLLCCLPDFLLLTSYNXAXTLKSSAXTTXRXNDVTXXAARQEPESV

SEQ ID NO: 176099 - protein, 46 aa, Triticum aestivum
  unsure (1)..(46): unsure at all Xaa locations
  Clone ID: PAT_TA_70517.pep
QXRERPNLSGRGXRDRXRSXPGPXGAPXEHPXQAMSVRARVDHPSC

SEQ ID NO: 176100 - protein, 183 aa, Triticum aestivum
  unsure (1)..(183): unsure at all Xaa locations
  Clone ID: PAT_TA_70518.pep
DTIXQCKGEDLXQGGHLPXPAAXSSLPGKQLENGCTFAXXNIQKESTLHLVLRLXGGMQXFVKTLTXKTITLXVESSXTIDNVKAKIQDKXGIPPDQQRLIFAGKQLEDGRTLADYNIQKESTLHLVLRLRGGMQXFVKTLTGKXIMLEVESLDTIDNVKAKIQDKXGIPLDHQHLIFCLVSS

SEQ ID NO: 176101 - protein, 61 aa, Triticum aestivum
  Clone ID: PAT_TA_70519.pep
VKMLKNMANLPCLSTFSISQKFPWQSSLINMSKNMAKLPWQVKMLKNIFHRIVAMMANFVL

SEQ ID NO: 176102 - protein, 97 aa, Triticum aestivum
  Clone ID: PAT_TA_70520.pep
GNNCSNNIMIPSLIIDGIFSNLQAHCIHLDLVIIDDISNIQLQFHLLFFNSFHFSFKYSFSFSTKFNFSTRGSVAIFGSHTSKVVPATGRCGAIDGG

SEQ ID NO: 176103 - protein, 100 aa, Triticum aestivum
  Clone ID: PAT_TA_70521.pep
MLHKSLPFQEMAGIIRCRSREDNVKFEVTVRAIIDGFVYFSAYCRVMPHQHSTPWLLSFCMETVALNKLGRIPSGSSYPYIMPWPRSLVGIHNKQTSLSS

SEQ ID NO: 176104 - protein, 79 aa, Triticum aestivum
  unsure (1)..(79): unsure at all Xaa locations
  Clone ID: PAT_TA_70522.pep
DNIQGITKPVIRRLARRGGVKRISGLXYEETLGVLKIFXENVIXDAVXYTEHXRRKTVTAMDVVYALKRQGRTLYGFGG

SEQ ID NO: 176105 - protein, 39 aa, Triticum aestivum
  unsure (1)..(39): unsure at all Xaa locations
  Clone ID: PAT_TA_70523.pep
LNKXWXXENETXVKSDEXKXXLXGTCXSHXNTEXGVNKX

SEQ ID NO: 176106 - protein, 133 aa, Triticum aestivum
  Clone ID: PAT_TA_70524.pep
CKCCLQFARLILRHSSSTTMVMQCTATPACSGVGVCPPRVLLDSTPPCSMGVSEFFFVEDMQLVGECLVVQAARACSPPLDFCLYFEVVQCGGVSPWGMGVEYIFFMIKLGDAVHSIHVLHFLEIFLKCTQFV

SEQ ID NO: 176107 - protein, 60 aa, Triticum aestivum
  unsure (1)..(60): unsure at all Xaa locations
  Clone ID: PAT_TA_70525.pep
LRHXXGYAVGSRTLPIXLHEXFHXXTXHTDSSQPXNSDRXAXSPSPXAXLLASXPSLGIX

SEQ ID NO: 176108 - protein, 53 aa, Triticum aestivum
  Clone ID: PAT_TA_70526.pep
AKPDGSVSVPGEVLFQVWVVSSLLLTHRGSPSMMYHLLDGCLKRIICCALEEG

SEQ ID NO: 176109 - protein, 97 aa, Triticum aestivum
  unsure (1)..(97): unsure at all Xaa locations
  Clone ID: PAT_TA_70527.pep
IIWTARPFPCSXLCDCHCIGMNSRVALYLLIGAEPKLXSLQQDKLNLSNKPKIXKNVSESEIKMIRLEESRIRRWXXLLITWREAKDKSITSPSLEV

SEQ ID NO: 176110 - protein, 58 aa, Triticum aestivum
  unsure (1)..(58): unsure at all Xaa locations
  Clone ID: PAT_TA_70528.pep
MLXGDFNLILRDEDKNNGNXNRRMMGRFRRLVNDXALKEVLVTGSLHLVGDVLRLIKT

SEQ ID NO: 176111 - protein, 68 aa, Triticum aestivum
  unsure (1)..(68): unsure at all Xaa locations
  Clone ID: PAT_TA_70529.pep
PRARLXAXRXMFXRXXAXNTXSXXXGVXMVLXTPSAXXRHLLSXTWMDGXVGPACCLXXXVLXLCXSX

SEQ ID NO: 176112 - protein, 43 aa, Triticum aestivum
  Clone ID: PAT_TA_70530.pep
NAMSRLKGEDIRGLEVKVLEELQNFHVEALSRICQEKMAKQVL

SEQ ID NO: 176113 - protein, 60 aa, Triticum aestivum
  Clone ID: PAT_TA_70531.pep
LKHHTGFAEPQLLEPAKMLVMAHAAAPDSKLKAIYKKYSCEQYGRVSLRAPAVAAPQRLA

SEQ ID NO: 176114 - protein, 80 aa, Triticum aestivum
  Clone ID: PAT_TA_70532.pep
SSATFKHVTVPQYTKLNDLLFRFIIPSPEFSFTFAYNRHCSPLQHRFKLTRAQGNRWEKRRPKNTRACLILVQLVSLSWI

SEQ ID NO: 176115 - protein, 142 aa, Triticum aestivum
  Clone ID: PAT_TA_70533.pep
GHGRGKHGRTSGAPGGLDGGHIQQSQGRLHYANFHQDEDARVVRLVVHVLEDYDSKEWILKHSVETSYLSGGTHVLDLNVDFHLIAVHPECNLIFFTAGWDTTFMCYNMDSRRVKVICNLEDGKPPYLPYVPLYTELPSLHT

SEQ ID NO: 176116 - protein, 117 aa, Triticum aestivum
  Clone ID: PAT_TA_70534.pep
TTHRGEQRKNGAFSEEKDKGLEWEPSASDFKHHNLAGLSIYGRFQAEDKLVSYARSIMQAAVNLEDIKLYKSPVCQRCKHMRQEWTLEEKSSLGYKIKEGMPSLVQIHFPSLGEVFF

SEQ ID NO: 176117 - protein, 209 aa, Triticum aestivum
  unsure (1)..(209): unsure at all Xaa locations
  Clone ID: PAT_TA_70535.pep
EGLPPKRQYDHVIPLVTRARPISIRPYMVAPQLKDKLEEHVAELLKTRMIRHNNSLFSPPVILVKKKKXWRMVLDYRHLNAISVKGKCPIPIVDELLDELQXVAWFSKLDLKAXYHQIRLAPSEEYKTTFQTHNGHFETSVLAFGLSGAPGTFQGAMNYSLSSCLRVCDVVLFDDILIFSKNFEEHLSHVEKVLRILQKDSRKFKMSKN

SEQ ID NO: 176118 - protein, 135 aa, Triticum aestivum
  unsure (1)..(135): unsure at all Xaa locations
  Clone ID: PAT_TA_70536.pep
MMAVKLLVKIAVMMMAPGVTPAPREARGRXAPPPSSSLPSSLDGRRVSPLVLGLYGVXEGREPLRDRICLSVSLYFCVPLIALSXFVYIYMEICNFDWTETSAEXFSEKXLSCGKRIATTTLXGAHXGQGRAPPA

SEQ ID NO: 176119 - protein, 69 aa, Triticum aestivum
  Clone ID: PAT_TA_70537.pep
SENEKLCSVIHQVELNGIACAQQNGIWFNEILQHILDDAIRREIGMKINQIFPNFPDQLYIADKLTYKT

SEQ ID NO: 176120 - protein, 64 aa, Triticum aestivum
  unsure (1)..(64): unsure at all Xaa locations
  Clone ID: PAT_TA_70538.pep
ASSQPSSLTTQLPRSLTLTQLSXNRSIHPSIHRCSSPRAPAMEAGDDPTFVAEGTVTSISLAVA

SEQ ID NO: 176121 - protein, 41 aa, Triticum aestivum
  unsure (1)..(41): unsure at all Xaa locations
  Clone ID: PAT_TA_70539.pep
XXXXXRXMXXTXGCGMXAGVXCRXXCCWRWXXXLVXTVCRS

SEQ ID NO: 176122 - protein, 87 aa, Triticum aestivum
  unsure (1)..(87): unsure at all Xaa locations
  Clone ID: PAT_TA_70540.pep
AFVVNYNMXPGTWDVEKTIAMCVQEEERLKAAHGGTLNYVHGHKRKNYNLNNKSSPSKPQGKVSYQHQRQQQPFSVDKDTCKSSIFE

SEQ ID NO: 176123 - protein, 45 aa, Triticum aestivum
  unsure (1)..(45): unsure at all Xaa locations
  Clone ID: PAT_TA_70541.pep
HDLCCQPRQEPXXSXLVSLQAWRVCXMFKLCVGIQMFWSETGAFR

SEQ ID NO: 176124 - protein, 49 aa, Triticum aestivum
  unsure (1)..(49): unsure at all Xaa locations
  Clone ID: PAT_TA_70542.pep
XSRXAIASYLQGYXPMLLXPSFXSXAXCVVDLRTRELLLXCNVICFXLL

SEQ ID NO: 176125 - protein, 96 aa, Triticum aestivum
  Clone ID: PAT_TA_70543.pep
LQQTETKGNRTASNWFVKGERKEIKEHNSKIRDLSKGFAGYMYQVQNTFAGIYRIAKNGVCSTSSKHGNDLSKAAAFFQHNKAIVDVQNELAHLNN

SEQ ID NO: 176126 - protein, 32 aa, Triticum aestivum
  Clone ID: PAT_TA_70544.pep
NDRLGTILCCYHILLTTKMPRAKDNLGLVFFF

SEQ ID NO: 176127 - protein, 92 aa, Triticum aestivum
  Clone ID: PAT_TA_70545.pep
FSYAQGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 176128 - protein, 138 aa, Triticum aestivum
  Clone ID: PAT_TA_70546.pep
LITLVPPGGKVEFEGGLYTNLWTAHPPFQIDANFGFAAAIAEMLIQSTQSDLYLLPALPRDKWPMGSVKGLKARGDVTVDIRWKEGELHEAVLWSSNDRNTVARLHYGKEVAAVTVRRGIVYRFGSGLRCLETWPLCK

SEQ ID NO: 176129 - protein, 135 aa, Triticum aestivum; identical to SEQ ID NO: 130416
  Clone ID: PAT_TA_70547.pep

SEQ ID NO: 176130 - protein, 204 aa, Triticum aestivum
  unsure (1)..(204): unsure at all Xaa locations
  Clone ID: PAT_TA_70548.pep
MRHVERRLKPEEFSAQLSFDVAEWCQFFTPSPKPVIQDTSKWKPSSEFVKINLDCAYYPESGTGGWGCMXRAPHGDILFAAAGPLSNLSALLQAESNAILKAIDLSENFGMGKVIFETDCLNLKQVVCSDASDRAALGALFREAKYRLRLGFIEYRMELSPRNCNTPAHVLASLGSREVQSDQLWDHEFSCYEPMQRPAICRDH

SEQ ID NO: 176131 - protein, 168 aa, Triticum aestivum
  Clone ID: PAT_TA_70549.pep
PRMEGPNNQDFGPEDLLQLADSVGGFSLMTYDFSGPQNPGPSAPLKWIQYSLTTLLPAKGSASQVHSHMIFLGINFYGNDFLLSKGGGGGSITGRDFIHLLEKYKPSLQWDDKSSEHFFIYSDKGVRHAVFYPTLLSLSVRLDEAQDWGAGLSIWEIGQGLDYFFDVL

SEQ ID NO: 176132 - protein, 85 aa, Triticum aestivum
  Clone ID: PAT_TA_70550.pep
SSLIQSTRSLTLCCTLAFFCFHKIQHVSVTKESTCLQQSAMCIQQSSRLSQIFGLRIMPSETVPSSLPCVDTLNKNIGACLQNVY

SEQ ID NO: 176133 - protein, 41 aa, Triticum aestivum
  unsure (1)..(41): unsure at all Xaa locations
  Clone ID: PAT_TA_70551.pep
PPLGRFAVXXXRQTXPVGVIKGVEKKDPTGAKVTKAAIKKK

SEQ ID NO: 176134 - protein, 108 aa, Triticum aestivum
  unsure (1)..(108): unsure at all Xaa locations
  Clone ID: PAT_TA_70552.pep
KGAEKGKMKVRRKMRXPRFCFQTRSEVDVLDDGYKWRKYGQKVVKNSLHPRSYYRCTHSNCRVKKRVERLSEDCRMVITTYEGRHTHTPCSDDDAGGDHTGSCAFTSF

SEQ ID NO: 176135 - protein, 46 aa, Triticum aestivum
  unsure (1)..(46): unsure at all Xaa locations
  Clone ID: PAT_TA_70553.pep
ATISXHXHKLDKFVLRRLAQTSTWIEKARPPAWEPPNYSWSSAVST

SEQ ID NO: 176136 - protein, 126 aa, Triticum aestivum
  Clone ID: PAT_TA_70554.pep
CIHQYKIPLTPSFSCEARRNLLGRLNLLEGLLGFGFGVLRTLEGLSKLGLLSLRVTLQGLVFLDEILELVLDLVDPGLLLLMLGAFLGRFVFGLGQRLLKGRHFGRGPLTFLELPLHEAELSLGPL

SEQ ID NO: 176137 - protein, 96 aa, Triticum aestivum
  Clone ID: PAT_TA_70555.pep
SCIKGGMCWCWNRICWCLKALASCRIMIRWINFRDLSTVLLGASELLHMCSKRASSSLSSFGSSRRTVPANGSPSLSFPDGSGLDTAISADETQTG

SEQ ID NO: 176138 - protein, 45 aa, Triticum aestivum
  Clone ID: PAT_TA_70556.pep
LKIFLENVIRDAVTYTEHARRKTVTAMDVVYALKRQGRTLYGFGG

SEQ ID NO: 176139 - protein, 160 aa, Triticum aestivum
  Clone ID: PAT_TA_70557.pep
IHIRYVGFAKLERFYVDFRIPRVVFEEGAMPKLEHVELKLYAGSASEEHMGISHLLNLQKVTLRYFKWYATNKGVKETTEAVKSECKEHQNELTLCIAEEEKNGICNMKTEVFQENRVASSSKMTEIVKEEEEDTQEGGLHQREATASCNGTSEIEEVVE

SEQ ID NO: 176140 - protein, 75 aa, Triticum aestivum
  unsure (1)..(75): unsure at all Xaa locations
  Clone ID: PAT_TA_70558.pep
GRAGYWRXASRKVGGTRQPSEIARWPRPGTRFCRTLSTRMPNTESIGSSTLFLFLXLXIFALGSPXPRSXXLLFH

SEQ ID NO: 176141 - protein, 196 aa, Triticum aestivum
  Clone ID: PAT_TA_70559.pep
LRAGYVDPEYVVTQELTAKSDVYSYGVLLLELVTGRPVVQDDRSLVEWSRELIGTDYRLHELVDPAVADTFDLDELQVMADVIHWCTHKDGGARPSMKQVLRILYERLDPLSGGFARAVEVEQGYYYGGQSGRKAKEWQQRPRDGGGDVIQFSGEPRCLPSSSSTSRSHCSRTVPLEGNSPEPQSPAHADRGGFFA

SEQ ID NO: 176142 - protein, 45 aa, Triticum aestivum
  Clone ID: PAT_TA_70560.pep
VYDVDAGDYIKFVNCTQHGSWLDDCELNQRNLNLPSIAVPNLKDY

SEQ ID NO: 176143 - protein, 76 aa, Triticum aestivum
  Clone ID: PAT_TA_70561.pep
LNLQHGALAVIFVQTIWWKYEHVKLQSKRNLNCKPLFETHVALNVVEKAMDIISRYRLQGRCPECSRPGESYIHQA

SEQ ID NO: 176144 - protein, 138 aa, Triticum aestivum
  Clone ID: PAT_TA_70562.pep
PLHSKFRLREPFSRPILSANPSIMSHSLQPSDRFIIFASDGLWEHLSNETAVKIVHKHGRTGIARRLIEAALQEAGKKRELTLKDIMKIESGVRRHFHDDITVVVLFIDHGLSAKDHAQESRALSISVPSGLGDLAWA

SEQ ID NO: 176145 - protein, 69 aa, Triticum aestivum
  unsure (1)..(69): unsure at all Xaa locations
  Clone ID: PAT_TA_70563.pep
EHTRQGHTGTTEHERXLYFIQRARARAHAXXXDDTLGGGELVVMXLACLSXSSSXSPLXAGLLGAGSVA

SEQ ID NO: 176146 - protein, 34 aa, Triticum aestivum
  unsure (1)..(34): unsure at all Xaa locations
  Clone ID: PAT_TA_70564.pep
HKLDLARSLLCIRMPVLYRCRNNESKYFRISXRF

SEQ ID NO: 176147 - protein, 62 aa, Triticum aestivum
  Clone ID: PAT_TA_70565.pep
ITFSSLICFHTVFKKPVKLTFRAKSVLCSYKISISTLDLKCCFRSFLFLQIFHSHQRGSINC

SEQ ID NO: 176148 - protein, 86 aa, Triticum aestivum
  Clone ID: PAT_TA_70566.pep
EYLAAELLELAGNAAKDNKKSRIIPPHLLLAIRNDEELGKLLAGITIAHGGVIPNINPVLLPKKTAEKSPKEPKSPKKTAKSPKKA

SEQ ID NO: 176149 - protein, 155 aa, Triticum aestivum
  Clone ID: PAT_TA_70567.pep
LVSASQTILPDSEGAINGHLTEAGLTIHLLKDVPGLISKNIEQALEDAFKPLGIHDWNSIFWIAHPGGPAILDMVEEKVGLDKERMRASREVLSEYGNMSSACVLFVLDVMRKTSSQDGQATTGEGKEWGVLFGFGPGLTVETLVLYSVPLSTIA

SEQ ID NO: 176150 - protein, 30 aa, Triticum aestivum
  Clone ID: PAT_TA_70568.pep
LKRWSTNILSTVLTNYYFPRITNGEEYYCN

SEQ ID NO: 176151 - protein, 62 aa, Triticum aestivum
  unsure (1)..(62): unsure at all Xaa locations
  Clone ID: PAT_TA_70569.pep
KFWHRVFVSYEATVRXWRANTFAYLFFARLRVLCSYVRRLLLRCVELVRXSFSXXMDGKRCK

SEQ ID NO: 176152 - protein, 134 aa, Triticum aestivum
  unsure (1)..(134): unsure at all Xaa locations
  Clone ID: PAT_TA_70570.pep
HKLRLYSIASSALXDFGDXKTVSLCVKRLVYTNDAGEVVKGVCSNFLCDLKPGADVNITGPVGXEMLMPKDPNATIIMLATGTGIAPFRSFLWKMFFEKYEDYKFNGLAWLFLGXPTSSSLLYPEEFGKMKAKA

SEQ ID NO: 176153 - protein, 143 aa, Triticum aestivum
  unsure (1)..(143): unsure at all Xaa locations
  Clone ID: PAT_TA_70571.pep
SPSARTPDQRCRGTISLWYIPVMFANVFSFTLQMYLQAQSKNMVITYLAFVTLGLHVFLPWLFTVXLHLGLAGAMTSMVIAMWIPVFGQLIFVFFGGCPLTWTGFSFTALTDLVPISVSHLCVCSVGLCTAHIGVLTGYMRCR

SEQ ID NO: 176154 - protein, 62 aa, Triticum aestivum
  Clone ID: PAT_TA_70572.pep
RITIKVELVVPCLTRVCGVLEDNYLFFQYVKNERGGTLVGVVDVSEVVPQDRPNDSSDVCST

SEQ ID NO: 176155 - protein, 52 aa, Triticum aestivum
  Clone ID: PAT_TA_70573.pep
GLDYSDVNSLNMAIRAHAASNRQRGGRREADDDFTDASMRGTFWQMVNVRSR

SEQ ID NO: 176156 - protein, 65 aa, Triticum aestivum
  Clone ID: PAT_TA_70574.pep
QRSQAAGGGSLEVMDAGWCMRPGRGHQVGMRLQQYSSRLSPPNEHALVLRVVSLLNGHGVIFFFF

SEQ ID NO: 176157 - protein, 107 aa, Triticum aestivum
  unsure (1)..(107): unsure at all Xaa locations
  Clone ID: PAT_TA_70575.pep
PRRLRRQRSALHPRRHHHQQRLPDSHPTSLGPPCVQGCSNQKFGIIKGTMTTTHXHTGDQRLLDASHTRXCARARAAALNIVPTYTGAAKAVALVLPNLKGTAQRDR

SEQ ID NO: 176158 - protein, 65 aa, Triticum aestivum
  Clone ID: PAT_TA_70576.pep
QCHKLQPKVTNHLLCLIFMRATMEKRSNEPVRWLIIVSILINLLSCNVYTQLSTPSCENTTQTKE

SEQ ID NO: 176159 - protein, 61 aa, Triticum aestivum
  Clone ID: PAT_TA_70577.pep
FFFFFLNIPPDSIITNTKHPASTTLIPNIQQAQILQLGKMRGRVLGHALPHQTDMVQQPPP

SEQ ID NO: 176160 - protein, 57 aa, Triticum aestivum
  Clone ID: PAT_TA_70578.pep
PRRTTGSAPWPSSRTPSSHPCLPPDHSISRSPNSLACYVQYFNGVFVPLWLWVTMGQ

SEQ ID NO: 176161 - protein, 65 aa, Triticum aestivum
  Clone ID: PAT_TA_70579.pep
LSLISRLKLYRSADEDVDEDEVEPLPGAISFWRLFNFVDGLDWALMAAGTVAAAAHDAAFVVYMH

SEQ ID NO: 176162 - protein, 116 aa, Triticum aestivum
  Clone ID: PAT_TA_70580.pep
HIYNGTNIDPAFAALRKGACPALAPNGDTNLAPLDVQTPLFFDNAYYRNLVAKRGLLNSDQVLFIGGSQDALVRQYAANPTLFASDLVTAMIKMASLTPPSGTPTQIRRNCRVVNS

SEQ ID NO: 176163 - protein, 74 aa, Triticum aestivum
  Clone ID: PAT_TA_70581.pep
FFFFFFKHIPVILLCTLTAKQVQSVTAGPRICSNIDGLLMCAFQKEPAFLPFLWRQCHKKVAYSAYIHKLLYLH

SEQ ID NO: 176164 - protein, 102 aa, Triticum aestivum
  unsure (1)..(102): unsure at all Xaa locations
  Clone ID: PAT_TA_70582.pep
GRLRGRNSFLPHTSGCVRTSHGHPAASPKFNIDSSGSSKSNPCVGGENVTVQTIPCYPQTRXQHKNPIPRSTLHFSCRTLHFLLGFSLYGTFLAGALALKTG

SEQ ID NO: 176165 - protein, 90 aa, Triticum aestivum
  Clone ID: PAT_TA_70583.pep
LKWTTVLLEVICLFVLSPNELQESSKRTANRSPLDSFLKIKTQLGHRLFLGCTRRWTELHHSARWALIDSGQQHFSCSFSTHFSSPVKRE

SEQ ID NO: 176166 - protein, 74 aa, Triticum aestivum
  Clone ID: PAT_TA_70584.pep
FGWRRHEVHIYMVAWTPWRCMSSFVVVPCGCVQRAARSKQACSLWIFLSVKCIRLGYDVLCVKTICWEVYFNKH

SEQ ID NO: 176167 - protein, 58 aa, Triticum aestivum
  Clone ID: PAT_TA_70585.pep
KMSIKLFVYTLCKTTVNCRMWILKQFTQDYLSNYMIGGWPPQGVGLESCMPSASRRAQ

SEQ ID NO: 176168 - protein, 129 aa, Triticum aestivum
  Clone ID: PAT_TA_70586.pep
NISVLDKMHVLAYSNFRDAHFVSAPCWYAIQLRHLEHPVGPPFNYTNWCHSTKSPNAAHLYFFFSASNENGGDRAISSRCSACSRRLLARHRPLPSPRVLSSSCARWTSPRAACDLLTPVRLLASTCVL

SEQ ID NO: 176169 - protein, 49 aa, Triticum aestivum
  Clone ID: PAT_TA_70587.pep
IPPVNLLVAVAAHQGAMQPRHFHTTRKEELLIIFYAPCCELSPLATCSC

SEQ ID NO: 176170 - protein, 79 aa, Triticum aestivum
  Clone ID: PAT_TA_70588.pep
NNLKSLHVTGFKACTGQVEFLMHMVENAPALEGLTLDQSEKYLLEGHKKDAKTVIDLVHRTAKKYLEGKISPRCILMLL

SEQ ID NO: 176171 - protein, 86 aa, Triticum aestivum
  Clone ID: PAT_TA_70589.pep
VQGKYPGWARFAAAKRQLDPRGLFDSPWSEDVVGGKELSKDDGCALDGRCVCSEDRHCSPGQGYYCGTGLVFSEARVCRYSASQLV

SEQ ID NO: 176172 - protein, 154 aa, Triticum aestivum
  Clone ID: PAT_TA_70590.pep
ILLKVWAEQVRDLSYNIEDCLGEFMVHVASQSLSRKLMKLKDRHRIAIQIRDLKSRVEEVSNRNTRYNLIEKNKFARATDEKDSCMEDIRNQSANNIDEAELVGFSKPKQELINLIDVHAIDSPAQVVCVVGMGGLGKTTLTRKVYENMDNFSC

SEQ ID NO: 176173 - protein, 52 aa, Triticum aestivum
  Clone ID: PAT_TA_70591.pep
IVKWLDLPELKRFTSCNLVKFGSQPCFFRSFILGGQYCNKKQPEAISCLVIT

SEQ ID NO: 176174 - protein, 101 aa, Triticum aestivum
  Clone ID: PAT_TA_70592.pep
NIYMGKTSVTDLQSIAITEPRPKSLQAYGVQQKKQYTRSSYSLQRLGNRLSDSYDPAGGLLLESLRLYRLSTEARFSFPLGHVRLHLFSRGLEGIWVDFYL

SEQ ID NO: 176175 - protein, 89 aa, Triticum aestivum
  Clone ID: PAT_TA_70593.pep
SAWWQHLRYCTRSQEALGGTKVQHIFQDEFALWLIRSLQNHKSCIVYRNIIYTSMHSALHVHHYLSLKREKRKKRCGLLKKKKKKKIKK

SEQ ID NO: 176176 - protein, 108 aa, Triticum aestivum
  Clone ID: PAT_TA_70594.pep
ISTHSPRPSSADYKPQSLGSILADEGASTAEGQNSPEKEHGEPDDAAARKSTAQEQIPDADGKASAAQAVVQPLVKEHEAAADPRKKKRGPGLLGRMIFRKRVEGRSS

SEQ ID NO: 176177 - protein, 42 aa, Triticum aestivum
  Clone ID: PAT_TA_70595.pep
ITCTNSGMHDQLSLQLGPTIGHASYQPHTWRTTWHRCVVISR

SEQ ID NO: 176178 - protein, 116 aa, Triticum aestivum
  Clone ID: PAT_TA_70596.pep
MTRNSVAEQAPSPGAAVPADGSFSHRNIARTFDRDGYTTEADSVDAPVDGVIEQIERGVYVTLAVSPGGRKDIRRIRFSRKHFGEKAAQCWWEENKSRVYANYSVEQAATPHLNRA

SEQ ID NO: 176179 - protein, 47 aa, Triticum aestivum
  unsure (1)..(47): unsure at all Xaa locations
  Clone ID: PAT_TA_70597.pep
MTXKLSTSALLLQYAEVSQRHFIFHVHIILLLLGFSRRPTRPGWGGR

SEQ ID NO: 176180 - protein, 71 aa, Triticum aestivum
  Clone ID: PAT_TA_70598.pep
TDGLIKDIYHVVATLNMMIFLYIYIYIYVCMDLLIVFFFTNGGACLCKSNPSISNRGFLIFPSKKKKKKKK

SEQ ID NO: 176181 - protein, 182 aa, Triticum aestivum
  Clone ID: PAT_TA_70599.pep
MIWIHCLIISSNIAGMIPSSWSRTAKEEKDDLQLIDGASMIGDMGLRNCHVFTNRIHGDSGAVDVTFSRLENAVEATVEVFISEVQNSFSLFLGCLTSGLSEEIRLFDGVIGETQSLKRSVVAVVTGSSIHLKFKVGLESSSSAEHDCSFIAGNHGSNARKIETDFALISVKVTWSPLPKGH

SEQ ID NO: 176182 - protein, 82 aa, Triticum aestivum
  Clone ID: PAT_TA_70600.pep
SICRVISRMKIRPMIHRRQTMQATFSPIFIQSYTWNRRVSIVKIFSYGYDACIIFLIISPARKGCNTLCIKLVTARNELNAC

SEQ ID NO: 176183 - protein, 62 aa, Triticum aestivum
  Clone ID: PAT_TA_70601.pep
NFHKNLEMSYDVFKSLLCSNIFNSCNILSPTLKFFFSGPECILHCNPFTYFFKTSTKIRGGQ

SEQ ID NO: 176184 - protein, 79 aa, Triticum aestivum
  Clone ID: PAT_TA_70602.pep
IWQPGNCMKSTRVLQGASRASGSPSSCLISPYTPAHNLNFVHTEYSRTDLMPAMSNSFDTHYLEKLVLDKCPQQPYILV

SEQ ID NO: 176185 - protein, 99 aa, Triticum aestivum
  Clone ID: PAT_TA_70603.pep
PTPPWSAAGSTRRWAPASTPAAFGASFSAAAAPTPASSWRPPAGAIAQQHGCFSDPEVTLSCTTSAGPHQTGDLSAGEHILCLGCFPSAFSPPVQSSLV

SEQ ID NO: 176186 - protein, 66 aa, Triticum aestivum
  Clone ID: PAT_TA_70604.pep
FFFFFFDTNIRWSLLLTTGGSKTFHSKVKYSDSVIILGKELLGDELVNQQKFCMVNSYWTVPLVAC

SEQ ID NO: 176187 - protein, 75 aa, Triticum aestivum
  Clone ID: PAT_TA_70605.pep
CIHFVICSSYVPNFHSREQKVFHCLMPVVQCKICCSFVIATVCTSVSSSVIGAMSESRTSLVPPEFDQTPLAPLV

SEQ ID NO: 176188 - protein, 61 aa, Triticum aestivum
  Clone ID: PAT_TA_70606.pep
LVMSVNLYCAGTYRLQNNISHFAVMRMLYAWFLVKSKILQQFFYMHGFLLNLKFCNKFSSL

SEQ ID NO: 176189 - protein, 96 aa, Triticum aestivum
  Clone ID: PAT_TA_70607.pep
RQQCQRHRLLGMQKTSLPNRLRNASSIPDATTARSTIGVSSVSVTASSACRRRHSQIVSVMHPGIPDATTVLPAPISIIDCSLAWPMGAPRLRTMF

SEQ ID NO: 176190 - protein, 76 aa, Triticum aestivum
  Clone ID: PAT_TA_70608.pep
SVLLVVLDKTKSYVSLILSTAYGIFCYLMNQSHLFFLYLRRNFPRGSNRIPRENRKANQLTFSRSVLFLGNALWYI

SEQ ID NO: 176191 - protein, 154 aa, Triticum aestivum
  Clone ID: PAT_TA_70609.pep
FFFFFFKIHMFGCACVSGGIVLSEMISELLPRVRSLLWIHSSRTPIRVTRTDKGELLKNEEEEARSRRRRGAAAVRAVIHWMVSTSPPPRLLSPWWFRNGPGPLSWPKGPAQTRDGRRAPNIPPSLKCGLTPSRHHREPPGSHCTRCSLTRSKS

SEQ ID NO: 176192 - protein, 45 aa, Triticum aestivum
  Clone ID: PAT_TA_70610.pep
HVSCNKGDRRGLPQPGGCRALQPLGGGLRCEAWILHRANDRLGDC

SEQ ID NO: 176193 - protein, 114 aa, Triticum aestivum
  Clone ID: PAT_TA_70611.pep
KTSQTISLTIDKSGVLESGTVAVKRLSDMCMDEKKFHGEVQCLMKARHKNIVRFLGYCADTQGNMLSYNGKLVMADVRQRLLCFEYMSKGSLRDYISGRDMIFVHYIIILVKYP

SEQ ID NO: 176194 - protein, 135 aa, Triticum aestivum
  Clone ID: PAT_TA_70612.pep
GNNRMAPLRNMFPNLVTKEDLASKEEIEHFKKHVTSLAALDFLVCLKSDVFVMTHGGNFAKLIIGFRRYMGGHRLKFIKPDKGLMSKFFGNPYMPWANFVEDVMITHQTRTGLPEATFPHYDLWENPLSHCMCRA

SEQ ID NO: 176195 - protein, 72 aa, Triticum aestivum
  Clone ID: PAT_TA_70613.pep
CRAGTGRGDEPRPAAPVQRRVLQRQQLLCAVSASAAAAPWARAGTSSPSTAAGSRAAARLHQRTAAQHQLAS

SEQ ID NO: 176196 - protein, 44 aa, Triticum aestivum
  Clone ID: PAT_TA_70614.pep
FQAGPMKMDDYRVFMILDLTFISFICQCFFVQKWVQKNLKRVCG

SEQ ID NO: 176197 - protein, 140 aa, Triticum aestivum
  Clone ID: PAT_TA_70615.pep
PRFKKWCDDYFHIKHRGERRGVGGIFFDDLNDHDQETLLDFATECAASVIPAYIPIIERRKDTPFTEDHRAWQQLRRGRYVEFNLVYDRGTTFGLKTGGRIESILVSLPLTARWEYDHKPQEGTEEWKLLDVCINPKEWI

SEQ ID NO: 176198 - protein, 69 aa, Triticum aestivum
  Clone ID: PAT_TA_70616.pep
TVGTICFDPFFMFQRDFVALPSKSVSQNSEHDTIFSTPLNYQHSPQNNISLPGRNANSKLENGLLLWWN

SEQ ID NO: 176199 - protein, 82 aa, Triticum aestivum
  Clone ID: PAT_TA_70617.pep
DDIENESNELNRIKNYLNGKLAEHTGHSVEKVHEDLSRSKRFDAEGALEYGIIDRIVRPSRIKKEGGSTTGQKKELRNLGLG

SEQ ID NO: 176200 - protein, 88 aa, Triticum aestivum
  Clone ID: PAT_TA_70618.pep
FFFFFYFFFFLRSNRSFTRYQHLPLPKSTHRQITPATVAGKENQKGTKEKVRGCLVVSCPSSCTLFVAAVNADRAVAVAMVLADFPAN

SEQ ID NO: 176201 - protein, 112 aa, Triticum aestivum
  unsure (1)..(112): unsure at all Xaa locations
  Clone ID: PAT_TA_70619.pep
FFFFFTFGEILRCFTXNLRSDDSGSFIYISLLHSFESIKRMNSAIKGKFIFSCFSFTLPNESSEPQCIRNNRNPINTENTIPPLIQSFCMVMDDTLGSHSQFIFCCADAFNP

SEQ ID NO: 176202 - protein, 77 aa, Triticum aestivum
  Clone ID: PAT_TA_70620.pep
QPHYSLILVTGKACKTHNITFQVLDQEELSNCVQVMFVDSSQVLHQIDKISSSPREILVLQTLALKGPSTLSTRHKD

SEQ ID NO: 176203 - protein, 64 aa, Triticum aestivum
  Clone ID: PAT_TA_70621.pep
VSPNFGRAFQFAVVVGNIEGRLFAVFCILGGQRTSTFCQMKHHCIFRLYTLLFWITQSACIYPR

SEQ ID NO: 176204 - protein, 57 aa, Triticum aestivum
  Clone ID: PAT_TA_70622.pep
FFFFFFGWTYVSVPHNQKNWEQYTVTCLFAELLKASPLRALRLYLSINRHVLQDANN

SEQ ID NO: 176205 - protein, 102 aa, Triticum aestivum
  Clone ID: PAT_TA_70623.pep
LKMRFLILRVASHYSVTKQIDISVASCVLHNFIRLHDGDFSWPENTTVEIDQEQFVDVPSGDHNYHNDIHAFNYSREAGNQKRDYIAQQMWAQYVSRRSQNM

SEQ ID NO: 176206 - protein, 97 aa, Triticum aestivum
  Clone ID: PAT_TA_70624.pep
ARDVNGLNLPRQSMASSWQALKVRSREEVASLKTTAGFKGEIKGGGSFSEDDGAPPFPQVPAAEKCKLQFVIRGKSPLARTVVRFVPHRRLLAPAFG

SEQ ID NO: 176207 - protein, 163 aa, Triticum aestivum
  unsure (1)..(163): unsure at all Xaa locations
  Clone ID: PAT_TA_70625.pep
ISAKLHALAFSHFQNIPKKIHQEGATKSCXCSHRGRKKMPQDLYSNAMTQSSRNVGCSVATVIWGSSFTIKQLKQQEIGICKSSHPVIISPWALGPCSYMIFNYFLFIFTEHEPLVLVLHCSFFVKFLAQYVCIVITIAIQLPVCYSFVYHDRRGTKDTSQFL

SEQ ID NO: 176208 - protein, 78 aa, Triticum aestivum
  unsure (1)..(78): unsure at all Xaa locations
  Clone ID: PAT_TA_70626.pep
KDGGDPEKLASNFSSSSGGNXFYASLYAGLYYESQKDADLAKSHIVAACKTPYGSRSGDYMASLAVVHCQCRNWTLEE

SEQ ID NO: 176209 - protein, 65 aa, Triticum aestivum
  Clone ID: PAT_TA_70627.pep
FFFFIFFFFFLFCRPIDCLWLQLHTCNSANTSHSHASNQHPAGAAQQLKKGTGKKSCARSRKNIA

SEQ ID NO: 176210 - protein, 73 aa, Triticum aestivum
  Clone ID: PAT_TA_70628.pep
RSDLILRASVPVRCWSTSSSFCLFQLLFFIVPQGNNHQNLTMAASHFCERHLPYFCERCLIFFHRSKKKKKKK

SEQ ID NO: 176211 - protein, 94 aa, Triticum aestivum
  Clone ID: PAT_TA_70629.pep
HDKQLVDDIPVEKLLIHDVPVDIICTPTQVILTNTAIPKPQGIYWEKLSPEKLGQIRILRELKRRIEQETGTILPCGPSENLPPTAQRRKRRGR

SEQ ID NO: 176212 - protein, 193 aa, Triticum aestivum
  Clone ID: PAT_TA_70630.pep
WGGWTAGHELKKPSISLLFPTIERVKSAACGIQLSRYLLSLPEKTWQRLRSTGIFHDAIPHPHDRIGHPMHVKVAQRRFRSRLGGHSFGWTYCGSHNFSPAAWGQPLRPPSKANPTDATRGAPSGSRLHICNYELGIILIAPPPGMSKEGNGRRHGIDGISLPFVIPAPHYKYSDRPATPLAMRQAWPKLVFR

SEQ ID NO: 176213 - protein, 56 aa, Triticum aestivum
  Clone ID: PAT_TA_70631.pep
VRGSNFHCLRLAAVAEVLDVGVCWPLLSCYPHFLCCRTPTISKYSKIPSLNSELVF

SEQ ID NO: 176214 - protein, 54 aa, Triticum aestivum
  Clone ID: PAT_TA_70632.pep
RVRYYSLSVAHQYWAATGCIRHACAKTPAGIIHSELPQIQLLRLLHSNSSLRRV

SEQ ID NO: 176215 - protein, 116 aa, Triticum aestivum
  Clone ID: PAT_TA_70633.pep
WNVYWLVGACSSMRNDELLLFIPALCRRADKEWIPNCPDVGRSESIIRYMASLEGFVYIYLQGHNLESLWGCEDDTISNLRALLFYGVHLCTKNGMFFSCVIYCGFFFQKKKKKKK

SEQ ID NO: 176216 - protein, 57 aa, Triticum aestivum
  Clone ID: PAT_TA_70634.pep
VKCRYRFLRPHPVQKWHHYFPLEVCTVEIMIFFSNFRFIEIKIGVFFKKKKKKKKKK

SEQ ID NO: 176217 - protein, 110 aa, Triticum aestivum
  Clone ID: PAT_TA_70635.pep
FFFFFFFFFFFNDALGYYYSTRSLLHISSRARTREQVYNSQRPPSPTLQITPQVKQNNSHLGCLKSHQKIARSHTSAAGSGRKILLLLRHHRLRLLLIVALFLLGRRGRR

SEQ ID NO: 176218 - protein, 62 aa, Triticum aestivum
  Clone ID: PAT_TA_70636.pep
APAASMAAASQLRRRRRSLYHNSDSRCIAAPVVSQPLLPSWKMCLERYHGRCMMVPAREGKC

SEQ ID NO: 176219 - protein, 153 aa, Triticum aestivum
  unsure (1)..(153): unsure at all Xaa locations
  Clone ID: PAT_TA_70637.pep
FFFFFFLGPASQADVAPLNIXTWNGNVWERYNHVWAYGVRLSLEDWKKKEKEERYVVRALFVTHELEPWLGDARRFMAPEEHRSPHHCFESALVDGDATSLSAVRWEDGVRSEWPRSPPTARRQIWGTHPHPSGAGRRKKTPRPPSRGSVTRW

SEQ ID NO: 176220 - protein, 114 aa, Triticum aestivum
  unsure (1)..(114): unsure at all Xaa locations
  Clone ID: PAT_TA_70638.pep
RSVCGFITLMVMEDNSLGLAGVKDFSLHLWSRKVNGAAKWVPCMVIDLQKIMPMXNPLKGNGANVVGFAEGLGVIFVSTEGGLFTIDLKSRLLKKVDEPGVYFSVLPYMSXLHS

SEQ ID NO: 176221 - protein, 178 aa, Triticum aestivum
  Clone ID: PAT_TA_70639.pep
IDERTNELIISEKEAWAMLYLKEGALLEGTVRKLFPYGAQIRIGETNRSGLLHDSKITHGQLRSVSDALSVGERVKALVIKSTTPDRIALSIRDLESEPGLFLSNKEKVFAEAEEMARRYREQMPATPRSGEGPDGGYDDTVPFEDEAESYANWKWLKFIKSDRADCNPQCHRNHRGL

SEQ ID NO: 176222 - protein, 77 aa, Triticum aestivum
  Clone ID: PAT_TA_70640.pep
HCPKSMFTSESQPIHPTKSACVSDSSHSNGQGSKVESYSASFLSLLHICLLAIVLYGWVSKVTGRKQCLLASYMMTS

SEQ ID NO: 176223 - protein, 43 aa, Triticum aestivum
  Clone ID: PAT_TA_70641.pep
RHLLRRGTTRGGWHRPVSVLICTPSVHKYKSFLEIPFLYRLHT

SEQ ID NO: 176224 - protein, 56 aa, Triticum aestivum
  Clone ID: PAT_TA_70642.pep
KEKTTTIIRPLRNHDMSSESDQLQDISFLIFRSSGKNYYPTIYIQYKLLLKFALTE

SEQ ID NO: 176225 - protein, 46 aa, Triticum aestivum
  Clone ID: PAT_TA_70643.pep
VSWEKVDVSFHRSMRSFAAHSIIQVKYAFMNEGADVIQHIIGHFQL

SEQ ID NO: 176226 - protein, 133 aa, Triticum aestivum
  Clone ID: PAT_TA_70644.pep
PHHSLVLCNRNVNMCIFSLFPTPLSFSSPLLGTPKFLFFFHFYLPCPFLFVQPAWKRSQQEKSWIHHDDGPVSVILYSSSQTEDVEVPKTLKPVVNYSSSSAFCRCNLYRGNSSRMFGSRLSIAGSQATNGNI

SEQ ID NO: 176227 - protein, 100 aa, Triticum aestivum
  Clone ID: PAT_TA_70645.pep
HRFYARVTTMESSGSGQLVKLELQYPLLLPLVRRQCWSANRLARCLRRGLPGSMTPMRRERTRRGRIRHLDEKKKKRKTGKVETHLEFPGREKVKFGLSC

SEQ ID NO: 176228 - protein, 41 aa, Triticum aestivum
  Clone ID: PAT_TA_70646.pep
FFFFFFFLNQKESAQVLHIHIINSVHQTFTRLQYMQFTDYM

SEQ ID NO: 176229 - protein, 63 aa, Triticum aestivum
  Clone ID: PAT_TA_70647.pep
LMIYLLFMVHWHDIEPPVKEMYPPGKEMYKLGVNFTHHAGYMIDRVFVQNRLIYIYIHTHTHT

SEQ ID NO: 176230 - protein, 84 aa, Triticum aestivum
  Clone ID: PAT_TA_70648.pep
RYTKFQLLQLKRNIVLYRNKNRMKYFRRGKLKFCRALYITNQGESEPQTLPKRDFPSPLKLTKNITIHPFPLIFPNYFQKAQKP

SEQ ID NO: 176231 - protein, 66 aa, Triticum aestivum
  Clone ID: PAT_TA_70649.pep
FITKYVYITGQKALQNSITCSYTKLSNHMYNKTEYKKFSSTKINFLPLSSSRTQHLSLKGSTIRSI

SEQ ID NO: 176232 - protein, 78 aa, Triticum aestivum
  Clone ID: PAT_TA_70650.pep
KKLYTALLTQDTLLIRNNHINYIVEDRPQKATELRKLDVHIAKQSFQLPVCMMLSPLYFTTSVGKVFSFHQKGKRETI

SEQ ID NO: 176233 - protein, 107 aa, Triticum aestivum
  Clone ID: PAT_TA_70651.pep
STTRTSCGTATKTTTAWTSSGSTRRTRGRGSSTGAAATASPTRTSTATDTTSTTRTRTTGSQTCETDAMPSMAEAAARSLICAMSPSASLPCFIVEGSWRCSRNPGL

SEQ ID NO: 176234 - protein, 52 aa, Triticum aestivum
  Clone ID: PAT_TA_70652.pep
RGEKDRHRGSGGAQPAGGGRGRHWRPSLQSISEAAAGQSSSTSSSIFESTAS

SEQ ID NO: 176235 - protein, 89 aa, Triticum aestivum
  Clone ID: PAT_TA_70653.pep
PRPTPSPLQRLMVPCRRKRGLQSLSPEAGVDPPRLRRSQLPRRLKAGQESPNARSRLARFSMCLDCILGRVSKLVAGCDVVSFYWMFEK

SEQ ID NO: 176236 - protein, 117 aa, Triticum aestivum
  Clone ID: PAT_TA_70654.pep
VLSPMLQKEVTTYSESCGTQSGYRLGMSEEEMPCQMYRGENSASSSQKFRATYNPQHLGHVNSVGIPELLPERENSHSSKGKSKMVYSSDKSAQQDICAQALSLSGVATNAATRGRS

SEQ ID NO: 176237 - protein, 91 aa, Triticum aestivum
  Clone ID: PAT_TA_70655.pep
IGQAAACTCTCMFSRLVRTSTMPVRCHRPFNFCSDCTYTCIIIYNSMIFGPFQQHRVNILVERIPFEHQHNTSLSLSYLIDIVEGKSIFSN

SEQ ID NO: 176238 - protein, 72 aa, Triticum aestivum
  Clone ID: PAT_TA_70656.pep
QLAGKDGMERAEWLRQRTTQTTQDAEDCLRINYHGSKIVTEALLPLLRSSSDGRIVNVTSAWGLLRVRPISF

SEQ ID NO: 176239 - protein, 106 aa, Triticum aestivum
  Clone ID: PAT_TA_70657.pep
TTTGPAPSQSEHESLLAELVQAKTAEAVAKQEAEEARQKLESIRKSHGLSRSVSGHSSSASQSGPGGVFGLLTGHGASAVNDVAMKPASANAGSPGSGGSFWGWRR

SEQ ID NO: 176240 - protein, 129 aa, Triticum aestivum
  Clone ID: PAT_TA_70658.pep
YAMERAQRFKSERPFTVKTMKHNDVYASYFMIIPDKFVKTFLPEESRKMTFWDPQGKPWKVWYEYTGGECPRAAFSAGWGALAMENNLEKWDVCIFELLDQEYNIKLHVYKVVLEITPCVIAPKPRTCK

SEQ ID NO: 176241 - protein, 71 aa, Triticum aestivum
  Clone ID: PAT_TA_70659.pep
RQNREILDFCAEAGIGARQYLPNHKSQPEWEAHFGEERWARFAGLKAQFDPRAMLATGQGIFPPPALLSDF

SEQ ID NO: 176242 - protein, 130 aa, Triticum aestivum
  Clone ID: PAT_TA_70660.pep
VAAVQPCRRPPASSAARRSEENAPVDRARPCLDPVGSAGAIHPAPEWAGLPAPEAQMRPCRPPSSTEWAEAHGDASCAPSFFSFSFPLGPVSYSPCCFFPEQICLISSVKQICRKNPKLHAYHISKKKKK

SEQ ID NO: 176243 - protein, 130 aa, Triticum aestivum
  unsure (1)..(130): unsure at all Xaa locations
  Clone ID: PAT_TA_70661.pep
FFFFYKNSELHTTNLVVVGVSHRGGCAXGKRATKQNLGSFKNIQNELQSGSGRHCSTADEAEQREDSSGTIEGSSRALRGRRRTREGVRTEGGRAIGSRCPIAGHRRSRALQRPRNRTTGSALANCALRW

SEQ ID NO: 176244 - protein, 132 aa, Triticum aestivum
  Clone ID: PAT_TA_70662.pep
DGHRVLFGSADGWIKCWDVRKVQRTGGVGAHTSAVFDMRWYKGLDDPLTGVPPGVDEKGAQLPKKSGTFFISSGFDRNVKVFSADDWTLVQTLSGHTGPVASVDYSRDGKWIVSGGHDRTVKLWGRNDGEGI

SEQ ID NO: 176245 - protein, 148 aa, Triticum aestivum
  Clone ID: PAT_TA_70663.pep
TIKLAKLWEIRQIRSREKNSHGPKLPSPNKTQERGCALQTWAKARFGAGLDAVGGWAGRCRLRRLAGPCAKRPRRGRGGDPAGADVGRGKAGPGEVNAGGQGARSVVGEAEDVDDVDLRRRRAAARSWGRGTWTRGSGAARRRIRVWG

SEQ ID NO: 176246 - protein, 118 aa, Triticum aestivum
  unsure (1)..(118): unsure at all Xaa locations
  Clone ID: PAT_TA_70664.pep
ISTMIWSSLASNHAQKRDGSLPRIVTTGHLALDCLNRRRLPGHSCCRSTTCRRAAASSSAARSRPATRAGCGPVRCRCSPRGTAATCRRRRRGARSXWLRSARPPWWTAARLRWTCGC

SEQ ID NO: 176247 - protein, 140 aa, Triticum aestivum
  Clone ID: PAT_TA_70665.pep
FFFFFSENSYIPRPIQTVASSYIRSTPVLHTPAEFENFPKVFGDTTQTVGKLSNGGKPKYGHQPSLTPPEHRARQTLSSSRRPTSILNSSTSRLSWLDDMNGRGESWLTSMIKHPLAAPRMQNGRPCAVDHGSGIVFSSR

SEQ ID NO: 176248 - protein, 36 aa, Triticum aestivum
  Clone ID: PAT_TA_70666.pep
FFFFFFNSKRIPISPIYNSDPTAWSPDLLNTFNLQM

SEQ ID NO: 176249 - protein, 121 aa, Triticum aestivum
  Clone ID: PAT_TA_70667.pep
YGSVKAIAIDYGSKSVNLFSFERGSSLSLPCGSTCILPLGPHMIALPDRSKYKLHIEVDLRVITTCDSQEEDKNLKFCLDCSRRIRSEESLELPRRIRTQKREFDGEQVEVKVIWVLEKFF

SEQ ID NO: 176250 - protein, 66 aa, Triticum aestivum
  Clone ID: PAT_TA_70668.pep
RTPSGQREVHRWPRTKGGVQVCVSQLSLSAPAIKWYVAGQACLPEMCFVSSRAMLALYVVLAASTS

SEQ ID NO: 176251 - protein, 157 aa, Triticum aestivum
  Clone ID: PAT_TA_70669.pep
WYISFICSGFRLCARLISDFSACFFFVLADFFPGHSQAVLLAIEAAREARRANSEEIAANAPRTVDEQLLSIEARLRPAHRQMRRFSVPVPRRLPLCGRTCRLCAPPVGPPTGWKSLPVVLRPGRAPRPEPERAGPWSSPRRGIQGWTWTVWPHSGQ

SEQ ID NO: 176252 - protein, 111 aa, Triticum aestivum
  Clone ID: PAT_TA_70670.pep
EFQFMHICCISSHAGHSTYGISSFMIKLCRPYRTGYTILCCIESTPVCRNVDHGKCGITEKELFCRILTLSHHLAAKPRALKYFLHFNTWFSYLIGCEGHNYVQLVSELGG

SEQ ID NO: 176253 - protein, 164 aa, Triticum aestivum
  Clone ID: PAT_TA_70671.pep
NRHAADSRIPFEYCYDLSSSEARIQTPSISLRTAGGSLFPAIDPGQVISIQQHEYVYCLAIVKSTKLNIIGQNFMTGVRVVFDRERKILGWKRFNCYDTDSSNPLSINSRNSSRSTPENYSPQETKNPAGASQLRHVSSSPPVVWWHNNSLLLMMFVLLHLLIF

SEQ ID NO: 176254 - protein, 45 aa, Triticum aestivum
  Clone ID: PAT_TA_70672.pep
KYSANDLLDVDGLLALFRRSEVVRVSKVDAFGLDTEVVLRKKRSP

SEQ ID NO: 176255 - protein, 128 aa, Triticum aestivum
  Clone ID: PAT_TA_70673.pep
AKAACVGFREDLWYHLNFLACLKDDGDEQSFFAELRYVRCSSTIIIETCTILEKPFCPFRSSCTLCPDESKILHPSDVELGCGKEGHQEEFFRERCGWNGHVKEFFSPREMLAIPFKLGGPVPRYRLE

SEQ ID NO: 176256 - protein, 78 aa, Triticum aestivum
  Clone ID: PAT_TA_70674.pep
YMLLTTIQIRSKIRIHDSCKANISKLLGWIYCGSSSSGGSNQDNLLTVFHFNCSNMGWRMWSRRVEEKMEKVVILALR

SEQ ID NO: 176257 - protein, 91 aa, Triticum aestivum
  Clone ID: PAT_TA_70675.pep
TTQLVRTSDTTTNSDRSVVVLVEVTSIARNFNMIIRKQTISRSLWSIGARMRPWTSKRWPAGTARWGDASYITPNHHVWQSRSHRIEIAHI

SEQ ID NO: 176258 - protein, 41 aa, Triticum aestivum
  Clone ID: PAT_TA_70676.pep
MSKIVDRDVRFPCLSLKIFYIFFPGPKKKKKKKKKKKKKKK

SEQ ID NO: 176259 - protein, 87 aa, Triticum aestivum
  Clone ID: PAT_TA_70677.pep
SAAIIKLILNGHFLQETVKVPADHGLFFLPSLQVPSFRRMPHVQHHTYDFCTPLKIESFTPRSKMQQAGQKKHRMYSHSNYSLCKLI

SEQ ID NO: 176260 - protein, 118 aa, Triticum aestivum
  Clone ID: PAT_TA_70678.pep
PGLNAPVSPGDSFDDAPGEWGNPPIGEEEPLDRSKHWGELEEEEEVEQEPMEDEEIEEGIRSVDTISSTPAGAETPDVIDLGRTQPERQAERLYKVLERKEERIATGTLFGSTHTYRF

SEQ ID NO: 176261 - protein, 114 aa, Triticum aestivum
  Clone ID: PAT_TA_70679.pep
SNQISLRWISLHVTLHSGYFFLPAGRRAGQGSGYYSAMAPRSGTKSRPRLGALRDRRRDPPFTPLLAAGGAAGRVGEHERAVVGRRPARRWRGSRARPSPPPAGPAAASRRAAR

SEQ ID NO: 176262 - protein, 100 aa, Triticum aestivum
  Clone ID: PAT_TA_70680.pep
MFDPTRSTAHTDDAARFMSLASTNSTIIWPLYMLGMSSVCSPETKQYAVEGLNAIHREAGLEQARVVAGLLQEQKAGHSIHNSSLLSKLPSVALSALPSI

SEQ ID NO: 176263 - protein, 107 aa, Triticum aestivum
  Clone ID: PAT_TA_70681.pep
ASATRKIDMEAFFPSRRDNWGEVTSASMCTDYQTRRLGTRTRVDGKLAFPWTANGTALAVPRVIAALLENGWDEEAKTVAVPECLRPWMDGKDKIGLGGRRSSVDRV

SEQ ID NO: 176264 - protein, 95 aa, Triticum aestivum
  Clone ID: PAT_TA_70682.pep
MSSCRFVPQKFEEIFIKHAKVRPDALTSSEVEEMILANRDPLDRRSWLAPVKEWGLTYKLASDKDGFLHKDSVRGIYDGSVFVKLEEKRSLQIEI

SEQ ID NO: 176265 - protein, 140 aa, Triticum aestivum
  Clone ID: PAT_TA_70683.pep
SGPGASKGLKKRALMALPKLAYEDAVAAAVAARGGPAAAAQEGILSECAICLSEFAEKEEIRVLPQCGHAFHVACVDAWLRAHSSCPSCRRVVVVVVADAPPRKTPPEPKRCRKCEAMEEASSSSASATAGDNGAARFMP

SEQ ID NO: 176266 - protein, 127 aa, Triticum aestivum
  Clone ID: PAT_TA_70684.pep
FGCRAAAAAAGEAHAANRFLVEWFASRPLGAESSPAPAPAPAEEGGGLRLCSHALCGRPETRRHEFRRCSVCGVVNYCSRACQALHWKMAHKAECTPMDRWLDGANANPNPNAVAGVGDAAVAAPAL

SEQ ID NO: 176267 - protein, 63 aa, Triticum aestivum
  Clone ID: PAT_TA_70685.pep
SQAPPPGTHPLIEEGEAEELQNKQASLSRHLIALHVPATVVVVNYEPRGLSNPITMDIKTSKA

SEQ ID NO: 176268 - protein, 133 aa, Triticum aestivum
  Clone ID: PAT_TA_70686.pep
RGRPATRTAGEDDRRRGRPARMATGEHAQPARYKEATRCRESFIRVRLKKGIGRFSINQIGWLRADLLKLSAGAPAPSAAHYERGSTHFNRTKAGQLENQIETMVRDQTIPTSICRANQENSFCSHRFPPSLL

SEQ ID NO: 176269 - protein, 65 aa, Triticum aestivum
  unsure (1)..(65): unsure at all Xaa locations
  Clone ID: PAT_TA_70687.pep
DNVNAKLKPLASAKWTSKTCKLQLFKTPLTAGGGPAYSHPLASDFGCADPFDLKXYDKAEKISVS

SEQ ID NO: 176270 - protein, 102 aa, Triticum aestivum
  Clone ID: PAT_TA_70688.pep
GTSVRQAATPQTTHNSPSENLTFNLPVKGKTYYVSLIHIVTTCEPRQKIAVTTCMHYSPNVQIGKGGVQQCLNSIHGHHSSLVSAKTVQRTKRNKTKPGFYT

SEQ ID NO: 176271 - protein, 76 aa, Triticum aestivum
  Clone ID: PAT_TA_70689.pep
LRLLKTYSFFYGLLLLSDNLCRGRRRGGTAWWRRGHGPAVAPLSRCCPSCHSLNIHGMEPQITQGCTGDANHACSL

SEQ ID NO: 176272 - protein, 154 aa, Triticum aestivum
  Clone ID: PAT_TA_70690.pep
DFVGALQVFETALACGTADGMVRLWDLRSGQVHRSLVGHTGAVTCLQFDDVHLVTGSVDRSIRIWDLRTGSIYDAYAYDNPVTDMMFDARRIVSAAGEDVVKVYDKVEGRQWECGAGITAAEEGKTPAIVERVRVRDGYLVEGRRDGIVGVWTS

SEQ ID NO: 176273 - protein, 170 aa, Triticum aestivum
  Clone ID: PAT_TA_70691.pep
MNDTKLDPNNMSRQWTYQTCTQWGYWQTGSGAPKDQLPMVSRLIDVEYNTIPCREEFNITTPPNVESINKLGGFNFSYPRVAFIDGEYDPWRAATPHAIGFPERESTTSEPFILIPYGVHHWDENGLAPGSEEIGLPPPAVKQAQQDIVDFTKAWLEDWEKEKGGATADL

SEQ ID NO: 176274 - protein, 69 aa, Triticum aestivum
  unsure (1)..(69): unsure at all Xaa locations
  Clone ID: PAT_TA_70692.pep
IHNNFHLEYGTDCAIIIFHRYDSGIFLLQYVSKYKGLGLEGFSNDDLQALXSKFLFEIVTCKDNEIQLP

SEQ ID NO: 176275 - protein, 123 aa, Triticum aestivum
  Clone ID: PAT_TA_70693.pep
EPKACPGSPLCIEVFYSGAHDHEAPKQSTRTPCCRFSSSSPTNLRWIICWKSTRHGSISRCSAPPWLLAREMRMPAGQHDGILTCRRRAVRASATGTDRTEKRRSIGGRADGFGISHVAFAAV

SEQ ID NO: 176276 - protein, 60 aa, Triticum aestivum
  Clone ID: PAT_TA_70694.pep
VTQKASQLMLHHNVSMKYIIKKGVLASTYLLTWETIKQYILESSCQQSNDHGGKKVDAPR

SEQ ID NO: 176277 - protein, 123 aa, Triticum aestivum
  Clone ID: PAT_TA_70695.pep
LRVPTTSTALEPRLGEAPAWWHVDLSEDQKHTRLGENQKTKILHKIIAEDAHETPGKTLAGDAHDAAARPLPEPRQDLPKTSAGPQPGPHLPRLHRRSCQPANKAGTCVATCSFQAKSASTYY

SEQ ID NO: 176278 - protein, 103 aa, Triticum aestivum
  Clone ID: PAT_TA_70696.pep
TCFRLLHQAPHRIHNMTRKSLRLHRVPLGHLTHGDGRRFQIRLPSRPDVVTDASIYQYRHYHLFMCETYVYSMYETNDYVLMYETYAYSILVLYYPNHNIMFG

SEQ ID NO: 176279 - protein, 98 aa, Triticum aestivum
  unsure (1)..(98): unsure at all Xaa locations
  Clone ID: PAT_TA_70697.pep
IVADGAEDVTIKISDEGXGIPRSAFPRIFTYLYSTAEHPPDLDGHNGVTMAGYGYGLPISRLYARYFGGDLQIISMEGYGTDAYLHLSRLGDSEEPLP

SEQ ID NO: 176280 - protein, 156 aa, Triticum aestivum
  Clone ID: PAT_TA_70698.pep
FFFFFFVAKLLKIAHSPGVRQKRNETHLLVHVRVCFIQSVFNKIDRMHVLSLAREPEAREVHVAGHVGAGEEALHDVVRAAFQQYACVVRRSPVDILKEFLKRRRGALRRTGHVVRAAVGDAAARRRSRTIAVRRRRRCREVCPGLSTVDAPRLGV

SEQ ID NO: 176281 - protein, 82 aa, Triticum aestivum
  Clone ID: PAT_TA_70699.pep
QIRYHNDIPKIQSLHSRPTKIRRQTGSLSLREGQIFLEKGGLTNCKRTVPHYITHVITAGALYPGYLSSALRILTYILQSNI

SEQ ID NO: 176282 - protein, 129 aa, Triticum aestivum
  Clone ID: PAT_TA_70700.pep
ANQWSGSSSRNDRSYGSNSSYQTPNIYTKTPAAKSVSASGQNFKMRPGTQQQHQQQPQHAHGSSNSYSQQQQATYPAYSGSTHQNQQGQTSNQQQQQQPPSWYFQNSHNPSMHHGSQSSGYNYESWSGV

SEQ ID NO: 176283 - protein, 106 aa, Triticum aestivum
  Clone ID: PAT_TA_70701.pep
VDMLIWRTVATIQHINWEICLQVLLPPAKRKQIGRPTTSMDKAPYEGLSKRTRFCSICRRQGHKRTTCPDRGDVPKQPRKLARCKNCGVKSRRRNNCHKAGELRRT

SEQ ID NO: 176284 - protein, 124 aa, Triticum aestivum
  unsure (1)..(124): unsure at all Xaa locations
  Clone ID: PAT_TA_70702.pep
SNQMEVVMVPAVLVLVMLLIQNIVIAALLLMMAVYLVGIYYYPPHRGYGYGGGGGGGGFSGAGGDXTGWGCGLGFYMLLLLCLVMCAMFSEEGGSWWIPGVLLAACLLCLNLFSGGKVLGQEYF

SEQ ID NO: 176285 - protein, 165 aa, Triticum aestivum
  Clone ID: PAT_TA_70703.pep
ITAQDLIGADKDRPLAAAIAKIQIGNQIRRTRPGQPQGSANPAWNEEFMFVVIEPFEDPLVVTVEEKVGAGWDEPIGRVIIPMASLYVPRNDLVKSVPSKWFTLLRRMTVDEAAADVTTGIKHREHSKTFTSKIQLRMSLETAYHVLAESTCYISHLHPAAAFLH

SEQ ID NO: 176286 - protein, 198 aa, Triticum aestivum
  Clone ID: PAT_TA_70704.pep
TTLTTKYFEATRWKMMEPWHNWQKDRTLDMFKIPVDQSYCELLRDVLDGQCTRIAFEKLEGGHPALSLHDDDVVYIMAKAKEMNRRAVVFAVNMRNKVVQGVAKFDGKRTYGFTQTYLQSGISSYLTAESSARGKARDGIPQGGDCIALEPIDNMYKGKAAESSRDRITQAGDISKSNAAGQAGFEFQEDASRKLDKQ

SEQ ID NO: 176287 - protein, 128 aa, Triticum aestivum
  Clone ID: PAT_TA_70705.pep
GRTSLSSVEKEKVEEKVQAIQSELPIFVVVMTKSRINADQLGFRMEYGARHIPHLGRKMDLMLQAEGGTEQRTRLVIDQNGKRWIRRGWQQFVTENKVREGDICLFERGESTKKLRMTVYFIRKSSQT

SEQ ID NO: 176288 - protein, 139 aa, Triticum aestivum
  Clone ID: PAT_TA_70706.pep
SKTLFALWSIGMPNKHTFETSSCCCQCTHDSQVWELTDHSSSVRCYSLPLNISKPTSYSCLQIVKPVLIPAGTGRRPAGDPRRGGGARKTGKSGRGVNWRLVRRLVPVPAASCSSKKGKIRASGREETEEERRRRRGAR

SEQ ID NO: 176289 - protein, 171 aa, Triticum aestivum
  Clone ID: PAT_TA_70707.pep
SVLSVQTFDRIQVSCYQLQPTKPFSGVTDGSTHPIEKVRLPITFGERNNYHIELIDFDVADILLPYNAILGYPALAKFMAATHHGYNILKMQGSGGFITVTSQEKDAVYSLERAFQAAAVENPEDDSGALPPEVAPKTKKLQLGRGSREEAFPKDATLSLTSTDKAPSPIA

SEQ ID NO: 176290 - protein, 86 aa, Triticum aestivum
  Clone ID: PAT_TA_70708.pep
GQTCTPAVGGFVTLLQLSPACPSRKGASAYSFISFPCLPLWLTQHPTMKFSTPSVCKHHRCWVELAARQDPDKFHVLTLFVYFSWI

SEQ ID NO: 176291 - protein, 89 aa, Triticum aestivum
  Clone ID: PAT_TA_70709.pep
QSSRSQLRPATPDEGTPTTHHATPLEGLHSPWPAFWMEQGGGIIHTAELVEPYCELDKQGIVGDISLLCHDFGLNSSKVAVQGTTGEES

SEQ ID NO: 176292 - protein, 102 aa, Triticum aestivum
  Clone ID: PAT_TA_70710.pep
PARDGSSAGAAGGHDNCHWEVAARACATLATAMAGAQLGRLTRRASVRRRQGMAWCSSAWVTWAMAMAHATAVSGLVHNGGGWLYAHKLLDKMHKRRQKQRR

SEQ ID NO: 176293 - protein, 83 aa, Triticum aestivum
  Clone ID: PAT_TA_70711.pep
AAVRPCKPSQINAAGQIALAQAGSSCSACFVRWASHIPRKKSWLSPDGNPPVPSPPRGYNRQQCHHLCRQCPVQCIMWCLSSA

SEQ ID NO: 176294 - protein, 148 aa, Triticum aestivum
  Clone ID: PAT_TA_70712.pep
IDGRVHAPDFIAHLVGFALKLRNLGVSDHGLIRELSVPLAGSLYSGAGHSRLYYDDAVYDLAIAHALETAPAGPSPAPCTISPRGGSLTSQNPYVLPWIMRGLLEEDFVRTELSAEADELLKQFDDWKPTNKALKDVKYRLEAVRSKL

SEQ ID NO: 176295 - protein, 157 aa, Triticum aestivum
  unsure (1)..(157): unsure at all Xaa locations
  Clone ID: PAT_TA_70713.pep
IYAMVASWFQTHGMLMFMSLVRRRGVVGSRWLHRSSGVESLDCLSSLDGLGSVHRSLVQLGGRAVEGSRLVTVVADVSGGHGRRNVVGRSGRLVXARVGRLPLLDLSSGCGVHGGSDLTDGAVCDLRRAGSDSEVLGSVKSGSHVTRTRAIGSSRTG

SEQ ID NO: 176296 - protein, 133 aa, Triticum aestivum
  unsure (1)..(133): unsure at all Xaa locations
  Clone ID: PAT_TA_70714.pep
RGETLTDAQVKELLGLSDLDPALASRPASELSVGQAQRVAXARTLANEPEVMLLDEPTSALDPISTQNIEEAIVRLKKTRGMTAVIVSHSVRQIQRIADLVCLVVDGVVVEVLPPSDLSQAKHPMARRFVELS

SEQ ID NO: 176297 - protein, 87 aa, Triticum aestivum
  Clone ID: PAT_TA_70715.pep
DHGNTTSLTSRTDFFLKTSKPRNQKTLRHKEQEQPVRFLGQNYTLSKDQNTKHEDGASTRWLGSWGTCHPTRIQARLGHAVLAEFLL

SEQ ID NO: 176298 - protein, 121 aa, Triticum aestivum
  unsure (1)..(121): unsure at all Xaa locations
  Clone ID: PAT_TA_70716.pep
SAGDSYLAGFAAGLLWGXSATDAALLGNFFGAAAVSQVGVPTFHPKMLQAVRRILEDKVIPRSSPCINGATFTFQRSIMHDELHASLEEAARLMHDQSPLATENGDGILSAQEPTSPPSGC

SEQ ID NO: 176299 - protein, 157 aa, Triticum aestivum
  Clone ID: PAT_TA_70717.pep
SAPPIPAAAAAARLRSSSRGCTAGATSCPAGAGSRLSRRRTTRRVRRRTTLPPPQQQLQHHHDSHPTSPRRRRAGSRRTASTPWPDPPKLASSTTAHRVHPPSMAKIGPPNQARSRRSMGVSSEPTTITTTTQLELKPKPKLDASILILFPFLVIFT

SEQ ID NO: 176300 - protein, 119 aa, Triticum aestivum
  Clone ID: PAT_TA_70718.pep
AAKWYLRAAEGGNVRAMYNVSLCYSFGEGFTQDPVRAKKWLQLAADCGHRKALYESGIKLCATGDKVRSLMYLELATRHGESAASHMRDVILESLSPAIAQRALSDADRWRPKCLSARR

SEQ ID NO: 176301 - protein, 116 aa, Triticum aestivum
  Clone ID: PAT_TA_70719.pep
SGIAKPSAKQFVKALPSALQSPFQPSRPWTISASSTKKEAGKKAATARKRAQRVKRKENDCLLLKALIAQNQINNKLFESESNIMPDGMNDAEIDLVLAKNKANVLEVHKKKKKKK

SEQ ID NO: 176302 - protein, 132 aa, Triticum aestivum
  Clone ID: PAT_TA_70720.pep
RHTVSCTGAPHYSYYIVVKMINIPYNWVSFRTYVQGTRSRWSPSASALLAASIFCELILHHRFFVIFLFLYLHTFSLDLIATVHLHTLCLDLIGVFLLFCLLTSSLDLITIFLLFRLLTSSLDLSGLFLLKL

SEQ ID NO: 176303 - protein, 103 aa, Triticum aestivum
  unsure (1)..(103): unsure at all Xaa locations
  Clone ID: PAT_TA_70721.pep
RLVSGKAVASCAGTKKLPSIGSAEHEPNDKDVHTNGCKIFGISLTQKVRVCDEVECSSANCDFXLQPLKPQMSKSLGNSCATVHEQRPAVGMVVDLSAVDTMI

SEQ ID NO: 176304 - protein, 72 aa, Triticum aestivum
  Clone ID: PAT_TA_70722.pep
TMKFHYKMKQQKITIWLTIIGSLIYVAISIPLKKKNSNRRFLTGISITWNMQNRQKLTLQIVFCVKVNFAMQ

SEQ ID NO: 176305 - protein, 105 aa, Triticum aestivum
  Clone ID: PAT_TA_70723.pep
QRVPCVKKGGVRFTISGHDYFELVLPTNVAAAGSIRAMDVRGSKSGDWMAMAHNWGANWHSLAYLNGQGLSFRVTITDGQTLVFADVVPPSWRFGQTFSSNMQFK

SEQ ID NO: 176306 - protein, 153 aa, Triticum aestivum
  Clone ID: PAT_TA_70724.pep
QHDGSMKIIDRKKNIFKLSQGEYVAVENLENIFGQAPNVDSIWVYGNSFESCLVAVINPNKQGLERWAESNGVSGDFASICGDAKAKEFILEELSKTGKEKKLKGFEMIRAVHLEPVLFDMERDLITPTYKKKRPQLLKYYQGIIDEMYKSMK

SEQ ID NO: 176307 - protein, 144 aa, Triticum aestivum
  unsure (1)..(144): unsure at all Xaa locations
  Clone ID: PAT_TA_70725.pep
AGRCQAGERLIVVVLAVRTPSPAPSTPPPPPKSPPSSPPPAPAAXGDSXTSPPPALAPPAAGNSSTSPPPALAPPAAGNSSTSPPPALAPPAAGNSSTSPPPAIAPPPVTNGTVSPPPSSPSSASASRGGFLACLMIAGAIVLA

SEQ ID NO: 176308 - protein, 184 aa, Triticum aestivum
  unsure (1)..(184): unsure at all Xaa locations
  Clone ID: PAT_TA_70726.pep
VHQTTTDLKKWSKVVDDIKYAEXYARPGMLTVAKLPNNEYIYVYEYGGGPNPPAGSEYWFPVYYRLSKDPQKFLNKAHHQIVSNDGTTPAGSPYVVWTPYGGKNGTIVVSCGTRSEIFTNQALGDASAWKKWDVPQPTAYTRSLLTFQKDPDLLMIMGAGILPPAGGKNTVSASVVRLSEVMKS

SEQ ID NO: 176309 - protein, 172 aa, Triticum aestivum
  unsure (1)..(172): unsure at all Xaa locations
  Clone ID: PAT_TA_70727.pep
PTKIARGTIEITADLKLIEAGTKVGASEATLLNLLNISPFTYGMTVQQXYDHGQTFASDVFDIEESQLLKAFSSAINTIACISLAVNYPTLPSVMHSVVNSYKNAIAVAIETEYEWEAIHELKDRIANPDAYAAAAPAAGSAPAASADAPAEEKKAESEEEEDDDMGFGLFD

SEQ ID NO: 176310 - protein, 60 aa, Triticum aestivum
  Clone ID: PAT_TA_70728.pep
FGTEGVVPSYNLIRYKCTETAISVTYLDVLISLPYWLSHSVTYLDVLISLPYWLSHSSAT

SEQ ID NO: 176311 - protein, 85 aa, Triticum aestivum
  Clone ID: PAT_TA_70729.pep
ASGETLDPVFRIGQRRRRLVVVLLREGVVLFARSFLGADFGDVGRLVVGRIVSLVGEFSYVFLCLGRVSHVPLCWAPCSRLCKRS

SEQ ID NO: 176312 - protein, 107 aa, Triticum aestivum
  Clone ID: PAT_TA_70730.pep
SSLQAGAMAVTTQRHLSVWLLRGSIQIATVLFAGVGVSGIGYVLMTWCIEKRGPVFTAGFLPLIQIIAGVLDLLVLHEQLYVGSVVGAALVIGGLYLLLWGKSKEAS

SEQ ID NO: 176313 - protein, 59 aa, Triticum aestivum
  Clone ID: PAT_TA_70731.pep
TYKERNKNQRIERNRRAESHCYYMNMHEVKHEIIYHHLTLAITLVSNCSAFNMVICSTS

SEQ ID NO: 176314 - protein, 66 aa, Triticum aestivum
  Clone ID: PAT_TA_70732.pep
AAFVQAVLEGSTQPGVWFPEEPEGIAIESRKLLLERASQGTTNFVMNKPSWMIETDPKEVILGIYV

SEQ ID NO: 176315 - protein, 55 aa, Triticum aestivum
  Clone ID: PAT_TA_70733.pep
LLIVSCVVCVSNQTTVYHVRLNSVMDHDMPSVVWASPSNVELIPYLESQLIKHVS

SEQ ID NO: 176316 - protein, 96 aa, Triticum aestivum
  Clone ID: PAT_TA_70734.pep
SRQQMPSFFFQSRLNQQHTPAPLFSSSVHPLRELMAATGTVHHQPTPLCQQNTFAHYNKLDLLLTVLALKTCWSSAFRKSEIKALERVYTKKKKKK

SEQ ID NO: 176317 - protein, 103 aa, Triticum aestivum
  Clone ID: PAT_TA_70735.pep
GEVDEINDTRGVDRQLQRIRGAAGEQEEQRQHLLRHYKHLLLAELQPVNRRSFSSVVVNFKCWPSFKPLACQVYNWSNSSSWMAFFFLPYPSYFRPSEHMGRK

SEQ ID NO: 176318 - protein, 76 aa, Triticum aestivum
  Clone ID: PAT_TA_70736.pep
HAAPQLEVVVTPNRHTITMPLNLQGSPNPVTRRMLAMALADEASQQPTPIVKDTTMAYDMASTSKARKLTPKRRKI

SEQ ID NO: 176319 - protein, 85 aa, Triticum aestivum
  Clone ID: PAT_TA_70737.pep
REILLSFREWLSHLHPTDDAVDKERVDPLARHVGPRAELCVCGYLSVRGRQREGMCVLSELCISPNLLCISPPSPVPHLLSQATS

SEQ ID NO: 176320 - protein, 112 aa, Triticum aestivum
  Clone ID: PAT_TA_70738.pep
CLHGQPAYQSDWVFVTLCTCLFISKESEILEQLECQSYERMNNKRECKFAVHRIRMLNSLVCLVHLFYSRMNELLISHFWSLLASNSSILLLQGYLVTATSWRPNSTSISTK

SEQ ID NO: 176321 - protein, 72 aa, Triticum aestivum
  Clone ID: PAT_TA_70739.pep
FIEHVAAADGSFLLLVQGALDPLQQFVADGCHLTRKTAENIKEAGFSSLSLNAVRLSSAYIVSPHVYGVAYK

SEQ ID NO: 176322 - protein, 85 aa, Triticum aestivum
  Clone ID: PAT_TA_70740.pep
DPEAMIIDHINYDSTLVEGDHTLIAGDDLIQSALWARACIMMSRWCLPTRKELLSRLSCTSVMSWKWSSVNFLLWSMVVMLVSYF

SEQ ID NO: 176323 - protein, 70 aa, Triticum aestivum
  Clone ID: PAT_TA_70741.pep
YDRHQQGRDFDRPAAVKIDRRGAASQTNRQNVTPFRKKPQKLAETGWCSSPAGGDYGAECHGPRPSPVGL

SEQ ID NO: 176324 - protein, 47 aa, Triticum aestivum
  Clone ID: PAT_TA_70742.pep
LATVIYNSTIVFNLLQNGAPVNSDHKLGTCSCHMNHMPYSLDDHSQD

SEQ ID NO: 176325 - protein, 162 aa, Triticum aestivum
  Clone ID: PAT_TA_70743.pep
PSLAGFEPVRMVYGPFFPGLSYPFTGPCTGPCTRRVPRTWFCPVFHGARQLPFTTAVGHFFPVSTYSPFTGPCKGPCTRRVPRTWFCPVFHGARQLPSTTAVGHFFPVSTYRPFTGPCKGPCTRRVPRTWFCPVFHGARPLPSTTAVGHFFPVSTYSPFTPP

SEQ ID NO: 176326 - protein, 135 aa, Triticum aestivum
  Clone ID: PAT_TA_70744.pep
CISDSIYSCIHPAFNDKAPLFLDYRRADHAAVALEKGVAIVDPLHRCQKLDYSAALQDTPQEAKEEAAGHLPLGVHGGVEGAVFGNYCSSPASSSPSLASFELLADDTFAPNLEISLGRHDWGMEHPEELSLKYL

SEQ ID NO: 176327 - protein, 184 aa, Triticum aestivum
  unsure (1)..(184): unsure at all Xaa locations
  Clone ID: PAT_TA_70745.pep
SINVFKKMLKERVRPDEITFVAVLIACSHGGKVDKGREYFKLMQQQYRIEPNVKHYGCMVDMLGRAGLLKEAFEFIDTMKVEPNSVIWRTLLGACRVHGEIELAEHANRHLLKARSDDSGDYVLLSNIYASAGEWLESEKMRKLMDDSGVNKEAGRTVVDGSAKDQMQSFRESKXHHGLKGFIG

SEQ ID NO: 176328 - protein, 68 aa, Triticum aestivum
  Clone ID: PAT_TA_70746.pep
LNLTELCYKQFQQQRAGYHLVTDKVMASQLALGTACDGESLIKRCGTAFLWSAVFIFLQLILLDVITK

SEQ ID NO: 176329 - protein, 90 aa, Triticum aestivum
  Clone ID: PAT_TA_70747.pep
GDQCLRCSPSHNGCFFGPARRRISSAPSLASAVIAFGLLGIDLCGMLSCSSFCNPWHLFYHMLYPDPGGSYGSLLGSFAPCYLNCGYSYM

SEQ ID NO: 176330 - protein, 131 aa, Triticum aestivum
  unsure (1)..(131): unsure at all Xaa locations
  Clone ID: PAT_TA_70748.pep
MKNMTKSSTCFFLKVAPFIEKLEVHFHDIGTXRFASDGPLRQEMPPCEDKFVNLKDVRATGFRGARGQAEFLMHVVENAPAIEVVTVDTAQRLTDAWDPDEPIPRLDSAALDMVRAPLLKTLPPNAKLSLI

SEQ ID NO: 176331 - protein, 52 aa, Triticum aestivum
  Clone ID: PAT_TA_70749.pep
RQSDLVVLQCIKPQCLATPQLFKHDLRGVPYTLSNFRTSTSHFNMTQSPALL

SEQ ID NO: 176332 - protein, 98 aa, Triticum aestivum
  Clone ID: PAT_TA_70750.pep
VLYVNSEDQSEHTSWTDVARWRIMYRRSAVLFFIRLNATGVKNADRDGIVVIDCKLFKIVRISPLLSSFVRLPSHTSNGHSREIARSRCYRTNPMSPM

SEQ ID NO: 176333 - protein, 78 aa, Triticum aestivum
  Clone ID: PAT_TA_70751.pep
MHALVARLVIEMNEQPLRIMVWNVRGLNAPARRNAVFQVVNQACPAIVCLQETKLHVVSLNIVRQCLGAKFEKKKKKK

SEQ ID NO: 176334 - protein, 82 aa, Triticum aestivum
  Clone ID: PAT_TA_70752.pep
HLQSCFRLYTVGWCKEGAIHSKPHHLLNCSCLVAFSENCKPYNPLPAHIYHYLNDKTKLGDIKHGMIQNTIFLKHGRPSSIL

SEQ ID NO: 176335 - protein, 145 aa, Triticum aestivum
  unsure (1)..(145): unsure at all Xaa locations
  Clone ID: PAT_TA_70753.pep
CFNRPPDFFRYDAHRQWRPVETATPCYDXRHEFLLSELHPAIDGSCMQQEGVAGSTTRCGGCATTATASCGERWRPATHGDGGCRGVRKLCAARPRGGGGWLSVVTRCGRRHDVWKDREEIMRLLLPESNGCLATGRKLGRCAGA

SEQ ID NO: 176336 - protein, 157 aa, Triticum aestivum
  unsure (1)..(157): unsure at all Xaa locations
  Clone ID: PAT_TA_70754.pep
FTTKKLQELLAIAEIPPXAVNQVELNPAWQQKKLIEFCKEKGIHVTAYSPLGGQSRTSKVNAVLQSEILKEIAEARGKSVAQISLRWIFEQGASMVAKSMKKERLQENLEIFDWELTDEDRFKITRIPQYKKVTVLAILCPEGVPGVDLXEVDVVET

SEQ ID NO: 176337 - protein, 161 aa, Triticum aestivum
  unsure (1)..(161): unsure at all Xaa locations
  Clone ID: PAT_TA_70755.pep
MSNILFSRKLIAELTAIIRNFWWTRINEEPTTKTLYLWAWKDICIPKCEDGLGIRNIQAMNRGLILSGAWRIAXYDPESFLSKVLTSKYYPNTYLLRASTKTPKSAFWSSIIKLRHILISNSSIHILDGNSSIWSTPWFPLLQSIYDHLIMQPSHFKYPSQ

SEQ ID NO: 176338 - protein, 108 aa, Triticum aestivum
  Clone ID: PAT_TA_70756.pep
GSIFNNMEFNPRLAAGIFPVTTDATIRAFCRFPFFLRKITSLWTCGDLVPWFSTYTGEASSFTCPASISSLCICCQYVLLAFCTTIIIRRFIPASDWSTGLLFSFWSF

SEQ ID NO: 176339 - protein, 43 aa, Triticum aestivum
  Clone ID: PAT_TA_70757.pep
FFFFFFLMLPKTFALYVSYCENRAQNKKKIRRLIYLIHVTCTM

SEQ ID NO: 176340 - protein, 92 aa, Triticum aestivum
  unsure (1)..(92): unsure at all Xaa locations
  Clone ID: PAT_TA_70758.pep
KIDGHDYFNLVTVMNVAAAGSIKSMDVKSSDSNDWMPMSRNWGANXHSLANLTGKMLSFRLIDTDGQTIELKNIVPGGWKFGQTYASKQQFK

SEQ ID NO: 176341 - protein, 67 aa, Triticum aestivum
  Clone ID: PAT_TA_70759.pep
GPVSGIRDLAVQYDAQVREEDVTPPERLPVVRAGRPDAKKQLGERAEAAMSGNIVQTLGMMLDTVTF

SEQ ID NO: 176342 - protein, 65 aa, Triticum aestivum
  Clone ID: PAT_TA_70760.pep
NTNHFTSFCRYLTSHKLTQYYHAPKGPFSYVKPGACRTDLTNSNSCTHGFSSGIMCGRLKNPLRI

SEQ ID NO: 176343 - protein, 60 aa, Triticum aestivum
  Clone ID: PAT_TA_70761.pep
RINMSCIDDVCMFGKIIPVKKRITNFCFVDQYTLDSGPGSCFLFFQKKKKKKKKKKKNKK

SEQ ID NO: 176344 - protein, 93 aa, Triticum aestivum
  Clone ID: PAT_TA_70762.pep
SKSRSSDHSLTTPQRRPTGFRSSCVRAGEPGQNETRRHGTMEKRRHTFPFFLTFSLFIFLEACTPALVLYSLVIFFGYFSLVVSLGWRFFIDV

SEQ ID NO: 176345 - protein, 131 aa, Triticum aestivum
  Clone ID: PAT_TA_70763.pep
RRKNRENIEHVCKQQAGRQAGSLSLTHGINSFRLIFKAHIHDSASTFLAMFSSHHATLPPTLCRTCHCKPSDTLQVSSLQLSACPLILVPSDCLKGALLSWLRLYPTMRFSLSLPATALGACLLSKVHLEC

SEQ ID NO: 176346 - protein, 106 aa, Triticum aestivum
  unsure (1)..(106): unsure at all Xaa locations
  Clone ID: PAT_TA_70764.pep
VTEGTALPVGDEEPAARAQGXYFYDKKESYSGWFSFSLVFNSKAXRGTLNLMGADPMDAETRDFSVVGGTGDLFMARGVATIRTDATEGLFYFRLKMDIKLYECYV

SEQ ID NO: 176347 - protein, 77 aa, Triticum aestivum
  Clone ID: PAT_TA_70765.pep
CCHYFFFLQSRGDDSTLNCTRTIPLPSVMQSSWYTIVLCLLCLHLLVFSTCIYSSTCTQIYICQLFLKKKKKKKKKK

SEQ ID NO: 176348 - protein, 131 aa, Triticum aestivum
  Clone ID: PAT_TA_70766.pep
GAHTIGKASCAAVKPRLCKSKPETLDGKYGDFLRRKCRRGDAEHERVELDGVRPTAFDNGYYKNLERRMGLLETDQKMLHDSRTRSFVQEMAREPEEFKRQFAESMRWLGNVQVLTGSEGEVRSKCSAVNY

SEQ ID NO: 176349 - protein, 75 aa, Triticum aestivum
  Clone ID: PAT_TA_70767.pep
LQVSLRTTSSSTCQVDIKIGVNMKKWCILQSKIKSGATEEYRREVCKILEAANDYAVKAESNGPNREDIVVTSSA

SEQ ID NO: 176350 - protein, 75 aa, Triticum aestivum
  Clone ID: PAT_TA_70768.pep
YVRRPPSNSFAISEPASNMQMVHQRNLMNLNMLGTTRSLETLNSNSRILVPFLWCSQRLFILIPEICFPIQQEMS

SEQ ID NO: 176351 - protein, 58 aa, Triticum aestivum
  Clone ID: PAT_TA_70769.pep
DSNSLKLKVNQTVVLCKSSRVEKHHVVQNMFSEFYLSNSWQTYLNWDDCLLWPIIREP

SEQ ID NO: 176352 - protein, 98 aa, Triticum aestivum
  unsure (1)..(98): unsure at all Xaa locations
  Clone ID: PAT_TA_70770.pep
MPGASFSVVDSYKIIKDLLDHPRKHGIRETYRACCSXWVHXGVLCRKGGPICRDRTKYVFFDGLHPTDVVNARIARKGFGSESPREAYPINIKKLAML

SEQ ID NO: 176353 - protein, 46 aa, Triticum aestivum
  Clone ID: PAT_TA_70771.pep
EEMRRGYGDCYYNGGVAEVCAVFARKFKPEALDALLDLAPKLFASG

SEQ ID NO: 176354 - protein, 103 aa, Triticum aestivum
  Clone ID: PAT_TA_70772.pep
SEQDKPTRLRFRKGRAAGEGSSGGIQLRARSLRRRGSGISGSATGFMVPEVTLRHQKTLERKKSRRLSNNLIEETASRLAKSRKSRVKSLVGAFETLFSKIGK

SEQ ID NO: 176355 - protein, 93 aa, Triticum aestivum
  Clone ID: PAT_TA_70773.pep
MIKRCGIRPCILDALARSTMYISLQFKCCPSITRTIGIPDSITICFFKEKHVWRGERETTVQCSLSRCGARMGAKPMSMQAMSSVVLNFLSSE

SEQ ID NO: 176356 - protein, 86 aa, Triticum aestivum
  Clone ID: PAT_TA_70774.pep
FFFFFFFFFFWPPPLLPFLVYIQHSFYKANRKHCEHQRQTRYFIQVQNVQHRNSPGVIRMEQVLIFGCFADLNQSGARPLVRDRLT

SEQ ID NO: 176357 - protein, 98 aa, Triticum aestivum
  Clone ID: PAT_TA_70775.pep
NCQIQNKVVTCTKILHKLNFPQTLELLFVALLEENVEFITVIALVIILLIATWIIITLHIDVICHFATLQSCITFPCFATARSEEKLQSGVSTLLQAN

SEQ ID NO: 176358 - protein, 69 aa, Triticum aestivum
  Clone ID: PAT_TA_70776.pep
FFTHCNARAYLLVNIKSLVNFFLTSQLSTCRTARATTEVISSQQVSFPHRRTARATTEVRMISSQVKFK

SEQ ID NO: 176359 - protein, 117 aa, Triticum aestivum
  Clone ID: PAT_TA_70777.pep
FFFFFFFLLNLFLFINVAVCIIMQRPGSPLLKKNGVSNYKRSTCPPHELSTTSESPPSCRHPQHTRPRTRPPLTRAPGVDAQESGVPWTMMPRSAFGSCTLTLASTRIAPSYAAEYC

SEQ ID NO: 176360 - protein, 130 aa, Triticum aestivum
  unsure (1)..(130): unsure at all Xaa locations
  Clone ID: PAT_TA_70778.pep
WELLEFDRLELXFPFEINKPIPCSLQLTNITNDYVAFDVEMTGSLQYCIELEKCVVPPRSKCNIMVTLQAQKRAPHATVCKDEFFIMRCVSVNEGLGAEDINIDMFNEESGKEVDEVTLKVVVITELLVN

SEQ ID NO: 176361 - protein, 84 aa, Triticum aestivum
  Clone ID: PAT_TA_70779.pep
VRLVPEQRLQEEINALAPSSPRPFRDGQDKDLHPGCRDQPVNTSTRRQRLQQENDASTSLLSPTNKHQNKSFHHGCEAVFQSPS

SEQ ID NO: 176362 - protein, 59 aa, Triticum aestivum
  unsure (1)..(59): unsure at all Xaa locations
  Clone ID: PAT_TA_70780.pep
RLGASYWKLGYCMALATLVGGCVALEVNAWVXFCRRQHEEKLMRREVEDVVVKDRAAAF

SEQ ID NO: 176363 - protein, 63 aa, Triticum aestivum
  unsure (1)..(63): unsure at all Xaa locations
  Clone ID: PAT_TA_70781.pep
FFFFFFFFFXKTDPDAATALMEVSSLQNFNPILMVIMGLRPFFYKDRYKEGWNLNAWLGLSLG

SEQ ID NO: 176364 - protein, 70 aa, Triticum aestivum
  Clone ID: PAT_TA_70782.pep
RAWGFPPLAVEGNQEKNPAGLHGVCGVFPTCHLVLLGTHVCHLDLILWVAGNLDTPPTHTKSFVWGLKKK

SEQ ID NO: 176365 - protein, 58 aa, Triticum aestivum
  Clone ID: PAT_TA_70783.pep
QFEILWPQCTYVSFSGRSTIGAYVSTNFDCDGTTDSIKTPAIHFYWYLLYDSHGLCPY

SEQ ID NO: 176366 - protein, 77 aa, Triticum aestivum
  Clone ID: PAT_TA_70784.pep
FFFFFFFFLGPEDQPGQKFPSTFPRPSIKCQKYFTAPHGKHTRKVQKLLTVTMLSCGKLQNPLSLRDYGCIKNLYGC

SEQ ID NO: 176367 - protein, 124 aa, Triticum aestivum
  unsure (1)..(124): unsure at all Xaa locations
  Clone ID: PAT_TA_70785.pep
QNVPCPMSILWQAPSHVLHGAAXVFAGIGMTXFFYDQAPYAMKSLCAALAQLSIASGFYFNTVVLGVVAVVTTRGGAPGWIPDNLNEGHLDYFFWMMAALSLLNLAQFVHYSVRCREKTILHPE

SEQ ID NO: 176368 - protein, 82 aa, Triticum aestivum
  Clone ID: PAT_TA_70786.pep
HNQTTYQTAVDMVVSKTFGHQTTSHNQWYAICMQYFCELRLSMTSFSCADAGELSAPAWKQSSPLAEGEAPTPPSNRCCCCL

SEQ ID NO: 176369 - protein, 98 aa, Triticum aestivum
  Clone ID: PAT_TA_70787.pep
LSYFPTGTSDILPVISHGCQIQLPKEKQKLQIECQKKLPFVRPEIPIARCLAMEWPRHLKPDPSLPQAALLRRPSSRHRPTPVLRHGCGNESSISFTA

SEQ ID NO: 176370 - protein, 84 aa, Triticum aestivum
  Clone ID: PAT_TA_70788.pep
QTAATTRRLKGEHLKPNSASTRDPQILTTHASTQNPQKTTRATKQNQLLNTQIGTKSTTQTHEHTTTNKPQTWIWKLHNHNHEK

SEQ ID NO: 176371 - protein, 57 aa, Triticum aestivum
  Clone ID: PAT_TA_70789.pep
QMLSGIISDHMLPSISIVSFCCYFAPSIFVTDSYVSVSMECIYLSIYLSIYCLSFTA

SEQ ID NO: 176372 - protein, 113 aa, Triticum aestivum
  Clone ID: PAT_TA_70790.pep
RTSMMIPCAFTSSRTVASPKTYTFRTEHCNTIHIGPSTPHAAKLTLGIQEKTSVIRQSQSRSRSVCLISWIPYRPISIFVVRTGKIDACAVHHLDKGSERCCNLTHWSATNSN

SEQ ID NO: 176373 - protein, 58 aa, Triticum aestivum
  Clone ID: PAT_TA_70791.pep
LKKLISQVADFFTNYMKQHAYIRKLNQVGDFPKLSIQCSSVILSHKMPQHLKRIQGVK

SEQ ID NO: 176374 - protein, 37 aa, Triticum aestivum
  Clone ID: PAT_TA_70792.pep
LLCYTLLCFVIRLELCTLASGYSLVGTVQEFRIVYDS

SEQ ID NO: 176375 - protein, 57 aa, Triticum aestivum
  Clone ID: PAT_TA_70793.pep
GELTSLGPKPQELEKVIIHSFCRTIATSDTSTCDGFYVLRRHAEYCLPPTVSIESTF

SEQ ID NO: 176376 - protein, 49 aa, Triticum aestivum
  Clone ID: PAT_TA_70794.pep
INKDHTRETAFFKRLKEQNSEVLLHQGVRFAFRVHQAGSLLRAWVLLMS

SEQ ID NO: 176377 - protein, 73 aa, Triticum aestivum
  Clone ID: PAT_TA_70795.pep
TSNRRRLGRPSTKDKGGNDLPILVLVPPAYILDPPFMPGSTTMAAHKIYQNNVPPFMFFKHGGVSFSVEPDTV

SEQ ID NO: 176378 - protein, 76 aa, Triticum aestivum
  Clone ID: PAT_TA_70796.pep
VHWAQSSELLAESMLRHSRSSLSLEFYSIHYSVRSPCNIQSPHFVIQYFALSIPCEINEAKHLCYCTFYGVCVPLI

SEQ ID NO: 176379 - protein, 54 aa, Triticum aestivum
  Clone ID: PAT_TA_70797.pep
KTCPYDTLVFCFCTSLYIYKLQIKEPHICHAKNVETIPLAECLKPCKCWQHYTP

SEQ ID NO: 176380 - protein, 48 aa, Triticum aestivum
  Clone ID: PAT_TA_70798.pep
YLQKPSGTNVIRSKWMSNSCLLCTGAMQLNTFKTYVAAKKTKKKQKKK

SEQ ID NO: 176381 - protein, 49 aa, Triticum aestivum
  Clone ID: PAT_TA_70799.pep
RTKERNGSDPGGYSRWGSVRFTPSQTGIGALNPRRPMGFDPSLPCVCVR

SEQ ID NO: 176382 - protein, 65 aa, Triticum aestivum
  Clone ID: PAT_TA_70800.pep
LTSAIFNSLKWTIVILVVSSKMLYSCESIVCSVASICRSLALVVQSTLLPGSLDCFWFQKKKKKK

SEQ ID NO: 176383 - protein, 107 aa, Triticum aestivum
  Clone ID: PAT_TA_70801.pep
MPNSTFYLWLDLSNLPEGINDGLNFFQACLEEKVIVVPGIFFDLNPSRRRDLFDSPCHHFVRLSYGPRMDVLEKGLDSIARIVQKYKDEPQKHRAVSHRPRGTGAPN

SEQ ID NO: 176384 - protein, 119 aa, Triticum aestivum
  unsure (1)..(119): unsure at all Xaa locations
  Clone ID: PAT_TA_70802.pep
HYNQPEVGDHHRFVRGVAAMLRAEWCVARHRLSLLVCLGKKIRGALIITGRGLSIGPHMKTETVWLLLTLCWLGPTRQRHNKLVQNFSQPIKNNNLSAXRKWTTLAPIFRCTTEKIKLM

SEQ ID NO: 176385 - protein, 73 aa, Triticum aestivum
  Clone ID: PAT_TA_70803.pep
TAPADLCILPHQCCKFNLGFPFCPAVPLCHVNHHSFLDRLVFSPNFCWLGWVGNNFFTLPNPCHKKSGIIHSL

SEQ ID NO: 176386 - protein, 105 aa, Triticum aestivum
  Clone ID: PAT_TA_70804.pep
SACHTNWQEKADSCRHNVESLKFIFIHDHLKLSASPAQLLQAIQVAKRMPKPHTASCSLLLKIRFIPKSTSKSGHCWIQSKGTIQTIEPLFLISQINHSSAIFSV

SEQ ID NO: 176387 - protein, 55 aa, Triticum aestivum
  Clone ID: PAT_TA_70805.pep
GKIVIGEFPTGPSAMPSRCGGCACIVLLQGSTRELDIPSFFFVYAGEKKKKKKKK

SEQ ID NO: 176388 - protein, 73 aa, Triticum aestivum
  Clone ID: PAT_TA_70806.pep
RRATSLLVLGTTFDIEMEHPQCARLQAQHLYGLSLASLLHPCPSYGLTHWMHTTHTSMTGLPRLARLGLPCQR

SEQ ID NO: 176389 - protein, 62 aa, Triticum aestivum
  Clone ID: PAT_TA_70807.pep
FFFFFFFFFLETGQNKIYFSSNHVYILNGPCPSQPANTTSLQAIKHHRYKLTMKMFERRLYS

SEQ ID NO: 176390 - protein, 84 aa, Triticum aestivum
  Clone ID: PAT_TA_70808.pep
ATDQAQRGTVERTSSVMLSEVAHYLKSLITQRGRARVCMHGHSFWFALAGIFATAMYCVVWRLYLACRAVMPLSLNYVRLLVYS

SEQ ID NO: 176391 - protein, 82 aa, Triticum aestivum
  Clone ID: PAT_TA_70809.pep
MYWLALASSISWSVVMEQNHDRNTGNKKKTILPYQFNLQRRNKKCSSRATLVLNPNNHLAPWHRLDLGMLCSALLAAAASTN

SEQ ID NO: 176392 - protein, 76 aa, Triticum aestivum
  Clone ID: PAT_TA_70810.pep
FFFFFFFFFFFQKNKGFTFECVMTYSLGHTAQKKHSNAQKGNSCTNHQHLILSTHTIPGEEKGRKIFPPLYFTFTL

SEQ ID NO: 176393 - protein, 47 aa, Triticum aestivum
  Clone ID: PAT_TA_70811.pep
FFFFFFLFFRSNISPLYGLASCKILKTSNISSAIIRHIIYLSFYLLS

SEQ ID NO: 176394 - protein, 88 aa, Triticum aestivum
  Clone ID: PAT_TA_70812.pep
CTYVTLLRFYLRSSFSCGGQTNYPSHTLAPPSKFQLHLRVFSSHRQQTSSMRSSSQTSYCVQHHEEHGYTSCNNFLPPLYISTFIVVT

SEQ ID NO: 176395 - protein, 56 aa, Triticum aestivum
  Clone ID: PAT_TA_70813.pep
LFSHSVVGFCLQARGFPHVNGVCKQANELSRNEPPISCSISYVLSFLIGLKMYHGH

SEQ ID NO: 176396 - protein, 62 aa, Triticum aestivum
  Clone ID: PAT_TA_70814.pep
EREVAFLKAIADETRKEMHSTRRVLAGEQSRTFQLQVEVFHLKQGLQTAEGRSVTPRKPHNP

SEQ ID NO: 176397 - protein, 59 aa, Triticum aestivum
  Clone ID: PAT_TA_70815.pep
PRAAGFGRGGGGVRVSPVLNVTSIGTSVVNMLSHLLCDCGEKAGKQQSRGFGVRCWVTR

SEQ ID NO: 176398 - protein, 60 aa, Triticum aestivum
  Clone ID: PAT_TA_70816.pep
QNTIEHGDANQAASSSQLARHWPRTFYLLVLLDHSTILMADSMLIHHTSMGHRLDSKIKC

SEQ ID NO: 176399 - protein, 82 aa, Triticum aestivum
  Clone ID: PAT_TA_70817.pep
SRTTTPAPTRRRPRFRSDGLKHLGDVADGGFDPVQRDKCLLLTDYAYTKVQRYWINRYYVQLRQQISCSPCLLISYSDSRPN

SEQ ID NO: 176400 - protein, 106 aa, Triticum aestivum
  Clone ID: PAT_TA_70818.pep
KKNAYGECLRAENQMLRLQLVRKTKELEAEQIRRLELELHFMKKENEFLKKQLEELKAENEYYKKTAKPQKTRRLCRFCKEYVDHDFRNCPERHASACSEEDDGSI

SEQ ID NO: 176401 - protein, 74 aa, Triticum aestivum
  Clone ID: PAT_TA_70819.pep
LAAKTKINILKQVRFVTANKRYQAGGNLHYNQNQIAFAFTQVLLSKKLANTHIALVQILFAPMLLPHLPPGVVT

SEQ ID NO: 176402 - protein, 139 aa, Triticum aestivum
  Clone ID: PAT_TA_70820.pep
GPPSCRAKRLVVASQVRDSLISDDFPDDLLHYFDSYGGPDLLYELRFLNARQRIVATKHTIERRLESKGVRELARSMKDFPQRRGDEGWDAFDRHSAGDCLAYARFRLSREAIANEDRIPELERSLDVVETESARARVE

SEQ ID NO: 176403 - protein, 64 aa, Triticum aestivum
  Clone ID: PAT_TA_70821.pep
PKEDTKTNRAQTALPQTRTRRRARGALIITDAPSPEKGRQPQVGSPLILASPHRGLCAPPLWLW

SEQ ID NO: 176404 - protein, 148 aa, Triticum aestivum
  Clone ID: PAT_TA_70822.pep
DIRPENVIRVSNGSRQPHFVLIGWGHAILEDRDRPLMNLFFSSTFALQEGKLCAASDAESLIYLLYFSCGGVCPELDSVEGALQWREASWSRRVIQQKLGDVAAVLKAFADYVDSLCGTPYPMDYEIWLRRFRRTINEDHGKEVDTSS

SEQ ID NO: 176405 - protein, 46 aa, Triticum aestivum
  Clone ID: PAT_TA_70823.pep
SNDTLFWFTFLYRLLYAEFMRLHCTIKLCSMLSNIQNCHYIFNVVD

SEQ ID NO: 176406 - protein, 79 aa, Triticum aestivum
  Clone ID: PAT_TA_70824.pep
NKSCMLIQVQIQTSILSGRETSKQVYLAHCRSESGWHLNLISFANGAVGEWNRLSSITKNMIAKQRSCCELQCLSGCYL

SEQ ID NO: 176407 - protein, 107 aa, Triticum aestivum
  Clone ID: PAT_TA_70825.pep
KFIEQLSQHKKLSYRVVYPMELKLSSASDDVDCEYSLFAVVVHVGNAANHGHYVSQIKSGDHWLSFDDDSVDKIQESTLQTFYGSSREYFGNSDHGYILFYESVAKS

SEQ ID NO: 176408 - protein, 56 aa, Triticum aestivum
  Clone ID: PAT_TA_70826.pep
LRVNCAHPGFVKTDMSMGSGVLTPEEGARNLVKVALLPDGGPTGAYFAMGEEAPFV

SEQ ID NO: 176409 - protein, 80 aa, Triticum aestivum
  Clone ID: PAT_TA_70827.pep
SNLTSTMVPWGAVAKQVPLYWSSKHPYSMWVEHGNTGRETQYSSHCHSCDKSRSHHTTWERSNQGGIKPSSIHLRGAALP

SEQ ID NO: 176410 - protein, 51 aa, Triticum aestivum
  Clone ID: PAT_TA_70828.pep
HSFHLGLNRYLGFTYHSLETTPIDHSNHARFLQSIRLYSNQNDTAAHSLRI

SEQ ID NO: 176411 - protein, 55 aa, Triticum aestivum
  unsure (1)..(55): unsure at all Xaa locations
  Clone ID: PAT_TA_70829.pep
DISXGLDNITKSSQEYISLHRNYGTSSTILTCTYMHVCLLDRRMHHFSSLASMHR

SEQ ID NO: 176412 - protein, 66 aa, Triticum aestivum
  Clone ID: PAT_TA_70830.pep
FFFFFFLPVQNYYVYFEITIDKSKILISLYYKGRMTLHEHSYHLIVVIIVIPAVEEPPDGAHNRPA

SEQ ID NO: 176413 - protein, 67 aa, Triticum aestivum
  Clone ID: PAT_TA_70831.pep
CNFGSSSSLNLIPSPFAKKKVLSSLYNCFVHCFSSINSSLLAKGLFYMMMYISPSFQLLKCICARVV

SEQ ID NO: 176414 - protein, 29 aa, Triticum aestivum
  Clone ID: PAT_TA_70832.pep
YDYLFDPDEADDCKVPCLCQNADCRKFMN

SEQ ID NO: 176415 - protein, 67 aa, Triticum aestivum
  Clone ID: PAT_TA_70833.pep
YLIYVVIISQDEPRVLGHTTPCPYCPTEEFSREETNEIFAEKQETVEFYNTSRLRLCAPSQPYNITA

SEQ ID NO: 176416 - protein, 84 aa, Triticum aestivum
  Clone ID: PAT_TA_70834.pep
MKLRVKGFGLLLLLVLLALCSTIDVCDARRGKHWRPRSSPSSSLLKKKGKAKKGSSHRPPPAPPGVGKGHQTPYQPSPNVPVSP

SEQ ID NO: 176417 - protein, 77 aa, Triticum aestivum
  Clone ID: PAT_TA_70835.pep
IFLQPSSARKLTTYLIIQLGMRISHSHGRRKHTCYKEQHLIYVYDETKLIIYHGHQPRRGEEERSKQTVRILQEINR

SEQ ID NO: 176418 - protein, 84 aa, Triticum aestivum
  Clone ID: PAT_TA_70836.pep
TELHNDESSASSSSCFASTPLSFSTLLTPEKTNNGSGVRSRPNYMSLTESIKAKRKPCGAQKTTASKQLDDRKAPGAELKAAKA

SEQ ID NO: 176419 - protein, 121 aa, Triticum aestivum
  Clone ID: PAT_TA_70837.pep
RATTSLHFFCLFYVDDLRIASGDAGMLGRISSKGTPAPQRTKLRSGVDERRLRSAPSRDLAWMNAGSAAHQVEIWRGERRLRSALLRSEDKAMSMARKKIIPRRKEHSNFNLEGRKSSRLL

SEQ ID NO: 176420 - protein, 132 aa, Triticum aestivum
  Clone ID: PAT_TA_70838.pep
RLEGSFSLDYVQTYEINLSSSGDAKEDGRTVSMAIRAIQESMLSHHFGPDIVDALFHKYTQLVTESMEREEVKSVQIGVVLTQVVTRVCLLTVFSLASLGLTLFYCHIQYCLVVVIGSKKSHFSLKKKKKKK

SEQ ID NO: 176421 - protein, 90 aa, Triticum aestivum
  Clone ID: PAT_TA_70839.pep
EDPRKIMTSVKCRQGMSVSEVAPWLLEERGPPARIHQHIVAPPVRIGKRFSISRATCYLLHLNVIHADAPTKDIIGTKWNLLVVPKKKKK

SEQ ID NO: 176422 - protein, 83 aa, Triticum aestivum
  Clone ID: PAT_TA_70840.pep
FVLSCTAFPWHLVRLYFFKMLALNTFAQRGLDTLEKTVLFCWRHLAGVQALKSENYPSFLVTFSCLLFKIWLIFRPKKKKKKK

SEQ ID NO: 176423 - protein, 45 aa, Triticum aestivum
  Clone ID: PAT_TA_70841.pep
SGSHLHLFLDIFRVIVDRPHTKPCKLTRYFVHQKETRNAALFCNQ

SEQ ID NO: 176424 - protein, 40 aa, Triticum aestivum
  Clone ID: PAT_TA_70842.pep
FFFFFFFFFSATFSNCLTILKHKLHHLFGSNPGGYNIPYP

SEQ ID NO: 176425 - protein, 64 aa, Triticum aestivum
  unsure (1)..(64): unsure at all Xaa locations
  Clone ID: PAT_TA_70843.pep
CRSSGCCSRTWWPTPSASSPRQTASASRAGXWPSDHSTTPMSNPNPNHDQSRALQLEYLSLTGK

SEQ ID NO: 176426 - protein, 147 aa, Triticum aestivum
  Clone ID: PAT_TA_70844.pep
PREVVKDIRTPVFVLNPAYDAWQVQHVLAPEASDPQHSWQDCRLDISKCSPEQLQILQGFREELHDAMREIKQKKDWGIFIDSCFIHCQTLNSVTWHSPSSPRVNNKTMAEAVGDWFFDRREVKELDCKYPCNPTCHNLVFSKPFKG

SEQ ID NO: 176427 - protein, 108 aa, Triticum aestivum
  Clone ID: PAT_TA_70845.pep
KRRSAREAKKIKSVDGPTPAMSPVSLLHWTGGGGVERELESLPAQPLAQATNVHFGHRPDLKRMLLGIHDENVGVMASGPSGMLEEVATICSSGLASNLHFQSISFTW

SEQ ID NO: 176428 - protein, 68 aa, Triticum aestivum
  Clone ID: PAT_TA_70846.pep
IMCNSARESDLAKPSATNQAHIFISATESASKLNQNMICIQIASIIRIWGKVGRGSPRYEVRRMQPSL

SEQ ID NO: 176429 - protein, 49 aa, Triticum aestivum
  Clone ID: PAT_TA_70847.pep
WRDTSSSSRLWQIFAVKEGKKCYTYVNAVLFMFFLGNCSLRNIPTPSIY

SEQ ID NO: 176430 - protein, 70 aa, Triticum aestivum
  Clone ID: PAT_TA_70848.pep
KYINDNFEHSNSIILQMRYVILSNRLRALVFCCFHLFRSEQAVDHLWSIAAPELDLIFWSCSCSAPFDGS

SEQ ID NO: 176431 - protein, 101 aa, Triticum aestivum
  Clone ID: PAT_TA_70849.pep
VFFLCPSPLHLLHLDFFLGCGISPLSGEVVLLWHWDLQMLQNLLLLVIPSYDALSQALLICQRFRSCLVPLIQNFMLHDILSSSHTSPSSLPVGICHIVVI

SEQ ID NO: 176432 - protein, 97 aa, Triticum aestivum
  unsure (1)..(97): unsure at all Xaa locations
  Clone ID: PAT_TA_70850.pep
RALPTVRYAADGGEASEADECAICLAEFEDGQHMRVLPQCSHAFHAACVDAWXRSHSSCPSCRRVLVAELPRGERSGRCGARPGGLDALLKAVPLCR

SEQ ID NO: 176433 - protein, 79 aa, Triticum aestivum
  Clone ID: PAT_TA_70851.pep
DYRFLYKLYVLLNKRTTLLPIVQEKKVWCFPKILPPKIIYFVLAIQFELLKRHIYYGTEGVYKKQKCFFSKKFCIRERN

SEQ ID NO: 176434 - protein, 75 aa, Triticum aestivum
  Clone ID: PAT_TA_70852.pep
IQLQCCEYTTQYDAGCSKHLQVLNLGQIQEPLVQLTPEPHVSPEASAGSVTVAVAAVKLAHGGVAVANVAGRRGK

SEQ ID NO: 176435 - protein, 150 aa, Triticum aestivum
  Clone ID: PAT_TA_70853.pep
FFFFFLFSRCSRLQFNTLSARSPARAIPTTRQGEQGKGEKRNHASSSDVPVSSPPSRRWAWTPLPASCARPPPLSAWRLGPAPPGPPSQPPERRGTVKSVRRNHRNGAGSSNQPVQRDVPARLLAGPAAPRLEADGGIEPSTRRSVHGWV

SEQ ID NO: 176436 - protein, 154 aa, Triticum aestivum
  unsure (1)..(154): unsure at all Xaa locations
  Clone ID: PAT_TA_70854.pep
TDRLSTSSVFSEGXSFSICSPKSKKTGAETKDELLTSLLSRKEAPMTFSSGSLLASXXGVPPQLPTSGSSADQQGASSFSLQYVQRMLEESLGSVHKSIHEDVRNLHIELLRQFHMQEMETSGVMNLVLEKLEGLTKEVQQLRRENQQLRHQLL

SEQ ID NO: 176437 - protein, 86 aa, Triticum aestivum
  Clone ID: PAT_TA_70855.pep
LPYRRWCGPLEAAITTHQSPLLVSASSPSLVASDKHQHLIASDKHQHLRPASPSLFAILHMISFIFPRCILNPGKMKNIFSIFRFL

SEQ ID NO: 176438 - protein, 88 aa, Triticum aestivum
  Clone ID: PAT_TA_70856.pep
NHSPHHIRIAAVLLLVDLSAGSWIMIAQPFLPHRNLGRLYRPPPRPPLGLLLPAGRRKRPTPTPCKQRQMTVRPWRASAPTEFPALMN

SEQ ID NO: 176439 - protein, 86 aa, Triticum aestivum
  Clone ID: PAT_TA_70857.pep
RGRRICWRRGGEAAGEEGEKLLERRGRSSDPAARGGVGGKLKLVRALSPPASNCWRPDSVSRPSLPAQSSVSRLNSPALSKASSFA

SEQ ID NO: 176440 - protein, 141 aa, Triticum aestivum
  Clone ID: PAT_TA_70858.pep
NFYAAPKGSPSEAGTAPTLFFVECSNVDEDENVLRCFVVDPSTDDGRCYHCEYRGTRLVHPSSGTYHGCDAEFEEIASDGYGLTIDELIYHGMRRSEFMGWLPEEDSIYFDPRWDVKFAHYINDAAKPGRTPVQSNGLIAP

SEQ ID NO: 176441 - protein, 49 aa, Triticum aestivum
  Clone ID: PAT_TA_70859.pep
NPTYPQVYKNTMVQKWAKILINSPPKKTYLGSSGFNKCKHGLCVLTKLP

SEQ ID NO: 176442 - protein, 156 aa, Triticum aestivum
  unsure (1)..(156): unsure at all Xaa locations
  Clone ID: PAT_TA_70860.pep
PNDMPKIGYLKMXVKETLRLHPPATXLLPREAMRDXXIGGYDVPAKTRIYVXAWAIGRDPMSWPDDPEEFKPDRFEASEIDFKGANFELIPFGAGRRMCPALSMSVATVEFTLANLLCCFEWALPDGTMVSVEEQGXLSPLLKTPLVLVPTPHGRV

SEQ ID NO: 176443 - protein, 109 aa, Triticum aestivum
  Clone ID: PAT_TA_70861.pep
FHYYHWLLLLIVSSWAIPCTLGPAKASCMSCRTSHACMHAGMRCPACFQRRSWQGKRRVLSCHVDRTGGRQGLPAGQSLQPTGVVLRLASLSYGSGVSYVKLLPAVQRW

SEQ ID NO: 176444 - protein, 79 aa, Triticum aestivum
  unsure (1)..(79): unsure at all Xaa locations
  Clone ID: PAT_TA_70862.pep
AYIRISTNSTKTSTIDPRSSGTPLSVHFPSTFLTLKSGLXSWLGWMNFGSTCDQRIQNLQPSHIITTCTSHASTTQENK

SEQ ID NO: 176445 - protein, 67 aa, Triticum aestivum
  Clone ID: PAT_TA_70863.pep
EIEQKNGQMRGIKFHATNCKEIWSVIHHKRYILHGQPIITNIRVMYCTVHFQLLIQYLQSKKNCMNE

SEQ ID NO: 176446 - protein, 65 aa, Triticum aestivum
  Clone ID: PAT_TA_70864.pep
SKCTHKFKRYSPFFLWTNILIFLFVSGKTREKHDYSLLGILNNNVRLLFLVQAKKKKKKKKKKKK

SEQ ID NO: 176447 - protein, 141 aa, Triticum aestivum
  Clone ID: PAT_TA_70865.pep
RYIFDSGFIASSLLMTATLLGPSFLKSTNTQSSEWPRLPDLAASSSGPGRSRPSTTRPSSLRFPPQWRLYRGTDALLRPWRVSRLDKAHQTLPSSFQFLARDSFARDATVCGRRDQVIEMLSSLVQQEELWREQDNAPFLC

SEQ ID NO: 176448 - protein, 168 aa, Triticum aestivum
  unsure (1)..(168): unsure at all Xaa locations
  Clone ID: PAT_TA_70866.pep
VIAGVDDDAEGTNSAFPNSDFAPNTKHSPTFPESGFSPPDSLSTNSSDDENDGRPESVRRQVRVPLEVEDEDDDEMGEMVGPSSIGMMDSDDEDEAIINESLGYSNLSGPGRYNNFRRARAVSSNYEEEQNDSSDGEDDGLVEILVPGRKSSTSNXRGSLYIHFPSMG

SEQ ID NO: 176449 - protein, 81 aa, Triticum aestivum
  Clone ID: PAT_TA_70867.pep
GSGGIQGLNLQLQMDHLVMASVNHFGGLDCEVDFVAKLLSWAPALEELKIDWKGEMECSMVLAKLLALPRASTRAKVIVTF

SEQ ID NO: 176450 - protein, 69 aa, Triticum aestivum
  Clone ID: PAT_TA_70868.pep
KICINESKNNVHIYKACQLLPLWVGSKRNKMLVTYSCKNLGDRCHKGSNKVLACFCKKKKKKKKKKKKK

SEQ ID NO: 176451 - protein, 101 aa, Triticum aestivum
  Clone ID: PAT_TA_70869.pep
TQLKSPSEDGDGWTVYDVMTLRNVPFGDYFRVHLRYDVRSVASSEPPSCRCEVLVGIEWLKSSKFQKRIARNICDKLAHRAKEVLEVAGKEIASAMSGSAS

SEQ ID NO: 176452 - protein, 99 aa, Triticum aestivum
  Clone ID: PAT_TA_70870.pep
LITPRILVGQMREMAGYNLPERWHDKWIKMRAGDHATAEEAGPNLQEWLEEVYFYHPQSPDLTREDVARLGQFIGTLLQFEPSARASAGQVLDDPWFKE

SEQ ID NO: 176453 - protein, 110 aa, Triticum aestivum
  unsure (1)..(110): unsure at all Xaa locations
  Clone ID: PAT_TA_70871.pep
SPQAEYYIVESYGGFDPCSXGVTQLGTVASDGSDYTLCTDTRTNQPSITGTSTFTQYWSVRQNKRTSGTVTTSNHFEAWAKNGFGNSDFNYQVLAVEAFSGSGSASMTVS

SEQ ID NO: 176454 - protein, 106 aa, Triticum aestivum
  Clone ID: PAT_TA_70872.pep
KAAGAAQYTMDTARAGTEQTGSYIEQTAEAAKQKAGAAAQYAMDTAVAGKDKTGSLLVQAGETVKGAAVGAKDAVMNTIGMGGGTNGSTDVPAKDTSTYKPGTRDY

SEQ ID NO: 176455 - protein, 79 aa, Triticum aestivum
  Clone ID: PAT_TA_70873.pep
ANIPIHHAEACACDCSKFKGWLKSGEAGCLLDGSLIRQQVYIMCSAVIMCPVFRYLVCSSVSPNISELLMSGGIASARF

SEQ ID NO: 176456 - protein, 74 aa, Triticum aestivum
  Clone ID: PAT_TA_70874.pep
PGTLSASISDLFIEQLDFSLTSRQLLFCIVQHLMRSDNRLACVNMRKKEGLGDLLQNQASKYCILENVCRYQPV

SEQ ID NO: 176457 - protein, 144 aa, Triticum aestivum
  Clone ID: PAT_TA_70875.pep
APCRCRGLLNDTGVDGLRVQVGNGSGSPGRGGPLCSPLKFILQLAESLFCSSLAGIVHGQRLRAVQAIACVQCGECVRFGDAKYLHSRYVNTWGSVHFIRATATNHPADFLGKSVRSSTVIGVVVCGFFVCLSNVSSWYKMYFV

SEQ ID NO: 176458 - protein, 101 aa, Triticum aestivum
  Clone ID: PAT_TA_70876.pep
MAGHGGEMNVDTLAGLDAPERRRKLGRPTSSREKAPYEELSKRTRYCSICRGKGHKKTTCPERGDLPKKPRKEAKCSNCGVAGHRRNTCTNAEAVKLQACP

SEQ ID NO: 176459 - protein, 127 aa, Triticum aestivum
  Clone ID: PAT_TA_70877.pep
IVEMVYDSGTIFEPKILDIKPEDLRVKFMEGVSRLAAVCLSIGYPTVASVPHSVVNGFKNLLAVAAVTDVEFKEATTVKEFLKDPSKFAAVAVAAAPAAESPKAAKKEEKKEESEEEDDDMGFGLFD

SEQ ID NO: 176460 - protein, 67 aa, Triticum aestivum
  Clone ID: PAT_TA_70878.pep
TYVYPAVLDHKYKIVCTNSITNPNNKFCFLYNTIGSVCRQKSSKLCAEPSMNFAKAAPWVEKLSATN

SEQ ID NO: 176461 - protein, 66 aa, Triticum aestivum
  Clone ID: PAT_TA_70879.pep
KHDTVLKPQDDTVSQFNIHPNNRICIHVHYSFLAELELKPIQYRGLQYRHPNAALSLLHSPRGIYT

SEQ ID NO: 176462 - protein, 88 aa, Triticum aestivum
  Clone ID: PAT_TA_70880.pep
IKAMDVKEKIAMNSQIKCTIKSKGREPGLNQNNNISLLSPRCHTAQLRYRKRVMDRDLTTQNKIKSQKTNHSFPGSVTVHIFASKPAR

SEQ ID NO: 176463 - protein, 41 aa, Triticum aestivum
  Clone ID: PAT_TA_70881.pep
RTEASLCQAAGRWLVLEAAEAVGGEPALVGAALVLLPGELP

SEQ ID NO: 176464 - protein, 48 aa, Triticum aestivum
  Clone ID: PAT_TA_70882.pep
FSFHSIKVPIKIININANDEKIHIFRLVEKNVVNNGKIKAISTSKIME

SEQ ID NO: 176465 - protein, 94 aa, Triticum aestivum
  Clone ID: PAT_TA_70883.pep
RSSAVTEKTKFKRNKKGKLAFKRHLDVHLHSHLAAKAGTRPLSGMFQAEAYSSKNNDVLGEIFTDLFSGPSMKMKKFLRPIMAHYRHLRDMDDE

SEQ ID NO: 176466 - protein, 94 aa, Triticum aestivum
  Clone ID: PAT_TA_70884.pep
FFFFFFFFFLSRPNTWNDMLTTGIEEAHLHFRLSGCQIFSFCISSSFSLTKDCISSSLPSRVSTIFNALAASARNLQFSSSLFHTSTCSTSTFC

SEQ ID NO: 176467 - protein, 65 aa, Triticum aestivum
  Clone ID: PAT_TA_70885.pep
FFFFFFFSTLKNFNCLIPTNHKQHDMTNHKRVGLRLHSRYISLPDKNSKCTWLPKYGPSSFDHYI

SEQ ID NO: 176468 - protein, 124 aa, Triticum aestivum
  Clone ID: PAT_TA_70886.pep
DMKNMSNPCQMGVSKQKYNKRVCIHYTEPTFLFAAKVVNYNPRNSLGQTQKLPGKNELHPPPLMLMMKNDLQSSSQRSSNFFNWSAGYSVLLGMLDKICCNAFPEVWDATLIEMLHDNTIKVFE

SEQ ID NO: 176469 - protein, 162 aa, Triticum aestivum
  Clone ID: PAT_TA_70887.pep
VTRISFVNDLLEVESFLKMRLHEMKSGGNDLLSLAQLQNAESFLQVQTTDSVQKMLTTVQTMITKINDPTLYHLHNIRHSPRYVDNLAVTLKQKLSLVDKSIALQGRVREKRVEHGELARDLRPKLDLVISKTKVLQSQIEEDISKKYKGRPVNIMGGVNTL

SEQ ID NO: 176470 - protein, 111 aa, Triticum aestivum
  Clone ID: PAT_TA_70888.pep
LWERKSNYDGVVEWVLLQKNFQLERLYQKGMRSKLQEEYLVGYEADLVGYDEESNALVLAMDFGVFMLELDSMQFRTLSKSSRWGTKIHYPYRNFFTAGKGVGWRRAVLDL

SEQ ID NO: 176471 - protein, 55 aa, Triticum aestivum
  Clone ID: PAT_TA_70889.pep
FFAVLLRVGRLFLGLCTRWMVGVEQTRCTLDHCRCSSWFDQSRKEKGNQQEVVFF

SEQ ID NO: 176472 - protein, 90 aa, Triticum aestivum
  Clone ID: PAT_TA_70890.pep
SFRRFRPGPKNKKERIKTKAYPQTNNRSNTSDGSGQDPDSRDSLGLISVWCSSYRWRQCALALLLEASTQAAASTRPDDGNTASPTRPPP

SEQ ID NO: 176473 - protein, 72 aa, Triticum aestivum
  Clone ID: PAT_TA_70891.pep
ENPSIFTRPSQLVCSTETGSNTTKFDLTEYTHTHTYHISVSWVAPSFLVLARHLTEVYEISIHKLLSNLHGC

SEQ ID NO: 176474 - protein, 122 aa, Triticum aestivum
  Clone ID: PAT_TA_70892.pep
PRTWPCPARGRGTHLGTGPVPQQGVCSSASKAIKLPCLSSTIQARPRPRTAPSRVTGSHVAILFVPSPDWSSDESAMLSFSCKVVLYHTCRARYTCRACKVLYYTWSYVLAWIEYCCCQCIM

SEQ ID NO: 176475 - protein, 116 aa, Triticum aestivum
  unsure (1)..(116): unsure at all Xaa locations
  Clone ID: PAT_TA_70893.pep
DGVRLKKYRGMGSLEAMNRKDAKGAAMDRYFHNEMDKLKVAQGVSGAIVDKGSVRSFLXPYLACGIRHGCQDIGSRSLSALRSMMYSGELKLERRSNSAQAEGNVHSLFSYEKRLF

SEQ ID NO: 176476 - protein, 127 aa, Triticum aestivum
  unsure (1)..(127): unsure at all Xaa locations
  Clone ID: PAT_TA_70894.pep
TAYVMFMSQLLGGPEDVALLSRHGVIEHHLGDDAEVCALFRGLAQGLVFDPSGGHYLSTVGVRLRSHHRSRLXNRWRAWVMRHRFRNPWLAVAWVLGSMAVLGTIVQTVITLLPYVHHQGRTRNIGS

SEQ ID NO: 176477 - protein, 182 aa, Triticum aestivum
  unsure (1)..(182): unsure at all Xaa locations
  Clone ID: PAT_TA_70895.pep
RFVALQTWISPLKGRNCSQEERDHLRSMIRTEDPPLNIACPSEEQMLFITASLXHVGKPDIYEGTIQGGGAVPAWCGQEKMQGLRFSTSSTSSCPSTAGFVTQAALRLYYGRPACGSGGTADLPKLLFFVLSRYFVCFVAVIGKLATPSEVSLLLLDLFHFPLGLSSWCACNIKKKKKKKKK

SEQ ID NO: 176478 - protein, 99 aa, Triticum aestivum
  Clone ID: PAT_TA_70896.pep
SVVCARARAVTRPRFTCKMWVNLETPPAVVANCGKEDMVLVDMHMRSSSSPGAVVAAGEPTFLTVPPMYLVPAAGDRASMEVPLYIRIDKLSPWSDALV

SEQ ID NO: 176479 - protein, 73 aa, Triticum aestivum
  Clone ID: PAT_TA_70897.pep
ISVNDASDIDRHKLKVSNNKQLIPDNNFIVYQCAMKISEVCQKDYSQPARPQYHCHPFSYFKKKLHAHKHARA

SEQ ID NO: 176480 - protein, 69 aa, Triticum aestivum
  Clone ID: PAT_TA_70898.pep
LKQENKLGPSFCFPERSVCHTSVLLLAWGIFFQALNFGVPSLFDTGNGFMQFFLAMGVKSLVFSLCVSI

SEQ ID NO: 176481 - protein, 91 aa, Triticum aestivum
  Clone ID: PAT_TA_70899.pep
VMKCDPTRSSTSFQLISFSFNYLFHSKLTVLHTYIFQCKTTRGLWSMGYQAPLNNLHRFFWRIMCICMVYNGVYKIDSLTPKKKKKKKKKK

SEQ ID NO: 176482 - protein, 87 aa, Triticum aestivum
  Clone ID: PAT_TA_70900.pep
FFFFFFFDPNILQAFFFHLLITLRCSWGKNILRAILGPGQNFRPVPPYPPNATSPGRWVYKKKKRFAPNIISLLTHLPLAQVSVFNR

SEQ ID NO: 176483 - protein, 59 aa, Triticum aestivum
  Clone ID: PAT_TA_70901.pep
PVKCQRQVSDQSTSKVLRKVLFFEYIFTLHSRVCVFQINLCEHRTAHLLFDSPTYGLMI

SEQ ID NO: 176484 - protein, 72 aa, Triticum aestivum
  Clone ID: PAT_TA_70902.pep
LNTGAGDLGRGYKLLKHLASISRRVFYKALHHNVKSPKQWPLHHSSVHLGFGYGLLSAAFLIRSISFLSRCR

SEQ ID NO: 176485 - protein, 86 aa, Triticum aestivum
  Clone ID: PAT_TA_70903.pep
DNMERLTSLKRLEIVYCDNIRSLPTLPQSLVKFILIDCDYEFMEFCQTVGHPYWQKIEHIPEKIFNVNFNPFPDSDDSQETNASPS

SEQ ID NO: 176486 - protein, 73 aa, Triticum aestivum
  Clone ID: PAT_TA_70904.pep
HPGRHPRDHGSPEKLAPPPKMEAVVAAADLTVVMPGQRYPTFLAQPAPLLLPCTREGVRWPPHDDHRRPFLPP

SEQ ID NO: 176487 - protein, 56 aa, Triticum aestivum
  Clone ID: PAT_TA_70905.pep
PHHLSRTWQLALGSPSLPVWRCGVNTKYVSNSRKYVVLASFKVNHWSVFLKKKKKK

SEQ ID NO: 176488 - protein, 112 aa, Triticum aestivum
  Clone ID: PAT_TA_70906.pep
THCGMNSVLEAVFAGVPMLTLPIGMDQPTNSRLVVDVWKIGYSLKEKMQPDGIITREAIARAVETLMSSSDLPQSNGVRSRALLWRDASRSAIQEGGSSSTDLNSFLRCMIS

SEQ ID NO: 176489 - protein, 77 aa, Triticum aestivum
  Clone ID: PAT_TA_70907.pep
FFFFFFFFFGKNHRPQKHFSSFRGPKPSGKTWKFKVHHLNNYLNRQLNTSYFPKVKFQPPRPKAGTQVHSKVYIHTT

SEQ ID NO: 176490 - protein, 61 aa, Triticum aestivum
  Clone ID: PAT_TA_70908.pep
CRDNMCQGHGCVETTGMTMSMMLRRPWRWRPDRADDGAMACLKAAAARIPCEGGVAWCAQH

SEQ ID NO: 176491 - protein, 84 aa, Triticum aestivum
  Clone ID: PAT_TA_70909.pep
SKFDTTTHHTTCMSVSLFRTATKLERSRSAPEVQYVVLSIILLRPARDPAHLSKWAILRYSAATMLLGLGVGFIFHSDSAARTY

SEQ ID NO: 176492 - protein, 77 aa, Triticum aestivum
  Clone ID: PAT_TA_70910.pep
ITHHLPEQWLLYTFARTMEIRTRFVYCLCFGRNYSCGPVDELPWRLGRNSGPLGSGCEGCRLLKKWAFFCSSRYTGS

SEQ ID NO: 176493 - protein, 40 aa, Triticum aestivum
  Clone ID: PAT_TA_70911.pep
RARYHLVVIDMLVHPIARILPGRLFLRTIKGAINIFVGNV

SEQ ID NO: 176494 - protein, 68 aa, Triticum aestivum
  Clone ID: PAT_TA_70912.pep
ECRQKYSRNQPSKLTTKFTTPRWHIYHLLDMKQQNSNFYPLLSSSNLLCSRNHLISISRPVKLHTNIL

SEQ ID NO: 176495 - protein, 115 aa, Triticum aestivum
  Clone ID: PAT_TA_70913.pep
SAATTTRAPPTTSRSTGSAGAPTGGRSSTRDRGLLKKMMFDEPPASLIRPITDHMATVSCWERLHALRSTTLHGCARSGCWDKFWSVCLGIEFMMMMLNDPLHTASSLEPVLALH

SEQ ID NO: 176496 - protein, 98 aa, Triticum aestivum
  Clone ID: PAT_TA_70914.pep
RLLLLDPHNENCGMVPRVSEHLFLRIQKEKEERRGKILSFTRRCSFLEICNGQILDLLNPNPTNLQDNRHSFHPSCTSWRMEAPYFMSRTNRYSACCS

SEQ ID NO: 176497 - protein, 60 aa, Triticum aestivum
  Clone ID: PAT_TA_70915.pep
FFFFFVGANFYFYSFTSGPLQLHDSITKRNILKIPTIKDGAEGCPQTARPTHRRKQSCTL

SEQ ID NO: 176498 - protein, 90 aa, Triticum aestivum
  Clone ID: PAT_TA_70916.pep
FFFFFFFFTETTALLMLADYISLILHRHTRPSSTLGAAEQYVHYLMNMTRVSITRTTRQRKTTKWKLHSTGTPAWTRPRRKMRSDANQLA

SEQ ID NO: 176499 - protein, 74 aa, Triticum aestivum
  Clone ID: PAT_TA_70917.pep
RVIPPIVLKKNSQHLGYKTKCPQRHNFCSWIGRPFLRFLVFCLDLQSRLIPYLSWMTLCDGTGWVPDLDLCACC

SEQ ID NO: 176500 - protein, 79 aa, Triticum aestivum
  Clone ID: PAT_TA_70918.pep
LCGGLAKAQLDRPGANHLGLDVGDDGFLPSGNVASATNLVGGVLDPLGTPTVLAQLVLAHVGKVGFLLKLRFLFQLSPI

SEQ ID NO: 176501 - protein, 61 aa, Triticum aestivum
  unsure (1)..(61): unsure at all Xaa locations
  Clone ID: PAT_TA_70919.pep
LNQPSNHIXMSGHAQEIYEGRYIDHWTIFFSPKISTTAISSSREDTCIERVILAHKVYLAS

SEQ ID NO: 176502 - protein, 134 aa, Triticum aestivum
  Clone ID: PAT_TA_70920.pep
TDGGRPVLIEAMSYRVSHHSTSDDSFAYRARVEVEDWKRRDNPIIRLRKWLENQGLWNEDKEKETRDQMRKAVLKEFGEAEREKKPPLREAFKDVYEEITEEQREQMNELKRILETYPDEYDLRPYKDGAKGLD

SEQ ID NO: 176503 - protein, 28 aa, Triticum aestivum
  Clone ID: PAT_TA_70921.pep
TSTNSYMGKLVGTYVLYVNSVIICISLL

SEQ ID NO: 176504 - protein, 82 aa, Triticum aestivum
  Clone ID: PAT_TA_70922.pep
VKTAMTLCQANEVRTEARLMLHLTGVAVEESESGDDDFMPSKKAHNRSKGCESSKNGRLSKSVASLKGADADYVSKKKKKKK

SEQ ID NO: 176505 - protein, 35 aa, Triticum aestivum
  Clone ID: PAT_TA_70923.pep
FFFFFFFNLISVPIIGCISKIYCVEYQTITKTLKL

SEQ ID NO: 176506 - protein, 92 aa, Triticum aestivum
  Clone ID: PAT_TA_70924.pep
QHFNAFTLVCDMGVAVPLKVDRKRDNFVEAAELERAVRSLMGGGEEGRKAKEKAMEMMVVCRKAVDHGGSSCASVKRLSEDLLGGAVVLPNV

SEQ ID NO: 176507 - protein, 86 aa, Triticum aestivum
  Clone ID: PAT_TA_70925.pep
QLASWGDGVWPWWVVTVVRGCPPEIFVQTDRVILIFILCPFLQFILGYRSSFQWFWCIPPWEKKTMKFVWWALGVPPLEKKKKKKK

SEQ ID NO: 176508 - protein, 70 aa, Triticum aestivum
  Clone ID: PAT_TA_70926.pep
AAHDITFSSLFLFFMVSPKCTSSQHQQQITAVKIYNDYTASSSSEDQNTNFTGEIGPQLASCILFGWPVA

SEQ ID NO: 176509 - protein, 101 aa, Triticum aestivum
  Clone ID: PAT_TA_70927.pep
SGGGTGSSTSACQCTFKRKSMCWPWMNKGHQVDSCYQPRSSRRFLGSNLHCTNRPLHAPRRGRQRLPAAGRRPLPGRRRPGGRPRLAAGRGGGGGGKHLVP

SEQ ID NO: 176510 - protein, 77 aa, Triticum aestivum
  Clone ID: PAT_TA_70928.pep
IPNPTLCAPHKQSSQQQPSFLDWKFLGGHYSIKKFTTKCTGKRKNYTPRFILSSCASFAASLFGAASASPISTSAIE

SEQ ID NO: 176511 - protein, 80 aa, Triticum aestivum
  Clone ID: PAT_TA_70929.pep
NNDSLAKTPAARPFFILSSQPPQSRPITRRTVPRVLLLPLPLRQVDSHHLAPLRQADDHHKPNQSAARPPPVLPLLGGWR

SEQ ID NO: 176512 - protein, 137 aa, Triticum aestivum
  Clone ID: PAT_TA_70930.pep
NGSERRFFPETRWRGTWGRGDEDGAGPFWQAVPRGRGLGGVFWNKPRRVWSGSLGVTDSPGMGGTQWFPRACRAHRARRLRAGRAGRSSMACVRLCLVCVLVACSQMATGLFATGAGKQPDFEVVRAGKKKKKKKKK

SEQ ID NO: 176513 - protein, 105 aa, Triticum aestivum
  Clone ID: PAT_TA_70931.pep
LAVRSEGYIGNNMVEESVCCCLHGGCYLLNLRPPWIEIIEAVVNKDIAYFLPEDIHCPLFVCFPVEQYFIGKSVNAKALLWRQSFNDFWRMLAMFSNITLCGCSP

SEQ ID NO: 176514 - protein, 76 aa, Triticum aestivum
  unsure (1)..(76): unsure at all Xaa locations
  Clone ID: PAT_TA_70932.pep
NNKELVNGQPIVYNYNSLCTLELLDVRVCHKAILSMQIFTGIGSAGAEFSCCCNSEIWMVRLIASXGELNSLLFQP

SEQ ID NO: 176515 - protein, 125 aa, Triticum aestivum
  Clone ID: PAT_TA_70933.pep
FFFFFFYFFFFFFTQKQTASLAFSFQHCHSAVPRNYTGGMGWDGNRSHHLMCPQKKSILVCLLHKKCLDGTQIITTLKLHLNKNEILPPKCSSNLLYTERPCRPKYLLSAAETEAARTLLPRRGR

SEQ ID NO: 176516 - protein, 103 aa, Triticum aestivum
  Clone ID: PAT_TA_70934.pep
MDIGSIVPVESIGSHAIFIGHHRCLAVDTDKFPSVESNCVYYVERLGSSAYICMYNLKDEKDERISAGAVDFVKLHELFIFAAHRPFTIIQLFSSYSINARDS

SEQ ID NO: 176517 - protein, 50 aa, Triticum aestivum
  Clone ID: PAT_TA_70935.pep
LPLGWLPPAPSWHPPVHSAPSSPPCAPPRRRPAAPWPPPSPPPRRRPAAS

SEQ ID NO: 176518 - protein, 78 aa, Triticum aestivum
  Clone ID: PAT_TA_70936.pep
TLPKTGDISGREAKCMLRRKTTCACICIKHESIKIYLLWIGSGPLGILLLLLRYASSPACPPPGFCTGELFVLTLPPG

SEQ ID NO: 176519 - protein, 61 aa, Triticum aestivum
  Clone ID: PAT_TA_70937.pep
AHTSSVVKFYISSQMNLYIYIRGKQTSCSMGLVMLVRRKGVLNRARLYSSTLAAQDREGHV

SEQ ID NO: 176520 - protein, 63 aa, Triticum aestivum
  Clone ID: PAT_TA_70938.pep
VKILVGYTTENLKTMVCCLNKVVHSTIENGTSSSQKSEIVKKENLTSIATRRVVQKNYKFETK

SEQ ID NO: 176521 - protein, 95 aa, Triticum aestivum
  Clone ID: PAT_TA_70939.pep
RNESGETATQNLSKHSLHIYRIYVVRNRHSDSKQSEEELLSFSVPCDISMKREEEPWAKSFLARVNGKLERCSQVWASVRLEIEVFQSQSGVIVL

SEQ ID NO: 176522 - protein, 129 aa, Triticum aestivum
  Clone ID: PAT_TA_70940.pep
LQVCRKAELIDAGYEELIVKTNKVWLHKVDMEAEELVEINSLHHNVLFLGRNQPICLSAEEYPQLKANCVYFADDEQYNWMYKTNPRDIGVLNLEDASREEIVSPLWCSCPSPIWITPSFTVMNQSMYK

SEQ ID NO: 176523 - protein, 91 aa, Triticum aestivum
  Clone ID: PAT_TA_70941.pep
QLLPHFGGNLAMANRVHGHSAEVLLVFTGLVLGLPLLSCPARSVNEQSRELTSSEGYSERHLFTGLERRGQTTFYHADDLNVADAKLPIGR

SEQ ID NO: 176524 - protein, 68 aa, Triticum aestivum
  Clone ID: PAT_TA_70942.pep
IWCSDCFARMEQQNMLEIRVHKVQNYCNLRQVSESCILQGARFPVFLCLATFYIFLMVLLVNQVKRAS

SEQ ID NO: 176525 - protein, 109 aa, Triticum aestivum
  Clone ID: PAT_TA_70943.pep
RVNAFRIELVASSYEDLLSSAVASVACDASVGNAVYILPSFYNHDCDPNTHIVWLENADAKLTTLRDIDEGEELRICYIDASMDVNARQKILTEGFGFQCRCQRCLSGD

SEQ ID NO: 176526 - protein, 65 aa, Triticum aestivum
  Clone ID: PAT_TA_70944.pep
VITRASAGVGGIPCTTSIIPSPKPCDNNSCNQACIDRVWVGGYGECVAGACKCQQCTYIPPKNGN

SEQ ID NO: 176527 - protein, 122 aa, Triticum aestivum
  Clone ID: PAT_TA_70945.pep
NAVTDSCRSSTRVQHTAFSRPTLWIVSQLMESGSFRQTYLCALLDEKSPAMVQNKEIREFAADSSSEPNEISYFWCMRLFVSVLVPWNTPRRSRQGCKIRRSHQGRGFLCCSIEEKSFLIPG

SEQ ID NO: 176528 - protein, 74 aa, Triticum aestivum
  unsure (1)..(74): unsure at all Xaa locations
  Clone ID: PAT_TA_70946.pep
VAGGWAHEQRTLHGXVGGREKAASMELGHMAEETKRRAEITRLRAVHTLKGKVENAAMLKGIDLDDINNQHYTV

SEQ ID NO: 176529 - protein, 156 aa, Triticum aestivum
  Clone ID: PAT_TA_70947.pep
IQPEPPKQLIAIFRNLTSMLLLRIFSECDLSWTLFILEAAPALYDMTLSRHSCTKTPKDSAEKTNVVWEPSKDLKHLNLKVLRIFGCEEEGKVTNYIRLVMERAVGLLKIKLYGESPCRSTHTWIILIRGDNYLLTDMVRECSGLIMLAGLQQLEQ

SEQ ID NO: 176530 - protein, 134 aa, Triticum aestivum
  Clone ID: PAT_TA_70948.pep
PPAPIERKTVSGDDIMPSGHQVQAGDTIFISLHSMGRMEGLWGKDCLDYNPDRWLSDDGNNLKYVPSHKFLAFNSGSRMCLGKDIAIMQMKTGVATMLWNFDVQAVEGQSIQPKPSCILEVKNGLMVKLKKREM

SEQ ID NO: 176531 - protein, 27 aa, Triticum aestivum
  Clone ID: PAT_TA_70949.pep
MQLNAATLHFILFSNNLGLHSLRLSSF

SEQ ID NO: 176532 - protein, 55 aa, Triticum aestivum
  Clone ID: PAT_TA_70950.pep
MSFDMVLLPRMEEYRHLALCMNIREHYREKHTYRGLSKTILYDLRTALSNTLLLS

SEQ ID NO: 176533 - protein, 80 aa, Triticum aestivum
  Clone ID: PAT_TA_70951.pep
ACQLHGNEAAAKRAAERVLALEKEDPSMYLLLSRTLAGRHDWGGAGRSRGLMGDREVMKLPGSTWLQSMPEIESAQACTA

SEQ ID NO: 176534 - protein, 52 aa, Triticum aestivum
  Clone ID: PAT_TA_70952.pep
DLAREIFTLQLCQYDVNMPAVYCASVVILFPTNINEHCRTLILMDKGDASTR

SEQ ID NO: 176535 - protein, 67 aa, Triticum aestivum
  Clone ID: PAT_TA_70953.pep
MTLDGILSIPITTMCLTPGMKVVILLIKDTNTIIRYLGSCTWTHCTFILLGSFCLHLCMHVSWIADP

SEQ ID NO: 176536 - protein, 133 aa, Triticum aestivum
  unsure (1)..(133): unsure at all Xaa locations
  Clone ID: PAT_TA_70954.pep
TSMTSIFSMLLTLKFSDGCGCSSSSIECHVNFQKQKESXVRDRSLVLQELKCTAERQSRAGQQSILERESLPRAETSIHAFVTNIIRYDAEDLKVADPKGSWMNSGSSTSSNLAKRLVEGASGYSASTKKLKC

SEQ ID NO: 176537 - protein, 144 aa, Triticum aestivum
  unsure (1)..(144): unsure at all Xaa locations
  Clone ID: PAT_TA_70955.pep
PIKGSENRAADAPLSRLHEPDELNAITSCQPQWLTDIVAGYSKDTFTQNXLSELAVLSTHKNSKYSLHNGVIRYRGRVWVGANFXMKKNILQALHASGIGAHSGITATYHRIKALFAWTGIFQSVESFVNKCQICQQAKVEEKN

SEQ ID NO: 176538 - protein, 106 aa, Triticum aestivum
  Clone ID: PAT_TA_70956.pep
VLQGIVWKSLLKKSPYSVGTIKSRQASNQVSRQTSSNKINSTKVADHVNRIIKGRMQRINMGCTWASNVLVQMIFIKNLKHLNFPFMKELSIKYRHSTSKTPQPRP

SEQ ID NO: 176539 - protein, 139 aa, Triticum aestivum
  Clone ID: PAT_TA_70957.pep
ENWCNPPLKHFDLSKPMFLRLVTDFHVGIIPVQYRRVPCAKKGGIRIEMTGNQYWVGVLVFNVAGPGEVKVLAVKGAKDGQWRNMKRNWGQIWDGHVQNLVGQGLSFRVVASDGRSVVLDGVVPASWTIGQSFEGKGQF

SEQ ID NO: 176540 - protein, 124 aa, Triticum aestivum
  Clone ID: PAT_TA_70958.pep
RFGRALPDHPLKKPEILDIFYNGLTDASRDYLDSCAGSLFRERTPDEAEILLNNMLTNENNWAPPEPSPAPITEPILKPTPKKRGVLFLSPEICKRQRNLRKKKVLKLKTLRIYLLLKKYMVLI

SEQ ID NO: 176541 - protein, 207 aa, Triticum aestivum
  Clone ID: PAT_TA_70959.pep
SDEHNRSAARNQAIPPMADKKGSTSRQRRATGEATGGFSLRPCTTTKQHMAAATGGKGDLSLRPCTSIKHHIVVEDAAADAPEDEVTGGKVPLKACPAKRKSAGVCEALNMFPAQAAASSGRRRAVDWAGRPTLAVDLVEDEAELRRRIKATLLTFPESKALTAQQMELAIDRIVEESKPEAASVAAPGMGRMSDFDIRFFLSLPMV

SEQ ID NO: 176542 - protein, 129 aa, Triticum aestivum
  Clone ID: PAT_TA_70960.pep
KITLETCVVPRGMEATIDLDFVEVPADGFLVRMRGNTVLSQGSYSFIDEHCRDTVGFIPSSGKHIQKFVAAVNLGDTLRIDFMEEGQDALSFVASKHGEEEQMYRFSNGALVSVRVVWSTILSVDDYEE

SEQ ID NO: 176543 - protein, 201 aa, Triticum aestivum
  unsure (1)..(201): unsure at all Xaa locations
  Clone ID: PAT_TA_70961.pep
ARAEGKIVAWNAAEGDRLAKGDPVVVVESDKADMDVETFHNGFLAAVLVPAGESAPVGSAIALLAESEEEIPLARSQAANFSSSAAASPPAPQETVAQEASPAPPPPPPPGPVAVSAPAPPSPATQGGXRVVASPYAKKLAKELSVDLFAVTGSGQXGGRVVAKDVEAAAAAPKKAAPVPAARQDVPLGSTVPFTTMQGAV

SEQ ID NO: 176544 - protein, 147 aa, Triticum aestivum; identical to SEQ ID NO: 158562
  Clone ID: PAT_TA_70962.pep

SEQ ID NO: 176545 - protein, 139 aa, Triticum aestivum
  Clone ID: PAT_TA_70963.pep
LPFLLLCRLDRLLTLRLLLLLTLPFGRWLLLLLLRPWLLLAGGGVRFLRRTVVREGGSMRRDGPEDATKGARRRHHLLLHPWFLLLLLERWLLLANGVVKLLRGAAEREGDIGSRERQVGDEVGLAGARRQHRLSCRIR

SEQ ID NO: 176546 - protein, 49 aa, Triticum aestivum
  unsure (1)..(49): unsure at all Xaa locations
  Clone ID: PAT_TA_70964.pep
VLLLERYSKXWADDSLHIKLAQVFAATSLXSDALSHYQSALRINPHNEA

SEQ ID NO: 176547 - protein, 177 aa, Triticum aestivum
  Clone ID: PAT_TA_70965.pep
VLSASLKPPPSLAALSPSSRAPAPPAASFPAPRRSCLRLSAAAASEGATVSQEDAASVSAAFEEARLAQFAADWKAVRADKDQGKILTLPVLRSNTGGLILKYNSMQGFVPNPLLSPAHWSKDPKRPIQDVTKDLVGSSVSVKVVEANEAEKKLVFSEKDASWSMYSSQVKIGGTYD

SEQ ID NO: 176548 - protein, 62 aa, Triticum aestivum
  unsure (1)..(62): unsure at all Xaa locations
  Clone ID: PAT_TA_70966.pep
PVRAPQDVAGDGHAAGXAGPWLARARESCTCMLPPPSTLPSLSAAAALLALLPSIYWLAVGG

SEQ ID NO: 176549 - protein, 46 aa, Triticum aestivum
  Clone ID: PAT_TA_70967.pep
ACCDHTCVTCIYAYRTSSARSSCVVLCATYMDKNKGNHFRLLKKKK

SEQ ID NO: 176550 - protein, 35 aa, Triticum aestivum
  Clone ID: PAT_TA_70968.pep
VLSFYGSAREPSPKIPSSLNFCGPNPWLLSSKLAV

SEQ ID NO: 176551 - protein, 121 aa, Triticum aestivum
  Clone ID: PAT_TA_70969.pep
IRPSRGTTWSSCERDFPPLPSPPAALPRRPIPWARPGLGVSTAMLRLSCRRSTCGAAERPDNRSFRFAAADQLSSFSRPQRENLQVAVCASKAVVQPQQGPELTPPVGSCDEPGRRTPSST

SEQ ID NO: 176552 - protein, 33 aa, Triticum aestivum
  Clone ID: PAT_TA_70970.pep
FVRFLRGPDPIVGWHELDGHGRIASDARGALGW

SEQ ID NO: 176553 - protein, 73 aa, Triticum aestivum
  Clone ID: PAT_TA_70971.pep
ASSSMSKESTSYDMADFDQTAIFLYLDGHDPQSIQEQRQTLNIFPSQPMHAAEPLNPTAKINGGAVMAAMLAN

SEQ ID NO: 176554 - protein, 100 aa, Triticum aestivum
  Clone ID: PAT_TA_70972.pep
SRYCSTSPFLEEYPLAEKSLVNIESDDRMVSSAPFSCSPEQRHSIAMRRTKFLNLPLSFLPSILLYHISPHLSTQLPFLLPKPKGNLARRRLRQRTRPAA

SEQ ID NO: 176555 - protein, 40 aa, Triticum aestivum
  Clone ID: PAT_TA_70973.pep
ATLEQEKFKDMLKVSKGFGEIVEISLMNISNYQLNSSKFE

SEQ ID NO: 176556 - protein, 73 aa, Triticum aestivum
  Clone ID: PAT_TA_70974.pep
SLSGTAPPARPAAPLSAPSARSPAPPSWAMASGRAVPADGEWKGTGGWRLRRGGRRSPWLARKDGYGSSSCRI

SEQ ID NO: 176557 - protein, 68 aa, Triticum aestivum
  Clone ID: PAT_TA_70975.pep
EEGQLIPTPGPHERVVFLPHFLRGLGFPLHPFVRGLMFYYGLDFHDLAPNFVLNISAFIVVCEASCRI

SEQ ID NO: 176558 - protein, 61 aa, Triticum aestivum
  Clone ID: PAT_TA_70976.pep
TTPNQDPLVTKGSNLHPLLGIDVWEHAYYLQYKNVRPDYLTNIWKVVNWKYAGEEYEKVLA

SEQ ID NO: 176559 - protein, 71 aa, Triticum aestivum
  Clone ID: PAT_TA_70977.pep
KQNLELFVPQREPQRAMVCKIALMIFFCIYPQQPRLNIVCLIAPQCLIFCYPFSFSLFLQLSQASQLFLSS

SEQ ID NO: 176560 - protein, 73 aa, Triticum aestivum
  Clone ID: PAT_TA_70978.pep
KPVTLASARHRGTARLGPLLPRGSTRRGDRGSTDRRPASDVEPRGVLRDHVLGVPAVLRGAGDVRGAHVGAHP

SEQ ID NO: 176561 - protein, 88 aa, Triticum aestivum
  Clone ID: PAT_TA_70979.pep
NKTPRLGDLRVQSADYVDKVLIKNCKMQNRKDDAVEKADGALDESVRALGAVATKSKAEGGVVAPRSLGVRECKMDMKEELLFVMLVC

SEQ ID NO: 176562 - protein, 111 aa, Triticum aestivum
  Clone ID: PAT_TA_70980.pep
KKVTSPELGKLMVDKDSNSSVSSDSGVVQFSANRDLEVDKGDYMDIEKDAGDDSSALCGMRTDSESHRCSSRTPEPAGSPHRCINMLQGCRGVDEFERLNTINEGTYGIVS

SEQ ID NO: 176563 - protein, 83 aa, Triticum aestivum
  Clone ID: PAT_TA_70981.pep
WRPSRCSCSSSWWPRRPRSSAPTPTQTTTTDPLRPPPPRAPTPPPRTRRRRRRPCAPPPLHPPPTRKAITTRRRRRRPRRRWR

SEQ ID NO: 176564 - protein, 43 aa, Triticum aestivum
  Clone ID: PAT_TA_70982.pep
GETIKECENELGDVRGAEALLRENEGLRILANLNRALVAPYDV

SEQ ID NO: 176565 - protein, 85 aa, Triticum aestivum
  unsure (1)..(85): unsure at all Xaa locations
  Clone ID: PAT_TA_70983.pep
SNLGIEPHSVELTPAGDLLLLDSMNSNLYRVQLPLSRYSRPKLVAGSLEGLSGHVDGRLREAKLNHPKGFTVXDRGNIYVAHAMN

SEQ ID NO: 176566 - protein, 91 aa, Triticum aestivum
  Clone ID: PAT_TA_70984.pep
ESRLNKPDYQLYSRYFHSDNTNRSWSVKGNKNKIEKRKNDYLSDFHGVDTTFIRGTYTVGSFTTDCLLKRYDAKEKILSSLLLMKTWRHPN

SEQ ID NO: 176567 - protein, 65 aa, Triticum aestivum
  Clone ID: PAT_TA_70985.pep
IPASPYSRTTSTRGLPPTSPPPPPDASHGISRIATPSRKRLMRDFKRNDAVPSCGHKRGCRGQQH

SEQ ID NO: 176568 - protein, 191 aa, Triticum aestivum
  unsure (1)..(191): unsure at all Xaa locations
  Clone ID: PAT_TA_70986.pep
RFGRGRHSFSSLPPRVHPRSKSPPRFHHHTNPSQSPLLPLSLSIGIHPVQPTSPLLLLCSPKGSRELPPPCHLPRLSTPASSARISPEQAHPDPVAAGEQRQQPRRLPSRPLPWSSPPXQHRPRAPPSPTSPRPTSPHHPRLLXPRACPRTRLLWFPRPSRPVPATPRRPPASSASSEPRGVCAVHSCIPL

SEQ ID NO: 176569 - protein, 172 aa, Triticum aestivum
  Clone ID: PAT_TA_70987.pep
GYVERLGHGGFESSWRKDAMDWICKVHSYYNFGPLTLCLSVNYMDRFLSSFDLPHDKSWMQQLMSVACLSLAVKMEETVAPLPVDLQVCDEYYAFEPRNIKRMELIVMETLKWRMHSVTPFSFLCYFLDKFNEGKPPSYMLVSRCAELIVATVKDYRFLSFRPSEIAAAVVL

SEQ ID NO: 176570 - protein, 131 aa, Triticum aestivum
  Clone ID: PAT_TA_70988.pep
AAGVAVTDRLMEEQQRPMAADQISAPREGMGQLSWAKQSRVGGPCQDQRDRSRAKRGQGGEDTPGKVPPATTFFLLALVFSFPSRVIAAAAAIVPILARGLGLCVSNRPRIPNPSSSSTSLSYSPMPRQGV

SEQ ID NO: 176571 - protein, 93 aa, Triticum aestivum
  Clone ID: PAT_TA_70989.pep
MPSAMAACPRKRRHSMVVTSDHVMVVPYNSPWASSLHADLLLLVAWRLLDGDLMDYVRLRAVCKNWRYATICPRGRGITDSRFHPRRWMMLPE

SEQ ID NO: 176572 - protein, 57 aa, Triticum aestivum
  Clone ID: PAT_TA_70990.pep
SIRTRVRVIYKNKSSLYLLPLSLCLRVGGHPPFRKKNFCLRVLGVCHAMKFKFQIQP

SEQ ID NO: 176573 - protein, 85 aa, Triticum aestivum
  Clone ID: PAT_TA_70991.pep
MSWQTYVDDHLCCEIDGQHLTSAAILGHDGSVWAESPNFPKFKPEEIAGIVKDFEEPGHLAPTGLFLGGTKYMVIQGEPGVVIRG

SEQ ID NO: 176574 - protein, 48 aa, Triticum aestivum
  Clone ID: PAT_TA_70992.pep
DGTSLHDDRLAAFQCWKVRMAHCVILQCIHGNGILSMVSPPLARANNI

SEQ ID NO: 176575 - protein, 79 aa, Triticum aestivum
  Clone ID: PAT_TA_70993.pep
MEAEERRRRRRQGRGRRRRHDDAVDDATLVVEDGTVAASVVVVVERTHRRWPAAAVVAVGARRDGHARACVGSGVGPRA

SEQ ID NO: 176576 - protein, 73 aa, Triticum aestivum
  Clone ID: PAT_TA_70994.pep
GKNFKKELCSTKKFCSGKTEPPNIFLSLYSLPQILEQSKTSLHPILHVAGAILHVLYALSALDFCRTHSKPAN

SEQ ID NO: 176577 - protein, 77 aa, Triticum aestivum
  Clone ID: PAT_TA_70995.pep
HFIFLYFYSHINAFLVVLELLVVFTMNFCCIFFVYVKLHAIEGWTSFFAILKHVIGGRMSHNINSESCTVVQANFFL

SEQ ID NO: 176578 - protein, 135 aa, Triticum aestivum
  Clone ID: PAT_TA_70996.pep
RDDLRLARSVGGEGVMENSAAAVGVEKEDELVGAGGGDWGYLTSEAMATAGFPAFGFPCGARGGVTPAPTSASLLMSMEHAALFDYNAAFPSSSSSAAAAPPAYHDFGSGGNPFSVDAPPFLLEAPPPLTVAPGG

SEQ ID NO: 176579 - protein, 126 aa, Triticum aestivum
  Clone ID: PAT_TA_70997.pep
FGTRVHDFVFIKSGGRESHVAYVEDMYEDGSAKNMVLVRWFEEPDGEHGVALPPDLYCREIFFGYGLQDLRVEFVEGVAAVLNPQHFEMFKKINGGSSSWQPYVCRRCIDDGTVEPFDITQLQGYA

SEQ ID NO: 176580 - protein, 75 aa, Triticum aestivum
  Clone ID: PAT_TA_70998.pep
FPFGLVVGCVKLLSRHNFEVLGSVRWFIPPPFFGWNKPLPLFFIFYQSLMQCFVVCPKKKKKKKKKKKKKKKKKK

SEQ ID NO: 176581 - protein, 68 aa, Triticum aestivum
  Clone ID: PAT_TA_70999.pep
FFFFFFFFFLVEKHILYYKQLRDRSRPQHLNSQGEQRQTEELMQTPPMIPTKSGNILATSESLIPLGG

SEQ ID NO: 176582 - protein, 57 aa, Triticum aestivum
  Clone ID: PAT_TA_71000.pep
LSGALDGGLAFMAVLIYLCLELDNITLNWWGNASDGCPLASCPTAKGIIVDGCPVHN

SEQ ID NO: 176583 - protein, 74 aa, Triticum aestivum
  Clone ID: PAT_TA_71001.pep
MDRGRGRGGGGPPRSIDMGHAPVAREQVEIVQSLNGWVAENMLPLLNPVESSWQPHDFLPCSAAAPGASEEEAL

SEQ ID NO: 176584 - protein, 54 aa, Triticum aestivum
  Clone ID: PAT_TA_71002.pep
FFFFFFFKVPACWNTQTCHVHSTHRVPQHFSKLIHTDTDTDTNTHKHMHAQIIL

SEQ ID NO: 176585 - protein, 102 aa, Triticum aestivum
  Clone ID: PAT_TA_71003.pep
FFFFFFFRLAAPMHWPIIFHQMLNKQGNLTGWRNLFFLVLSLLSQICKYHVPIHSIWICSLSLSISHSHYQKCIRKHIEKNEVVFHTIWEQVCCIQCSCDPS

SEQ ID NO: 176586 - protein, 41 aa, Triticum aestivum
  Clone ID: PAT_TA_71004.pep
EGNMMKLSFMNKDVLELARILKVEVIVQQLIPAILQRVPVS

SEQ ID NO: 176587 - protein, 96 aa, Triticum aestivum
  unsure (1)..(96): unsure at all Xaa locations
  Clone ID: PAT_TA_71005.pep
KSMDLWFLPDSEKSIWVKKYNMPSHVXRLYRYPFQMLDDGTIFFSGLDGLQGLLGDGEQGEGFLLSYDPRNGTYGYALKLRGSKSIGIYTGSLLSL

SEQ ID NO: 176588 - protein, 67 aa, Triticum aestivum
  Clone ID: PAT_TA_71006.pep
WRLQPIEGNICASLWRAPPMKNQPCLFHHGLRPRSTSLTRVDSHEVGDLLALTNSLIQLHNILGAPK

SEQ ID NO: 176589 - protein, 67 aa, Triticum aestivum
  Clone ID: PAT_TA_71007.pep
KKHVAASNLPKKKNNLAQVAIIHSSKYDRNAQHRFTKNKNNKVHAGGSSTTSPLTVSGRLFTNIEAP

SEQ ID NO: 176590 - protein, 76 aa, Triticum aestivum
  Clone ID: PAT_TA_71008.pep
FFFFFFFFAEKSTQNNITSAGRKVHDSGLMLSTYQLSRSICTCVQATGPWPMFVNKESQYQSICLILLDRGCVDGF

SEQ ID NO: 176591 - protein, 107 aa, Triticum aestivum
  Clone ID: PAT_TA_71009.pep
YGKGRILDPPDERLGGEFDAQEMKRVMIVGLWCFQLDFKMRPPIRQAVNVLRSEAPLPSFPALMPVAYYMPPVATRSFTFLFVTSGSSSGNCKSWMAASARPPLSQD

SEQ ID NO: 176592 - protein, 92 aa, Triticum aestivum
  Clone ID: PAT_TA_71010.pep
IARSGEHRGSGRGRSRSTTARGVVLPPPEQSGGGRCRVRRGTGEGHAAWELAVSREQWKKRKDDVLGVCTCIALAFSDDCEAYGRGISECLL

SEQ ID NO: 176593 - protein, 55 aa, Triticum aestivum
  Clone ID: PAT_TA_71011.pep
IFSAFLGLPHLRKSFAFPLKILIFWWIVKLSLRDYSCQDQHLTFKSIEAFFIEEF

SEQ ID NO: 176594 - protein, 49 aa, Triticum aestivum
  Clone ID: PAT_TA_71012.pep
FFFFFFFFFFSTSLMYSSNSCIKVNIDGTFRHYWYNYLITERMQDELDY

SEQ ID NO: 176595 - protein, 63 aa, Triticum aestivum
  Clone ID: PAT_TA_71013.pep
IVMMLCLMSPRTRSSSKKHYGWRQLFCTIKVATLMQFSLAMVVDPVMLFITLCISSCVVPGML

SEQ ID NO: 176596 - protein, 46 aa, Triticum aestivum
  Clone ID: PAT_TA_71014.pep
PNQQDATSIDVLTASSFSLKGPTMEIPIRTQSLYRRLSTFDLAINH

SEQ ID NO: 176597 - protein, 64 aa, Triticum aestivum
  Clone ID: PAT_TA_71015.pep
VLFENQVIKHFDLWKTHVLGLEQVFLSHCAGGTVLFLSSLRTETSLKYNELEGQSEVSLDMLSA

SEQ ID NO: 176598 - protein, 98 aa, Triticum aestivum
  unsure (1)..(98): unsure at all Xaa locations
  Clone ID: PAT_TA_71016.pep
TLVQVYIKNLVLPRCAMXYHLQPELCGVTNPRDPTTLNLLEHHGEEEVAHKGSPKEIKEEPRKVESVWLGSGPSGVIRLCETDRNPTSLLLVHVCVYG

SEQ ID NO: 176599 - protein, 89 aa, Triticum aestivum
  Clone ID: PAT_TA_71017.pep
FFFFFFYCILLHPMLISGQQICTHTFMQEKTRSITLGIFLIQGKHMAYRSRQSQECVPSYYASLQLQNQLCSLSAGQLKMINNIEKNTP

SEQ ID NO: 176600 - protein, 56 aa, Triticum aestivum
  Clone ID: PAT_TA_71018.pep
NKNMLKAKDSLAMELTGRLSEIPDTVCTLIIFIYDWASMLLLGIRRSPVLGTISPS

SEQ ID NO: 176601 - protein, 65 aa, Triticum aestivum
  Clone ID: PAT_TA_71019.pep
INNLLHACNIERSLTLIFRGKHKVCMLQCSVIKHKCTSVRVLELYLAAQQSYHRVVKKKKKKKKK

SEQ ID NO: 176602 - protein, 55 aa, Triticum aestivum
  Clone ID: PAT_TA_71020.pep
NMSSVVYNFILSKKITKQYVFLPSPFLSVQILFYLELFEILGHFICWCSSLHLQE

SEQ ID NO: 176603 - protein, 99 aa, Triticum aestivum
  unsure (1)..(99): unsure at all Xaa locations
  Clone ID: PAT_TA_71021.pep
ASEKTPQWRTGPLGPKTLCNACGVRFKSGRLVPEYRPAASPTFLLTQHSNSHRKVMELRRQKELVXIRGSHRLDAAAAAGPGPGVTVKPELMFHDYGIC

SEQ ID NO: 176604 - protein, 73 aa, Triticum aestivum
  Clone ID: PAT_TA_71022.pep
FFFFFFFWVGESRSTLQVKETTNTREISSHEARKKAHAKSFTKMGFSKISSPSSFRCSPPLVPSEHPSSRPSS

SEQ ID NO: 176605 - protein, 47 aa, Triticum aestivum
  Clone ID: PAT_TA_71023.pep
SDRLFISFEDHPPFGRCSSLISTAERVSCASVDIDPLACSAKKKKKK

SEQ ID NO: 176606 - protein, 48 aa, Triticum aestivum
  Clone ID: PAT_TA_71024.pep
NLQGIRSFNFHYPNSIAKLITLRGLDTLEYSLSKSPSNIISIICQKKS

SEQ ID NO: 176607 - protein, 98 aa, Triticum aestivum
  Clone ID: PAT_TA_71025.pep
FLRRRPTDDMFKDGLSIVKLTEISFPDRVMEIVDPQLVQELELCQETPTALKEKGVRSLLSMLNVGLSCTKPSPHERTNMQEVVAKLHGIRDAYLRGN

SEQ ID NO: 176608 - protein, 64 aa, Triticum aestivum
  Clone ID: PAT_TA_71026.pep
LQVNKVINQLGYCGADYKGKDLPKTEKLQAKFTTPRGSTNKAPGEIAIKLPEVSPSQNSRAEAT

SEQ ID NO: 176609 - protein, 35 aa, Triticum aestivum
  Clone ID: PAT_TA_71027.pep
SFKLINYLNVYMCDLCTSRCSNSSTKKKKKKKKKK

SEQ ID NO: 176610 - protein, 67 aa, Triticum aestivum
  Clone ID: PAT_TA_71028.pep
TGGVISGRRNNSRLLLRIKLQVWLPYINGCVNVKVRFQITITSSVRFYKSFPTTENGVLCTLFKKKK

SEQ ID NO: 176611 - protein, 46 aa, Triticum aestivum
  Clone ID: PAT_TA_71029.pep
SNILHIRFTTTKNTAKYQNITIYKSITSSNELELNASSLFILELAT

SEQ ID NO: 176612 - protein, 66 aa, Triticum aestivum
  unsure (1)..(66): unsure at all Xaa locations
  Clone ID: PAT_TA_71030.pep
GLFCKTANSGINRKFVLWKKNETGQIWSAQQCTWSRAANIGLRPSQGRGLAXRAPLGLAAGPVGGP

SEQ ID NO: 176613 - protein, 38 aa, Triticum aestivum
  Clone ID: PAT_TA_71031.pep
IATPASKGLKPYFVKKKNSTSFSPHGSYPTTTFQPKSV

SEQ ID NO: 176614 - protein, 84 aa, Triticum aestivum
  unsure (1)..(84): unsure at all Xaa locations
  Clone ID: PAT_TA_71032.pep
PHGDRTAKRGSRAEEEEEEKRKKRRTGCLLFSPAAAGRVSTGRACYYRLASGSRAXMQPWPRARRALTPWPSRPPPSPCSSALP

SEQ ID NO: 176615 - protein, 82 aa, Triticum aestivum
  Clone ID: PAT_TA_71033.pep
FGSRSCRNYTPVFQPYVQPCLKPYCFLSSQQMADKHIICLVILSLSFLLLLLLTMASTRPALSEIQSEPLPTQIAKRVVNKQ

SEQ ID NO: 176616 - protein, 40 aa, Triticum aestivum
  Clone ID: PAT_TA_71034.pep
DQAWSLVEPDRGQITGGLTVSWSEADTLYYCSLYVFTCRM

SEQ ID NO: 176617 - protein, 39 aa, Triticum aestivum
  Clone ID: PAT_TA_71035.pep
FICIPRSHYDDLSSRLKSSSSSSFVIFIFHDLIELVRHL

SEQ ID NO: 176618 - protein, 97 aa, Triticum aestivum
  Clone ID: PAT_TA_71036.pep
AGADYQLPPENPLIYSQPPWQQTVHYNNNNGYVNNDTIDVPQLPEAHVDDYGMNGDRYNGMKRKRSSGSLYCSQLQLPADQYSGMLIHPFLSQQLHM

SEQ ID NO: 176619 - protein, 53 aa, Triticum aestivum
  Clone ID: PAT_TA_71037.pep
FFFFFFFFFFFFFFFLQLPIDSHIILSNRTKQHPTSQRVEGKFKNVDSFNQTS

SEQ ID NO: 176620 - protein, 40 aa, Triticum aestivum
  Clone ID: PAT_TA_71038.pep
FFFFFFFGSPRETLRRENEPIEFCCPFIEIYRKMKLIIKT

SEQ ID NO: 176621 - protein, 67 aa, Triticum aestivum
  Clone ID: PAT_TA_71039.pep
FFFPPNQTLTRINKNNNCPSLVPNSIFTKLDSGELGGKTFAGPARGRDHTSRWLLSITHINQGRVKC

SEQ ID NO: 176622 - protein, 57 aa, Triticum aestivum
  Clone ID: PAT_TA_71040.pep
HITGAAFSSQGFNSACQQPALGKRMHDLFIRAFDAHIQIIHYQQINTAQDSTPFQPK

SEQ ID NO: 176623 - protein, 47 aa, Triticum aestivum
  Clone ID: PAT_TA_71041.pep
FFFFFFFFFVISVIVEFNVPLQQQSAIRSNCADHSDHTRAATNTTPV

SEQ ID NO: 176624 - protein, 88 aa, Triticum aestivum
  unsure (1)..(88): unsure at all Xaa locations
  Clone ID: PAT_TA_71042.pep
SAVRTMNSVPPQQPAGRRGGPCRALPPTDLQXGCSVNAVVVGRFWQSPVVTTEPYTTPSFPVYRSYLKILVFLFYNAQFGCSHHMFKF

SEQ ID NO: 176625 - protein, 30 aa, Triticum aestivum
  Clone ID: PAT_TA_71043.pep
DLTIYMESNISGLLPWTHIIFCIMTYESHE

SEQ ID NO: 176626 - protein, 93 aa, Triticum aestivum
  Clone ID: PAT_TA_71044.pep
RATIRLQPGGGMQFLGGGGFFSTGEKFGPLRGKKSWCVMGNDDLFYCLFGTAFTVNAILKIFCPAGVGKGNKFFVNCFSKKKKKKKKKKKKKK

SEQ ID NO: 176627 - protein, 74 aa, Triticum aestivum
  unsure (1)..(74): unsure at all Xaa locations
  Clone ID: PAT_TA_71045.pep
PYVGKNPRQGYAKYRDIDLGRKEVVKEISTFCSGKVWGGKXFKGKFQRVGFSKGKVDPQDYFRKGQGIPPLFGK

SEQ ID NO: 176628 - protein, 47 aa, Triticum aestivum
  Clone ID: PAT_TA_71046.pep
FASTPILLDNHNNKAMQSAKPLSAPRLLLNPKHTAAPTFCFIIFNSG

SEQ ID NO: 176629 - protein, 60 aa, Triticum aestivum
  Clone ID: PAT_TA_71047.pep
FFPFFPSPPQGPSKPRFISSHTHPTNLSVQTSDAGTALPLNSAQLKMVCTAFMPQSFTLH

SEQ ID NO: 176630 - protein, 106 aa, Triticum aestivum
  Clone ID: PAT_TA_71048.pep
GHAHEEQLVARRRGRRGRAHVPDGATDVPGASSSSIRGWGCVHGSSSAHPHRQALPLVRRIGLIRSSTQGSSWLLILEFQLKLSIWVMFIRRCSSSLMVVLPSSEL

SEQ ID NO: 176631 - protein, 40 aa, Triticum aestivum
  Clone ID: PAT_TA_71049.pep
SEDAAQVLTVLPIAIGVVGSMLFVTFPTTRHGIGFPLSQH

SEQ ID NO: 176632 - protein, 81 aa, Triticum aestivum
  Clone ID: PAT_TA_71050.pep
RMPIEPAAVVWRSLLSACHLFGNVEIGTYAAEMALLADPMDSGPSVLMSNIYASKGLWSDAQKLRQGMDCAGVVKEAGYSW

SEQ ID NO: 176633 - protein, 84 aa, Triticum aestivum
  Clone ID: PAT_TA_71051.pep
ASPIVSVQPMPPADPYANLWKRINALTIPAKDKLEIVAYLSKPDQDIFRSYLNYADETILREWVISYFEPQFHEGGNDGSAAAH

SEQ ID NO: 176634 - protein, 88 aa, Triticum aestivum
  unsure (1)..(88): unsure at all Xaa locations
  Clone ID: PAT_TA_71052.pep
PGAQFRVAEVYDFFTGILQNPSXYGFVKAARGCCGTGLYEMGYTCSEWDALTCADANRYVFWDAVHPTERANKIIAEYLMNTTFSHFL

SEQ ID NO: 176635 - protein, 62 aa, Triticum aestivum
  Clone ID: PAT_TA_71053.pep
MLGLLWNFRMVEMGNLSPLCCCVNFQLYVDTRRLFYLRTKPLFIYDGLAHVFKKKKKKKKKK

SEQ ID NO: 176636 - protein, 109 aa, Triticum aestivum
  Clone ID: PAT_TA_71054.pep
KGEGCSKKDAYIHTYIHTYIQSGMPRLNCVWYCHIRPQDFVILFYLGSRDQTVSCEISSSTPSKQVLAMPIASCRNIFCVCRRIVLYVFCLYKDSARFALKKKKKKKKK

SEQ ID NO: 176637 - protein, 74 aa, Triticum aestivum
  unsure (1)..(74): unsure at all Xaa locations
  Clone ID: PAT_TA_71055.pep
ARCTLKRSPIWTETLKHHTGFAEPQLLEPAKVLVMAHAAAPECKLKAIYKKYSSEQYGRVSXRPPAVAAPQRLA

SEQ ID NO: 176638 - protein, 111 aa, Triticum aestivum
  Clone ID: PAT_TA_71056.pep
GTHVEQVNGHTSVAMHAEHKHKEINRQAEHIAIHTSTRKPYHGMKGGALPVSNLFLPAGECCSIVVILFSISFCFVLSFRSIMFKTRLVFMLFNGLTHLIGDFVTVELKLL

SEQ ID NO: 176639 - protein, 92 aa, Triticum aestivum
  Clone ID: PAT_TA_71057.pep
TVPVLLHNLLLQSPISDQAVHVCFTFYVSSCKMWMIQSPPMMLCGVNFLYLILVVVCELTLHMSNWFRGAPVCECSFCSLEKDYWLVLQKNG

SEQ ID NO: 176640 - protein, 56 aa, Triticum aestivum
  Clone ID: PAT_TA_71058.pep
FFFFFLVGKHIITCQQSSALSILLWSQRLFREHGYSLKVLGVELSCQAIYNGCASF

SEQ ID NO: 176641 - protein, 71 aa, Triticum aestivum
  Clone ID: PAT_TA_71059.pep
FFFFFLISTTPGTKFTIDIEVTVNKLFKIYNEQHDLASCSKIETICNTKLVTIPPIQRQWKSLPFSPLWDF

SEQ ID NO: 176642 - protein, 77 aa, Triticum aestivum
  Clone ID: PAT_TA_71060.pep
KHVRIEQSFSCVHLQEVSIECEEKLRVKDKVNQIVKIMTRNGVLTENISFKKIPRPEVYHLVCVSPRAFDPYWSGED

SEQ ID NO: 176643 - protein, 106 aa, Triticum aestivum
  unsure (1)..(106): unsure at all Xaa locations
  Clone ID: PAT_TA_71061.pep
EIGRDKNAWTDPDAFRPERFLXGGEGEGVGLVPGPKRKEIKMMPFGAGQRACPGGGLATMHVKSFVAALVREFEWEPPARGGVDLTELDGFFKVMKSPLRARVTPR

SEQ ID NO: 176644 - protein, 85 aa, Triticum aestivum
  Clone ID: PAT_TA_71062.pep
HCSTRRSTFGTVLTMSSLLPLMGKFSRCDNLPSLRSSPRDLLHGQPPSFTTPDWPLHEPAKINAHTNQIVGDERRNRRRDVYASV

SEQ ID NO: 176645 - protein, 134 aa, Triticum aestivum
  Clone ID: PAT_TA_71063.pep
VFIVDDIQDVDLEETQTGESHADGKGKRLGRYVDGNNKKPKTSLVIQEQITRVGDIAERTQSSFESYMKKEESSSITSVMDLVVECGAIVGSDEYFIASELFVKREQREMFLHMTESAARLDWLRRKYNSKYGH

SEQ ID NO: 176646 - protein, 112 aa, Triticum aestivum
  Clone ID: PAT_TA_71064.pep
EDHDMMPAVPSGLSLDEIIEVSCDLDSDSPPSLRPPPPPLPTPAYDEPQALAHINGEVSPVHGATDDNMHDAPRRVELRDLVPLKWDDELAKLEQQCAKLQSKIDEKLFIYF

SEQ ID NO: 176647 - protein, 112 aa, Triticum aestivum
  Clone ID: PAT_TA_71065.pep
SHNCRQGIITPALFYISHAWSKCRPAAGRLGCRNLEAHVGVETISIRVASNTIVMPVSISDHTIRGQSSFMEILSSLAVEIAVGSLVNLAECTCSTNILALNRNIRTIISRT

SEQ ID NO: 176648 - protein, 145 aa, Triticum aestivum
  Clone ID: PAT_TA_71066.pep
RNIQRWAAQEHNTKFHNSLQADTEKFSFAHQIHHTGLIFPPMFSSHLVVLVLHWCTCSSGELRRPRPSRLFRNIPTIGPADAQILQSCQLTQTFIWHLLLACCRPPHRNNRIRAGHSQWHDLSSPAFPAHCSMHFDSSTFGLPFP

SEQ ID NO: 176649 - protein, 61 aa, Triticum aestivum
  Clone ID: PAT_TA_71067.pep
VNKIVKFSFIPIVHMIVRDNKINGDVTNYNFPTVKYSILSWLPLVALLQILSCRLKKMNLS

SEQ ID NO: 176650 - protein, 90 aa, Triticum aestivum
  Clone ID: PAT_TA_71068.pep
TIEILVSFGSSRFCPKWHMREVVEARSCESPDGNGPMLPIGTLVQPIISRPMGLLGWLHKKIGSRELSPSAHRDKRVDSILVAQDCSLPL

SEQ ID NO: 176651 - protein, 95 aa, Triticum aestivum
  Clone ID: PAT_TA_71069.pep
VHQHEHPLAHSSTRRRVESRAKKFTLGTKASAGRAFLMLSNRPQERWRRTRTGTVRRQTRMMPLTMASRQPRKMERPRPMGMPTVHLQLARWRRR

SEQ ID NO: 176652 - protein, 63 aa, Triticum aestivum
  Clone ID: PAT_TA_71070.pep
RLRTGFHVNKRNVSLSTLSSYTSAWGGRKQQHEDDILSRLQACTKAAVLELLYLYINSDAIFF

SEQ ID NO: 176653 - protein, 74 aa, Triticum aestivum
  Clone ID: PAT_TA_71071.pep
ASWYLSSSHCISCMITPECRECGMPDHHKGMDITKTLMLFRLLIHLTQCPTPGIQVERTPAHLQEHKLSIVPRP

SEQ ID NO: 176654 - protein, 82 aa, Triticum aestivum
  Clone ID: PAT_TA_71072.pep
ALLKGERHITSVYNYCFNGGWPDIIAINWYMSRWWMKENSLVAPSERGMLVHSCTSTSSADMRSFVLPSYVNFFKSCSGLID

SEQ ID NO: 176655 - protein, 56 aa, Triticum aestivum
  Clone ID: PAT_TA_71073.pep
LFGTSIFVNWNTLHITVNYLDIFIYDPLLLRGHISLLKSSCDFLFPSFCCVNELVS

SEQ ID NO: 176656 - protein, 103 aa, Triticum aestivum
  Clone ID: PAT_TA_71074.pep
QQRQRQLLMIFCPAHKVEVKMNLNVVLLLIFCPAQKVELKINLDVVGRTPRSQRIVNAIVLLQKCFSATNLLEQLIYLFSTMKWLKLAYICCGRPGCAYIEFS

SEQ ID NO: 176657 - protein, 77 aa, Triticum aestivum
  Clone ID: PAT_TA_71075.pep
CLSGMCCDHFPKFIISCATTFEVFSTLLGIHSECAESLKNTSSVGKCNALEYHHPWLKIMLCPLVLSSDVLRTNLFM

SEQ ID NO: 176658 - protein, 166 aa, Triticum aestivum
  unsure (1)..(166): unsure at all Xaa locations
  Clone ID: PAT_TA_71076.pep
QPDHDRIGLIQQNHLNARFKKNHLHALNKSHCHTRRKRLDVANVAGIDINQKITVFYTCQDCSSMTQRRWHRPHKCSRVTAAIVEVRFSYCRHAYTRFLLASGLLFLCYLPTPVANSDLNVKSALXQLQVLRFHLTDEMSLLASGHGVASFYRLLMCLARLRLAAE

SEQ ID NO: 176659 - protein, 59 aa, Triticum aestivum
  Clone ID: PAT_TA_71077.pep
FFFFFFFIALYSSIHTFSNNMSARITPFDTNYFTSLGSHKQVFPTLNTRSQQYRLKGME

SEQ ID NO: 176660 - protein, 103 aa, Triticum aestivum
  Clone ID: PAT_TA_71078.pep
QQTRNPLPRNGKHRRNGQGRKIPIMLEETGLMPEMPFLSYPFIIDRVPSDGVVCVCYMAWYCVFVPTVHAWTDMFFICVCRSTECVSVLLVINVCHVNKIEHM

SEQ ID NO: 176661 - protein, 81 aa, Triticum aestivum
  Clone ID: PAT_TA_71079.pep
NLKLLRMSGFEDEDKVTNYIRLVMKRTVWLKRIELHGENPCNKCDAIDPTSRRPHVDEARRRRIKEKLTHKSSSSVEIIIC

SEQ ID NO: 176662 - protein, 82 aa, Triticum aestivum
  Clone ID: PAT_TA_71080.pep
VRGRVRGAGAVAPRLPHQPGRHFHPHQEEGEGEEEGLIAIAAQQSQFLVCCTLNCCNFMSTYVLILILIHPILHLFKKKKKK

SEQ ID NO: 176663 - protein, 82 aa, Triticum aestivum
  Clone ID: PAT_TA_71081.pep
NFLSSKGTSWQTSNNSIQKGELKQTKVDAPSFSQPGHHKIQANAQPHLHKNETEQLQKQVQYTWISQIRIFKMMLYPWYSLT

SEQ ID NO: 176664 - protein, 180 aa, Triticum aestivum
  Clone ID: PAT_TA_71082.pep
SNSEDNVLSLGDLLNLQDLNLTYCTEESDDHLKRNLAALASSLGKLVNLKSITLAPGASGTAIYHDVWSSVSSLPFFLQRLELLPPICIFSRLPQCLGQLRKLCILTVVVSELLMEDMDILTGLPALTVFSLYVRQPTLESIIFKKRAFLGLKCFKYTCGVLSLTFQEEAFPNLQRLEGG

SEQ ID NO: 176665 - protein, 76 aa, Triticum aestivum
  Clone ID: PAT_TA_71083.pep
RSEFQFLPPILTFVSLITLFSQISSVLPHLAKISHNLPCLKFCIRSDWLVPIIRSSWHGTWTIFFCLFFSLLNRSS

SEQ ID NO: 176666 - protein, 49 aa, Triticum aestivum
  Clone ID: PAT_TA_71084.pep
ILIDISQSCDLGKPQNVLNEIRGVYFLQAGTLEILYWQEGCDKQIVRLY

SEQ ID NO: 176667 - protein, 73 aa, Triticum aestivum
  Clone ID: PAT_TA_71085.pep
VARRGGTRICHFIRWQVGGTTASDRDDTNSQRKLEVCSFSTSREEPPFWVPRVCSEPTSADAMEDLLRQTRSV

SEQ ID NO: 176668 - protein, 68 aa, Triticum aestivum
  Clone ID: PAT_TA_71086.pep
SGNHPHPVPASQHHMHSVRTLSCRFIIFHYSFIPHFIIWVITTWIICGRRRKSGVGRWSILHHECHRH

SEQ ID NO: 176669 - protein, 62 aa, Triticum aestivum
  Clone ID: PAT_TA_71087.pep
MSSAVSVSVNSHGQICGLTKRGGAGLNPSVIFDMISVAKNVSQRYYTLLESAIAAAEAAADE

SEQ ID NO: 176670 - protein, 76 aa, Triticum aestivum
  Clone ID: PAT_TA_71088.pep
RVKLGPLPSLEIPLGGGGDVGREPSTKDPFFLWFYVDEEVAVAQGKGGGTAFWCRCKRVDGQGRRPAFWYFGFNII

SEQ ID NO: 176671 - protein, 104 aa, Triticum aestivum
  Clone ID: PAT_TA_71089.pep
LAGMSHKLRLQGYTANTKEVLFDIEEEEKEGAISLHSEKLALAFGLITLPEGTVIRIVKNLRVCKDCHDYTKMISKVFDREIVMRDRNRFHHFKHGACSCRDYW

SEQ ID NO: 176672 - protein, 133 aa, Triticum aestivum
  unsure (1)..(133): unsure at all Xaa locations
  Clone ID: PAT_TA_71090.pep
PIPSDVHELYVDKLAYQLADVLDFFSLGSVMCMGVTAGAYMLIFFAVPCYLTLANNLLYILSXDKVEGRVLGLVLVSPLCKAPSWSEWLYNKVIIDTSVSAMNCQCLISLCILALWQYIIFHFNLKKKKKKKK

SEQ ID NO: 176673 - protein, 74 aa, Triticum aestivum
  Clone ID: PAT_TA_71091.pep
LGHDLLLVWSLHGFMIWHFRGEMDSTMVHAVNGFHGSDRNSPFTVHVCDYWIGHGIFIFQNGDQYRICQKKKKK

SEQ ID NO: 176674 - protein, 49 aa, Triticum aestivum
  Clone ID: PAT_TA_71092.pep
PWSLLDHDNGNWWTDYSKISPFKYLGIIGTLGDHVEHLNHWICRIKWIM

SEQ ID NO: 176675 - protein, 112 aa, Triticum aestivum
  Clone ID: PAT_TA_71093.pep
KACCVVRKLILQGVAPCLGCCTFRISDACHREHCKVGTEWHAFVCGWYPSKSTVSFSAASKLVLLLLIPHQWQTTTNERIPLLPNVGSDATSVHPVHHLQLPITASLSIHDL

SEQ ID NO: 176676 - protein, 59 aa, Triticum aestivum
  Clone ID: PAT_TA_71094.pep
VVVTFIQGKNHAFQMECFRQNTRVFSEQKFDAESRGNAEMGNVQEMDVKLLLQYHDHLW

SEQ ID NO: 176677 - protein, 87 aa, Triticum aestivum
  Clone ID: PAT_TA_71095.pep
SRAFKLLATRNTPRSTSRNPRWNTFAILSSFTLNWHSYLIPYYSFEQFVRKVEEVGASNRVRINLFLPLRICFHTVGQQDLSPTMRD

SEQ ID NO: 176678 - protein, 44 aa, Triticum aestivum
  Clone ID: PAT_TA_71096.pep
IRHCLHPLGNIPYHNLRMLCKFPLNYKIKCCTVASISKLFRQSG

SEQ ID NO: 176679 - protein, 61 aa, Triticum aestivum
  Clone ID: PAT_TA_71097.pep
LQVIGSANLLCSLGFDQFEERGMSLAKFFHLINLLRSLAVRWSMQYHQSHGSLTECNAWAV

SEQ ID NO: 176680 - protein, 69 aa, Triticum aestivum
  Clone ID: PAT_TA_71098.pep
VAPRPAFDAQDHQQIDHLMLLILFPCMEACNSSFLSFLLYWRFLAPLMQIMETLMARHHVIRFPPNVSI

SEQ ID NO: 176681 - protein, 103 aa, Triticum aestivum
  Clone ID: PAT_TA_71099.pep
FFFFFFFFFFPHIPILHSNLFPFLASSFALPMVQVSNLHTMNPFRTPVLANKIILLLGPTCSSHHLAMDPPVIFLLPWPADDIDVMVNIWWILSVASWNIAMI

SEQ ID NO: 176682 - protein, 75 aa, Triticum aestivum
  Clone ID: PAT_TA_71100.pep
EEVGDSCAVSKDEAARLANDAGKYDVLMNKHACLRVYDEMVEANDVRISKGALLRSLVEHEPRKHMKRKRLKNPS

SEQ ID NO: 176683 - protein, 104 aa, Triticum aestivum
  Clone ID: PAT_TA_71101.pep
FFFFFFFFFSGGNNSNGTVHAKKKYLLVTGGKLYVHSVRQTSTIRKTWVYATNPWRAHAQNRLPKCVENDPTSNKYSMLHARDRRRIKLCANGSDSRPFLFEAR

SEQ ID NO: 176684 - protein, 64 aa, Triticum aestivum
  Clone ID: PAT_TA_71102.pep
IHPFLFILMTSISGRREYVTGYYRTYFVPYETHILSLCKCSSVSIYASVMFRLQKQNNLGIIGY

SEQ ID NO: 176685 - protein, 120 aa, Triticum aestivum
  unsure (1)..(120): unsure at all Xaa locations
  Clone ID: PAT_TA_71103.pep
TKLKHQFNQQSPTSTYNKIPSTRNVTMVSPNLILQPIPLSFHPNASHRSISVPPTSIYRSRWSASSTNGAATSRPEAAGGGVXAAPVTSPVAMLASQASLLAPPRITPCPWMPPPPPPPV

SEQ ID NO: 176686 - protein, 71 aa, Triticum aestivum
  Clone ID: PAT_TA_71104.pep
PQFYKKAITQMQIIQFTLYIVQAIIIGFKYPNFRPRGCILLAIAQSSIFFILFYNFFKNSYKKLQKNAKKE

SEQ ID NO: 176687 - protein, 151 aa, Triticum aestivum
  unsure (1)..(151): unsure at all Xaa locations
  Clone ID: PAT_TA_71105.pep
EFSXETRNICWKIRTTQIFHGQPLRSLTHDKTAVHLVSLLLCSSITVPCSEVDLSFTRSLPRRGAPHAQDQCPRTAAPVMHPSFFPVLLLLPLLLPGSSSVSLFYQKNRSPAMTLELSLPATEARLHLRAAAPDPSFSRARWIPPSPFCIE

SEQ ID NO: 176688 - protein, 80 aa, Triticum aestivum
  unsure (1)..(80): unsure at all Xaa locations
  Clone ID: PAT_TA_71106.pep
SFAEKEYQTESKWNEIFTMIFLGPKDIQRAWSARRESHEAATRSGGAXQGVGRAPHPSGPLMTLPTYFFRLYILSEGNMP

SEQ ID NO: 176689 - protein, 82 aa, Triticum aestivum
  Clone ID: PAT_TA_71107.pep
LPKSIHWTTLSFLERTSIWIQTVILHVLIVIFTVRYRWLLRLVPFAFPNYSDLKDIFLYRGSIFNNFGLQYVYVPRRMIQLE

SEQ ID NO: 176690 - protein, 94 aa, Triticum aestivum
  Clone ID: PAT_TA_71108.pep
QYRLHPSTKPLLPVSAWSTTDRTTLPSPPREVRHLTREQSIYRLPCKHSITSHSVRSTEFVLLKKQKMEFEAAAGGWWCGCRRRSAGANSSIRR

SEQ ID NO: 176691 - protein, 134 aa, Triticum aestivum
  Clone ID: PAT_TA_71109.pep
SCHLGGLGFHSEGFPIIPSLRTSFVSIGGNCQAIHCYLKNHCYQPSIVDRRSSGYQSPACRCLLSRSSTCSVFLLAELLLCNGYIATCFPSFWDHDYCIWVLTLARRWRATLSSLPPSNRNPSLGSKKKKKKKK

SEQ ID NO: 176692 - protein, 89 aa, Triticum aestivum
  Clone ID: PAT_TA_71110.pep
LQENTYYTRHSRPISVQTALGYNQTVAAAEYLLQIMRITAFFQPAKKTRSASRHSGSHVAWVPTQSTFQEQIRDPTKHKLPALRASPSP

SEQ ID NO: 176693 - protein, 87 aa, Triticum aestivum
  Clone ID: PAT_TA_71111.pep
MTLIHSAVLALSVPSYGVMYLAVKKNYIGSSSAVRQLRALVDEEGAFGVHLIAEPPEREIWNSSLNKHSFTASRKTEQGRLSPQFCI

SEQ ID NO: 176694 - protein, 106 aa, Triticum aestivum
  Clone ID: PAT_TA_71112.pep
GGISVDTKAYITLVLTVIHYLFCLCSIKQGVYYTRRENQNHLRCLDDPLDLLAAPLGGFFLALGASHLGHSQSSSGTRSRGGSQQSMCMPAPQATVPSSLPQISIT

SEQ ID NO: 176695 - protein, 119 aa, Triticum aestivum
  Clone ID: PAT_TA_71113.pep
GFPTRAAVQALASQHTVLKGIIRHSGPLKPASPPPPPAAHRESYDDADGDSNGQVVLYASRLELTLENQNLKSLLDSMHWRVMELEKVCSRMKTQMTKMKASRRGGGAAAARSLPRMCS

SEQ ID NO: 176696 - protein, 100 aa, Triticum aestivum
  Clone ID: PAT_TA_71114.pep
SRCCRTTEDELAAPTVTPGLRRVPSSTTTLAATVAAASTGMQSDEEDEEEADQKGQEESAPLLFTSRVGDREELVQSVRRCQQLRQRPLFIVESYSIIAA

SEQ ID NO: 176697 - protein, 84 aa, Triticum aestivum
  Clone ID: PAT_TA_71115.pep
PPNGDICLSHYVAKHCRVTSACVCFSPSTENPWRQGAVLSSPTQLSELEREQAVGVCISLLHKIARLNSNLRDRRSRGASLEPP

SEQ ID NO: 176698 - protein, 121 aa, Triticum aestivum
  unsure (1)..(121): unsure at all Xaa locations
  Clone ID: PAT_TA_71116.pep
FFFFFLRKMETFTGFRYTIYNLPLIPXRNQEMVLDTQIVLLRPIIHGTRDLPRNRFVTDASXSXRCVLALFIYSVRPSNVHARLFSHFFHWGXLWTTTLPEFSLFPTIVWQVSLHDSGFFF

SEQ ID NO: 176699 - protein, 48 aa, Triticum aestivum
  Clone ID: PAT_TA_71117.pep
YCYILNSCSPAFRYIKRNLDPKVSKHYYVHRKCSRQKIYRYKYIYIEK

SEQ ID NO: 176700 - protein, 89 aa, Triticum aestivum
  unsure (1)..(89): unsure at all Xaa locations
  Clone ID: PAT_TA_71118.pep
EQPSPPNLDPPHRHPQPSRGSPSLHEELPTDIGIEPVLACVCHHVCVTVPLVRAWSFGNVIISYLDVPKPDYQASMIPHFHNPLWHSLX

SEQ ID NO: 176701 - protein, 99 aa, Triticum aestivum
  unsure (1)..(99): unsure at all Xaa locations
  Clone ID: PAT_TA_71119.pep
RARNQTAGPRTQRTKKGCVKMYVWSLPLIFSVISGSASPTARVPGPSPVRCFCQGPRXAGATLRLSSRRAETRRRRGGAKLEEGEMMKWREDLMWFRCG

SEQ ID NO: 176702 - protein, 62 aa, Triticum aestivum
  Clone ID: PAT_TA_71120.pep
AHTRNLDSYDRDAQESNLAMNLPGLKSGDESSWSQLLLIRRGTSRCLPTIKSIRRGIRPLSN

SEQ ID NO: 176703 - protein, 104 aa, Triticum aestivum
  unsure (1)..(104): unsure at all Xaa locations
  Clone ID: PAT_TA_71121.pep
PRRSTHGLSLVIRSSDREPGFLVRTTSTSCCFAVPAAYYVAIRLQATSTHTTHLPHVPRALDAPDEPDRTTSAXRTSRAHPPRPTRPTAPDAMAYSNTLPLSHN

SEQ ID NO: 176704 - protein, 87 aa, Triticum aestivum
  Clone ID: PAT_TA_71122.pep
CTLKLDNLPRLFCTLALFLPFFQVCSSPSLQFNQPAPRISIKYSSAISMKCEIDEKPEKQSCLVKQSHQNALNLNKKLSSYPSRRQD

SEQ ID NO: 176705 - protein, 112 aa, Triticum aestivum
  Clone ID: PAT_TA_71123.pep
HHLLLESLQDMHHLLTNLHSVMHKQTQRMHGYMTDLLASPLTNPYMQLTTTPFMQTNSPSSRPVLLQSSTCVPYHTTLPPRAAPRCHAAIGISPDSRYLTAVWHLAFSTHLH

SEQ ID NO: 176706 - protein, 60 aa, Triticum aestivum
  Clone ID: PAT_TA_71124.pep
QKVQLINIRPVEVSSGINYSKSLGLKRKQSLFLYGDGDVAAGNGVFGEDGGQLDILALLG

SEQ ID NO: 176707 - protein, 45 aa, Triticum aestivum
  Clone ID: PAT_TA_71125.pep
SIDVQSTAGSEVFVTSKRLNGLTLKGRGTRRSMDKENDDQSNSFF

SEQ ID NO: 176708 - protein, 165 aa, Triticum aestivum
  unsure (1)..(165): unsure at all Xaa locations
  Clone ID: PAT_TA_71126.pep
KKKKLEPLETYVPAVLLXQDQFRDLEKSLEFEKPRFDESRSLLRSGPASXSLRINIRAVAQYASSNGQGKTASDAVDECLRALEDLDSLLLKASRKDSSASVEVMRSKIAVALGALDNLLQTVPSAVMDKGKAIADAYRTPSDGYYEEGNGAELDPSLKQLQDIL

SEQ ID NO: 176709 - protein, 102 aa, Triticum aestivum
  Clone ID: PAT_TA_71127.pep
LAGLRGLHHAAFREAERLCPYHRQAMVVVDGGACSVCFHDEQRMEEGMGVGLTGQFALEPNASYLEFLCLKLRSLLEKQLLESHNNSEHSTQVWKSPQQAAT

SEQ ID NO: 176710 - protein, 78 aa, Triticum aestivum
  unsure (1)..(78): unsure at all Xaa locations
  Clone ID: PAT_TA_71128.pep
TPPAALPRRSPRAPSSSTTSSRCPSAPPTSPPPESPPTGSAPPSPAPXGSLPXPPTPCPPPTRPSSSSRTPSXTPPSP

SEQ ID NO: 176711 - protein, 99 aa, Triticum aestivum
  Clone ID: PAT_TA_71129.pep
RKCSQLLLFLDAALVTLGVGAIHELPGIFLLHIAFLAGSYLSVGNVGGQIIIKGWILKPKWPFFASYTLRSVLHLMSNWSAHHPSSKTQSHHSPPPGSV

SEQ ID NO: 176712 - protein, 120 aa, Triticum aestivum
  Clone ID: PAT_TA_71130.pep
LLEPDGLLGHEEEELHGAATAPKAPSDHRPIFSEMDVLMVCSPLSFPGGNEMMAPHQHGHFGGLLLPCFLREARQRAVVFLLSRVVCLCRMTWTNKRSKKKKSSTEKIMDHIYPGWRCQV

SEQ ID NO: 176713 - protein, 147 aa, Triticum aestivum
  Clone ID: PAT_TA_71131.pep
PHNLVFQQRSSNHQTHHLVTVSTVVEQPPNITHHLVFQQWSSNRQTVHTQSCVSTAVEQSPNTTHTIYGTTITKRDQATVTSTLQEPRSHTPWLVPEHAGLNTAVARMRKSEREASTATNNFSPKSTETTRLESSNEPSGSMGGSLS

SEQ ID NO: 176714 - protein, 107 aa, Triticum aestivum
  Clone ID: PAT_TA_71132.pep
FFFFFFYHLVGMNPYGDFYFHDVYKFDLEDGTEEMVAEAISWSDPITRRDADPPFTAVQLLSSYTINVRGSELVIPETCRVDIDQLVEEFFSTEDKEFFAMFPLQLG

SEQ ID NO: 176715 - protein, 64 aa, Triticum aestivum
  Clone ID: PAT_TA_71133.pep
NWCSLPRRRTLRTSPPLPARKSTSYKISMFYLKTTENFSVPAKCFLVAISDWFIGQKQKQGCNW

SEQ ID NO: 176716 - protein, 111 aa, Triticum aestivum
  Clone ID: PAT_TA_71134.pep
QERKNSIFTSQERARVTDYLLLLQVPQERTEPGRGDAIGLPPELVRLQTERGHGQLVVRANARVLPQPRWFVPRLGDGVFPERAPERDLNGGRDVLVDGWQLDDFLKLVVD

SEQ ID NO: 176717 - protein, 85 aa, Triticum aestivum
  Clone ID: PAT_TA_71135.pep
GLRGHAPGMPSTRPMYSVRARGWVQDSQARALRRPRRPDRPGAVAVAVLFCCTSSSRYMHVLMYSQRFRQPCSKKELVCRCLVCS

SEQ ID NO: 176718 - protein, 91 aa, Triticum aestivum
  Clone ID: PAT_TA_71136.pep
ARGQGSAVCKRGPPAQRGVMFLSNLASLSLARIAVLQGTDVPHALGCLCPIILGFVLNLCTSRIIDDFPSVLPVDEFPMLDRLDCKLVALS

SEQ ID NO: 176719 - protein, 115 aa, Triticum aestivum
  Clone ID: PAT_TA_71137.pep
RGVLIDRKGKLACEELRISTCKITKAGIGGPLIDAQGNFVGMNFFHDEETPYLPREKIQEVVRRFDEERANDGWPEPRHRYFIPTWYPVPFGLFPDSDVYVDSLDDLYSKFAWHQ

SEQ ID NO: 176720 - protein, 59 aa, Triticum aestivum
  Clone ID: PAT_TA_71138.pep
VCGCGFLTMALVNVVQVKLGRLGCGAGGSAAWGAVIPLVTLVPSAMLIYIGIVFYAFTR

SEQ ID NO: 176721 - protein, 61 aa, Triticum aestivum
  Clone ID: PAT_TA_71139.pep
VCGSAHRVLAPYWGGKLGKQKLIAFQVSQRSGTLYLELDIANRRVRIQGEAVTVMAGTLFA

SEQ ID NO: 176722 - protein, 97 aa, Triticum aestivum
  Clone ID: PAT_TA_71140.pep
VPTTRPCTHTAHTSHCTEPRHYLSKSSIIIHCLGVAPQPCGTCYAYMAFHTTVLASSRSPYWFWNIAPVWACCPLVALQREIQHRRCGRRLHLSRTQ

SEQ ID NO: 176723 - protein, 156 aa, Triticum aestivum
  unsure (1)..(156): unsure at all Xaa locations
  Clone ID: PAT_TA_71141.pep
CQGLGHVNVGAQNNLNIQARYDIGSPGPHYFQLIPLYEERGWNMIFEKTKSRTTWQVIELYVNFTPNQDMLSQEDTDPEEDLMGHDDDDEHDSIAAPSQSSDEDSKPRVADHVNAFPFMYICGXNGLRAFSDISILTETTTDEGMSGTLANHQLES

SEQ ID NO: 176724 - protein, 86 aa, Triticum aestivum
  unsure (1)..(86): unsure at all Xaa locations
  Clone ID: PAT_TA_71142.pep
PQFYAFRXITLLLTQEFNFADIIHIWDTLLSDPDGPQETLLRICCAMLILVRKRLIAGDFSSNLKLLQSYPPTNIGHLLYVANKLQ

SEQ ID NO: 176725 - protein, 48 aa, Triticum aestivum
  Clone ID: PAT_TA_71143.pep
LFDRKCLCATLLKANLFDSRLYLEIVAFADFCVFELMYSSPQGPWLVK

SEQ ID NO: 176726 - protein, 74 aa, Triticum aestivum
  Clone ID: PAT_TA_71144.pep
IRSRSTSTTRFANTTSTVCVSTHPTWTKCFSEFLKRKTMEPCCCCATGYVFCNTICLGCVSYFVCARILKKLSL

SEQ ID NO: 176727 - protein, 155 aa, Triticum aestivum
  unsure (1)..(155): unsure at all Xaa locations
  Clone ID: PAT_TA_71145.pep
EFQENGHTYDVEYYLADVIYLKWATFVKLIASSQGKKEIYLHNAQVATRKDVERAFEILQSQCAIVXGPSRFWDQEILYIITTCXILHNMVIENERGQIWITPTMDSWNNGRGQLEGKNKSNALFRCRMTSKIMIHTKIFENISWRSGRHAMGNN

SEQ ID NO: 176728 - protein, 61 aa, Triticum aestivum
  Clone ID: PAT_TA_71146.pep
LGLHAHPCSSTIMASLGFLFGFFCFGSLSAYSEMQNVAHKWSYIKQEYRLIKKKKNKKKKK

SEQ ID NO: 176729 - protein, 74 aa, Triticum aestivum
  Clone ID: PAT_TA_71147.pep
SLPLSQNQLTSVLVHYIVEDKHQLCNLRVPFATGIYLHGKEYKNDSIITFTSSQYLCGENAPSLRVYRIRLTSI

SEQ ID NO: 176730 - protein, 118 aa, Triticum aestivum
  Clone ID: PAT_TA_71148.pep
RAIDKERKREERTGHTDALCLVPPSYTSHITKPYHFIVSPLLLENQKKNKTLAKRPAQSATTHHTNSQPLPSSVLPTAGDGDPGRATAAAPEERSPRAGSRPSLPPLPLLGLPTRWAR

SEQ ID NO: 176731 - protein, 89 aa, Triticum aestivum
  Clone ID: PAT_TA_71149.pep
TNPYFRSSTVLPLVNSSHMLVASMLTAERVNIILVAIDLTHALRFLICLFMLYEPHFAKLLASYIRMRRLFILNFECAMRLCKHYYIWY

SEQ ID NO: 176732 - protein, 66 aa, Triticum aestivum
  Clone ID: PAT_TA_71150.pep
TRVNIATNVTSSTHHVKNNCGGLPTVFNSKKESKVALEILMKILDLVLPSSLGMSLIYMKLMRPFY

SEQ ID NO: 176733 - protein, 63 aa, Triticum aestivum
  Clone ID: PAT_TA_71151.pep
LMEKPKIFLKIMLDGFDHVTKLGCKCHLVEVMRFVVCTVCLYYAVQTFCQFEVNVVLNAIHLR

SEQ ID NO: 176734 - protein, 69 aa, Triticum aestivum
  Clone ID: PAT_TA_71152.pep
LKHQMITSWLVHKCCKVITSMHTIWLSTWRRCPPFATDYPLQVVALVPSEGTFHPPFIYLLHVGGHGSQ

SEQ ID NO: 176735 - protein, 168 aa, Triticum aestivum
  unsure (1)..(168): unsure at all Xaa locations
  Clone ID: PAT_TA_71153.pep
NENNLSIMFGDITSDGTNHWNPASGTIPQSSSXSVFNVDNIHDIDLEETQIGESRADGKGKRLGRFVDGNNKKLKTPLVMQEHVTRVGDTAXRTQSSFESYMKKEESSLLTSVMDLVVXCAAIVGSDECFIASELFVNREQGEMFLHMTKSAAHFDWLRRKYNTKYVH

SEQ ID NO: 176736 - protein, 50 aa, Triticum aestivum
  Clone ID: PAT_TA_71154.pep
ADPPVSTCSSPCQPNKMGPLQGGSSSSSSPGRPLRTTIIALARQQTNKLG

SEQ ID NO: 176737 - protein, 76 aa, Triticum aestivum
  Clone ID: PAT_TA_71155.pep
QSGWVVEKLLDDDGVESCIVTYVVQLDPAAGWLPRCIVSRLDNKLVTIIAKLKKLAQTTTCPSAPPAARSCNSEEN

SEQ ID NO: 176738 - protein, 126 aa, Triticum aestivum
  Clone ID: PAT_TA_71156.pep
RWHRACVQFLRRVAGPDEARRLKLEKKVAASCSAPVEFDVLAQPECDTVPCIPRCCTGRSSICASVSARRRSSVREPKTSISNVVLETYVFSSLVEVLDCLSNVVLETYVSSLVSLKYWITFVYLA

SEQ ID NO: 176739 - protein, 72 aa, Triticum aestivum
  Clone ID: PAT_TA_71157.pep
YMNITLQQPSKIKVRLRNQNKEQPQMQQSPRSPQLGSTTDQLERNNTMNDIFIKLLLELGCVTCTVSSAPAN

SEQ ID NO: 176740 - protein, 71 aa, Triticum aestivum
  Clone ID: PAT_TA_71158.pep
TNRPRTYILCLTCFSVLLPQFQITRRGFSSNYLSPTRRRARKHMRSPTALMKMASPGSMNMHWPTMVSARA

SEQ ID NO: 176741 - protein, 46 aa, Triticum aestivum
  Clone ID: PAT_TA_71159.pep
FFFFFFKLNENALAQGFLSHETRLICESLHNIKPGGHPLPSNKPQL

SEQ ID NO: 176742 - protein, 88 aa, Triticum aestivum
  Clone ID: PAT_TA_71160.pep
FFFFFFPAQTHLFLIKKKIDYWQRITRPAGLIAWVHVLYDSNSPTALLRNVHLVLHSLRARANHRPRVNYMSKTTTMEVFVELRRLLT

SEQ ID NO: 176743 - protein, 73 aa, Triticum aestivum
  Clone ID: PAT_TA_71161.pep
KMKMHACIPSFLPSLYLRQGVSFISECLIHACLFSHARVFISFCCCFFLFNIYFVCFFCCENKIHFVVALKKK

SEQ ID NO: 176744 - protein, 110 aa, Triticum aestivum
  Clone ID: PAT_TA_71162.pep
FFFFFFSGPADKPRRGRTHPLIFFIFSMATSLALPAHLINTWKGFLYPDAHTRLATTHAPTTTAYLAQLRTRSACHTGRAQTHATACSDRPGSFATNQLPDPTKWNTRHT

SEQ ID NO: 176745 - protein, 48 aa, Triticum aestivum
  Clone ID: PAT_TA_71163.pep
INPLFLSKQKQRKKRKTEEECNGSDPTPRTFPFSNGGIRNKQELFVVD

SEQ ID NO: 176746 - protein, 90 aa, Triticum aestivum
  unsure (1)..(90): unsure at all Xaa locations
  Clone ID: PAT_TA_71164.pep
KKFGMNQRKLAVQLMWVRPTRRRHAAGCRWAXRPWAAADLCRWPTGAGGRLAAVPCVTIRWRAPAAKKKVFVVCAVSSWMLGYCVLRYAG

SEQ ID NO: 176747 - protein, 81 aa, Triticum aestivum
  Clone ID: PAT_TA_71165.pep
EAMRIHDHFSSENHGKEELHQILCEKGKSSVPADKLEELLHAHIALAEDLGYLDDETKKRCVVRSKNDIEARADATLNLDS

SEQ ID NO: 176748 - protein, 78 aa, Triticum aestivum
  Clone ID: PAT_TA_71166.pep
GPPSCRKIPTYKGKLSTQNKRSGTSVQPINCHVHNIRSKLSISIKFCLAPPHQKTPLFFTIIRTRLNNDELISYRAQS

SEQ ID NO: 176749 - protein, 57 aa, Triticum aestivum
  Clone ID: PAT_TA_71167.pep
IEFRGAKQPMKTQQDVRGKLANRRTRQSTFDTSSNHTNSLGEAGIQLSCRLAVSSRT

SEQ ID NO: 176750 - protein, 73 aa, Triticum aestivum
  Clone ID: PAT_TA_71168.pep
DKLQQMLNKVKSTSRGGMYDDLYGDSVPAKLGSSWAYKSDGQPEQVKVVDEKKSSRDVGANPADDSDDDLFGD

SEQ ID NO: 176751 - protein, 46 aa, Triticum aestivum
  Clone ID: PAT_TA_71169.pep
HVVACMLTAERGNIIVTFHQNLTHALCFLIYVCCINHVLPSCSPHL

SEQ ID NO: 176752 - protein, 64 aa, Triticum aestivum
  Clone ID: PAT_TA_71170.pep
NGSIVCDVSLPSAFGGTWCYLVLLFVEKMSLVRNFLRWSPDCSIVMDVGKPLSIDFLVPKKKKK

SEQ ID NO: 176753 - protein, 62 aa, Triticum aestivum
  Clone ID: PAT_TA_71171.pep
NWGRKFTEIQCPNTIPGKLYSYFPKITCVGMVKPHMYKTFAQTVRPLLIESAKEKASCQPPT

SEQ ID NO: 176754 - protein, 74 aa, Triticum aestivum
  Clone ID: PAT_TA_71172.pep
ADADSTKLFFSEVDLYFRSENDVIMCCIVGENDAGRCYGCENRQPVVHPSSEAYGGGSSTCIDYPGSDGDSDSD

SEQ ID NO: 176755 - protein, 74 aa, Triticum aestivum
  Clone ID: PAT_TA_71173.pep
HSCYNIRGKLQDYNCTVEFFLSLSCSLKPSKIKLDHLPTMIQQLREAYFSHIQHRQAQGVSPTYISSYFNYFSN

SEQ ID NO: 176756 - protein, 65 aa, Triticum aestivum
  Clone ID: PAT_TA_71174.pep
ELKTDNTANAGSSIIEHIQLYLWSSTGGLLLVRKKPLQRRPHCGTAASLHRMRRLLRPQQQQHPR

SEQ ID NO: 176757 - protein, 72 aa, Triticum aestivum
  Clone ID: PAT_TA_71175.pep
LSLWSLSGLRKCILKKTRSTWVRAMCFRCQNQNAMRVLHVLAWAMVVCVSGACGLFNALLSAMRGIDDEIEF

SEQ ID NO: 176758 - protein, 76 aa, Triticum aestivum
  unsure (1)..(76): unsure at all Xaa locations
  Clone ID: PAT_TA_71176.pep
RVLRSIEHRTRAQXVLGRTTVAALIMPTMDCVVGPAKEIVVEGRSARYRRVAFRDFMHIYNTVGACKESVEEALKI

SEQ ID NO: 176759 - protein, 111 aa, Triticum aestivum
  Clone ID: PAT_TA_71177.pep
EKLAPEPEVATGEKDKSLVHEESLAAGVGQRSEEEKAKAAAAAMEAKAVLEKKATACSGWKERVAGGLEQLTDMKWADSVVEKARNNKEVVAIAIAAFSLGFFVSHKLFRK

SEQ ID NO: 176760 - protein, 104 aa, Triticum aestivum
  Clone ID: PAT_TA_71178.pep
AKSMAELTCHILENETALERLTLDAIYDNSSYGDAERCCVGEKGECNPKSRSMIMHAHKGLGVIGKYVVEKVPSTVQLSVKKLCSRCHKIKSKGFRYGNRTTTP

SEQ ID NO: 176761 - protein, 58 aa, Triticum aestivum
  unsure (1)..(58): unsure at all Xaa locations
  Clone ID: PAT_TA_71179.pep
AEEMEGAGFGFFNGDCVGEWYSDGMAVEWDEGRSXCSFYPSYGAEASAEQPYISPLWE

SEQ ID NO: 176762 - protein, 61 aa, Triticum aestivum
  Clone ID: PAT_TA_71180.pep
FDKKYTLMSLKKKIHKHTRKYLYMSKKRAKKRTLCYSTTSAAPIKQGPTLVEHQSRVVPHS

SEQ ID NO: 176763 - protein, 56 aa, Triticum aestivum
  Clone ID: PAT_TA_71181.pep
ELKFGVSHRINKQWVADQYRVVEMENRGFQGAQLEFIQNDDVLSLDAHDLSNADPF

SEQ ID NO: 176764 - protein, 98 aa, Triticum aestivum
  Clone ID: PAT_TA_71182.pep
NDITRSLLFRLMRNLMHHSVHDAPSLLFRLGRSFGSITRSSTRRTEADTLVTWKIEQEQLRKAELRRTPHPADHGTARLGARWGGTSWVPASAAASGF

SEQ ID NO: 176765 - protein, 120 aa, Triticum aestivum
  unsure (1)..(120): unsure at all Xaa locations
  Clone ID: PAT_TA_71183.pep
FFFFFLKEKKCRLIYIKGIHRMNYNKPTYTSTSYTTRRVNPRKKKTRRVKLNIGRCCAXNFKPSISQAPRAKHVCGPPLCSPPKCARLRPCQRYALVAMMQERHRLVHWPRRAIQASQPR

SEQ ID NO: 176766 - protein, 109 aa, Triticum aestivum
  Clone ID: PAT_TA_71184.pep
PAAALAARSCCAAPLMLAAAVVCCCYLLLLLVAPATYGCRFAACCCCSSSCLAAALRHCRRLLLLLATAMAVGVLCNVCVCVARVCACAVCCVLCVRECVGVCGRLDTV

SEQ ID NO: 176767 - protein, 57 aa, Triticum aestivum
  Clone ID: PAT_TA_71185.pep
DEQRRAVVEVQPKEAVGTDVFRMVVRPAGMDVSLAMVVVLALDQMLGRPGLLRSWSS

SEQ ID NO: 176768 - protein, 81 aa, Triticum aestivum
  Clone ID: PAT_TA_71186.pep
FFKTMPVQGTIQQSILITIGLILHIEVYECLCLQVIDAAKDRVHTYIIYIRCRTINLGGPGIIKERLQHCLCLQVIDSARH

SEQ ID NO: 176769 - protein, 76 aa, Triticum aestivum
  Clone ID: PAT_TA_71187.pep
LILKQHSQWCLGQFGGSSCGILLFFMEPRKLREVELQSGGVWHAVLHGCPCGFFFCTCTPLVYFLVFCCWKKKKKK

SEQ ID NO: 176770 - protein, 106 aa, Triticum aestivum
  Clone ID: PAT_TA_71188.pep
GQPAGQSVRPRHAAAHGGAGRVPELRGRLEGRPAARHPRRRPRPRVRAPRPHRHRLHPRRRQMIMRRRLASMDQIIVAVFFLHGSPSIFPRHHHSSFIIDDYHCYI

SEQ ID NO: 176771 - protein, 87 aa, Triticum aestivum
  Clone ID: PAT_TA_71189.pep
RRKSQDDMPAQFLKNAHRDRVCVCVHRGERMHVCMSACVCTVLKKANLYFFPVAGPRAPMCQPLFFLNQHEVKFRVFKKKKKKKKKK

SEQ ID NO: 176772 - protein, 69 aa, Triticum aestivum
  Clone ID: PAT_TA_71190.pep
QGMLMSCSYDMTVCMWDYRKEDALLQRYGHHTEFVAGIDMSVLTDGLLASTGWDEMIYVWPFGSDPRAM

SEQ ID NO: 176773 - protein, 87 aa, Triticum aestivum
  Clone ID: PAT_TA_71191.pep
FFFLANGGESRYSNVGGYNRSMKNNILLLSNVPTKQAIYLPQKNPPVPPSYFSKESCYAHNPKQTICAQNTTSVHQCKLSKCNKWLN

SEQ ID NO: 176774 - protein, 108 aa, Triticum aestivum
  Clone ID: PAT_TA_71192.pep
IVMKWERTDSSKGKEQTVTFLQEVLLLPWFICFLSKFTLEDTHDVIPDEVVEYGLVFDHLQCFVAGHHLHTRNHSTHLSWVARVFVLSKLKDFGNAKPPSSQVHKAAI

SEQ ID NO: 176775 - protein, 65 aa, Triticum aestivum
  Clone ID: PAT_TA_71193.pep
FFFFFFFLNQANFLFRGPARAAAPQGKELHASISTVEFFFPPLRDENVTFYIDPDICRTIFMTNH

SEQ ID NO: 176776 - protein, 92 aa, Triticum aestivum
  Clone ID: PAT_TA_71194.pep
SNLNLLSSLLSRRRSSVIAIEVPALCQLMLCSGILACSGFFNRMKNCRWLKDPARVLQNVLHSAAALVLVGSGVKDQDFVVLSSNLEQCGFT

SEQ ID NO: 176777 - protein, 58 aa, Triticum aestivum
  unsure (1)..(58): unsure at all Xaa locations
  Clone ID: PAT_TA_71195.pep
GTPAPTGVGRCKGCGDGAAIVLLFPYRHLCVWAPCAAXVQACPLCGCPKNGSVCVNFS

SEQ ID NO: 176778 - protein, 71 aa, Triticum aestivum
  Clone ID: PAT_TA_71196.pep
YYSPPQIRLSFLYRSHFNYFTLKFYTHMLHIVVYLEQFLSYFFETEIFEFEFFQKIGLHQGREPKRHSLQF

SEQ ID NO: 176779 - protein, 64 aa, Triticum aestivum
  Clone ID: PAT_TA_71197.pep
TSTKVRCQYLMCWRYFKSHTVIILFQRVPWFLSVAGPSTVITCGMVIPPETIISVESWRIMLDV

SEQ ID NO: 176780 - protein, 73 aa, Triticum aestivum
  unsure (1)..(73): unsure at all Xaa locations
  Clone ID: PAT_TA_71198.pep
ILLANSFRRIRWGYVDLVCVGVVAARWRFHVLVLRGLCAMRPSLCHQWLVFGLGECLGCXLFSVVPPPPISLL

SEQ ID NO: 176781 - protein, 62 aa, Triticum aestivum
  Clone ID: PAT_TA_71199.pep
TEASDLSIEAKKNEIELVLLTTPSTKAERMNEITSASEGFVYLVSINGLTGTRPDVNPRVKD

SEQ ID NO: 176782 - protein, 54 aa, Triticum aestivum
  Clone ID: PAT_TA_71200.pep
TIELVLANLLYQFDWAIPGGTSPESLEMSEVFGLTVRRSSNLCLQAANRRPQLH

SEQ ID NO: 176783 - protein, 119 aa, Triticum aestivum
  Clone ID: PAT_TA_71201.pep
FFFFKLLGSGPGSFMRVRIFSTSSIFPLYSYSTAVQTRKRKTKKMGFTMAILVKSNHSFPTRRAHQQRPILSASADGGGGTRRLAFAPVARADLQTVCSSVQLLTSLFFCFCLFGWTDM

SEQ ID NO: 176784 - protein, 89 aa, Triticum aestivum
  Clone ID: PAT_TA_71202.pep
RHTVLKCTFRVLEVEQEVQRQNVAIIKYVEKKTFFTDRLLADCCFHDEVPLCQVFELFPMFLRACLSQLSLALSKTLCSLDEVESFSRQ

SEQ ID NO: 176785 - protein, 96 aa, Triticum aestivum
  Clone ID: PAT_TA_71203.pep
HITNTDPDGVVHSRAFFWMMMLLDRLRRRLFMIWRRAPPWLFAIYSSMRTRRTPTFQVSMARGVGYILTSVTLCTSPISQSFVDIWAWFRVFSSST

SEQ ID NO: 176786 - protein, 89 aa, Triticum aestivum
  Clone ID: PAT_TA_71204.pep
TQMVGLYGNSPHPNAFGSLPHGVIYRLVSLICCHGFAIDAQIDIYLLFLFVELFPVLLPSTMMCQRCTTITLQIALLTEIYYLPFLQLF

SEQ ID NO: 176787 - protein, 102 aa, Triticum aestivum
  Clone ID: PAT_TA_71205.pep
NPVVGCAADDMTSVFFHTNILVLIFFSNGQPLARFYYFEVNEFVLFYFIRTVGLLAVIVQKPDCILMLHFGCLFPKLRCFFGGTQMYLGFYNVCSSSLIVQY

SEQ ID NO: 176788 - protein, 71 aa, Triticum aestivum
  Clone ID: PAT_TA_71206.pep
QVECGSSTDSESCLLIADESPVLHLVVLRKSSFLRRIILEISSYTTVCCIKDPEFSASCVPKVKLLMFLCI

SEQ ID NO: 176789 - protein, 102 aa, Triticum aestivum
  Clone ID: PAT_TA_71207.pep
VGLPTLSLQNDAIFHFLAKIDYRQSEHTAWVLAVDMQTKTITQAAEFRAERTLGLAWGFDASSISAYLQTAPGTQQIPKRPGVPLLKSPSKKHTGDVDAMVA

SEQ ID NO: 176790 - protein, 94 aa, Triticum aestivum
  Clone ID: PAT_TA_71208.pep
AVQDVTNTKNKACKFCVSSGHMVKARCLDESYRNIFNLDRKRQNVKSCSIKKHSIHYIYYDTQNLQKCTTPTFIRKTATSRKFLNKFPFKASSE

SEQ ID NO: 176791 - protein, 105 aa, Triticum aestivum
  Clone ID: PAT_TA_71209.pep
SIHSQPFSRRQSKHGKVNLQLLEGKIALARGHCQTELARCSSVQLTVPVQIMNGWGSTTEKKIGRLAFAHRLPLAYLLLTVAFSYFFILSLPTTSATEQCMRYTG

SEQ ID NO: 176792 - protein, 79 aa, Triticum aestivum
  Clone ID: PAT_TA_71210.pep
LELMHVAARAAPPMQGAGGNRTHPRTAGLMGPQRPGAPKEGAGGRGGSSTRLPLDQHTSGACIFGITRRLKKNKKIEIS

SEQ ID NO: 176793 - protein, 88 aa, Triticum aestivum
  Clone ID: PAT_TA_71211.pep
RSLVENSLVRITKSFFVNKEVPPPVPRPLNLLMHTTSVRFVEIVCAHSLFVWSSGNLYGKQTTVCLAHARIDLAFHCWGRRCWSVLLT

SEQ ID NO: 176794 - protein, 79 aa, Triticum aestivum
  Clone ID: PAT_TA_71212.pep
FFFFFAEKSPHFLEINPQYTLYSVRKCFEFTNRTLCFHLFNPRSAERRRRDGWSLQRTDPCTAGAGKDSEAGGEDGGRR

SEQ ID NO: 176795 - protein, 56 aa, Triticum aestivum
  Clone ID: PAT_TA_71213.pep
NGLCPISYCLQFCSHFKSVITELAALRELNHNVLPLSKYKMFFDCKKTSFILIRRL

SEQ ID NO: 176796 - protein, 114 aa, Triticum aestivum
  Clone ID: PAT_TA_71214.pep
RIANSPFYSCQHCYTGEIYDVSVTLFAHTITAPKDDKCTNKTFSKLYGTVTDAFRSFGSSIQNRVALTSLEHIIIKYPRFPSVYFARLHGCTYVRTFIRGPPSSDQRSRRRVPW

SEQ ID NO: 176797 - protein, 76 aa, Triticum aestivum
  Clone ID: PAT_TA_71215.pep
KHISSHSLHEPEALSLYVSILEQQAKYDAALEVLSGDLGSLMGREEDKLRLQGGREYYGNVALSYLSDHTELQCRG

SEQ ID NO: 176798 - protein, 106 aa, Triticum aestivum
  Clone ID: PAT_TA_71216.pep
RAESKKNNKVEQGTASKEPFTSVSTDIRVAGQKRKQTKVYRPKGTATNTELKMKLDNNSKAIVLGGNNLNTSDLGTTLCQMYEEGNNDSYKKQKTELNLIPLRSAD

SEQ ID NO: 176799 - protein, 64 aa, Triticum aestivum
  Clone ID: PAT_TA_71217.pep
TRIFLREIYNTTKILVSSLYMCMFVKPFICLLLLHEKFIFLTFVTQWVDIFIQVYVKTCMLLQY

SEQ ID NO: 176800 - protein, 142 aa, Triticum aestivum
  Clone ID: PAT_TA_71218.pep
RKLHWIISSRTQTQSRSTNERRDKPPYDDRSAKSKKVKVASQLDTVIGCSTSKPTRFCTICCGPGHKSTTCPQRGDTPQKKRKEAKCSICGVGGHRKNTCSNPKIVVHVAEQPAHYPAIEASFPCILTAHCQPPYIHYVLSD

SEQ ID NO: 176801 - protein, 79 aa, Triticum aestivum
  Clone ID: PAT_TA_71219.pep
RYGSQFVVVVDFQREMKSSRSSFLLMFLLQEAMEDHQSCFCLSTPRQTQQPWMGLTILLFCNPLALGLDASLYLYTYRK

SEQ ID NO: 176802 - protein, 134 aa, Triticum aestivum
  Clone ID: PAT_TA_71220.pep
TVNRKGKGGENNTLDVLILRIAAACSRFSSSLSPTLWRLLRRYSLPVLHPCVFSSPARSAVVGYCQNEVRYDQSQKPYTENAAVVALVVALVAARRQCGGDLEPNVAVEATTAAAAPPSPRAASRSQSMACAES

SEQ ID NO: 176803 - protein, 91 aa, Triticum aestivum
  Clone ID: PAT_TA_71221.pep
QPGPALQPRGPDPAPAWASGRPASFASYWGEPMVRPAPAPSFFPIVGPARYGPFRVFCHSTFYLFFLGVWQFCRIAPVLFAFNISQTMHLL

SEQ ID NO: 176804 - protein, 73 aa, Triticum aestivum
  Clone ID: PAT_TA_71222.pep
VLNFKGLHSFSKTPYNILVIVNVDFYFIFENHFFSRKLTNQLSRCLNLSMINTLSIWVESTLVVRKKKKKKKK

SEQ ID NO: 176805 - protein, 71 aa, Triticum aestivum
  Clone ID: PAT_TA_71223.pep
NVSRNASSSLKFYFLRSSSRLLYSFAECKPLFDDQSQLWTQFFFCFIATILMLFRLVTLTLKTDKFFQGWF

SEQ ID NO: 176806 - protein, 58 aa, Triticum aestivum
  Clone ID: PAT_TA_71224.pep
VVRVPIISSKFQTASFFPPLYLKGSVTSQIGTASVDGCSCSCSDAQALRVNNSDNQIG

SEQ ID NO: 176807 - protein, 63 aa, Triticum aestivum
  Clone ID: PAT_TA_71225.pep
AITSSDWRCARQSSPRTGVVHLQSCKFPSFAVVRSAVLHWVMLHFVPLLDQQFYTLCRTSCRF

SEQ ID NO: 176808 - protein, 91 aa, Triticum aestivum
  Clone ID: PAT_TA_71226.pep
QVTSIMPLHPQGSRGVFGELKGSFAGFGFLHNVKLLLVNLQMYSCVHVDLMDGCAFGCPVTGLVCPCVHPGMHDLVLLADLRYWSYEPMYG

SEQ ID NO: 176809 - protein, 53 aa, Triticum aestivum
  Clone ID: PAT_TA_71227.pep
ASSCSVFIFLLKNRITPRTLHHFNANKHSPCSFEEITSFTNISMHSGNHEVTE

SEQ ID NO: 176810 - protein, 98 aa, Triticum aestivum
  unsure (1)..(98): unsure at all Xaa locations
  Clone ID: PAT_TA_71228.pep
RHGVRINCISPHAVPTPLVLEQFSQLYRGADEAQLAAIIGGXRELKGATCEAVDVAKAAVYLASDDAKYVSGQNLVVDGGFTTYKYMNMPPRKPQDQE

SEQ ID NO: 176811 - protein, 90 aa, Triticum aestivum
  Clone ID: PAT_TA_71229.pep
KMLSTMNIFMHYNCVKSSLGTNKKWFSTANIFMYSFSGEKEVFDQISGDNPKLSPASQEKHLMWPQNGHNVADSKQYFATQRGQDAFHEK

SEQ ID NO: 176812 - protein, 83 aa, Triticum aestivum
  Clone ID: PAT_TA_71230.pep
YGNTASCYTKTDAMPEVLKDTKKCIELYPTFYKGCTRKGAILFVSKECDKARERVFLSGMSILATPFFCLFSIAILYTMFSLT

SEQ ID NO: 176813 - protein, 90 aa, Triticum aestivum
  Clone ID: PAT_TA_71231.pep
FFLFFFFFFFCERNKTQWISRSTSGAFIRPQKTAIQHEVRYQKREYIRRANYEAIITKHTNKWRNSSALSMYFTKTASHGTLIRIGAAVN

SEQ ID NO: 176814 - protein, 45 aa, Triticum aestivum
  Clone ID: PAT_TA_71232.pep
ETATGDKKDCLCFIEVVAHKDDTSKELLEWGSRVSAANSRPPNPQ

SEQ ID NO: 176815 - protein, 78 aa, Triticum aestivum
  Clone ID: PAT_TA_71233.pep
IDHDYLDHGYITMIGYLDIDINGYVYTNISVTTLVNRIRVVSSVHATPAVTAGGKRGETRKTPEGDAVTALRADPSET

SEQ ID NO: 176816 - protein, 92 aa, Triticum aestivum
  Clone ID: PAT_TA_71234.pep
KFTKWLDKKFPEKANELINKYQDTVDSLQQQVDTLKCELEELRRRHRKRSAEEVVVIHGDKCPCGKSLCDLTCRGREKQTRPSQTPRLARDN

SEQ ID NO: 176817 - protein, 88 aa, Triticum aestivum
  Clone ID: PAT_TA_71235.pep
FGRGCVGCYAGQGGQVLGLSFFSFLDGRAESFLKWGVCQGTSGSTCLLPSRVQFVFLFCVRSISFPFQIWIRFGSGHNPDGQKKKKKK

SEQ ID NO: 176818 - protein, 87 aa, Triticum aestivum
  Clone ID: PAT_TA_71236.pep
PRRPRRRPRLRWWWTWSWGSEEGEEAWILSLGLAALEPRLFRTDVIIHHQSIHLSISDMSACTTTYACMHANVGCLENEKRSDVLTM

SEQ ID NO: 176819 - protein, 88 aa, Triticum aestivum
  Clone ID: PAT_TA_71237.pep
FFFFFFEHKRKPVFIIPFPQMYTKLYFVQLEPLNSKFTLQSNEHICDIECDFDGLLEQETSTSEGYRHPWGSSWEECVDDIGIAHAYA

SEQ ID NO: 176820 - protein, 64 aa, Triticum aestivum
  Clone ID: PAT_TA_71238.pep
RVCKSCSCGFCPMLVEMSNCSIEGSLDLRSSDASNNVEAPENQALVEWHPDEASDGATVNNVGC

SEQ ID NO: 176821 - protein, 119 aa, Triticum aestivum
  Clone ID: PAT_TA_71239.pep
ILIRYNRFDAGSKCIHASNNNNNIYNPSLVRKEWGTSATPAHHQALLQEKTQGVRDRVSPWRQRRNKQFDKITSSTKQTDNSIFRTGRKCGYPFSFRVCMSSCCSVEKNRRPLPSRGLS

SEQ ID NO: 176822 - protein, 73 aa, Triticum aestivum
  Clone ID: PAT_TA_71240.pep
FTNLQGNRGFLQSDQELLAAPGATTAAIVGQFASDEKAFFRSFAAAMINMGNIKPLTGGQGEVRRNCRRVNGS

SEQ ID NO: 176823 - protein, 67 aa, Triticum aestivum
  Clone ID: PAT_TA_71241.pep
LCVEVCYILYISSKHNTLSTLLIPKKTMVRTNVIPHRFKRVFFREIEFTSQGKLDWVVFVSSCQIGL

SEQ ID NO: 176824 - protein, 153 aa, Triticum aestivum
  Clone ID: PAT_TA_71242.pep
QYNEQNRQINSRRGNGFFVPKLSGSSSFIHPTSTSKTYTADIGTLKKNSQTFIIFFSATSYTSHRRTTMHPISMYTHLNLGMVSHQIKASPAHRTTRPGSKPKPSKKIELEPRPNQTVCFFNPTQSKPFLIFGMNPQTQTMDEALNMIVSSFV

SEQ ID NO: 176825 - protein, 94 aa, Triticum aestivum
  Clone ID: PAT_TA_71243.pep
STPQISVSSSNSYEQTRCYFPNSVHDYRIFALPRTGSHEANHGETDGEEYVRRLTSSPQGHSSSCVSVLSLDRGGMKMIVRPQPASSRRGRAHD

SEQ ID NO: 176826 - protein, 57 aa, Triticum aestivum
  Clone ID: PAT_TA_71244.pep
QNGLAKKDDKKGTVVYNRYYHIFVEGELQRLVAGMKNAAIVDQFYDKSNWCIVLEKL

SEQ ID NO: 176827 - protein, 58 aa, Triticum aestivum
  Clone ID: PAT_TA_71245.pep
ENNADNPGKAIFTYVQNYTECHDSRNSFLIFSGILLIPGAPALPTNGLAVHSCSREEG

SEQ ID NO: 176828 - protein, 71 aa, Triticum aestivum
  Clone ID: PAT_TA_71246.pep
KVIDYMMQPILFSWSFLTQFSIAGYCIYTVFPRERTEMWLGEALIQNLTFCLFQQWPFLLFASLINLEPSF

SEQ ID NO: 176829 - protein, 65 aa, Triticum aestivum
  Clone ID: PAT_TA_71247.pep
RRHRLPEDQVHRPQGQDLRLVARPPASRCHHLIWFGFISVCKKRFLLCVCSSSVVLVENNHQLLF

SEQ ID NO: 176830 - protein, 130 aa, Triticum aestivum
  Clone ID: PAT_TA_71248.pep
FFFFFFFLHPVHRLNNHHSTNIHETWFSHQHRVPHEIEEQVWSKCSQKNTRKSSEYKYLRLQHLNSRFQFSAMPNRLVRVVWLRPSIPQFLHLPSFCDFFGASPLSGQVVRLCPSRRHMLQNLVRLLRHS

SEQ ID NO: 176831 - protein, 97 aa, Triticum aestivum
  Clone ID: PAT_TA_71249.pep
FFFFFFFFPGKQKVHSHCHPNAGTCKIYFGIKTVIKKLFSGLEDHPPHTYPRYIFRDLQKEMQTGPLNILAGVLVRFTTLEKVFHNIVILGAFKAGT

SEQ ID NO: 176832 - protein, 77 aa, Triticum aestivum
  Clone ID: PAT_TA_71250.pep
FFFFFFFFFWETVHRVYVIFPKQASSMVSFHSSQLDKIWEKRNTNRVATNATLIAKFRKVEWFLSAQEGREEGQETD

SEQ ID NO: 176833 - protein, 85 aa, Triticum aestivum
  Clone ID: PAT_TA_71251.pep
RLQSFTTRSKQHCHPQTQQADFFLTKQNPRGCHPRPTKTEPKRYWVGQNTSKAADIGLPAVPNPAQLKPKQNAIGSAEILQKLPT

SEQ ID NO: 176834 - protein, 85 aa, Triticum aestivum
  Clone ID: PAT_TA_71252.pep
ETKDEREQMSTQKAVDGGHHVSAGSYHSTCCDCHPARQQPLAIFSTHVCLGYSCFIFSISGVGLALVGCNAWPVDGFVNSKPSSS

SEQ ID NO: 176835 - protein, 117 aa, Triticum aestivum
  Clone ID: PAT_TA_71253.pep
FFFFFFFFEPKESIRALLLQTKMPARCNGKKSHALPPPTSRENCKLHPNNPCPPSTPPHTICFTHGSRPPPLPLHDPSLYDMNQQPENFIAGPCWLHNYCRGRRKWSSVWLAACLLQ

SEQ ID NO: 176836 - protein, 103 aa, Triticum aestivum
  Clone ID: PAT_TA_71254.pep
AAYGGRLEATLRDKDYPIGRMLFTLAISVVDWHGDLAVGCNAQSQIPAGRSSNLIASLNLSNKGTGQVGIRLNSSEHLQIALLALVPIFKNIWKLLDNYYESA

SEQ ID NO: 176837 - protein, 84 aa, Triticum aestivum
  Clone ID: PAT_TA_71255.pep
FFFFFLNTEGGKFSQLKVATESILTKKRKLNGDAISVSEHKFIFIFVTHYARQVKKSGRWWGRKGNSVTPVPGFKLPPLPPNTP

SEQ ID NO: 176838 - protein, 54 aa, Triticum aestivum
  Clone ID: PAT_TA_71256.pep
QIGMFCYTGMNAQQVERITKEFSIYLTKDGRISMAGVTSKNVGYLAKAMHEVTK

SEQ ID NO: 176839 - protein, 83 aa, Triticum aestivum
  Clone ID: PAT_TA_71257.pep
STSEYCLKKNLYIGNKFTCRVSLCSILYCIVSAKYFRKRICRVDYRANQILASSTKILQFFQHRSIKLLSQKNYNGYEPIRNV

SEQ ID NO: 176840 - protein, 103 aa, Triticum aestivum
  Clone ID: PAT_TA_71258.pep
NKTDDTAARVLKFRQQQLQRYTRTGSLSSANTRQNNNHQVEHITHQTEPTSLSAQELRPQISTVHQPLPLQGRALPTPISDTLPNNYSQDHTLQGLIIQFQEG

SEQ ID NO: 176841 - protein, 73 aa, Triticum aestivum
  Clone ID: PAT_TA_71259.pep
VDRQANTSGQNSARCLERCVKNKPISLKHRCLFVEHRHLLRHLCYRNKHRYLREKTIYLYKHFSKHLAVYMVL

SEQ ID NO: 176842 - protein, 70 aa, Triticum aestivum
  Clone ID: PAT_TA_71260.pep
ERLELEKERQQKLDEEIEIKLLRKEQVPRAHPMPDFSRPFMPKRSVKPQTVPREPRFHTRPTRHSPKTRS

SEQ ID NO: 176843 - protein, 58 aa, Triticum aestivum
  Clone ID: PAT_TA_71261.pep
EECQDCSQDNLEGENEVHRCLLSLLKVALSCASQDPNERMNMREAATELHAIDTLYVS

SEQ ID NO: 176844 - protein, 95 aa, Triticum aestivum
  Clone ID: PAT_TA_71262.pep
FFFFFSRMLIFYFDFTVHMNSFELKLRRVLSAIDNCLVWFATSTVELVLRMLFYAYHQPTEEILMVGKILRTYLCIANYCTIISTTPCLYISDQC

SEQ ID NO: 176845 - protein, 115 aa, Triticum aestivum
  Clone ID: PAT_TA_71263.pep
GHSIVVWTLEDYAHRLWHWTLKCHLNMADAFGRKDLVCYDNGGIGGVPDWFWNCDYRILALELERELVVLSDHKTMKLISYNISTGELNEIRDGLEGYRYYVPCYSELPAQEPSV

SEQ ID NO: 176846 - protein, 65 aa, Triticum aestivum
  unsure (1)..(65): unsure at all Xaa locations
  Clone ID: PAT_TA_71264.pep
FFFFFFFFFFFFKRSQNNITHYSSLXGVDLYAGCHGHSAVTYEHILQAYKITIPALTELIQCKVK

SEQ ID NO: 176847 - protein, 103 aa, Triticum aestivum
  Clone ID: PAT_TA_71265.pep
DATAERARFKLINGKEIFQEKTYLVGVECKRAARDNFSIEESLKELEQLADTAGLMVLGSTYQKLSSPNPRTYIGSGKVAEIRSAVQALDIETIIFDDELSAG

SEQ ID NO: 176848 - protein, 40 aa, Triticum aestivum
  Clone ID: PAT_TA_71266.pep
GNVITSRSPGTAMEYAVAVVEKMLGRDEARRLAEGLLFLG

SEQ ID NO: 176849 - protein, 84 aa, Triticum aestivum
  Clone ID: PAT_TA_71267.pep
GADGARARAHRRQCRRCCGRRQEKACRSGQSRCRQLIARAGRLCVADDGHRFLDHLNPRLILLAIGIFFSSFVIYSTFLGDSKQ

SEQ ID NO: 176850 - protein, 70 aa, Triticum aestivum
  Clone ID: PAT_TA_71268.pep
KMNKDLQAVDLEEPLSWQAYNYAKVSFKIVGGTLSGLIIDPRSVTIYPSVKAPVEYSMQASSGDYILWNT

SEQ ID NO: 176851 - protein, 89 aa, Triticum aestivum
  Clone ID: PAT_TA_71269.pep
CNDALEAKIQAIREGMSLVLQWSNLPVMVQSDSMEALSSLSNASLAKSPNGHLVDEIKSLLLEREFIPVKITRSQNRVSHCLAKCSYGL

SEQ ID NO: 176852 - protein, 87 aa, Triticum aestivum
  Clone ID: PAT_TA_71270.pep
KRKRKKEYVWFHITARHVLLCKCVCVCVCVLKEWETEELITFCICCPIAWWLVMAVHQGRRRRRERQQRRRGRRPLLHGEGEGRWRG

SEQ ID NO: 176853 - protein, 114 aa, Triticum aestivum
  Clone ID: PAT_TA_71271.pep
WSKLGITWGAGNDRFEWLTHAKRGQAHVHGSLCGGAWRRRFKQDFGLLKCLLFLPAVRVLPLLLFIALGSPHGGAPRVYFVNHVTPTHLLCLLNTMRLGNLLQSFKVQKKKKKK

SEQ ID NO: 176854 - protein, 128 aa, Triticum aestivum
  Clone ID: PAT_TA_71272.pep
GEQSASIYQVVTVQVYTTQLLLTALDTSQHSPPYTKLLKTSPSYPLVPCLIRYFSYQQNKRIAQIERRQARNNSRGKFWLVSIKRLEVQRHCQLIPVSDDQRQMTDPLMPQGQQIRHLSCPVEASCHD

SEQ ID NO: 176855 - protein, 161 aa, Triticum aestivum
  Clone ID: PAT_TA_71273.pep
FFFFFFFFLGTTAVLKILLQQPYGCYTAKKLISWIQLPYPQSENLCYNNNPVLSLFNKYICPRFFTTLASCKQLSEFFFSWLPMNAALLEDLQEVLLAVQCWSCLKVSAKLTGGPCITIRSREFHPIVEIILLAHEGRGARNVTGNPVTGCTNDKLSACNA

SEQ ID NO: 176856 - protein, 63 aa, Triticum aestivum
  Clone ID: PAT_TA_71274.pep
STNGSIHQHGLKLHDHEDPSFFSHSKSYQEPASSGLLNTKRAKTAKPSIRSPELMILYNQKYI

SEQ ID NO: 176857 - protein, 70 aa, Triticum aestivum
  Clone ID: PAT_TA_71275.pep
AATTSLMAGVSTLTSMSAILGEMLGSGRATPRLLQLYAPYVVFAVIAILRGLCSCSAPPSPASSARKKRV

SEQ ID NO: 176858 - protein, 70 aa, Triticum aestivum
  Clone ID: PAT_TA_71276.pep
KIPIKARQGGHRACKLNVFLLHTTQKGRKGDDLLSWAKSLSTTKMISIPNEQGKTSQGSLLFSPRFIPKL

SEQ ID NO: 176859 - protein, 68 aa, Triticum aestivum
  Clone ID: PAT_TA_71277.pep
WVAAMSCSVSSDLNYERGEKEESELDGRGSYGSWWANRAARVRPAEILGRRTRRRSVAFFLADVCMLL

SEQ ID NO: 176860 - protein, 77 aa, Triticum aestivum
  Clone ID: PAT_TA_71278.pep
PPPPRRPPSHPPNPPPPPLPPAKPVPLPPPWGPRPWYSGCSDQLIWLAIPFSIKSSLAQILSDFLFSVNLFLPLLLG

SEQ ID NO: 176861 - protein, 93 aa, Triticum aestivum
  Clone ID: PAT_TA_71279.pep
AQLEGGGKKKPAAAAPAKVLLRKKAVAAAAPAPATEAPAKKSLKRKAVAPAAGAVARTSPKRKTAKAPAAKTSPKRKTAEAPAARRTSPRSKH

SEQ ID NO: 176862 - protein, 122 aa, Triticum aestivum
  Clone ID: PAT_TA_71280.pep
YPCQKNSNWPLALGNYTPIKDGGVPSTLGASRAKSASEPSVARWLLGGVASRSDLLVWLRSGRPNWDIHDRWITREPATVIGRRRERPQVSHRMLSCMRSRALNRLAASSPHARKGRLRQAR

SEQ ID NO: 176863 - protein, 74 aa, Triticum aestivum
  Clone ID: PAT_TA_71281.pep
LRARYPVAYNRRTPPALHHRTSCIFVSSLANTACIAPVAVLKRTTSSTTTTLDKVLLFPAKKKKDKVLLLLVTA

SEQ ID NO: 176864 - protein, 72 aa, Triticum aestivum
  Clone ID: PAT_TA_71282.pep
LKGCIYRWTSTRMIRSLSHLAIKKTHLILSSTHISIHYKYALAGSPTEGSANPANSQHFSINKGYSHSLISQ

SEQ ID NO: 176865 - protein, 76 aa, Triticum aestivum
  Clone ID: PAT_TA_71283.pep
FFFFFLIKMNLRQLVFNSSQLLFPYITNTRILPNSLKASIERKARVQTQYYRIMEFQVQKKKMIVEMTRKLLHFFN

SEQ ID NO: 176866 - protein, 93 aa, Triticum aestivum
  Clone ID: PAT_TA_71284.pep
AGHGGRAPQGRQRRRRPKPTARGHGNDPRGHRVSSSVAQRKHAIACRTQHNKVAQLCMPKPLRHHFPASIGMLHACQALLANGKYDRSAQLHM

SEQ ID NO: 176867 - protein, 93 aa, Triticum aestivum
  Clone ID: PAT_TA_71285.pep
TKKQQESGERVQATAPASIPQLAHPVPPSKPKDPFEADNAFRAAIAAARQVLVRRQREEARQERDKMVQTVYFNDPSMTLENVLKAQALIGSC

SEQ ID NO: 176868 - protein, 88 aa, Triticum aestivum
  Clone ID: PAT_TA_71286.pep
FFFFFFFFFQASSTRRAEDLIDATTCLHVKVSLQLHALFRTVIVAIIKEEIKEEEKKKKMDWSKIALTTSQSKRVTSYSTYKQGGLYY

SEQ ID NO: 176869 - protein, 109 aa, Triticum aestivum
  Clone ID: PAT_TA_71287.pep
CSPRCSAACVRAVQKSEACSVVEHQMAVANSPSIPSLCRRQLLTWRCSLDPLHHRHPADTTSSNGGPLQIPCSSSTAAATCCLDEEEAVCSPRDAGVQSVCAAPSPTTA

SEQ ID NO: 176870 - protein, 58 aa, Triticum aestivum
  Clone ID: PAT_TA_71288.pep
LVYHVHVTTTINLRHSLSGSSCRKFIIDRMLYSRCFYSIDVYKPRWNNIKHVLALLKK

SEQ ID NO: 176871 - protein, 108 aa, Triticum aestivum
  Clone ID: PAT_TA_71289.pep
QCRKLCANIANTWTTTAVASTSTRSQQETNKGRAGTTRQHEKLHPHIRTNMAAGFHHRTGRDVDTNDGRTAGHSGMATSMGRHCLRIISRRRNPPNMNLRYCCTAAGL

SEQ ID NO: 176872 - protein, 52 aa, Triticum aestivum
  unsure (1)..(52): unsure at all Xaa locations
  Clone ID: PAT_TA_71290.pep
VQGRAXYAVEKPGQVEMLRFLVRLTHYSLXTKHRAGAVVNANVSSMESSRRS

SEQ ID NO: 176873 - protein, 75 aa, Triticum aestivum
  Clone ID: PAT_TA_71291.pep
ARPHHAARTPARRRCRPRPSILFLVPSARTRQEWSFPTTTAAGTLMKLFTVIVRWFIGCNFPLPYGSMYIAVTSY

SEQ ID NO: 176874 - protein, 52 aa, Triticum aestivum
  Clone ID: PAT_TA_71292.pep
VDKTTNETLMNIEVVANNMKDRSHHLEKKLYKVKRQAQAREHEPFAPVIRRR

SEQ ID NO: 176875 - protein, 50 aa, Triticum aestivum
  Clone ID: PAT_TA_71293.pep
RDMEAGFAPLQMEERRSAKIARKEDEEEYRLIQQEEQRERAKKKKQRTES

SEQ ID NO: 176876 - protein, 47 aa, Triticum aestivum
  Clone ID: PAT_TA_71294.pep
FFFFFFFLHSQNIIKLLGIYRGNTEQTGGGGGVTMQVKLMQIGHITV

SEQ ID NO: 176877 - protein, 108 aa, Triticum aestivum
  Clone ID: PAT_TA_71295.pep
PSKTLNANCYKAQIQIATQQAPIFPNRNASTPCNHPQCAHLCPLTHPPLNILYTNGRNTQLLRRGVCITSQTPREFRPQGTTWLTHTYIHTPVSELSHSRSAHKYVTK

SEQ ID NO: 176878 - protein, 68 aa, Triticum aestivum
  Clone ID: PAT_TA_71296.pep
SVVHQCVVKVDERGTVAAAGTVAMSAGFGMVRDRPVDFVADHPFAFFLMEDVSGVVVFAGHVVNPLSH

SEQ ID NO: 176879 - protein, 70 aa, Triticum aestivum
  unsure (1)..(70): unsure at all Xaa locations
  Clone ID: PAT_TA_71297.pep
EDTLPTLPRFPSTFPHRSLFSRSHMXHLRKLGGQHNPDVKQASGSSISWRNGCCLQLRECRINYSPSATL

SEQ ID NO: 176880 - protein, 72 aa, Triticum aestivum
  Clone ID: PAT_TA_71298.pep
QLAWQLTLLMVPEYVKRDHGLPDQPYFSLERTTYEKLCSSAQCWLTCVIDDCCSYISPISAAELPLCTSRKL

SEQ ID NO: 176881 - protein, 59 aa, Triticum aestivum
  Clone ID: PAT_TA_71299.pep
PKLSYFFFLKVRQTPPPVGGYSNMGKSKGLVFDPPSEPLENNKKKSPEKAFGWDSLSKS

SEQ ID NO: 176882 - protein, 108 aa, Triticum aestivum
  Clone ID: PAT_TA_71300.pep
NPSAHNLPARRCFVKLMFIFLMLILHYSSETFLAYSTFRMNTYFSQLLDNKNYKFEYISYFINLYRIQSIGIRLVRNKQIPRYRKSQTGLKQLEKTQKTAYFHITSSL

SEQ ID NO: 176883 - protein, 95 aa, Triticum aestivum
  Clone ID: PAT_TA_71301.pep
FFFFFFFFFFFFNSLHKCAANFLEINSSAINLKASKNNQQSPEVHTRTKQAYSLCGGKNISKSNPPKPTLTISGSWNKDPHPPRGPKRNHQQLKN

SEQ ID NO: 176884 - protein, 74 aa, Triticum aestivum
  Clone ID: PAT_TA_71302.pep
FFFFFFFNRGNHQFVSQLPTKTVQRLCCTAGQTRQQHGTPVTQAKLCFSPPYSPRGSTTYKITNSRLKLIKQDG

SEQ ID NO: 176885 - protein, 104 aa, Triticum aestivum
  Clone ID: PAT_TA_71303.pep
KKENEEQNAADRTSFETSAAPYKDENFMTFVCGKAGTLDFGPEQTTSDLFDFTPVRMDFASADLDIQPAEEEVYRCLKKQFLRWQNNFKPYQDFCNSYKIQKPS

SEQ ID NO: 176886 - protein, 90 aa, Triticum aestivum
  Clone ID: PAT_TA_71304.pep
MIKWFREKQYSDNKMCELDFLHDSHYQFCPGLHLQRLISLTLACHALLDCKTLTRTEVGRNLPTNARTQHCIKRIDRLLGKRHLHKERLA

SEQ ID NO: 176887 - protein, 80 aa, Triticum aestivum
  Clone ID: PAT_TA_71305.pep
IRDLEKLIMADVDDGGCTVEQDNEAKALVVPMEGAGMALTTVTTKEWMVFDDDAGTGVRQGHFGDYVNPFLTNLTGLGET

SEQ ID NO: 176888 - protein, 111 aa, Triticum aestivum
  unsure (1)..(111): unsure at all Xaa locations
  Clone ID: PAT_TA_71306.pep
MQMRSSNFNKFNQHRNNNYNQQXDRPRPPPGSGLPNQNSTDNASTMQPAAGQQVQTMNQQPQQKQQQVQQQQQQKPNTNDQVQGVPNGSSNQPTRLATPLPQGSSRCVWSF

SEQ ID NO: 176889 - protein, 78 aa, Triticum aestivum
  unsure (1)..(78): unsure at all Xaa locations
  Clone ID: PAT_TA_71307.pep
QKRTEVKLQDLPVXLGACCVLHNICEARXEAMPPELRVEVEDDLTVLDNPVRSDAAAKARDKIAHNLLHRGLAGTAFX

SEQ ID NO: 176890 - protein, 128 aa, Triticum aestivum
  unsure (1)..(128): unsure at all Xaa locations
  Clone ID: PAT_TA_71308.pep
EDQETKQEPSVAGCTSSKLFALHIEKNKAAKMTEQSCTQENFLAVHKSSMFFRLLAEPHAGGRQLKCIRKFAALNSPQSTAKTWGWXGGSLLLFHRELHGRDARTARPRRANCTTQRSSKTPADLHHP

SEQ ID NO: 176891 - protein, 96 aa, Triticum aestivum
  Clone ID: PAT_TA_71309.pep
FFFFFLKEQMSLKAYIFIHYFLHGHRINDAVPNRTALGKDLLIQNDHPFLLPFSLCVSHKQQIKLQNEHQCSLLLLTKCTANDFLKEKKSEMQNKK

SEQ ID NO: 176892 - protein, 66 aa, Triticum aestivum
  Clone ID: PAT_TA_71310.pep
CKGASATWPEEMLPSGSIGASLDETQHKLLRNCSQSTANSWGRVIVTAGWDGRIRSFQNYGLPVHQ

SEQ ID NO: 176893 - protein, 86 aa, Triticum aestivum
  Clone ID: PAT_TA_71311.pep
FFSTSPNSFQKVSYLAKISLSQASLLQQNCQYHPRITKQFARATSSSTHDIKFKTQIKAVAWLHSIVAKQILCIHSFIYCYGFAQG

SEQ ID NO: 176894 - protein, 73 aa, Triticum aestivum
  unsure (1)..(73): unsure at all Xaa locations
  Clone ID: PAT_TA_71312.pep
LSNNYYCRCMQVVLLHACGRPSEDQVDPTFMALCSPSXSRACPALAVTMAVEHDLRRVPSGPSAPPLLATLSG

SEQ ID NO: 176895 - protein, 100 aa, Triticum aestivum
  Clone ID: PAT_TA_71313.pep
KSSYVDFARFFVLNTKGLEEMKITLPYHRQHGWFAHQLSLLRVTSRASPDARIEMRCGTSDDFTHNRDTHDLSMDDPFDLPSSGCSTCEEKGLEDAIYQI

SEQ ID NO: 176896 - protein, 79 aa, Triticum aestivum
  Clone ID: PAT_TA_71314.pep
AIIIIITFKTCVHGVSKNKKTSGNVSKNTRVVKCTNKTSIFKCCYAYTKNAFIAPRMQHAASRRTSYLPHEDAPVIFAR

SEQ ID NO: 176897 - protein, 99 aa, Triticum aestivum
  Clone ID: PAT_TA_71315.pep
FFFKRMPTERKSHKKLYGSFIKPGKRLFSKKKLKGTLRRATVSAMVSASLVHLNHDRLYHGSTSMRKGDMDMILIHDLSISRQRLILAASQNRYERGHR

SEQ ID NO: 176898 - protein, 104 aa, Triticum aestivum
  Clone ID: PAT_TA_71316.pep
SDRFMFSVDQSRFGWLPWSSELLQTLIGVFSPGSSLLCRLWLPVSLGLHRRLFRLLFLQAPGFKKFASPRRLPKGLLVYTSMTFRPLLLQAFGFKNVCFAKAVA

SEQ ID NO: 176899 - protein, 83 aa, Triticum aestivum
  Clone ID: PAT_TA_71317.pep
ASSCIQYIYVPLLTNVRLCFFLGMEMFLGTMTNINGGTTFLFYFLLPLLYCCCHKDLPGHGAIMMCLKMITLSFSNLMVLETS

SEQ ID NO: 176900 - protein, 78 aa, Triticum aestivum
  Clone ID: PAT_TA_71318.pep
MKWPYYNRRTWGPLYRPGWRCSALTLETTTYLPHQDFRSSLLHRLRKLTRKLLGKYHFLTGQGRYCPLVQHACVRDHG

SEQ ID NO: 176901 - protein, 86 aa, Triticum aestivum
  Clone ID: PAT_TA_71319.pep
GAGRLLEFRNKRVCDLCAVFGVQINMGMQSHILCILEMASLSLKTILHINMIVPMLWSRVKKIRYATTDFSSGGLHHRSIIQMFLG

SEQ ID NO: 176902 - protein, 140 aa, Triticum aestivum
  Clone ID: PAT_TA_71320.pep
ACAPAEQGGFILFSKGQATARDLVKQRLKSFNASFDEMYQKQSAWIIPDKDLQQRVCHLVVQAIVPVYRSFMQNYGPLVEQDISASKYVKYSAEGLDKMLSTLFMPKLRTRRTASMQIRSSNGKIASAVTGLQRSASTLQ

SEQ ID NO: 176903 - protein, 86 aa, Triticum aestivum
  Clone ID: PAT_TA_71321.pep
MLDSTWLLTFFSIVPLQVSDIPRSPATNVPSGSAPPAYSWTAPSPGVCAGPPGFAVAPGTEILKEICPRGNNKVIIYFLKKKKKKK

SEQ ID NO: 176904 - protein, 118 aa, Triticum aestivum
  Clone ID: PAT_TA_71322.pep
RHYFLRLKISVSSLVQRRGYYRGVLRSKHTETEQKGAKGNLTSQSLLFLPPALLWHAEMHSVLAHLPFCRYDVSAPHSLAISFVAHPKLLSHPGLLRIQPILITNNNNSLKYSSDIRL

SEQ ID NO: 176905 - protein, 93 aa, Triticum aestivum
  Clone ID: PAT_TA_71323.pep
RPTSWLGKTAKMLCQTYVDAYFDEDMNHGTSRAILLDGRRFFIVITTQLIGQVYDGGTTEAYAILHGLILVDHMDCNRIIVNFDCMVEISTPQ

SEQ ID NO: 176906 - protein, 92 aa, Triticum aestivum
  Clone ID: PAT_TA_71324.pep
SGTTTVKRRVRNVGAGPWLQYNVTVVQPAAGVRITVQPGTLSFGKINEEKEFTVKLEICDATAAAGYVFGSIEWSDGKHRVRSPVVATTKCG

SEQ ID NO: 176907 - protein, 139 aa, Triticum aestivum
  Clone ID: PAT_TA_71325.pep
MSLYLKRSGRSTLRRQLKHAPNVIAGTNNVVRSGSNNVVAGNDNTIIIGNNNAVSGSYQVVYGNNHVVTGDNHVVSGSNHAASGSHHVVIGKHNIVSGTHNDVGGSKNIVSGSNNVVSGSHNTVSGKNHFVTGHNKVVT

SEQ ID NO: 176908 - protein, 123 aa, Triticum aestivum
  Clone ID: PAT_TA_71326.pep
FFFFFFFGQGKTHNPKFIVHHKFTTTLLKVHGSSQHHSRSIVHHNSTHNSKFITTKEWHEIITLTSTIHMRRSCRHPSSKYQEQHPHGEYQLLSPPTSTILGNLIFSTSSSSSSSLSTKLKSL

SEQ ID NO: 176909 - protein, 99 aa, Triticum aestivum
  Clone ID: PAT_TA_71327.pep
ISLFGYQARSSYALVCSFWHATSTHGKNNCTQYPPADHMYQICENILGNFHEWPQVIEHAQVVKIAGSVVDFLPFIVAHCVREVVIGQEVGHLPKTRTQ

SEQ ID NO: 176910 - protein, 93 aa, Triticum aestivum
  Clone ID: PAT_TA_71328.pep
FFFFFFWFFNQKYVIVMHDGAKLSKTQNTLHKSTTQKIKILYIKCKQHPIVRTPIFHLVTHTVHGHAAKASVITSRVHAVVIEQLHKDPHSQK

SEQ ID NO: 176911 - protein, 97 aa, Triticum aestivum
  Clone ID: PAT_TA_71329.pep
THYPIDTQVKIPMAAAVFHNIIRSHRGDEQWLDTQQMQIDPLLFVTLPDGDDIPRHVPTPSSNQRDLGNSMRDEIANRMWADYQRIRSERSSRRSTS

SEQ ID NO: 176912 - protein, 121 aa, Triticum aestivum
  Clone ID: PAT_TA_71330.pep
FFFFPSNRQELCLFIKKKRIDKFIRKTGRKPIHLRYTHTPAPRLRSTRVDDTVTQVTRDDTLQQNTGLRSRRSDIHTGPEVRHQPSRWLRRPRGQSQHPTHTRSPAPPHRLPLRPRGREPT

SEQ ID NO: 176913 - protein, 95 aa, Triticum aestivum
  Clone ID: PAT_TA_71331.pep
DLFYFGANLYESGWPGLGRLNSRTWQRLAVCAERSSYGAIWYFAHERCKAYFAHCFASFNCHQSTLLEHSEQIASFTNMHVSYVCLSPSHMIIMY

SEQ ID NO: 176914 - protein, 67 aa, Triticum aestivum
  Clone ID: PAT_TA_71332.pep
WKAYMRSMHMPAVDLPNTHMFMPHDIQIAKIFRLWLLNDKALARGVRLNCAMTLCVMLSNIVCIQLV

SEQ ID NO: 176915 - protein, 61 aa, Triticum aestivum
  unsure (1)..(61): unsure at all Xaa locations
  Clone ID: PAT_TA_71333.pep
MMHMKRERRVAAVNKFREKRKERNFXKKVRYQSRKRLAEQRPRVRGQFVRLPLRDNLPPHT

SEQ ID NO: 176916 - protein, 153 aa, Triticum aestivum
  Clone ID: PAT_TA_71334.pep
IRHDPRCTELPPPDPIPLLPSGLPQHPKPPPPASAGLPPTASSLLFGGRPPQHKITPVVMPWLQHLPHTHCTRCLKFILIFLNLTGFCFAVYCDIHGAGCTTPSPVALSEARPGSAASGIRVWHGTPARGWFSSSPISSRYSSSWMFNCRKLY

SEQ ID NO: 176917 - protein, 68 aa, Triticum aestivum
  Clone ID: PAT_TA_71335.pep
LKRAGFMKQFIPGENYTRWFSKARGENYMMVQQSSWLLLLDKQRWLGTSHCVVFCRPSYVVPPIYTIQ

SEQ ID NO: 176918 - protein, 100 aa, Triticum aestivum
  Clone ID: PAT_TA_71336.pep
DPQSLVAQSWTIAPQTPIYLLQNRCPTAARRDVTILECSKAEHADTASALLRRGLSPRTPWSSSPAGCFCRVGCCVGRVCDSLLHATAAYVCLLGGCLLC

SEQ ID NO: 176919 - protein, 101 aa, Triticum aestivum
  unsure (1)..(101): unsure at all Xaa locations
  Clone ID: PAT_TA_71337.pep
YTMMFTSSSWSPQSGAHEDDTRPQCCPQHGACDTKKMVLRDDTSSPTLSTMCFLCLDGPSNTASSRDEVHSSLVYRSRPIGGMLLVLADXRKKKKKKKKKK

SEQ ID NO: 176920 - protein, 114 aa, Triticum aestivum
  Clone ID: PAT_TA_71338.pep
RCTVRLGFDGPLNEEQFNLRGMLTLYVEGYDTKFTILKSRVLLYPVGQKKFEVPLLRHVLGLPVGCRIHVKGNLKLGGHRLHVDQYLLLDRKIVEVEWPVVPSIKACICIEVSE

SEQ ID NO: 176921 - protein, 103 aa, Triticum aestivum
  Clone ID: PAT_TA_71339.pep
NVEGGKEVFLLSHVRPHRRVAKATLQTSCTSTIVGDKELGPGCCLVLVNQVLDGKAPLIRPLRDINTMDEALGHSIAWTRQQIQDDTTAAMVAPNQASPGQKG

SEQ ID NO: 176922 - protein, 46 aa, Triticum aestivum
  Clone ID: PAT_TA_71340.pep
MGTVMILLLCDYSLGAWYMAKLILEKGYTGAQVMNVIFAVLTHSVS

SEQ ID NO: 176923 - protein, 73 aa, Triticum aestivum
  Clone ID: PAT_TA_71341.pep
SIPWKSVLSGNMAINVRFRPEMCGPDEYLSPQHHFIMFAKATLIFRSFSLLTLTSPQISSNQPQHSATKTCTS

SEQ ID NO: 176924 - protein, 50 aa, Triticum aestivum
  Clone ID: PAT_TA_71342.pep
PVRAINSTLPCEELYLHFWTECMSLSKPCPLHFEPSSICIRYNACLTSYT

SEQ ID NO: 176925 - protein, 107 aa, Triticum aestivum
  Clone ID: PAT_TA_71343.pep
RARSLFLTPSVAAVIPSATKQRLPDTYKEQEKRILKTLHDYLGELVNCGRLHEEKLSSMPSKFFHEQTSVGSSCGSSSVSRVAEVARVGQTIRQSLHSPASVKSPGL

SEQ ID NO: 176926 - protein, 75 aa, Triticum aestivum
  Clone ID: PAT_TA_71344.pep
DNYAQKSADHNKHVQNKHMRLNSVTEKNAAKRMSHSSIVHTPCPSGGAAGFLRRRVFGFIMRGPNGARGSHGGRG

SEQ ID NO: 176927 - protein, 67 aa, Triticum aestivum
  Clone ID: PAT_TA_71345.pep
SCFSVVVDCQEKKDDAWHMLIARSRIGLLLDSLALCFRTSLSWSHYVTMYLYVFRMYFTNQFKRWHM

SEQ ID NO: 176928 - protein, 94 aa, Triticum aestivum
  unsure (1)..(94): unsure at all Xaa locations
  Clone ID: PAT_TA_71346.pep
MESHFLMHLCAVAGWSGHPVCGKRYHFIIENDSIQMAGRRRTCCLRCGTPMAAXGCNFFSRCLLCNFDMEGEELEECGYLHLDDSSHLLHAVVA

SEQ ID NO: 176929 - protein, 41 aa, Triticum aestivum
  Clone ID: PAT_TA_71347.pep
EVSTVVSMLLPRAAMDRFTEEIAVWLSHKDDEKNLAIMSSL

SEQ ID NO: 176930 - protein, 111 aa, Triticum aestivum
  Clone ID: PAT_TA_71348.pep
TGQDKPGRQEPVLPSDPGDAEPRRLSVLGLPAGWWPCRWHSRWRQFRARHLWHGPHPQPSLPGGLWNGLIGLGLAGGLNECWLEAGSHSDRCISAPTSPIKYKCCLNNLPY

SEQ ID NO: 176931 - protein, 140 aa, Triticum aestivum
  Clone ID: PAT_TA_71349.pep
QRVAVRRGTRALGAAVRRMGDGAASIQMARMGDSGDGGARIRMARRGDLERGGGGAWLLMVEGLPRSPPPGPPPGPRSAIRERAADSVFGSAEGVGTGGAHSCFENPKPTRLRNLDDLGGTSTGLRPCLDMSCSFFRQKA

SEQ ID NO: 176932 - protein, 67 aa, Triticum aestivum
  Clone ID: PAT_TA_71350.pep
LNRIALNLLYKQKSNPTISGTRALPHSQKRIAKRSHPTTSCLVGGLQTQEKCSIAPKQNMKKQQNYC

SEQ ID NO: 176933 - protein, 81 aa, Triticum aestivum
  Clone ID: PAT_TA_71351.pep
TTGLTGREGPVLKSQSTRYSSCNAMEQRELPVGTNMFSGLSLRPKACLTKNGCSLLRSASHHVNYPSYRSVTHSRGIVFVK

SEQ ID NO: 176934 - protein, 84 aa, Triticum aestivum
  Clone ID: PAT_TA_71352.pep
YEKKNYLFQNHHSYIFYFHLFTDFILHKKACKISMNKPQLAVSMPSHNGRCSIGGASMVHQWRATQTRPIPFLNPICPQINCFA

SEQ ID NO: 176935 - protein, 70 aa, Triticum aestivum
  Clone ID: PAT_TA_71353.pep
LWCLAHHCFMCASEGVVQDVKIIVKMKNFYRRRELYSFGIHLVASMKHHLLLRCAVFHICTCCCSFLRYI

SEQ ID NO: 176936 - protein, 120 aa, Triticum aestivum
  Clone ID: PAT_TA_71354.pep
LAVDMGSAQRWLLSVPERLPPPGEANAGGHETPTGSRFWSSLKNSQVGTVCPRGVCIPPCRAEGDLLFSAPRITRIWRTALPTRRHSQNPYFAITRYIHPPRCRDTRIQTHVYSVECYTF

SEQ ID NO: 176937 - protein, 115 aa, Triticum aestivum
  Clone ID: PAT_TA_71355.pep
SYLYVCINWFHIHFDEAFSSLRIANYKAFTRFHIKKNGDLEVFTLAVDKVPKEWMLDPDWDMEPKEPLQMSHTRRFPSKWRAASGWSDPTSVVRVVDQFVIPRTLVDPLLPDSAP

SEQ ID NO: 176938 - protein, 138 aa, Triticum aestivum
  unsure (1)..(138): unsure at all Xaa locations
  Clone ID: PAT_TA_71356.pep
LKVDCRVLPCARAQSISCFAGTRCYIARXLPYSLKAREKSDMSSSVAPSEFLSGRSRTDYQFEGELETVSGVXSHXLQRLDLKAGSYASEDIIKVLNIAIVXITRAPSERPAMREVVKMLIDIDSTSVFGXAKNKNNK

SEQ ID NO: 176939 - protein, 53 aa, Triticum aestivum
  Clone ID: PAT_TA_71357.pep
AARVVAGVPRGSVGLVAVSAAGQVTMAYNTTGMFRACATEDGYSEVAIWPASS

SEQ ID NO: 176940 - protein, 171 aa, Triticum aestivum
  Clone ID: PAT_TA_71358.pep
QPESLAVSCPMLESIELTFDGCEPLYPSEIGFTQDGLIMLIQSCPIRVLVLRGANFFADKGMKALSSAPLLETLELVCCRAITDAGMRFIARAPCLINLTLRICAQVTDAGVAMLVHALKLESLIIEGCDRVSKKAVKRVGESAQCHTSKKRSVQYSAESASPAELKRIRY

SEQ ID NO: 176941 - protein, 179 aa, Triticum aestivum
  unsure (1)..(179): unsure at all Xaa locations
  Clone ID: PAT_TA_71359.pep
PASIASFXVVTTLVLVPIYDMVLVPLARHATGEDRGLTQSQRLGIGFAMSTLCMAYLALLERNRLAVAATGEMMNIMWQAPAYVVLGAGEVFTVIGMLELXYDRSPQNXNXGALCTALSQLAVAVGNYLXSAVLGVVASTTVWISEDLDKGHLDYFFWTMAALGALNLLQFLFFSHEVQ

SEQ ID NO: 176942 - protein, 153 aa, Triticum aestivum
  Clone ID: PAT_TA_71360.pep
TCPRLSSATFRLWTRTSPSQKKIKRAPAQEGAKKQKILVALADDDVKQADGELNMSQGEKCDGQTIDRSFEEKCAIYPLVGQEVKRLAGEHPGLKSSFTELDGKIALLMEKELNKVAWKELKIQIEMDTKVQAPKARVRKELVSLLALVSKKG

SEQ ID NO: 176943 - protein, 108 aa, Triticum aestivum
  Clone ID: PAT_TA_71361.pep
LSSSITLKFSCAVQAFYWSSTQINCPMDGCFATLHNTLLHGSGQVSLAHIVSRTRWSNAFVCIRSVLQWTAPVSSAQNKLHMIPSQRFLPSLRKECRRFLTGRHGALS

SEQ ID NO: 176944 - protein, 61 aa, Triticum aestivum
  Clone ID: PAT_TA_71362.pep
MSAAASAGSPVGDQDELWTELDAFASPKLMDLIAAGHATPFSCTWEEPEEDGDMMRLWSFC

SEQ ID NO: 176945 - protein, 139 aa, Triticum aestivum
  Clone ID: PAT_TA_71363.pep
MSDDDGLDNRYNLMLAESGALGVSEELGQRLKLWTKEPSYGTDAIWVLSRVINLNILLPNDALVDAINSVQVLGFAHEANVTFVVTVAGLFSIELQSKRVRKVSGHRGFCNLIPVVSFYTPHARLKALVGEHPMTHRHG

SEQ ID NO: 176946 - protein, 87 aa, Triticum aestivum
  Clone ID: PAT_TA_71364.pep
CWFQNHLPIPPRVIWMVRKSSVALMREEAVPELDRECTFHSLIVYCLVLALQVWFSFRMIDKAEDTCGFFSSTCCICIFNTISFHKY

SEQ ID NO: 176947 - protein, 134 aa, Triticum aestivum
  Clone ID: PAT_TA_71365.pep
RFWCKVLGSNIGGLSLLGDGIGYIADLAENLLPNYANICEVTISKTPYRCQTELARLVYQASSGASVVAPRGDIGFAKVLLCRSALPLQSLYYTAHCSLRGPDYSPEFTKLEGSRFAHLTPLKKRFPNISNICV

SEQ ID NO: 176948 - protein, 114 aa, Triticum aestivum
  unsure (1)..(114): unsure at all Xaa locations
  Clone ID: PAT_TA_71366.pep
KRITMKEIKSHPXFLKNLPRELTEEAQADYYERSSSVPSFSKQTTQEIMEIVQDARKKPRSSTSGYGYADELSDDEEKNAKVSVPEQTDEEDECDKKVREVLESGELDMSVLHI

SEQ ID NO: 176949 - protein, 88 aa, Triticum aestivum
  Clone ID: PAT_TA_71367.pep
AATTTATSCVLVGCSSGCRLPERPTARSPTRTTTATMAPATITTITCISLRWTSCRRPIDAGELGDPYMEPWSGDQPTPSTAPTVSFN

SEQ ID NO: 176950 - protein, 68 aa, Triticum aestivum
  Clone ID: PAT_TA_71368.pep
FKLFDSSEERRQLAGCPYMLGIYISSLLLCFSLGLYGNLVLIANACCKQLAYHHGMITNLLNSSILYV

SEQ ID NO: 176951 - protein, 102 aa, Triticum aestivum
  Clone ID: PAT_TA_71369.pep
QSINKENNATSRHSSAGLFFLEMHSSAGHFPMMQEVIWPGPTRIQIALLGCKRFPLWAPLGAGAPAETFGRSNHNRSMRAARRLDLEPKKNKKSPQLLLPRA

SEQ ID NO: 176952 - protein, 119 aa, Triticum aestivum
  unsure (1)..(119): unsure at all Xaa locations
  Clone ID: PAT_TA_71370.pep
AVVVHPVRFVSRREGSACGPFVCGHTGRRCAGRMFRPVHSQPPDLLCDTVRLKLLCYFFLPFPRLPERSPHRPPVGAAPRSGTXLAPAARRPGRRLELTARRLGRLSDRHGCSSATQLV

SEQ ID NO: 176953 - protein, 44 aa, Triticum aestivum
  Clone ID: PAT_TA_71371.pep
FFFFFFFTEQLFCFKVYIHEHCENIVKTSSPSPPRPDSYLVLTK

SEQ ID NO: 176954 - protein, 113 aa, Triticum aestivum
  Clone ID: PAT_TA_71372.pep
AERNTNLKGLEWQIEELCHQCFNVEYHHKVFHHYNFTVKIEGPRSSDSRVALFFAEVKEIFGRKYYFCCPLEPNESGQCYACHNQGVDDLRHPATGGYDRGSLDIAFPFICMD

SEQ ID NO: 176955 - protein, 83 aa, Triticum aestivum
  Clone ID: PAT_TA_71373.pep
ASDGLWDVISNKVACDVARQCLEDGSPTRAPAAAAGSSGSAPAVSQEEEPRCFRAAALLARLALGRESSDNISVVVVDLKARG

SEQ ID NO: 176956 - protein, 122 aa, Triticum aestivum
  Clone ID: PAT_TA_71374.pep
RSRALASIDPNFFLQNMNQEEVRCLTSLPSLDWWWRSPPSCIKDAIAGQSASFGLGPSLDWETGITGFASCGNEAARPRREAANGRLTRDRGDAFPVTYAAPSAEHAAALGPTVLLSVCRGH

SEQ ID NO: 176957 - protein, 55 aa, Triticum aestivum
  Clone ID: PAT_TA_71375.pep
HSQHQHPWVTVKSKRLARNSEKQEIFNSATTFNSAIECYKINHPLRSGSFCEHVW

SEQ ID NO: 176958 - protein, 73 aa, Triticum aestivum
  Clone ID: PAT_TA_71376.pep
NSGFMVSVDSEDTSHLLVYLMLCINHVERGKFCMIDLLNFSVQLLPPLSQRSLSLIEPAVFLIHTILCCFLLL

SEQ ID NO: 176959 - protein, 102 aa, Triticum aestivum
  Clone ID: PAT_TA_71377.pep
VREDEERYRLRFEVPGLGKDDVRVTVEDGALVIRGEKRVEDEHGGDGEWWSASSYGYYHASLLLPEDARVDGIAAEVKDGVLYVTVPRVPGRERSVTEVKVQ

SEQ ID NO: 176960 - protein, 98 aa, Triticum aestivum
  Clone ID: PAT_TA_71378.pep
VPPERRRARHRRRQGACRVLRADDGPPRAPIRHRARIRHGSLTYRCFPGTVHPAIFGAGFWRADAFHPAVPEGIPFFSCDQLAAAAAVSACIAQPLRM

SEQ ID NO: 176961 - protein, 35 aa, Triticum aestivum
  Clone ID: PAT_TA_71379.pep
SYMSVVQYTCLSWLHLPLPRMRNYVVSVKDMCYTS

SEQ ID NO: 176962 - protein, 96 aa, Triticum aestivum
  Clone ID: PAT_TA_71380.pep
GQRTLMPEIGEYFQVHYTKEKLKEYIKPDDDTLKVKLANSSLHTSCRIMLGTDKRATITRNWSEFCHRANIHEGCICAFCFKVTVEHRLTLIVHVL

SEQ ID NO: 176963 - protein, 85 aa, Triticum aestivum
  Clone ID: PAT_TA_71381.pep
ACHVNLMFFLFSCFQLARSKPFAPFAPAPRLGNIVAADVIEASLAPTQAPTLPQATDDKQWTARARASSSCHQCHDACARTVLAI

SEQ ID NO: 176964 - protein, 84 aa, Triticum aestivum
  Clone ID: PAT_TA_71382.pep
WCYSVMMLFLDGCLGQVTYSAVNCSVLSYGPCAFIHGLCGFRGLCLWYGRCGFRGLCLGEISSTYHVPHYALFEALLIILDLMY

SEQ ID NO: 176965 - protein, 56 aa, Triticum aestivum
  Clone ID: PAT_TA_71383.pep
PRAPRWRRGPRAQGAGPQAGRHLRGMISRPCWRAHHRHAWHNDQDNGVLLLFLVVV

SEQ ID NO: 176966 - protein, 127 aa, Triticum aestivum
  Clone ID: PAT_TA_71384.pep
PCLVSGSRTELVSHPTARPCSSHARCRRTGRWRLVSAGLLGLDTGGRLGVRKRRVLFPRIICGFNCSRWHVQGCHPGRSCSARDGVAALNAYVCCGCMRLYQDKNCKVSYDATIHDFIQKKKKKKKK

SEQ ID NO: 176967 - protein, 64 aa, Triticum aestivum
  Clone ID: PAT_TA_71385.pep
ICIHPMFEIEYIFFSKQDRCVSSNLFTKISLKFVIVVVNCIQTFFVFVTVGTLQGTQLFIVFVF

SEQ ID NO: 176968 - protein, 54 aa, Triticum aestivum
  Clone ID: PAT_TA_71386.pep
SPVCLGLLVGKSTTLPPTTGRKWDLKSSYLNQERTSTNHHLGAEGSKAKQPTAL

SEQ ID NO: 176969 - protein, 59 aa, Triticum aestivum
  Clone ID: PAT_TA_71387.pep
QQPAYHFFFLFLLRVTSISFQHDTTKDHPSRAGKYIFEYIKKGIPDVQFVHKEEDIVLF

SEQ ID NO: 176970 - protein, 66 aa, Triticum aestivum
  Clone ID: PAT_TA_71388.pep
LWGIKANYSIGLDVVSSLCIPGEHHSPEDGTTATEIRWSPSMPTVCFARSFIKNRSKVINYLPSGS

SEQ ID NO: 176971 - protein, 103 aa, Triticum aestivum
  unsure (1)..(103): unsure at all Xaa locations
  Clone ID: PAT_TA_71389.pep
IHTVFGGHSKEIAVSSTKGAHGHLLXSAGNLETLFTILACNTGLIPATINHTESDIDLNLNYVPNTSQKWNHNSNAPRIALKNAFGFGGTNATLCISEYKTNV

SEQ ID NO: 176972 - protein, 69 aa, Triticum aestivum
  Clone ID: PAT_TA_71390.pep
FFFFFFFFFFLTSTHALELITGLSIIYMVFHMNVLADKSQLGSMNVDEDWPKTFTSVMCRLNPSDSCLA

SEQ ID NO: 176973 - protein, 71 aa, Triticum aestivum
  Clone ID: PAT_TA_71391.pep
SEMSRTAHLFSSCPFLSFQLAINHSCRSTPTMHPRPHVASHYCFPHHALLRIGGLDELTNWLPLLRATVCL

SEQ ID NO: 176974 - protein, 91 aa, Triticum aestivum
  Clone ID: PAT_TA_71392.pep
IEEHIGRPKLQAPPSKQSYTLKVKWRPLQSDICKVCDTFQKRRGAMFNCQLRCVCFQGCLRMCVARNKAHFHLIQVLSLTLFVSWHFSCDV

SEQ ID NO: 176975 - protein, 130 aa, Triticum aestivum
  Clone ID: PAT_TA_71393.pep
YIGPEYAGGGRHASTCGDVYGFGIILLEMMTGKRPTDPLFKDGVSIVDFVESNFPHEIVRVIDANLSEECKDIAQSKKISENSVHQCLLSVLQLALSCTHPVPGERMNMKVVASKMHAIKTSYGGCNAQE

SEQ ID NO: 176976 - protein, 96 aa, Triticum aestivum
  Clone ID: PAT_TA_71394.pep
LHQRFIISTALRIQPMRQFLKAQELEAFAQIAFFTQGHGFDHRWTSPTTYSNSGKYPMIHDPTSSCDVPCKLPCDLPFFCEHGLFGTSIQKKKKKK

SEQ ID NO: 176977 - protein, 69 aa, Triticum aestivum
  Clone ID: PAT_TA_71395.pep
SNLRVFISSLNQTIHHVCSAGPKTSTTSKWSEDRGNPILFVLLLLHFLLLHTRSIPSVLGKATKNRVSG

SEQ ID NO: 176978 - protein, 64 aa, Triticum aestivum
  Clone ID: PAT_TA_71396.pep
ANAGPNTNGSQFFICTVPCNWLDGKHVVFGEVVEGMDVVKNIEKVGSRSGTCSKQVVIADCGQL

SEQ ID NO: 176979 - protein, 55 aa, Triticum aestivum
  Clone ID: PAT_TA_71397.pep
PTAERVVPFVLVSLLHRSEWRLSDGVWADELDMTEKFTTVSTLTVPLRAVPIVVN

SEQ ID NO: 176980 - protein, 126 aa, Triticum aestivum
  Clone ID: PAT_TA_71398.pep
RFLATSQNPKSHHKCNTEPKKAQMVWPHGTSYICHCLHSRHGVFKLLNILRYGLVLVTQIRIIKEMRHPGQMDMITCEVSAFGAAHQKFTQSMEASGLIPESYSWVVVAFILLRRPPGFSSLIIAA

SEQ ID NO: 176981 - protein, 56 aa, Triticum aestivum
  Clone ID: PAT_TA_71399.pep
AEEGHSKNQATPAKHAGVSRACILLASNSVPGDCYVIGWTLICIFLQISQVIAMCL

SEQ ID NO: 176982 - protein, 98 aa, Triticum aestivum
  Clone ID: PAT_TA_71400.pep
YFGDRLSASFLFRIGATNFTKGLGNIQKTLSFLFSILVCLDRSASCLIFLIFFSLLVSRYYCEDFAWLSSLGRKFVELFRSFIKMTASFFPHTKKKKK

SEQ ID NO: 176983 - protein, 80 aa, Triticum aestivum
  Clone ID: PAT_TA_71401.pep
ALKKTQNTNSITVAEANGKIIDEDGGIPEVGDLVYVPKLKNQATVVKIDSSKNEVQVQAGMMKLKLKLKDVKVQKQKTSR

SEQ ID NO: 176984 - protein, 57 aa, Triticum aestivum
  Clone ID: PAT_TA_71402.pep
DKSIKAPHKAECHVCECPLEYRTKVERSLSGPRRSWVYGRVYMVKQGHPRKRRWIKD

SEQ ID NO: 176985 - protein, 109 aa, Triticum aestivum
  Clone ID: PAT_TA_71403.pep
LHTCSIILLCLVNYSLNTVKLFLATCHYLLITSTSYQDPGHVSDLPLARQSSLCDPNYCNPLNKFLATCSTMLISQTKDTPQNNTCISTFYHIASLTSTTTTVLVFVGV

SEQ ID NO: 176986 - protein, 64 aa, Triticum aestivum
  Clone ID: PAT_TA_71404.pep
CSWISHIMSVVVVHVWMAIFSRIFIRMPSVYWISHVLIRVHAFFLQELRCCGCSVLQCNYCIMN

SEQ ID NO: 176987 - protein, 92 aa, Triticum aestivum
  Clone ID: PAT_TA_71405.pep
KAHTGIPTTLKIIHAKCALHKVCTSNPTLGSTQTEHISWLPHNMDDCPLVIIHGPFRFNPFVKAGVSNREQGCQTPTAKLEMATRENRRKMP

SEQ ID NO: 176988 - protein, 185 aa, Triticum aestivum
  unsure (1)..(185): unsure at all Xaa locations
  Clone ID: PAT_TA_71406.pep
MKFLLALCPVTMHLKELKTGKVLGTGTERDGLYYLDNVAAPLALAAFTSSTDELLLLHRRLGHLSFHVLSRVFPSLFASCYKDKLVCDACELAKHTRATYPTSSERSQTPFEIIHSDVWGPSVTTSLLGDRWFVTFIDGFSRCTWLYLLKQKCDVFNAFKXFYALVCNQYNAKVNFFVQTKKKKK

SEQ ID NO: 176989 - protein, 36 aa, Triticum aestivum
  Clone ID: PAT_TA_71407.pep
AWGFVLAVVCLLTLFPNGGGTYSSSFLGEPFFRGGI

SEQ ID NO: 176990 - protein, 79 aa, Triticum aestivum
  Clone ID: PAT_TA_71408.pep
YKSIVAYKFEKKIREICIVLLVLSCHRLLTLVYSPTHSKASYGATLSNSTRLQISRWWPAGGVTVFKAHTFQPVHDKQR

SEQ ID NO: 176991 - protein, 63 aa, Triticum aestivum
  Clone ID: PAT_TA_71409.pep
FHVYNICIAISILWLLSNENVFYVIDSCFNLYSSLDYYEYTRRPIYKFNSLDQGATINFHLIE

SEQ ID NO: 176992 - protein, 65 aa, Triticum aestivum
  Clone ID: PAT_TA_71410.pep
LETRGGPCHLWSGGTFFLPDRRLDSAQHLLCIYRKFKREHASMRPGVHELEIWLASVRAYLALFW

SEQ ID NO: 176993 - protein, 45 aa, Triticum aestivum
  Clone ID: PAT_TA_71411.pep
QHIPTIPLMLLLTQGNKKNLLNICDRVLTVNAEELCEAWVLGPPT

SEQ ID NO: 176994 - protein, 45 aa, Triticum aestivum
  Clone ID: PAT_TA_71412.pep
KPSNTPLMCSFSCTELIILNSDYLQIHNPFSKSGFIHKGTLLCTN

SEQ ID NO: 176995 - protein, 46 aa, Triticum aestivum
  Clone ID: PAT_TA_71413.pep
EMRPRVKGRFPKVPDGSEGGAPLPPQQPTQAAGYEPGRLDLGWFRS

SEQ ID NO: 176996 - protein, 64 aa, Triticum aestivum
  Clone ID: PAT_TA_71414.pep
YKESATRKSREMMRNHIMEILMLLQKCKGQQFEEAWKKHGADLDLTLLLSRFKELCTEDGSPEF

SEQ ID NO: 176997 - protein, 88 aa, Triticum aestivum
  Clone ID: PAT_TA_71415.pep
TPTTVVSSEQLDIHGLVSLSIEQHLHMTCTSISNIHKVATQADGAQEASSRLSTVAAGTGRTRSRGACFCASGPPSTRRPWPWPPRLG

SEQ ID NO: 176998 - protein, 59 aa, Triticum aestivum
  Clone ID: PAT_TA_71416.pep
SFCRPHPVGSITNPGRKFGEFVLGSCLDAKGFVNHLTLCPEICLSFRPVHVLVYAFVTC

SEQ ID NO: 176999 - protein, 78 aa, Triticum aestivum
  Clone ID: PAT_TA_71417.pep
VKQPTVLIYTWIRTIWLFPLFPTQQVHHGSPSRIITVTKTTVALGGGAREFCDARIRAAWLLAQADAVGSATRRYTRT

SEQ ID NO: 177000 - protein, 116 aa, Triticum aestivum
  Clone ID: PAT_TA_71418.pep
DFSFCLCYFVDAHEVFLVMSASIFFYFFCCVIFQARLFGRFLFCFFEAFLVMSASILFSFFYCAIFQARLFGRFLFCFFELSVSASVNTLIRCFCLCEYAHQVFLLMCAKFAVLDR

SEQ ID NO: 177001 - protein, 46 aa, Triticum aestivum
  Clone ID: PAT_TA_71419.pep
VHNSKFHFCTQQTGRPIERSILTRPCLQAKGTYRCDAVYVLASHHR

SEQ ID NO: 177002 - protein, 68 aa, Triticum aestivum
  Clone ID: PAT_TA_71420.pep
GEFPLRTISDGAVAAQAMPTLHDYDIGVCASFCNFSCIISSGCMNTLFSRDYMNMLWRFGLCVSICQS

SEQ ID NO: 177003 - protein, 116 aa, Triticum aestivum
  Clone ID: PAT_TA_71421.pep
TVDISLAYVEHAVEATIEVVISEVHSGFSLSLSSLIYIMENYEEIPLFHGTIDQSRGLRRFVVAVTSATVMKLKFRFGSNSVERCCSFKAKLHGCVRRQIKHELASITVKVYWSTI

SEQ ID NO: 177004 - protein, 55 aa, Triticum aestivum
  Clone ID: PAT_TA_71422.pep
VEAAVRELMGDGDKAVAMRRKAAEWKEKAVRAVAAGGSSQRDLERFVDEIAHVKG

SEQ ID NO: 177005 - protein, 29 aa, Triticum aestivum
  Clone ID: PAT_TA_71423.pep
KPRSGLTSQRSKKTRTQVILSPLRILRFV

SEQ ID NO: 177006 - protein, 53 aa, Triticum aestivum
  Clone ID: PAT_TA_71424.pep
IEELRCCQCLLCYSQVDRLYDSRNANDSFSHCFRWNASVVYRYSEVGWAIQHA

SEQ ID NO: 177007 - protein, 87 aa, Triticum aestivum
  Clone ID: PAT_TA_71425.pep
FCTAASFTDVYRTYIAAISVTQICNNTTMILVDQSMVSCLVILTRKELVMQARLCRDNLQVHSFHSASEKAGDRNPQSTAETRRVVS

SEQ ID NO: 177008 - protein, 118 aa, Triticum aestivum
  unsure (1)..(118): unsure at all Xaa locations
  Clone ID: PAT_TA_71426.pep
TKENTIGDPQNTSGINNPWIPLLITTENVNRISFNLRRAQCKYRKQTTTXESTCISKTGHHQFPLDDEHADCRCPWACASWEGGGRVIPSIALRPCREHRQGLEKCRHEPHRSRKHRG

SEQ ID NO: 177009 - protein, 66 aa, Triticum aestivum
  Clone ID: PAT_TA_71427.pep
FVIFCHGPSAFSVMYQLLSNTRSSLINAAHLHRHDLLFSASGFPCIIHLNTLEAPTPMAAAYLPKQ

SEQ ID NO: 177010 - protein, 63 aa, Triticum aestivum
  Clone ID: PAT_TA_71428.pep
PEAFAELKVKEIKNGRLAMFSMFGYFVQAIVTGKGPVENLADHVADPVKNPPWAFATNFVPGK

SEQ ID NO: 177011 - protein, 81 aa, Triticum aestivum
  Clone ID: PAT_TA_71429.pep
ITQLVLYCIILSMIVRVRLAYDGLSQILVTQHRWSVFTQLVLDVKRTTHIIIKRYDASKIEIRAVRGCVHATMFYKKKKKK

SEQ ID NO: 177012 - protein, 66 aa, Triticum aestivum
  Clone ID: PAT_TA_71430.pep
HCNTSSFTKNIIHVMFAGLHTLQEGLVVFHSRRTCGRWLWSLIFLVGCRLGSRGLYVPLHSPIDFF

SEQ ID NO: 177013 - protein, 87 aa, Triticum aestivum
  Clone ID: PAT_TA_71431.pep
LAYVEDVLAGKAVPDNSVGRALTDMINSVPKMSPEEFDKMFNSNIKDLLMVMTLSQLVKTQLQLNEKLTLLTSRVILSCSTRNTPST

SEQ ID NO: 177014 - protein, 59 aa, Triticum aestivum
  Clone ID: PAT_TA_71432.pep
FLSNSKFIASQWKFRGNILRAQAPRDVFSQIEPPKYLMYVFRPYVKVTTKPIQLVIRML

SEQ ID NO: 177015 - protein, 76 aa, Triticum aestivum
  Clone ID: PAT_TA_71433.pep
ATELLKNILLAMKVSGILSTTSSVGENSLWEATWLRVNKIAPSLQSVVFPDYDDAVQSAQSKLDIPAVSEGRLVPV

SEQ ID NO: 177016 - protein, 42 aa, Triticum aestivum
  Clone ID: PAT_TA_71434.pep
TSFYSNQSIQGIDSTNFHTGTSLKLNKSTLLEHLTYLNITKY

SEQ ID NO: 177017 - protein, 51 aa, Triticum aestivum
  Clone ID: PAT_TA_71435.pep
SRDRLTFSQTEQYIVFKLIDFIAFNQPVARKLSLPAIFFVNVLVNILRCYN

SEQ ID NO: 177018 - protein, 49 aa, Triticum aestivum
  Clone ID: PAT_TA_71436.pep
YNLTASITNEHRESHKSQRVPNFLQASYIYPSTGIEPIDHNHLLRRTKV

SEQ ID NO: 177019 - protein, 57 aa, Triticum aestivum
  Clone ID: PAT_TA_71437.pep
RDGGTEQLSRSFTASTRGRSTMQRSSRSPLPPQAVHLGHTRPCDDAAIRPFTSAIGG

SEQ ID NO: 177020 - protein, 79 aa, Triticum aestivum
  Clone ID: PAT_TA_71438.pep
RESRYAAAKMILGSVRWCRRCYRSSSQTGKSISRVTNHVCVKALFSDLSPSCHIWLVLSLSRAALYPFLDADINWRGGS

SEQ ID NO: 177021 - protein, 87 aa, Triticum aestivum
  Clone ID: PAT_TA_71439.pep
YLHSQLREILISTLLHHPFLFKKKTNASSRSSRKKLWRHYRGGSTSSLSSTYHKFSSFEFTLFVIFLFVFISPTSKTFSEKIQKYLP

SEQ ID NO: 177022 - protein, 83 aa, Triticum aestivum
  Clone ID: PAT_TA_71440.pep
FFFFFLQKSLWFAKINPQYYRNQVKNSLVGTIPRSSPRPPPSPCPALPAPPSPCPFFPGAVRARRPTRLHLSSCQVAPAALLA

SEQ ID NO: 177023 - protein, 66 aa, Triticum aestivum
  Clone ID: PAT_TA_71441.pep
RRPIISLFSCELHSWQGGMIPCALRSRPSFGHLPWSSKNLIIVTQMIVCFLFTPCCINLVCGGEGS

SEQ ID NO: 177024 - protein, 100 aa, Triticum aestivum
  Clone ID: PAT_TA_71442.pep
LMATSEGRLASGPASFTPPRQHGSCRFATRRHFHHAGVQPHTINTSTILSPGLLTCSPASSPFTSKVHPTIGRWNLHRDDGGNNRSLSAASYALTLPRKI

SEQ ID NO: 177025 - protein, 109 aa, Triticum aestivum
  Clone ID: PAT_TA_71443.pep
RLRTSWSIWTTTVVVKRPMNTTAAGRSPRPPWRLRARWSIATCSGCLAEIGSDVFWLCQAAVTAGGVYHDQHVGLGRSRDACRKRVCIKTSISGFCINSVFELLENSVL

SEQ ID NO: 177026 - protein, 38 aa, Triticum aestivum
  Clone ID: PAT_TA_71444.pep
QLHSAERTLDAPDLVNKYYLNLMGWGSNNVLSIALGET

SEQ ID NO: 177027 - protein, 77 aa, Triticum aestivum
  Clone ID: PAT_TA_71445.pep
PRSHIYTHRQYAGVRTYMSTCITTDSATQEQGPRRCGVGSPSEVHVHDERLVPLVNVERAPDLLPAGAGGHLHDVLA

SEQ ID NO: 177028 - protein, 111 aa, Triticum aestivum
  unsure (1)..(111): unsure at all Xaa locations
  Clone ID: PAT_TA_71446.pep
FFFFFFFYRPNQNSSSPLQVFNRSHNDFLHFCQRRGNLYLDRSHDTDKIAKLRTTPXKPLWPKMRAHPTGSIPIKISTNAMSQKPRSPRGRPEPIDVQIEETGMKQIKVLK

SEQ ID NO: 177029 - protein, 96 aa, Triticum aestivum
  Clone ID: PAT_TA_71447.pep
QNSTMDFIALSYATCSNCHNLPSYFDPEELVTMAIHPGSDALGACSLSWSYCYPVDDVRSQGRYMGPALHVCLLHRCMHHRSSQASRHHQHLLTTF

SEQ ID NO: 177030 - protein, 49 aa, Triticum aestivum
  Clone ID: PAT_TA_71448.pep
ETQHNRIFCHLTRERERETWWKSESSLVSYRKLLMRWLLNKQQHRDQQQ

SEQ ID NO: 177031 - protein, 56 aa, Triticum aestivum
  Clone ID: PAT_TA_71449.pep
SNFLKIQNMFKNSEKNEDTHSCVMYKLKKFQHLIRTTLRCCLDKGNIQIGISISQK

SEQ ID NO: 177032 - protein, 63 aa, Triticum aestivum
  Clone ID: PAT_TA_71450.pep
VALYFSSKLRRAHLSIGRACIFSVHAFDYLPCCIRRLDFDVGLLLMFRSMTSHSVCFMFISLV

SEQ ID NO: 177033 - protein, 92 aa, Triticum aestivum
  Clone ID: PAT_TA_71451.pep
IDMFNVIEGHTLSHNTGGVTHRSEYDEPLQENYTYTHKSQHRKNTNMKDNLPFIADLGHEQSMMIHTDEMLQLSWNQSQFFIFFCSNQTVSG

SEQ ID NO: 177034 - protein, 51 aa, Triticum aestivum
  Clone ID: PAT_TA_71452.pep
TDNVTSHTSTDHVWLSQTPIFLEPCNQQESTLGNKFSMRLVCSLEGRLLYN

SEQ ID NO: 177035 - protein, 98 aa, Triticum aestivum
  Clone ID: PAT_TA_71453.pep
SAKPSWAASWRRSPPARRRAVRSSRSPLTAVIILVLVAASTVRVSCPGVYSDTDRVRCCTGLHTYRRGTAACVRRQGWRPHVRILCILHPFGNVESGK

SEQ ID NO: 177036 - protein, 72 aa, Triticum aestivum
  Clone ID: PAT_TA_71454.pep
NAYEKDVLFTNSCPIYNYKRSKMEKAISIQVYLLLMLIYFAHINNCIYDLLPTNLLTKYDTIILLRTSTRYV

SEQ ID NO: 177037 - protein, 61 aa, Triticum aestivum
  unsure (1)..(61): unsure at all Xaa locations
  Clone ID: PAT_TA_71455.pep
PAQPTAVXNGRPTLPAPCDTARPGADSQQRLTDVHCTFEKTQIIAKLIYSLNTLGKCLNTV

SEQ ID NO: 177038 - protein, 78 aa, Triticum aestivum
  Clone ID: PAT_TA_71456.pep
TKHQSDGNLLPDQTALKTSHYKYTVSVQVPYTTHHNFIRESISHGRMGFHKMMSQLLGKPLNLHTVVLVQKLAHKETP

SEQ ID NO: 177039 - protein, 56 aa, Triticum aestivum
  Clone ID: PAT_TA_71457.pep
KTHMSDVLKRMTSLQSGCCPDSRDHKNRRIMGGRGHCEPDLSLLRWRTWTRVAECK

SEQ ID NO: 177040 - protein, 59 aa, Triticum aestivum
  Clone ID: PAT_TA_71458.pep
ELTSDLTGRSLILVESISSSRASRSPIILSSCTYMHAFKRDRKTCTDSLFQKKKKKKKK

SEQ ID NO: 177041 - protein, 73 aa, Triticum aestivum
  Clone ID: PAT_TA_71459.pep
PQHPDLNDPSGRRPCPARGARGGAHLASHKGPALYHHIISLLQHRVQYVSPRRRIPKKTSTQLCVLAPWSWPC

SEQ ID NO: 177042 - protein, 51 aa, Triticum aestivum
  unsure (1)..(51): unsure at all Xaa locations
  Clone ID: PAT_TA_71460.pep
VHLGFKIRFWFTIWKEQNFWASPVDDKGMTCRCDGIVGLVTSXGIHVFDNF

SEQ ID NO: 177043 - protein, 92 aa, Triticum aestivum
  Clone ID: PAT_TA_71461.pep
SEQQGCGWMGKVRQGERAADGRCLPSRAAEALQGVHNEGPHRPPRKACRLINSGVHLFPPILCVVVVKTLRRCCLLSLVSSLEVLVGLLGVA

SEQ ID NO: 177044 - protein, 96 aa, Triticum aestivum
  Clone ID: PAT_TA_71462.pep
HTDITIIMHGKREVKTMKTTTQLNWRYFVEQPAGVIKWKFSKAPGTRRSHNRHSQPGCGSRPWSAIFLLWDLVIYFPNEINEKHVSRKKKKKKKKK

SEQ ID NO: 177045 - protein, 50 aa, Triticum aestivum
  Clone ID: PAT_TA_71463.pep
PPIEHLRGILLLINKETGSRVNLYHMISAMVPSSKPHTFVSWKEAFMGAR

SEQ ID NO: 177046 - protein, 87 aa, Triticum aestivum
  Clone ID: PAT_TA_71464.pep
NGVGANKNISFCWQATNATTYVLTSTILRNRERPLWIQPSRRAPSGFLRINSSQGRQKKVTVHCLTPTDFNSQPFHLLLTSITSGTP

SEQ ID NO: 177047 - protein, 64 aa, Triticum aestivum
  Clone ID: PAT_TA_71465.pep
WCRLDVWKWRWRLLLKDHMLKKMDLLCLHLQNLLPRLGGPNPPVLKSRREADHVLILVTFVQLV

SEQ ID NO: 177048 - protein, 70 aa, Triticum aestivum
  Clone ID: PAT_TA_71466.pep
DYFAWKSALVLPSTLFVQEVSNALKNFRWREIMMLYLQNTLVHVLFLCIYTVLGCTVIFCHVARTFRNCI

SEQ ID NO: 177049 - protein, 101 aa, Triticum aestivum
  Clone ID: PAT_TA_71467.pep
CTRNAHKIVFHTAYTLQLQKKGIYTAGTDSPFLSSAYTISEKGKLLSSHASMYLNSYRHTMILTKIESFREAAIADAGDLIVNSEIWATGKSRRSQLLYPL

SEQ ID NO: 177050 - protein, 73 aa, Triticum aestivum
  Clone ID: PAT_TA_71468.pep
FFFFFLFFFATTHWMPSLRVHTHAHVRYASRTHITLHHKSVAYNSFRAHIQSMAIDELRMTIGVRIYEAAALH

SEQ ID NO: 177051 - protein, 63 aa, Triticum aestivum
  Clone ID: PAT_TA_71469.pep
SPLRRVNQAIWLLCTGAREAAFRNIKTIAECVADELINAAKGSSNSYAIKKKDELERVAKSNR

SEQ ID NO: 177052 - protein, 52 aa, Triticum aestivum
  Clone ID: PAT_TA_71470.pep
FFFFFFFFFSSKTNNLAARFKNTQITCVSFTPHVYCPSSNILLTRSLLSCTT

SEQ ID NO: 177053 - protein, 79 aa, Triticum aestivum
  Clone ID: PAT_TA_71471.pep
GEHTQHITKRTRPPHVCEGKRHTAQVGTTSIDQQRSGCKCISWMVHIHELNLEAMVVPQTTSLLKLPCFGQGSQNCFHL

SEQ ID NO: 177054 - protein, 63 aa, Triticum aestivum
  Clone ID: PAT_TA_71472.pep
MNPARAFGPALVGWTWRHHWVYWVGPLIGAGLAGALYEFVMTEQPEEPAAAARRELPVPAQDY

SEQ ID NO: 177055 - protein, 75 aa, Triticum aestivum
  Clone ID: PAT_TA_71473.pep
CSTPELRKHYMQLVGRGSSGRGRRGSRRYRRPGRGEGCRHAVVGEAGRAGKEFKITVAAPRALLPKVVAIKRDGV

SEQ ID NO: 177056 - protein, 97 aa, Triticum aestivum
  Clone ID: PAT_TA_71474.pep
FFFFFFCTCSDSQLYTVFALINVSMALNKTTIQQHQLPTVSRPSLASHYCSLSAEQTLEDCCCITCQDMILCGTVLKPHSQGNFQLDGSPILHGEEL

SEQ ID NO: 177057 - protein, 136 aa, Triticum aestivum
  Clone ID: PAT_TA_71475.pep
ESGEFSYAIVAVGEVPYAERLGDRTDLSIPFNGSDLITRVASKVPTLVVVVSGRPLVIEPQVLEKIDALVAAWLPGSEGMGITDCLFGDHDFVGTLPVSWFRSSDQLPINVGDANYDPLFPFGYGLKMFRSDEGLA

SEQ ID NO: 177058 - protein, 56 aa, Triticum aestivum
  Clone ID: PAT_TA_71476.pep
FFFFFFFFGSGTRGFFFIPGPMLSTQTICPQFVCAARLTGFNITLRTPSAPVPTYP

SEQ ID NO: 177059 - protein, 110 aa, Triticum aestivum
  Clone ID: PAT_TA_71477.pep
LRGVPTRPNRSQSSNHTATPRPISLKVHLTRSIACGHAAPMTRRVAESDARPSVSTVPSGGDIQRPSRARLTRPHALCSASSARPTLFLACEKNHGVAFMLLDHEERGGP

SEQ ID NO: 177060 - protein, 66 aa, Triticum aestivum
  Clone ID: PAT_TA_71478.pep
TSLTLRRVSPCMKWSNKHPCAISPNDEQTCIGQVNSAQLGIIPLRTSIIFIVLHGDYRGVHFVGKI

SEQ ID NO: 177061 - protein, 84 aa, Triticum aestivum
  Clone ID: PAT_TA_71479.pep
PPLKDAGCKLHATGQWYRELHIFIGGNTPINGAAATQSSLTQASLLKRDRPHAALIAPGKKPSHFPVEVGVFTMEQMHLRFEMQ

SEQ ID NO: 177062 - protein, 75 aa, Triticum aestivum
  Clone ID: PAT_TA_71480.pep
TKINFYPNKCEHWDICTRTESNANIEFAGSIRKLATNINFTDPKINHHHKNTIKLSKWLLEEELATKSDHIYRLE

SEQ ID NO: 177063 - protein, 69 aa, Triticum aestivum
  Clone ID: PAT_TA_71481.pep
KQLVSSSYPLPPATKYNNIHMFYIPCHQLQHVKILTGNKLVTEQHLCCHVTIMTRFSQSQDVKKKKKKK

SEQ ID NO: 177064 - protein, 73 aa, Triticum aestivum
  unsure (1)..(73): unsure at all Xaa locations
  Clone ID: PAT_TA_71482.pep
HPIYLLDRTCAMSCCKYWSRKYKRTQEGSTTGHRRNEPLLLLPTXVSFHSRLLSTSNHCILCSRPAITAAMVC

SEQ ID NO: 177065 - protein, 47 aa, Triticum aestivum
  Clone ID: PAT_TA_71483.pep
ANLLHVHPGCLSNHITHLLDIQLTPITNNRAVFRSYNGQETFSPIMA

SEQ ID NO: 177066 - protein, 160 aa, Triticum aestivum
  unsure (1)..(160): unsure at all Xaa locations
  Clone ID: PAT_TA_71484.pep
RRAPATREKSCNVFREATTGDINLLPPFMAVTGNWNWRCYNCAYGSCNHRSFFVGECYHVVSHKLQPYTRKAASIVVFATTTATNCSQQASGERRVVRRSIGQDDWHRAXRARPAQIWAGRPRRLAAPMAMQLLPALCSAFTQKGQSEQGRAGKTRAVRN

SEQ ID NO: 177067 - protein, 77 aa, Triticum aestivum
  Clone ID: PAT_TA_71485.pep
RGWFTPMLTDFGWLQRCSKGMDARALEDSLGQALFTLPFGEQQSLFEEWFQCFAFRGGECPNLSRAFQVWWGRSFTR

SEQ ID NO: 177068 - protein, 69 aa, Triticum aestivum
  Clone ID: PAT_TA_71486.pep
PPHCKLIYLEPVYTSAEVIFSLGVKLLQLMNCKEIVRFVGLELNKLKTRELICRLFRVCMCFSCGPNTG

SEQ ID NO: 177069 - protein, 59 aa, Triticum aestivum
  Clone ID: PAT_TA_71487.pep
YELCFLCFFHNSIYPQKQYNRNLKPTKFIFAVYDDGVSTSLLTNMSYLTNCFYYTYLNY

SEQ ID NO: 177070 - protein, 104 aa, Triticum aestivum
  unsure (1)..(104): unsure at all Xaa locations
  Clone ID: PAT_TA_71488.pep
NWRPLLHKFLTCTXMERRWRGRDGWSTFHIPNSNRRGLPSSWLDLDSSFFVLCHMTSKYLIAPSNVALYCALCRTLNVTLLRLDFQICKNQTLCHIKHLWKLHY

SEQ ID NO: 177071 - protein, 95 aa, Triticum aestivum
  Clone ID: PAT_TA_71489.pep
GLIYTVIIRTHKINGSNFLINMVISRESVISIGIDVHSQVSICPLCDHNVCPFPSWLLHQSRHDCFGRCFFDLGRYLVIKGGLPGCSGKKGSSSP

SEQ ID NO: 177072 - protein, 60 aa, Triticum aestivum
  Clone ID: PAT_TA_71490.pep
KGQGKKMLRKEEKKHYSLTNQPTTDSSTTTFSFTRSLHILPPLSPHLLNPDFSQQQEQQQ

SEQ ID NO: 177073 - protein, 96 aa, Triticum aestivum
  Clone ID: PAT_TA_71491.pep
FALTCLMKSALSIRVLQRTKGRARAYYYGHLQPVAIELLFRPGPEDGARLDPADSYVQSQCRVFQEEHPVFHRGYEATQDQAARQLGLLCLALACT

SEQ ID NO: 177074 - protein, 154 aa, Triticum aestivum
  unsure (1)..(154): unsure at all Xaa locations
  Clone ID: PAT_TA_71492.pep
FFFFFFFFFFPVRTRAKPNFIFVFFTSFFLQHLFLLLVHPTHSHTSRHRQMPVLPRRMQLTNCTNPGEQQHRRGRSFRSDTRRGASFSSRRKRRDSASERASERATDEQQAPGESGILPVTVDRKAQGIRSHGQLHRAGPGEXHLNLMVARRTM

SEQ ID NO: 177075 - protein, 61 aa, Triticum aestivum
  unsure (1)..(61): unsure at all Xaa locations
  Clone ID: PAT_TA_71493.pep
FLLLNIFAVGQVTCYRXGSLPLVLVMVPTDMIKQKVTNRHKAFVFSQTDRIRACKCILYLR

SEQ ID NO: 177076 - protein, 88 aa, Triticum aestivum
  unsure (1)..(88): unsure at all Xaa locations
  Clone ID: PAT_TA_71494.pep
AAHVTGEACPEPELPEEFPPAMVVVGGLDPLQDWQRRYAAMLQRKGKAVQLVEFPDAIHGXYMFPKLPDAGKLVNDVKNFMETATSDH

SEQ ID NO: 177077 - protein, 145 aa, Triticum aestivum
  Clone ID: PAT_TA_71495.pep
SKSPFVVISMLLPSSTKHRSVLPEFLMMERLPRLLTVVPLLPQCAPTAFLMSSSILAMFHGSWSRSASVFAASCQQLVSIPFRSFSSPGVFSCCMHVLFRNLLGVRSDLLSCRFQFVSRLSSSMSCFHVSSTCILRSCIYFSFFL

SEQ ID NO: 177078 - protein, 123 aa, Triticum aestivum
  Clone ID: PAT_TA_71496.pep
NNVARFAQDWAAQRAGDCRLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLDAEAK

SEQ ID NO: 177079 - protein, 69 aa, Triticum aestivum
  Clone ID: PAT_TA_71497.pep
AVKLRLVDTVQRLGIAYHFEEEIESILRSVHREPRRCSWDNNANDIASAALRFRLLRDGGFPVCFPPGT

SEQ ID NO: 177080 - protein, 57 aa, Triticum aestivum
  Clone ID: PAT_TA_71498.pep
IGVTGTQFPALPSACCQRWVNWCVLMASMSSMLCIHSERHSGINGHKSGSNSSYGSS

SEQ ID NO: 177081 - protein, 60 aa, Triticum aestivum
  Clone ID: PAT_TA_71499.pep
LIVHAVLHISTSICSYISLRREYICIIQRMCSSDYYSISKSCGFVKTSGGVLRRSLSLCQ

SEQ ID NO: 177082 - protein, 59 aa, Triticum aestivum
  Clone ID: PAT_TA_71500.pep
TTSRKRHHFGWPAGAKKPGVCSCRESNPFLVIRGVYVRQLKFPSLLINIRGNLLPPFQK

SEQ ID NO: 177083 - protein, 97 aa, Triticum aestivum
  unsure (1)..(97): unsure at all Xaa locations
  Clone ID: PAT_TA_71501.pep
FIRLQVITTEKSYTGRNCVGAAGTKPRRLKAGGGXGRPQSVDLSTHKIPVKIRNDKKIRKQPLAWPANSATSQVLVPVLCHKKQRAQGRNVSTKLSE

SEQ ID NO: 177084 - protein, 108 aa, Triticum aestivum
  unsure (1)..(108): unsure at all Xaa locations
  Clone ID: PAT_TA_71502.pep
CFVSHCGXNSTMEGMLHGVPFLCWPYFADQFANQSYICNVWGTGAKVHADERGVVTKEEIKNKVELLLGDDGIKARAATWKDAASASIAQGGSSDQNLLKLVKFLTQQ

SEQ ID NO: 177085 - protein, 117 aa, Triticum aestivum
  Clone ID: PAT_TA_71503.pep
NVRKVLCVWSIHWSMASPAAHVEPIPTRNTEGGRRDSARFNLMEAQTVQAEHPSVRLKRRRGRAQRPGTYRRKNNLPHITHPHGIHHHTQHTLFIQRITHDAHCEMRHVFCQKKKKK

SEQ ID NO: 177086 - protein, 58 aa, Triticum aestivum
  Clone ID: PAT_TA_71504.pep
GIFLFLFQRVFCIGSLKNYVFFDRSVNSILVFQLLICTATTQMTVRECSSFKLPAAKL

SEQ ID NO: 177087 - protein, 107 aa, Triticum aestivum
  Clone ID: PAT_TA_71505.pep
VKIKTAQTHREDKIKQKRERDRLTKVRNRLLHGLGGSRLQSVSQSVSQLHLGYSPIASVCNLFVVKRVSSWCRGWMYCRKRDFGWWLSNACFDSSMSVSCFLRLPFL

SEQ ID NO: 177088 - protein, 63 aa, Triticum aestivum
  Clone ID: PAT_TA_71506.pep
ISFMDHITRSGGGESWFSNNLNRAHLDYFYWLLAGLSAAELALYIYITRNYVYKEKSQLRVTT

SEQ ID NO: 177089 - protein, 57 aa, Triticum aestivum
  Clone ID: PAT_TA_71507.pep
KCTRVYYTWIPFLQKLRSQRATNELTVQTCNPHTTLNSLDECAKYTKYRRVAACIPS

SEQ ID NO: 177090 - protein, 88 aa, Triticum aestivum
  Clone ID: PAT_TA_71508.pep
KTKQNAFRICRIVWWSTYYINTSPYRPRECHASTNRESLARKHTGCTTRLHSARAQLHDVRIIRHAYARTNRAALTAWPRCGTPGAGP

SEQ ID NO: 177091 - protein, 67 aa, Triticum aestivum
  Clone ID: PAT_TA_71509.pep
FSSKGRLNPRRLLMGLECWKHIISNVISRHRKEQHGNQNLVLIFFWRGERNPPHLNCIHLLSIDFAA

SEQ ID NO: 177092 - protein, 67 aa, Triticum aestivum
  Clone ID: PAT_TA_71510.pep
TSGGVQVIRSVHSFFSTCCQEEHRALSFCRPDAGNDLTKKAMRSFSLLSQVIIFLLLVCLVVHCNAL

SEQ ID NO: 177093 - protein, 52 aa, Triticum aestivum
  Clone ID: PAT_TA_71511.pep
YIPKQVISQQFHFPLANNFKHQRIIHLLFSCLPSVFYYTLKFVICRCHFGDF

SEQ ID NO: 177094 - protein, 50 aa, Triticum aestivum
  Clone ID: PAT_TA_71512.pep
VMCRHALVIHSTCTRVLVRGGGSSSLDNGTPVDFCHGKNAFAHRLTIWSW

SEQ ID NO: 177095 - protein, 55 aa, Triticum aestivum
  Clone ID: PAT_TA_71513.pep
CAQEVQGAVQGGTTSTLHRRRLCPGGGNRCGQEQEEGSQDDCCGKDGGGLTTTAC

SEQ ID NO: 177096 - protein, 108 aa, Triticum aestivum
  Clone ID: PAT_TA_71514.pep
SNKKFICLKNLLQKRTHDIFWQGRVKIYSYFSSRLYHKLKKNKHLVALDTLQYKWEAISLVVRYAFTTLGTVVGGVALAFFKNPNSTPFEKYLTEAMRFLVGLEGGVG

SEQ ID NO: 177097 - protein, 46 aa, Triticum aestivum
  Clone ID: PAT_TA_71515.pep
PGDLRLSFSVVMSTSAFISIENRTRVNSCCFLKIKIQKSQHMISHF

SEQ ID NO: 177098 - protein, 72 aa, Triticum aestivum
  Clone ID: PAT_TA_71516.pep
TRGSIFHVLIGISFNNLAPNTGEHTKITPNLYTGYEMCDEAGRFSGVFGVVVDSRESAVVILFFFSLKNLCA

SEQ ID NO: 177099 - protein, 55 aa, Triticum aestivum
  Clone ID: PAT_TA_71517.pep
PPAMDHLPWFPSCTARSWRRICCFLCVLYLELFCCYIPFICVVFRAFRSVRASLI

SEQ ID NO: 177100 - protein, 80 aa, Triticum aestivum
  Clone ID: PAT_TA_71518.pep
PVGVYFSSATARQEPHELQSPDTLRVILKPFFTDMNPRVDGANRRPAGRRENFSHVDFMAACTWDPYLSVLRFYLTARST

SEQ ID NO: 177101 - protein, 114 aa, Triticum aestivum
  Clone ID: PAT_TA_71519.pep
FFFFFFGYVKNIVLDGFDMYFHTNFEILILTETSRNTIALIVTIHIVHNYSFFTTFTTQLRKLNIKFRHRETEANQIITPRPFQSPQQARHKAGENGRFHSSSGGNSSCKPQFT

SEQ ID NO: 177102 - protein, 55 aa, Triticum aestivum
  Clone ID: PAT_TA_71520.pep
FFFFFFFFFTKIMKSQSHTYKSMSADVSHGKWKTNENKTYVHKLQDTLQKITSDK

SEQ ID NO: 177103 - protein, 46 aa, Triticum aestivum
  Clone ID: PAT_TA_71521.pep
IKSLSEKTRLFLGGPMGGEPGPIQSKCNTHPRGTNRPITFTFHTSA

SEQ ID NO: 177104 - protein, 76 aa, Triticum aestivum
  Clone ID: PAT_TA_71522.pep
LGWIKKDNPLLLLNNATYRIQHLVVAGTRCTWAGTVLQALQTKAGLGHEPAAEIQEGAQVQRRQSCRCMKLHGVIA

SEQ ID NO: 177105 - protein, 89 aa, Triticum aestivum
  Clone ID: PAT_TA_71523.pep
PDKMTALEKSVRVFAEAPRENVIVPNLGVTFDTLGETYDFYNTYSWKKGSGIRYEKSRLNVNRTRCVVCFRLLKPFTICISVFRLSALV

SEQ ID NO: 177106 - protein, 105 aa, Triticum aestivum
  Clone ID: PAT_TA_71524.pep
GYTGRYVFFTNKGHLAKSRGPKQIHISLHKFLTYMNKPRPNAFYSHTKIAFARGILLTPPLSQAYKRVPPKGLACCCKLFAPGNPGKPLSKNGFTGAGPGPTPGC

SEQ ID NO: 177107 - protein, 102 aa, Triticum aestivum
  Clone ID: PAT_TA_71525.pep
IIKQIPRLFGLGFTKAGKFPTLVSPQESLESKVNETKAPVKFQLKKVLCMGVPVAPLGMEEKQFFQNVQMRVNFLVFLLKKNWQNVKCLSLKSPMGKVSRLF

SEQ ID NO: 177108 - protein, 71 aa, Triticum aestivum
  Clone ID: PAT_TA_71526.pep
KKQWSGNIFRLCYLGKQNLKTFLGQLWVMFTCLKQMNFLTKQTLLKTQGVTFCFYFPLKRNPPNQNKGNWQ

SEQ ID NO: 177109 - protein, 63 aa, Triticum aestivum
  Clone ID: PAT_TA_71527.pep
KIKNPQRGFFFFFFNKNPPPFGPAGVKFCWLPPPPLWGQNSFFFTKKWFFFLNPKNFSPGGEF

SEQ ID NO: 177110 - protein, 77 aa, Triticum aestivum
  Clone ID: PAT_TA_71528.pep
LFGPPITQRRVVIKSRNPPQTLRERGPDWLALGGAPVFFRVPLPRPRFHWVHKMYKGRLPYLNHKMGWDGVMQRGST

SEQ ID NO: 177111 - protein, 108 aa, Triticum aestivum
  Clone ID: PAT_TA_71529.pep
MNRDRWDGNTSAVFPEEEEVFYTVGILRSAVSEGDLGRLEEQNEEILRFCEEAGIPCVQYLPYYAGQAGWEKKHFGPAKWARFVERKRKYDPKAILSRGQRIFTSPLA

SEQ ID NO: 177112 - protein, 45 aa, Triticum aestivum
  Clone ID: PAT_TA_71530.pep
TKVLVKIGSRYNVGAVIPPGFVPSAPGKDYPFWKNPGPGATRQGS

SEQ ID NO: 177113 - protein, 67 aa, Triticum aestivum
  Clone ID: PAT_TA_71531.pep
GKKIFLPMVGGQYRPILIGCPNFPPGGTNTCPHLGKIPPLNCHWGPFFFKKKKPTLLFPGKNTNPPF

SEQ ID NO: 177114 - protein, 134 aa, Triticum aestivum
  Clone ID: PAT_TA_71532.pep
ARQSEFHLLVALAENGTASGELFLDDGDSPEMGAVEASWTLVRFSCAREESKGMVPPKVSSHVVQNSYAPSRAQVIGKVVFMGLPSAPKSFTIYVNRVQFKAARTKSRTSGVFSISGLSLAIGQKFEIKLVMSH

SEQ ID NO: 177115 - protein, 62 aa, Triticum aestivum
  Clone ID: PAT_TA_71533.pep
IMILKRYRHLQMPMYAHGLQITNSTRISKLSQNKHTQSFCRLRLQVDIHISRTKRLLFITQG

SEQ ID NO: 177116 - protein, 60 aa, Triticum aestivum
  Clone ID: PAT_TA_71534.pep
VKGLIWGSQPGFFSFSPSLFWWAPNCFCAIVFHHFASHGFFFPPLNGSSVLLALLAQCVV

SEQ ID NO: 177117 - protein, 172 aa, Triticum aestivum
  Clone ID: PAT_TA_71535.pep
DASDHGVGTGTASGIAPGAHIAMYKVCTAEGCEESAVVAGLDAAIKDGVDVLSLSLSSLTGVSFNKDPIAIGAFSAISNGIIVVCSAGNKGPTPRSVSNTAPWLLTVAAGSVDRRFDAGVHLGNGKRMDGEAFTPVIKPTSKPYPLLYSEEHRFCQNASYGSVPGKIIAPQA

SEQ ID NO: 177118 - protein, 92 aa, Triticum aestivum
  Clone ID: PAT_TA_71536.pep
LGFFFFFFFFFLFLDQKKTHSDFLFWPLTKAAGGGEKNIWLNYFLSPVPKKKKLAFFFLGPWLQKTFWPCLPHTPGGYNFFRELPWGPFPCL

SEQ ID NO: 177119 - protein, 105 aa, Triticum aestivum
  Clone ID: PAT_TA_71537.pep
PPSPPKITLLHNTKGLRATKGSPKIKTKTDHSFLLGTFLLKIMGVKNRQSFALPCITRPTHVIAMLPMQFAPPYLGPQSITNDDLMTMTTPGVLNKKLTTFGGWT

SEQ ID NO: 177120 - protein, 104 aa, Triticum aestivum
  unsure (1)..(104): unsure at all Xaa locations
  Clone ID: PAT_TA_71538.pep
PGGGPKARAPGPRQRGPPGGIFQNPPPPPGGPGVFPIKXSPEVEGVPKTPPSHPPITPPLKVKKRPPRDGVPLFPECPPRQRVGALKNPPGLGPKKCPPPFEPA

SEQ ID NO: 177121 - protein, 102 aa, Triticum aestivum
  Clone ID: PAT_TA_71539.pep
KKFMAPGVGVWVSNGDPDGRVPVTLTRYRVNPIKLRGRAKNGWKGWFFPHQVARWAVEYKEGLTLVTVRGAGPQVPLFGPDRSLAKFYPFLRGQPLPAPAPR

SEQ ID NO: 177122 - protein, 105 aa, Triticum aestivum
  Clone ID: PAT_TA_71540.pep
IKHEILLTDITNYIEQNGILLWAGKRAALFLVKLACLSVFLVTLCASSSSAFALILIFILPLYQNTLSISRCVDLIGLLFDSVLPSEEDCEGLDMQWPSGVVRGA

SEQ ID NO: 177123 - protein, 110 aa, Triticum aestivum
  Clone ID: PAT_TA_71541.pep
PGDGPRPGDGPSALQEARAVHQEEPILQEVPPCQGGYQPIEDWCDMKSYAYFSIHVGIDPSSFFYVCREMLIPGSLDFLFAGVVVVIELVSNEPMSILVIYAIYFICSKT

SEQ ID NO: 177124 - protein, 157 aa, Triticum aestivum
  Clone ID: PAT_TA_71542.pep
IGDGGLLPLPAGSRDREVCAGSHLGRSLGGSAEGLAEPTGRLPGQRFPCEAGGGADQGVRGVVAAPDDVPGRDELEAEPGDAGPRRASGCQRFGRLHAARLRQGEGGPRRHRGPCRRGQAALARRQPIRFAANQSKPVLAIDRQAGLSPPSFCTNSL

SEQ ID NO: 177125 - protein, 95 aa, Triticum aestivum
  Clone ID: PAT_TA_71543.pep
PPQHMPGGCVLIAAVVRPVHGKQTTRASSKRGSLAYKLALPPKIEQKGGNLVYKLTLPRESRIHLVFCLPTFAPDYTLVFSELPRAPDLTKTTPA

SEQ ID NO: 177126 - protein, 128 aa, Triticum aestivum
  unsure (1)..(128): unsure at all Xaa locations
  Clone ID: PAT_TA_71544.pep
VPKDVNAAVATIKTKRTIQFVEWCPTGFKCGINYQPPGVVPVGDLAKVQRAVCMISNSTSVVEVFSRIDHKFDLMYAKRAFVQWYVGEGMEEGEFFXAREDLAALKKEYEEVSDEFNKGEYGYEGDEY

SEQ ID NO: 177127 - protein, 232 aa, Triticum aestivum
  Clone ID: PAT_TA_71545.pep
TPTPVRNLDIDNDENAGTSNNNEILNQQSNAGNVSYERNGTGQETSATPDNLSVQQYAYADKTRSQLKSYIGHRAEQLYVYRSLPLGQDRRRNRYWQFSTSTSPNDPGSGRIFFESREGYWRVIDSEEVFDALVASLDTRGSREAQLHSMLQRVESTFKEGIKRKRDAAIEQSAGRYLKNGATDTMRASYRSEFGSPSSTLSSVSADSATTYSDSFKIELGRNDVEKISISK

SEQ ID NO: 177128 - protein, 199 aa, Triticum aestivum
  Clone ID: PAT_TA_71546.pep
RAALPAFLSRFYPFAGRVVPSASTGVPEVVCGNEGAELVVAYADAALADVDFADADASLGRIQVPFQRGLALSLQLVRFACGGFSLTWGTDHLLVDGHGLTTLPNAWAEMLVGGGLSWEPHHDRSSLFRPRSPPRYTPSLDAEFVRYDPASLPNALLAAALVRRNYVVDAADVDRLRAAASGPSRRATRLEALSAHVWK

SEQ ID NO: 177129 - protein, 46 aa, Triticum aestivum
  Clone ID: PAT_TA_71547.pep
FLKRGVFNPRNELWFKLLGFTNNLGHVYVNGRDIYPPTGPNFGPCG

SEQ ID NO: 177130 - protein, 143 aa, Triticum aestivum
  Clone ID: PAT_TA_71548.pep
MIPDTRIYSNQGSVSVNPVWDLVWKLEVPTKIKIFIWRALHGLIPGMAVLAHRHIEVSPICPVCQTGLEDMKHLLSTCPRASQVWRALGLDLDEIIEQAVQVDRSGSVVLEDILRRPRGPSPVLGQLGLHETVAGASWYIWWE

SEQ ID NO: 177131 - protein, 52 aa, Triticum aestivum
  Clone ID: PAT_TA_71549.pep
LMLYLTSRHLNGISFTFKDPTMYCKYVNLIFLTETRRVDGLHLRQCTSNRPR

SEQ ID NO: 177132 - protein, 49 aa, Triticum aestivum
  Clone ID: PAT_TA_71550.pep
GGPGGFIYSFPGTCSGGEWTIVQGVPIDEFLRKKMDAAAPELSKEKALA

SEQ ID NO: 177133 - protein, 56 aa, Triticum aestivum
  Clone ID: PAT_TA_71551.pep
FSLWWAAIIWRKKTSTVFAVILIFLLAVLPPIVFPLYWLFYWIMIIRSKMPFGCLS

SEQ ID NO: 177134 - protein, 82 aa, Triticum aestivum
  Clone ID: PAT_TA_71552.pep
YITRHEDQGLILPCRKTLHENYPLNRTNPLLAARGERSYLATQNQTHDSFPVLIQTDMRMRPGEIHTSWGHTLFAQLVHTKN

SEQ ID NO: 177135 - protein, 152 aa, Triticum aestivum
  unsure (1)..(152): unsure at all Xaa locations
  Clone ID: PAT_TA_71553.pep
LLSAYVEIYFQSCFDEMRTGRIPGNSCSLEIDFMFLHXSVEAVIQIFAMVDHPHHLRFTAFSCGFDHEIVLFDDKFVGGGKLNQHVVAVKEKGKLDVRLQVEKMVFQWTFQNGVAGTVSSPDESVFKYGQFLVRVFFAPKDLQPRRKVVMFG

SEQ ID NO: 177136 - protein, 161 aa, Triticum aestivum
  Clone ID: PAT_TA_71554.pep
TLCLVQGLTAQKRRPIKVSDGPEFCARCGHPCLKKKMWPSRIVICPKKILETHRFSGYYLFAPNFSPSFFLANPDFPLEQTLDTPTISILQRAAAFKAPCMHRSHASTTESYPKPAANQDGSQPSSRATMKCWCTHAPKGAMATPLSSPFSVPTLRAPLWH

SEQ ID NO: 177137 - protein, 85 aa, Triticum aestivum
  Clone ID: PAT_TA_71555.pep
YFSEATDSLFFSLIVSILGSLCDNGTWRELLSHGRHVQKKRIRSSCSNAGGKKDMTVRLPHLQHLMGGITPTVVALLHAAGLSCL

SEQ ID NO: 177138 - protein, 56 aa, Triticum aestivum
  Clone ID: PAT_TA_71556.pep
FFGHHVKFFCIIHPYPVGPDALVGSLRHGLYYGKCFLCPIWVGATNESLLFPAKKY

SEQ ID NO: 177139 - protein, 98 aa, Triticum aestivum
  Clone ID: PAT_TA_71557.pep
MHLSQHDGVRGLGPFPSPGLEPLGLHAAKIAPPKRQPLTPIIMASDLLTVLTHFRCLLLPRLAALNLRLLLPCRLATTFRHRMIGAVLRRFMRHRPMW

SEQ ID NO: 177140 - protein, 133 aa, Triticum aestivum
  Clone ID: PAT_TA_71558.pep
AITVLGALVVAVLLSPSCSSPRYRRLRATLFLAMGMSGVIPAVHALWVNWGHAACYLALGLEVAMGLAYAVGAWFYVSRVPEKWRPGVFDVVGHSHQIFHVFVLVGAITQYVAVAVLLDWREKAAVSCGGTAS

SEQ ID NO: 177141 - protein, 122 aa, Triticum aestivum
  Clone ID: PAT_TA_71559.pep
GVPIFGGRGPPPPWGKKLEVEANDCNNVVEQGVPRGGVLIYQSFAANKKVVVFAGWPRSVFPCFGAERVQTPPLVKEGKFPTPLAWGGEKDSLEEGAGLCERLAVPVPFGDFVLKKFVVWLL

SEQ ID NO: 177142 - protein, 99 aa, Triticum aestivum
  Clone ID: PAT_TA_71560.pep
TSLLSTSPQQGSFRAGLDGRAIWLVTHLLTSQTEQEAFVVTNLCYLCPCVYCHRPTLTGIVFLSSLQFPAAAGVSNFLVLDLLPATTWFETALDCLTTS

SEQ ID NO: 177143 - protein, 106 aa, Triticum aestivum
  Clone ID: PAT_TA_71561.pep
NAFFGLGDHFWRGAPFFCILKQGGGWAPQMGKKGGAPKIKWAHNRFSAFCWVGGRKFPLKVWLFIWKNSVFFPLGRQKDFFVFVGQGKVFFSLFPKFVSPVGFGLA

SEQ ID NO: 177144 - protein, 57 aa, Triticum aestivum
  Clone ID: PAT_TA_71562.pep
KMNGASGPKLKAVCTKVGMFALREKRVHVPQEDFKMAVAKVIKKDPQKNILLRKLWK

SEQ ID NO: 177145 - protein, 92 aa, Triticum aestivum
  Clone ID: PAT_TA_71563.pep
PADPPPAQCWHHRRAGDAHAFVPRRGERRQPSPPRGRLQLLARCERPQQRRRRQRVLAAVTGGEPRRGHDRPEPVHKPALPAAVKPKSGWCS

SEQ ID NO: 177146 - protein, 52 aa, Triticum aestivum
  Clone ID: PAT_TA_71564.pep
FTKILEVIKANFNDKFDEVRNKWGGGVTGYQSQSKIKARERLIAKEVAQRIK

SEQ ID NO: 177147 - protein, 54 aa, Triticum aestivum
  Clone ID: PAT_TA_71565.pep
KSCFLMGAQFMDRNVCVRLIVWSCGLLSGRDRPRSGVELVSRLSFQNNKSPLVG

SEQ ID NO: 177148 - protein, 51 aa, Triticum aestivum
  Clone ID: PAT_TA_71566.pep
GITLMDIYDQNPPLLKHQPTGLSCLIQPRPVQAMKLNLNSSSPTLTKCNPW

SEQ ID NO: 177149 - protein, 56 aa, Triticum aestivum
  Clone ID: PAT_TA_71567.pep
FLMRINILSPFPYPYKTAEIKGQLALLGSNPPPRNQVCLLPPSPVICNDLTHDPVC

SEQ ID NO: 177150 - protein, 80 aa, Triticum aestivum
  Clone ID: PAT_TA_71568.pep
CKLKEGLGRRQYFNEFCSFFLSGDLLSRKGKKSVGYGTGGYGNSCLVLYWRLVRNGSDFSHPTPFLEKRAYNCSWYLDIG

SEQ ID NO: 177151 - protein, 118 aa, Triticum aestivum
  Clone ID: PAT_TA_71569.pep
YSYFLRRSYVASQLTVCVSVLQVSDIYPLQAIKTAMSRQLPGWEAPWIATERLPLDDSLKAHTISAAYACFLDHVVGSLAEGKYADFVVLPSTSWREFADDIPGHVLATYVNGKQAYP

SEQ ID NO: 177152 - protein, 89 aa, Triticum aestivum
  Clone ID: PAT_TA_71570.pep
WGGGGDKAGRPFLPVGRWWRWMVSIGWWWWWCSGNSFIFLSLTEFVKKKKKKKKKKKKKKKKKKKKKKGGRSQSRTGPVGGPVGGHVGQ

SEQ ID NO: 177153 - protein, 105 aa, Triticum aestivum
  Clone ID: PAT_TA_71571.pep
IQKKKFISLTIFGPDLDGAEQSLSQNSEIRKTLYSPVLVLGPRNPPLLPLSRGPNAVPFPTANPKPPSGLNGNGLQAAEPAKRDHNGPEQLFQKAEAGPFLNARG

SEQ ID NO: 177154 - protein, 212 aa, Triticum aestivum
  unsure (1)..(212): unsure at all Xaa locations
  Clone ID: PAT_TA_71572.pep
TQLLTKKGFQWSDKAQDGFVMLKKAMVSTPVLALXDCNRLFAIETDAWDTGVGAVLTHDGYPVAYISKALGVRNQKLFTYEKEFLAVMMAIDKWRPYLQHAPFEIFIDHKSLCALGDQQPATELQRKAMAKMVGLQFSLRYKKGTENTAADALSRVGHLLALDALSMCQPQWLXEVANSYKTDPDAQELLAKPAILNTNDQGRTLQQGVIRQ

SEQ ID NO: 177155 - protein, 140 aa, Triticum aestivum
  Clone ID: PAT_TA_71573.pep
NNGGGRGNGGYQERRDGYNGDRRQQGGYNGGRGNGGYQENNGGRGQERQDAYNGERRQQGGYNNGGGRGNGGYQERQEGGERRQQGGYNNGGGYQQGGNYRQWQGPRPKQDKEFTPADFPALGGAFQSQSQSQAQPQPQA

SEQ ID NO: 177156 - protein, 77 aa, Triticum aestivum
  Clone ID: PAT_TA_71574.pep
LTNQNNTVAFDLGQNRCNSLSYLPNLSNVNPKPKTKTGTNPRLSVCLSKRNSIHLKTKSVKPNFFGRGGAPISQSSR

SEQ ID NO: 177157 - protein, 94 aa, Triticum aestivum
  Clone ID: PAT_TA_71575.pep
CGRICAAEAGTADKAQASEHYIEQIDRKTPGWMPSQQPSVNVYSCVEASRLSSHFLHQNQFYSETYLAITDAMGEGSRTGKNLGIQYMLHSSLT

SEQ ID NO: 177158 - protein, 51 aa, Triticum aestivum
  Clone ID: PAT_TA_71576.pep
KNMGRWSIKIVYTHLHGANVPKINLLISPEKKHSVHRCYDDCILFAVWNVC

SEQ ID NO: 177159 - protein, 130 aa, Triticum aestivum
  Clone ID: PAT_TA_71577.pep
SNQGSPSSRQIPALSTSTITTINLQRAGRNLYPWFLLLPQRATTWIIPPARPREESSTAATMTTMTKNSLSSSGDPISAPTPIPVPGVAEQLLNLMNGSVCLSSQIQITNSTFYIYFVFHPTSTTMNGLF

SEQ ID NO: 177160 - protein, 71 aa, Triticum aestivum
  Clone ID: PAT_TA_71578.pep
GAKKNFFNPPNKIFPDQGFFFLQKYFQPRVNSMTFLTRNGKPQNTSGSFFKKKKRNLMGKIFWAFLGLNKL

SEQ ID NO: 177161 - protein, 86 aa, Triticum aestivum
  Clone ID: PAT_TA_71579.pep
IPFYLGPYFGIDMFIGTVILFVWQRLDRVKSDTYAPAVASGLICGDGLWVLPQSMLALAKVKPPICMKFLSRGVNAKVDAFIATLS

SEQ ID NO: 177162 - protein, 76 aa, Triticum aestivum
  Clone ID: PAT_TA_71580.pep
SVLVNQGSGRSMDPLTVVEPTKDYTNKRCRAPTSSHEPHPLEKEEPLHRQHPTSHKGQLNSDVISDMWLELFNPIV

SEQ ID NO: 177163 - protein, 82 aa, Triticum aestivum
  Clone ID: PAT_TA_71581.pep
NEVSTTHFFFPVLRSQGGGVCKKHLTSSPAKQLLKVQSSTNNGARPLWTGSFWVCSTSTGVWHQLSPRPACRRRSTLPPSQG

SEQ ID NO: 177164 - protein, 70 aa, Triticum aestivum
  Clone ID: PAT_TA_71582.pep
DGDPSDGCFKFSSEQIRLSFTRNPRGFRLPAPPWEIGDDPWDYYFFFRPGPRCHVFFPPTADVTKPPMIL

SEQ ID NO: 177165 - protein, 115 aa, Triticum aestivum
  Clone ID: PAT_TA_71583.pep
KAAAAAVEEQGEEKAAEPVKEAEEPPRQVKLVFGEDIRWAQVPATCSMAQLREAVRGKFPGLKAVLVKYKDREGDLVTITNQDELKWAEDLTDPGSSLRLYVTEADPEHEPYVED

SEQ ID NO: 177166 - protein, 46 aa, Triticum aestivum
  Clone ID: PAT_TA_71584.pep
EWNSGYTVRFGLYYIDYNNNLTRIPKASVEWFTQVLSQNQKTAAVM

SEQ ID NO: 177167 - protein, 103 aa, Triticum aestivum
  unsure (1)..(103): unsure at all Xaa locations
  Clone ID: PAT_TA_71585.pep
MFSSKIPLADSTMKGIPKLGRWLPSRAKTKIPPRPPLLTKRGPQKGKKPAGGSLTSPXGPPSPTFSTLPQSPPPKDGPHQQPFPPPPPFGGAGPQTPPNWAPP

SEQ ID NO: 177168 - protein, 51 aa, Triticum aestivum
  Clone ID: PAT_TA_71586.pep
ALYSYFVPFDVINWNCQCRKIQSTEDGQQQVKIMHTGTTLENRAVAAYWFA

SEQ ID NO: 177169 - protein, 96 aa, Triticum aestivum
  Clone ID: PAT_TA_71587.pep
GPKPAQVSPPPKFLNLLTPGHGTKQKGGTPGNKITRHESAQNGMKQQRVDPPDKTKGGDPPWAQPPLQLFNPGRRGTKEQPSAKRTTGGASWDPRK

SEQ ID NO: 177170 - protein, 29 aa, Triticum aestivum
  Clone ID: PAT_TA_71588.pep
SYPKAEPVVTKFNEFSVRPIIVMNVSVCP

SEQ ID NO: 177171 - protein, 84 aa, Triticum aestivum
  Clone ID: PAT_TA_71589.pep
NSDQHAERNKPKFEKGSKTTNQTENGRGGLKKKQHLYSKIFGKKTLKKKHLSGDGPTFNQKNFHKLGGANRFPPSRGKRENKGP

SEQ ID NO: 177172 - protein, 43 aa, Triticum aestivum
  Clone ID: PAT_TA_71590.pep
KQIEEKYTENRWFIQRFYYLTKHLNTDPLIIYWSFDNNNKLKS

SEQ ID NO: 177173 - protein, 47 aa, Triticum aestivum
  Clone ID: PAT_TA_71591.pep
MEFDAMKTCYCFFIWKTERKNGCCTTDLNTHHVPNDSCHPTNQIMRA

SEQ ID NO: 177174 - protein, 47 aa, Triticum aestivum
  Clone ID: PAT_TA_71592.pep
SITIWLILPDTMQVYIMIYKMHLQQFSHHYIKYPIYTNHRLNVSLPF

SEQ ID NO: 177175 - protein, 67 aa, Triticum aestivum
  Clone ID: PAT_TA_71593.pep
CSISLCRVVVSLHHVPVRRLVGLDYLSFLNYYLWLVTELMYGSVCRVWLYVVSIELLSVCMFCRECI

SEQ ID NO: 177176 - protein, 38 aa, Triticum aestivum
  Clone ID: PAT_TA_71594.pep
FKFTYNRNGSTFRAHTKTPLNGISHPANYNRAPIKHPP

SEQ ID NO: 177177 - protein, 66 aa, Triticum aestivum
  Clone ID: PAT_TA_71595.pep
GFYLFFFFFFLTALSSYPFYYSPHKLLGSRITNKKNGKAPPYLYNQVFLFHNRKWIKTPPNFINHT

SEQ ID NO: 177178 - protein, 68 aa, Triticum aestivum
  Clone ID: PAT_TA_71596.pep
ISFGSFDILFDEEVKQGLKKYLNWPPFPQFYYKSKLMGGCDIVFELEKSGKFKATFSEKGKFWCWIVV

SEQ ID NO: 177179 - protein, 66 aa, Triticum aestivum
  Clone ID: PAT_TA_71597.pep
GTHYSDYILTENPSLFFNKNPAQQKNYSFNVPKNGGGKKFLKSSKFSKQGVYTQFTLLLGVNPKCR

SEQ ID NO: 177180 - protein, 51 aa, Triticum aestivum
  Clone ID: PAT_TA_71598.pep
FCKGGLWVKCVFLTRVEVIKCTIDCVIFTIRDCQSVDVPSSNLERSIQDWP

SEQ ID NO: 177181 - protein, 95 aa, Triticum aestivum
  Clone ID: PAT_TA_71599.pep
KRAKGKKPPQGGKTSGFHRGGGGILNFLMAGTRPKRILIFWGPGGQQFPGNSGPGPPGFFEQTGSIGAPKKAKGPKRVPGENGYPPPGLFKAEKG

SEQ ID NO: 177182 - protein, 47 aa, Triticum aestivum
  Clone ID: PAT_TA_71600.pep
GGIFFFFLTKCLTIIISTRINTARFKPHFLVTHPPASNIGRGLPKIK

SEQ ID NO: 177183 - protein, 85 aa, Triticum aestivum
  Clone ID: PAT_TA_71601.pep
VFASESLGRNTNIDGPGSSPRYGAFNHMQNQQGPYNQPKRSLLYQFTAAQKRARVASPLFYVQTPFCAILCIFVSFTAKLAGASV

SEQ ID NO: 177184 - protein, 71 aa, Triticum aestivum
  Clone ID: PAT_TA_71602.pep
RIPRAFLVAKLKKVIILRTVPPVKFVKVMTTKAPLILIERYSKFLCARVPSHCTCLSHFIRVGLWSGQVSS

SEQ ID NO: 177185 - protein, 48 aa, Triticum aestivum
  Clone ID: PAT_TA_71603.pep
KMFFLVWCRDIKGTGLIWWGVAYLGPEFDLFLKGFAMVGPPLGCVLKS

SEQ ID NO: 177186 - protein, 55 aa, Triticum aestivum
  Clone ID: PAT_TA_71604.pep
ENYGHHHITKKNFTSLARPGKTRVNKHPMGDNNFYLKGPPQDNTPPKCPQKLQDG

SEQ ID NO: 177187 - protein, 56 aa, Triticum aestivum
  Clone ID: PAT_TA_71605.pep
GVFLRLWTQKIPKNLRIKLLQNYMANSLSFYWCYTPDTANRLKSFPRGHTLTNRRG

SEQ ID NO: 177188 - protein, 49 aa, Triticum aestivum
  Clone ID: PAT_TA_71606.pep
VGHEIFKKPVGFHKGFEFIKETFMDKQKVRVGCNRFRPVVVQTLDLFNQ

SEQ ID NO: 177189 - protein, 167 aa, Triticum aestivum
  Clone ID: PAT_TA_71607.pep
LSAAPKKDLGMAKQPFSDSNNSETYSFNQLMSLAEEKENANPDAAAKARRVSLCNGGAQQPRRSSLIPLPRRNSLMPLPAGGGAKTPAPAAASPLDKIKEYSSPPLSSPPVMSNDKGGSRSKRINSILRRSLQKKVVIRPAPSGQGGRRAGAGATAAAAQGIDSARR

SEQ ID NO: 177190 - protein, 109 aa, Triticum aestivum
  Clone ID: PAT_TA_71608.pep
GIPRSWVRFLWKGVVMVFLTPTLGKGPSVYGHGGCLVAQNFRPPGFCLLLKPHPGRWFFCPLNGGGPWVLVFFAGLEKIVGGGGFAPLRRWSLAWGPFFPFSIWGFCKK

SEQ ID NO: 177191 - protein, 84 aa, Triticum aestivum
  Clone ID: PAT_TA_71609.pep
PTKIFPRFFKKIEAGPQFFKNGEPGFFKKVPPQPLGGETFGRDPPLGRFFVGEIRQTVAVGVFKAVEKKDSAGAKVAKAGAKKK

SEQ ID NO: 177192 - protein, 68 aa, Triticum aestivum
  Clone ID: PAT_TA_71610.pep
RKRGVLCMSKEQCLLDRFNVTLTLCDTMMLLMLLCDDDHVTVGLANNEYNNFSPCRDKGMPIGRLSYK

SEQ ID NO: 177193 - protein, 160 aa, Triticum aestivum
  Clone ID: PAT_TA_71611.pep
SKDAVYEVMKKQVTEIARQTFRPEFLNRIDEYIVFQPLDSTEINRIVEIQLNRVKNRLLQQKIPLQYTPEAVEHFGAFGFDPKYGARPVKRVIQQMVENEIAFGVLKGDFKEDDTVVVDVSSVSIAKGFAPKKQLVLQRVENGSPELVAKDGSTELVAND

SEQ ID NO: 177194 - protein, 79 aa, Triticum aestivum
  Clone ID: PAT_TA_71612.pep
LRSKGAKTPKEPPDPRAHKIGFPPPQNLNGGPKFGPHLYGPRDGAPQKIPKKALVKGLSLAPPKKPLVGKDLKKPGPPF

SEQ ID NO: 177195 - protein, 78 aa, Triticum aestivum
  Clone ID: PAT_TA_71613.pep
VLLRIPAKELCRLRAVCPAWRALTFDPPFVAAHMSRHRTAPPLLAIAYRDDSEVNGVAISDLSGNVVRRIPVTGYEIV

SEQ ID NO: 177196 - protein, 55 aa, Triticum aestivum
  Clone ID: PAT_TA_71614.pep
PDIYLFIYPNINLLNVDFIYTNNPHLSNSLKEAPTGWLHREGYNYFPGYIFFIGS

SEQ ID NO: 177197 - protein, 106 aa, Triticum aestivum
  Clone ID: PAT_TA_71615.pep
KMERIKSATLLTQKPPKSSNFHSSVPRASFCRRLTLARHKVWLKRHSICWGFLRRGCSLLLISRSCWRRRWITTHQELFFIGSWCLPPYSALHVSTSHSLNYVHLY

SEQ ID NO: 177198 - protein, 95 aa, Triticum aestivum
  Clone ID: PAT_TA_71616.pep
KAPEPEPAFQILANPARVVPLQEKFIKFIEGSRYVPVRPAPCGGFILLRDMQPSEAEELVVLTDAPATGQPVPGASAMAVDDDEPQPPQPFEYLS

SEQ ID NO: 177199 - protein, 65 aa, Triticum aestivum
  Clone ID: PAT_TA_71617.pep
IHPLFFEWWVHAFDVLLILKKRNIAAEPCSKNMSKIFWPQIKCIGTSSVVPFVFSLFTCFFLCIP

SEQ ID NO: 177200 - protein, 129 aa, Triticum aestivum
  Clone ID: PAT_TA_71618.pep
FHLLVALAENGTASGELFLDDGEPPEMGAVGGNWTLVRFSCDREESKGMVTTKVSSHVVQNSYAPSRAQVIGKVVFMGIQSAPKRFTIYVNNVELKAARTKSRTSGVFSVSGLSVAIGQKFEIKLVMSH

SEQ ID NO: 177201 - protein, 46 aa, Triticum aestivum
  Clone ID: PAT_TA_71619.pep
ISMTLLLSPIIMCNSWFATYVRAGTRNFCVTSKIFSCIFIRLLFSC

SEQ ID NO: 177202 - protein, 65 aa, Triticum aestivum
  Clone ID: PAT_TA_71620.pep
VKVLMLFWVTSFLFFALRVKGFGLEVNRTGQLGRILDGRLNQKGYVVCHFVVVGMPWISDNSQLE

SEQ ID NO: 177203 - protein, 82 aa, Triticum aestivum
  Clone ID: PAT_TA_71621.pep
NPLVPFLLQCPKLLILMLVYGKGWRNSQLPQIKELLLVCTYLARTMKVCVVGYAVQVTKFLKLGFASSLLTKIMFIATCEVI

SEQ ID NO: 177204 - protein, 39 aa, Triticum aestivum
  Clone ID: PAT_TA_71622.pep
GSRDTPEDSSITQTCNFAIQTVSQSVMSVIIFQNIWGSS

SEQ ID NO: 177205 - protein, 49 aa, Triticum aestivum
  Clone ID: PAT_TA_71623.pep
PHTYNFTKRSSPGGVHRNFMTTCNEHRHFYNRQNCPIKPPWSFSKKPCP

SEQ ID NO: 177206 - protein, 143 aa, Triticum aestivum
  Clone ID: PAT_TA_71624.pep
ITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVG

SEQ ID NO: 177207 - protein, 89 aa, Triticum aestivum
  Clone ID: PAT_TA_71625.pep
PPGPLRRWMTNTSSLAKFESAFHQTYQAQKLWKVPDPQLKDALRRAIIERVISSYNDYLKKHPELAEHASRGNSTPAVLEEMLGQLFEG

SEQ ID NO: 177208 - protein, 107 aa, Triticum aestivum
  Clone ID: PAT_TA_71626.pep
VLKGPPPPLGPPQGGLSPKQNGGPPGKNGPGLGPWLGSRAEPHPGITHFFNLARRKTYLPRGKKTFLLFSIDEPPPGVQNLKFPPRVCGFCQKGQPAKGFKYGLERG

SEQ ID NO: 177209 - protein, 92 aa, Triticum aestivum
  Clone ID: PAT_TA_71627.pep
KWVPCLEFSKVGFIFREPNASPGYYDGRYWTMWKLPMFGCTDATQVINEVEEVKKEYPDAYVRIIGFDNMRQVQCVSFIAFKPPGCEESGKA

SEQ ID NO: 177210 - protein, 63 aa, Triticum aestivum
  Clone ID: PAT_TA_71628.pep
GPLNRLRGSPCWAPSASIKRISALVRDGGDKKTYFGLKFSVQPVVFFGKVCLLLNGFLTWGTC

SEQ ID NO: 177211 - protein, 60 aa, Triticum aestivum
  Clone ID: PAT_TA_71629.pep
PSVAYPSLITGIKNYLGPKGWDVSGPACSMGTSNLNQSRGAQLALLLRGGDGDKARPRGG

SEQ ID NO: 177212 - protein, 37 aa, Triticum aestivum
  Clone ID: PAT_TA_71630.pep
RTAWPARSRWATAAPWWREVAGLPARSAAATAPKAAV

SEQ ID NO: 177213 - protein, 68 aa, Triticum aestivum
  Clone ID: PAT_TA_71631.pep
FNAGPRTCLGKDVAFTQMKAVAAAVLWNFAVEAMPGHVVEPKLSVMLHMKNGLAVTVKRRKVPCVHAT

SEQ ID NO: 177214 - protein, 65 aa, Triticum aestivum
  Clone ID: PAT_TA_71632.pep
QTDPFHLLLIFFTLYENSKPNHLLQQHANSVLQTINRVFKHVKVTDSNINNSVHHHTKPNHSFHQ

SEQ ID NO: 177215 - protein, 46 aa, Triticum aestivum
  Clone ID: PAT_TA_71633.pep
HHSPPMCSKINVRSIWSEDIWFSPIKLDVFLVYQEDVKQMDPGRYS

SEQ ID NO: 177216 - protein, 69 aa, Triticum aestivum
  Clone ID: PAT_TA_71634.pep
FSTKGSQFTRQTIYKNGGYIPKRFIITTENLNFGPLGLKKKTTIPFNPIPYSLLPWAKLLFLTQPTCGK

SEQ ID NO: 177217 - protein, 133 aa, Triticum aestivum
  Clone ID: PAT_TA_71635.pep
KLQKLLVALCSASVETLVKTSHGVLSNGNGNAHSGNGEVGEGWTKTVSSALAVPSNRKLVLDLTGRATFEAVRSFLEFVLWRLHDAARAGGDATARAGLCVLRYMSERSMVVAAICIVLCLHVLNRTWLLAPA

SEQ ID NO: 177218 - protein, 99 aa, Triticum aestivum
  Clone ID: PAT_TA_71636.pep
KDEVCIIDLEDGLQKFVDAQNAANEGRKEMLETQRRVSAENLEARKLAHLAAKDHKESVMLETYRSLVMQDTTGMPEDVRSEHVLALKCLREKLFGKMV

SEQ ID NO: 177219 - protein, 101 aa, Triticum aestivum
  Clone ID: PAT_TA_71637.pep
YRSCFSIKQDTFRLQSSCFYSFLLILRCSTCLATLSGSRPCFSSRTRTRVREVPPALVALLGNTYATPVTGRPIVLPICSNNCTHSDRTKSDHSPLDHLFG

SEQ ID NO: 177220 - protein, 62 aa, Triticum aestivum
  Clone ID: PAT_TA_71638.pep
LLACMYDGCRSCDLFPMVVASKSPCINEFTHSSQSLHGSIILRYYNMRIANFLNNACIIKTQ

SEQ ID NO: 177221 - protein, 63 aa, Triticum aestivum
  Clone ID: PAT_TA_71639.pep
SFMNAVIREKSYASLDHKKVAIICDKFRDAPDSLFGSLSSRNVVQSARKKSLDVLKRRLKDFS

SEQ ID NO: 177222 - protein, 70 aa, Triticum aestivum
  Clone ID: PAT_TA_71640.pep
KQCTNVETEIQGCPSYGHVCRQAYQSTNFYPTKNLAHAAYPHQVKKKKHLQLRDRLARLVTTLLSFKLNH

SEQ ID NO: 177223 - protein, 72 aa, Triticum aestivum
  Clone ID: PAT_TA_71641.pep
IIHATNTGTTFQMMMHDKSNPSQKILEIKKNSNYDRKCGNKLHSHRSLSCLLHVHVAKSMTPEGILKTTPHA

SEQ ID NO: 177224 - protein, 40 aa, Triticum aestivum
  Clone ID: PAT_TA_71642.pep
PHLHNSRGHVYGAHLLHSCQCCAAFELCNMTCIMCSTRSS

SEQ ID NO: 177225 - protein, 99 aa, Triticum aestivum
  Clone ID: PAT_TA_71643.pep
SDFELTKPSTGQDYKGSTIQQEKENGARYKELEQLTTRQPSKQHKKVEEGVANIGGQPQIPLHRTGTRSPCHPSASEEGHYPLALARRAPDRRKAKRSP

SEQ ID NO: 177226 - protein, 65 aa, Triticum aestivum
  Clone ID: PAT_TA_71644.pep
HFPCGGRHLASSLLSSPLLWSCPPPIQSKDELIAPPFFKKKLIAHPATSLFPQSYPHFSLFHTHN

SEQ ID NO: 177227 - protein, 101 aa, Triticum aestivum
  Clone ID: PAT_TA_71645.pep
MIKSGYLPRVESYRHIICSLCEEGSIKTAKKVLGDMLLEEYNYDEIVWKILVDGLLRKGNAAECLILLSVMEEQDYRPGDALYAKLTGKVSIANDAHEVAQ

SEQ ID NO: 177228 - protein, 114 aa, Triticum aestivum
  Clone ID: PAT_TA_71646.pep
LNPKKRETRRVTKYPSTGPSPKKNPNKFLLQSSNLKIGGPFLTFSNTFFFLEKTPAKSFIHRGTHEGPPQTPLPHIEHGFIGTQQLFSLPGGEDYYNNNGRADNNSGGGGLPPD

SEQ ID NO: 177229 - protein, 38 aa, Triticum aestivum
  Clone ID: PAT_TA_71647.pep
VVVRGLIYRVVIFVDTDMFSRAIVLWDALCYAAEPQGN

SEQ ID NO: 177230 - protein, 68 aa, Triticum aestivum
  Clone ID: PAT_TA_71648.pep
KGLTKTPNLTRPPPQKSPQTNLWPRRQPIGHLNPGSTNPLATSKFQTQTSILPPKLEENKLPNRGDPP

SEQ ID NO: 177231 - protein, 124 aa, Triticum aestivum
  Clone ID: PAT_TA_71649.pep
GEKFFSLQSPCGWHPGILEGARPQPQGRVRVRGFNPLGASCVGGYSFSQKGGGVFGSGVKPGNKILVVMLRTQSWDGGGFLNFFSPAILFLKKRGPSFFLGKRDPGFVGKGDFLREVPPQLIIG

SEQ ID NO: 177232 - protein, 45 aa, Triticum aestivum
  Clone ID: PAT_TA_71650.pep
EKKGHKPAVLPHKMCTSTTAFFTTKIVISTKQATVSNLRVANIFS

SEQ ID NO: 177233 - protein, 34 aa, Triticum aestivum
  Clone ID: PAT_TA_71651.pep
TNTDPGHTSWCTLTYFSSLQRWGHHLNTNNPFTY

SEQ ID NO: 177234 - protein, 82 aa, Triticum aestivum
  Clone ID: PAT_TA_71652.pep
TELMLLSIHPTHTISLLHLQSTHSQILFCPSQTLIIHNPICLQSVAYSPIPFNTATQIVSMRRRQIIIQKIPPHLTTNSSRR

SEQ ID NO: 177235 - protein, 115 aa, Triticum aestivum
  Clone ID: PAT_TA_71653.pep
FKGGVPWGKPHFRGGVHGENPNQRHVSPSCFKGMNGCPPWAGPGMDQSFLFRVKRHGPGSKVTLGFNGPSRVFVLFDYAGQRWVPVKKKGGQPWGVGFKKFPFASLPPGGVPPLG

SEQ ID NO: 177236 - protein, 74 aa, Triticum aestivum
  Clone ID: PAT_TA_71654.pep
NHYCYACLDENMLSHSFCNVLNILNFLMSKPRSGVFYCFIVVSNPRKHAMYCGFVTVKNVRKRACISDFLPSGT

SEQ ID NO: 177237 - protein, 43 aa, Triticum aestivum
  unsure (1)..(43): unsure at all Xaa locations
  Clone ID: PAT_TA_71655.pep
MEDELVSHITRGSLDLFXEKSRDDFTMDGWKLVMKLKKIFSLP

SEQ ID NO: 177238 - protein, 105 aa, Triticum aestivum
  Clone ID: PAT_TA_71656.pep
TKSRVQLEPCDKLTINQDHLSMAICMCCEDGGTYMCDAQTKSLILPSCHDDQTNAVLLWCKHDQTNAATLIHFSLYMNNRLSILAQWYSASKIRIICSPSYSVVK

SEQ ID NO: 177239 - protein, 92 aa, Triticum aestivum
  Clone ID: PAT_TA_71657.pep
QQHHHHQQQQQLQHQQPLSQVSFQQPQQQYPSGQGFFQPSQQNPQAQGSFQPQQLPQFEAIRNLALQTLPAMCNVYIPPYCTIAPFGIFGTN

SEQ ID NO: 177240 - protein, 102 aa, Triticum aestivum
  Clone ID: PAT_TA_71658.pep
AKGGAGFATLSMAMAGARFAESLLKAAGGEKNVIEPSYVEFPLFKDQGVTFFATNVELGPNGVEKIHEIGKVTEHEQKLVDVCVGQLKGNIEKGVKFVAENP

SEQ ID NO: 177241 - protein, 76 aa, Triticum aestivum
  Clone ID: PAT_TA_71659.pep
FPKRQTAPGAFGATWDLNPFAKPRAQHDNNKRHDKNQVYNRPLLPNYFKVHIGRAQSNQRHREEGPMPSAYLGVLN

SEQ ID NO: 177242 - protein, 44 aa, Triticum aestivum
  Clone ID: PAT_TA_71660.pep
SRYNDRVTFHYQNSHRYYKPWEKMAHDPYICLTPVLIPQNCYSE

SEQ ID NO: 177243 - protein, 92 aa, Triticum aestivum
  Clone ID: PAT_TA_71661.pep
RFLTISTFKARGFDLIYSYINSKIFKLIFQMNMDGQLNKDFVSTGGDIITTMPKTFEGVFGYIIIQRPTIGSWDTYQALKKTGEIKLLGMLI

SEQ ID NO: 177244 - protein, 35 aa, Triticum aestivum
  Clone ID: PAT_TA_71662.pep
IWGFNLIPKFINRYWGYDRVSGRETIDELTGAGSR

SEQ ID NO: 177245 - protein, 28 aa, Triticum aestivum
  Clone ID: PAT_TA_71663.pep
VENKTSGSQRYGTNHIIKNTILTNPSLP

SEQ ID NO: 177246 - protein, 180 aa, Triticum aestivum
  Clone ID: PAT_TA_71664.pep
HTLPATGGDTLWASGYEIYDRLSPAMRTMLQGLTATHDAKFFLEEAERLGNPLRKNFRGSPLNHGDALTATHPVIRTNPVTGWNSVYVNKGFTKRINGVTKDESDLLLPYLFNLVTQNHDAQVRFKWQKNDLAIWDNRSTWHCATYDYEEARAGDRVASLGEAPYLNLGGQSRREALGAR

SEQ ID NO: 177247 - protein, 61 aa, Triticum aestivum
  Clone ID: PAT_TA_71665.pep
SRPARGSSYGAEALRPIPTPHGRRRLTEPPDPRRPPLPRRLLLPLHPDLRYTRSDRPALAW

SEQ ID NO: 177248 - protein, 124 aa, Triticum aestivum
  Clone ID: PAT_TA_71666.pep
DIKRDRHRVLHTFKFMALNNFFKDWPAKPLEFPIVKVDQIELGSDIDEEDSDDDLPDAETAKDCSLGLKENGDQPESSSSDEEDESEDGDEADDKGADTEITEKVSDEDSDAEQCEEGFSDFSA

SEQ ID NO: 177249 - protein, 108 aa, Triticum aestivum
  Clone ID: PAT_TA_71667.pep
PTSNFKHPRLAKLTIFCFQFEDYMMSHVRGVMEAAVNLEDVYLFDRLTCDGCQGVTPLKPIRFPEESRHRRWVEKQIRKGGIESLAPIHFLGTGAIRGDIFARIATGY

SEQ ID NO: 177250 - protein, 101 aa, Triticum aestivum
  Clone ID: PAT_TA_71668.pep
PRGGQQGGAPDVGGVFFQGQGSARVRPGGGGRGWPPALQDRHGGGVVPFVRETKRAPRREVLAGEPQKSKEQKRGVNACWDMVMKWVSMKLELCMNLFIFV

SEQ ID NO: 177251 - protein, 83 aa, Triticum aestivum
  Clone ID: PAT_TA_71669.pep
GLFASCTGCCLVSSLLQQMFRCPEEETWFFSMNLLLKSLLSFRLCTIGQGWASSDQIYCSELFVALLPLLQFMNDEFWMVTDY

SEQ ID NO: 177252 - protein, 169 aa, Triticum aestivum
  Clone ID: PAT_TA_71670.pep
NGQKQCFDLKCPGFIHTSPNIPLGGKLSPILKYDGPQAHMNTFVYQDTNSNWWVKFGKEGTVVGYWPGELFGYLKSKGTVGYWGGLVEGPTIKYKPPPMGSGHPASEGDGTAAYVKNIKIVTRDHQLVTPMSREFDVAVENPKCYSVAHKSDQDGGVHANWGGSGDCTL

SEQ ID NO: 177253 - protein, 154 aa, Triticum aestivum
  Clone ID: PAT_TA_71671.pep
LTKETWEKIFLWPNGTATGQLVLEPHGGIMGRITADDIPFPHRSSVLYNIQYVEFWNGTAPGGDVTPKWVGSLYDFMAPFVSKNPRGAYVNYRDLDLGTNKVVDGVTSYESAKAWGESYFGPENFRRLAEIKRKVDAGDYFQSEQSMPPLPLKQ

SEQ ID NO: 177254 - protein, 76 aa, Triticum aestivum
  Clone ID: PAT_TA_71672.pep
PANPDFPRCCPLIYYLLLALLGIILNVKTFFANVNLGLFGTGALLFVHHLVWWGICLFAAILCLFLIQNAAPFFPG

SEQ ID NO: 177255 - protein, 53 aa, Triticum aestivum
  Clone ID: PAT_TA_71673.pep
FNKTGMQLRACPKQQYMGWTTNKHFFSPGQHVFTNILRDPKTMQSSSPPFRVN

SEQ ID NO: 177256 - protein, 64 aa, Triticum aestivum
  Clone ID: PAT_TA_71674.pep
GDGKTQTPTGKLGKNVNRPTKYLMKNKALTETHVNEGKSRPYKLIKPQVITLRGLASLGSKGGT

SEQ ID NO: 177257 - protein, 63 aa, Triticum aestivum
  Clone ID: PAT_TA_71675.pep
VLWNCPHVEGVSAGVPPAPCAPVQGTPAGSCPFPTDTLAVDQIPGHQCSESVAPAITSMAGPK

SEQ ID NO: 177258 - protein, 105 aa, Triticum aestivum
  Clone ID: PAT_TA_71676.pep
RTERHEPLACWCARLWRMGLTHVPLGPSAAYQAAKLVRMYSTAGFRVQEIGGCLSLMWHERPLFTASVWSAMPADGAAEERADKHKLKMSIGESSSGHLPDAGAQ

SEQ ID NO: 177259 - protein, 67 aa, Triticum aestivum
  Clone ID: PAT_TA_71677.pep
ERKEEIFVFIVPDGSFLFGTVYLTFDCFPIQQHSNFPTNEQMTLVCPKNPTGHRIFSYFGKTGRAKP

SEQ ID NO: 177260 - protein, 59 aa, Triticum aestivum
  Clone ID: PAT_TA_71678.pep
ASTMRAFISNKEGTYPHIKQGDTLVGILPKGSNFIEPKGETPPGPGKSQTRDTHQTPSR

SEQ ID NO: 177261 - protein, 64 aa, Triticum aestivum
  Clone ID: PAT_TA_71679.pep
NWPTALKSKPNQNIPPEAYQWRDLRPITNTKQSQELHKSTTFLSDRKHHKRAKPKLPHAKILKL

SEQ ID NO: 177262 - protein, 57 aa, Triticum aestivum
  Clone ID: PAT_TA_71680.pep
WSLVWQSSPVAFDNDDKQILMKKNGQQITVPACNSFAAATEIPGAELASMVTAGTSG

SEQ ID NO: 177263 - protein, 60 aa, Triticum aestivum
  Clone ID: PAT_TA_71681.pep
PIRTKFPFCSVCVSVCVCFPSLSVPGLWEVGAFILYKERRMLSAPTCRPELSGDGTCNHP

SEQ ID NO: 177264 - protein, 44 aa, Triticum aestivum
  Clone ID: PAT_TA_71682.pep
IGDVPLYINVLLNALTLPEGCPEYICIFGTTSMIWFEVIQCCVI

SEQ ID NO: 177265 - protein, 34 aa, Triticum aestivum
  Clone ID: PAT_TA_71683.pep
KGPFHRLFYIKGVMILVPKQINVGDFKYNWHPDF

SEQ ID NO: 177266 - protein, 88 aa, Triticum aestivum
  unsure (1)..(88): unsure at all Xaa locations
  Clone ID: PAT_TA_71684.pep
GIQGAPFKGICMANVPVXMPKKRKVSWNCVDVEGVSAGVTPAPCAPLQGTHAGSCPFPTDTLAVDKIPVQQCSYSIASPAAFSVAGTG

SEQ ID NO: 177267 - protein, 99 aa, Triticum aestivum
  Clone ID: PAT_TA_71685.pep
RFPVGDGTMDLVRAGHAVNRWIPEPALEFLWYDADRVLRPGGMLWVDHLWCRKGDLDGVYAAMLRRLGYKTIKWAVADKTGIGAKDELVYLTALLQKPF

SEQ ID NO: 177268 - protein, 78 aa, Triticum aestivum
  Clone ID: PAT_TA_71686.pep
LYPGGSFDPFGLAEDPEAFPEFKVKEIKNGRPVMFSKFGFFVQAIVTGKGPLENLDDHLSDPVNNKAWAFATKFVPGK

SEQ ID NO: 177269 - protein, 146 aa, Triticum aestivum
  Clone ID: PAT_TA_71687.pep
LPARGTNDRWGVPFVLLGRVRQLGFCGNNDGGEHCRRCGIGCGSRLFFGVFTRLPRVLVAVKLKLWSGPCWRTMTGDMWSVRRSPLTPVLPNYPLFFCRSRSCVVLLWLEGDPSCECGVVLQPIGLRFSFFFDLRILSCCFSAAFC

SEQ ID NO: 177270 - protein, 89 aa, Triticum aestivum
  Clone ID: PAT_TA_71688.pep
PSIAVVQPTDIFCRANQIGGRAKQRPSETEQLPAAAAGRIFLPPLARSHQPLLILSLLPTAYAHQSRNQSTRFPAMASSSSSTSRVSTA

SEQ ID NO: 177271 - protein, 43 aa, Triticum aestivum
  Clone ID: PAT_TA_71689.pep
TPLQVLAALGGFYAMRHPRFRHRLPLTPVNFFRRLPARTDSML

SEQ ID NO: 177272 - protein, 104 aa, Triticum aestivum
  Clone ID: PAT_TA_71690.pep
TKLWPCSIQSGGLKDTIKQNPLSYVWLFKKENQLFIQIYVHRHYYRGCMSVYASFCWYLLSTRCCLLRARKFQGMPAKQTNLTLLLVPPPPSRRYFIYFAMQSC

SEQ ID NO: 177273 - protein, 115 aa, Triticum aestivum
  Clone ID: PAT_TA_71691.pep
NNNKKNNFKKTKPPLGGKGGEQFQKNQFLTILHKTAKKKVFYAPPVFPRGGITYYTQALLPSANRSKFLLHKLPNPLKGWKGGIILLIDNPVFAVMPFATQSFFPRAELPTKLPV

SEQ ID NO: 177274 - protein, 68 aa, Triticum aestivum
  Clone ID: PAT_TA_71692.pep
VIAIKDLSEHRHPPAKIAGVLERAFLMLRPSCPENLAIYSEIERYIAVVKSQILALVPTTSGNAALAM

SEQ ID NO: 177275 - protein, 74 aa, Triticum aestivum
  Clone ID: PAT_TA_71693.pep
PVLTPGKKVRPCPQRATNQLASTNFFILAGQTPTPIIQNLFPLLGNPKNLTQINGPGGQFGRRHKKKKPRPETP

SEQ ID NO: 177276 - protein, 42 aa, Triticum aestivum
  Clone ID: PAT_TA_71694.pep
PLYQDLISDFMLGPVHGAIKVCAEFRPPVDILVAADADFVGP

SEQ ID NO: 177277 - protein, 78 aa, Triticum aestivum
  Clone ID: PAT_TA_71695.pep
SLGHRLMAPTSLDTHSLSPPPTSYKSSFGFSAHNTPNGMHFSIGYPQPSPLPRPNGKESLNMFSYLKRMGKQSCKVSM

SEQ ID NO: 177278 - protein, 49 aa, Triticum aestivum
  Clone ID: PAT_TA_71696.pep
QARFLLTKMNPSAPYNSAHDVPPGFDIIFPQKVSFQVFFEHLQRVAVPL

SEQ ID NO: 177279 - protein, 57 aa, Triticum aestivum
  Clone ID: PAT_TA_71697.pep
LENAAYIFLLGKGYINRNHSFCRKGPKHWCLVWVFIALLDPDPPEVKMSLKRLVAVG

SEQ ID NO: 177280 - protein, 89 aa, Triticum aestivum
  Clone ID: PAT_TA_71698.pep
SVITACGPHIIGNWCRGNMNWSKDASFNHHIPKKNKREHIQKPRIFQSRHPKAKEKESSTRQAVAVAVQHSTFISKGHIKVQHDIIDAD

SEQ ID NO: 177281 - protein, 139 aa, Triticum aestivum
  Clone ID: PAT_TA_71699.pep
VLRWSLSGRRSIAGVATEHRQAVETSSVLQWSFLGHRSNARPRNIIGAPVELRGPLEHCQSIAGAATEHRQADETSSVPHWSFSGRRSIARPPKHHRCSSGACQPTDGALPEHHPCCAGALPGHRSIAEAPLTLWRSIA

SEQ ID NO: 177282 - protein, 75 aa, Triticum aestivum
  Clone ID: PAT_TA_71700.pep
EPLGLRLLEMQQDCATQLWHGRKEHLPLKAHYSPARKLMHNLDLKMLSGPIAFPSSPSPTRSRLFTFFVTACSCL

SEQ ID NO: 177283 - protein, 81 aa, Triticum aestivum
  Clone ID: PAT_TA_71701.pep
QLKINFNARKASETGLKLQRRSFTCKDLRMVKITCSKNDGRVHKLANLFMANGMPVEKIYVHHSESAYLRSQKQTKEFWGV

SEQ ID NO: 177284 - protein, 72 aa, Triticum aestivum
  Clone ID: PAT_TA_71702.pep
GLADDDVGGDPDADRKRKGSSSLRDLARGGGKDKHEKKRRKEDVGMVREKRGSSSGGKGSGGGRGGGDRGED

SEQ ID NO: 177285 - protein, 90 aa, Triticum aestivum
  Clone ID: PAT_TA_71703.pep
ERITACQLMKERRKLLCLVVEECIQQDPPDYGQLVLAQHQGMIFGDLRSGWRCITTCLCTLGSGLNLSLCKSMCDYGIVISCLLVLQYAT

SEQ ID NO: 177286 - protein, 35 aa, Triticum aestivum
  Clone ID: PAT_TA_71704.pep
AESNHIHPVSTPKSQFQSIIQQYMSRWTILSSCYY

SEQ ID NO: 177287 - protein, 195 aa, Triticum aestivum
  Clone ID: PAT_TA_71705.pep
HAPRLPRRGVLATRAYGAFLRDQLPVELSSPAPRVLYSYAHAATGFAAQLTGRQAAQLASSGSVLAVVPDVMQQLHTTLTPSFLGLSPSYGLLKVSNGATDVIIGVIDTGVYPEGRKSFAADPSLPPPPSKFRGACVSGPSFNASALCNNKLVGAKFFHKGLEAARGRALGEDSLSPLDTNGHGTHTSSTAGGSP

SEQ ID NO: 177288 - protein, 66 aa, Triticum aestivum
  Clone ID: PAT_TA_71706.pep
KPGSKIKGNFSPGGGGFLGIPAGVKNPFLNFPRYFFGCPVSPAPWGLGGFFFRPKLQGFSGLKFFF

SEQ ID NO: 177289 - protein, 55 aa, Triticum aestivum
  Clone ID: PAT_TA_71707.pep
EMGGGALALPPMKATKKGMGEKQVPVPFGGPRFWDGGWFYPDPGGIFFSRAGFFL

SEQ ID NO: 177290 - protein, 132 aa, Triticum aestivum
  Clone ID: PAT_TA_71708.pep
SFGRIGLSQGCLHYAATPLATDDKKKKERKKKKNDTSTVWCMKDYDSKEWVLKHSVSKDELRSITGVDYKVAAFHPDRETIFLDSYDVDTLVSYDMQHRKFHQIRSLRENRATLFVPYVPLFSDSFAGADGQ

SEQ ID NO: 177291 - protein, 108 aa, Triticum aestivum
  Clone ID: PAT_TA_71709.pep
KGLSTMSGPGKGGKGLGKGGAQRPRKVLGGNIQGIPQPAIRRLGRKGGVKRISGVIFEETPGGVKIFLEKVIPDAVPYPEHAPRKTVPPMDVVYAVKGQGRPLYGFGG

SEQ ID NO: 177292 - protein, 41 aa, Triticum aestivum
  Clone ID: PAT_TA_71710.pep
KRKKQAKDQFMQQQFQFQQQQQGVAPGPMPPASKFFNEIFA

SEQ ID NO: 177293 - protein, 90 aa, Triticum aestivum
  Clone ID: PAT_TA_71711.pep
HHHHQQQQQQQQQQPLSQVSFQQPQQQYPSGQGFFQPSQQNPQAQGSFQPQQLPQFEAIRNLALQTLPAMCNVYIPPYCTIAPFGIFGTN

SEQ ID NO: 177294 - protein, 82 aa, Triticum aestivum
  Clone ID: PAT_TA_71712.pep
DFKRGQRSLHREPTNWGFKRGGITKLDNFKRGGGTELDLQTGINPFAPRKRPSGDHRTCPLPLRAGTSCTPRWGRDGTTKGA

SEQ ID NO: 177295 - protein, 61 aa, Triticum aestivum
  Clone ID: PAT_TA_71713.pep
LTLGPPKGCFQGSKRTWSAFNSRIAKETYMPLGPAFWFLGPRWSFGFFSLKQGGGILTLFP

SEQ ID NO: 177296 - protein, 88 aa, Triticum aestivum
  Clone ID: PAT_TA_71714.pep
SPGPQGLIFSGQQLEDCRPPAGYNIPKEAPPPLGVPLPGGPVMSLGWSFLFTLGFPVGGAPSIVLTVFLFVAILRGCFEKKKKKKKKP

SEQ ID NO: 177297 - protein, 54 aa, Triticum aestivum
  Clone ID: PAT_TA_71715.pep
KVGEGVVAQCISGFPAMDIPPPRGPLWILGEVFMGPPPPVFDYGKLGVGFPKAA

SEQ ID NO: 177298 - protein, 100 aa, Triticum aestivum
  Clone ID: PAT_TA_71716.pep
KPVAMGGIKSHGMVLGASNEDHSKVELVEPPESVAVGEKVTFAGFYGGPEASLNAKSKTWEKLSADLHSNSEIVECYKDVAFTISAGVCKVKTIANGEIR

SEQ ID NO: 177299 - protein, 144 aa, Triticum aestivum
  Clone ID: PAT_TA_71717.pep
ILLGPGSWVQAEGTCFCVVGENSHRLIQALSRRTKHSSLRGSHHSMGHIYIATSHHRCCRHLQYHAVLRMRLRRWWNKAVLQVQAHRAGLEKAVEANAGGQAGALMIQDSAEVATRTRQLTTKLVHIGSVLSVMWSSGRTEPGL

SEQ ID NO: 177300 - protein, 117 aa, Triticum aestivum
  Clone ID: PAT_TA_71718.pep
LGHPKETLSCILVGYKIRTNMYYKYLGKSFDFFVHILSEMPNSRLLQTRGTDWFIDGRTFNLRRCSGSKQGELETQQLMEKSGHFAFTLPQFFQKSIEFVKKRNMILRRLPKLFFSG

SEQ ID NO: 177301 - protein, 82 aa, Triticum aestivum
  Clone ID: PAT_TA_71719.pep
VGQMFLLLQGVYLCKTCSEFSKHWSSLESGMVHRNGQRNIENYCLLEFRACSICKHETYSPYIDEAKMLIMMFSSVLGGLML

SEQ ID NO: 177302 - protein, 49 aa, Triticum aestivum
  Clone ID: PAT_TA_71720.pep
SFRHFQDLTSAKYVPRINLLPFNHVSTAKNSCCENDKSSSSFIFKFLQQ

SEQ ID NO: 177303 - protein, 105 aa, Triticum aestivum
  Clone ID: PAT_TA_71721.pep
EGKKFPSHKTRFSKIPGPGKKKNLPKKKPPLTGQGSPNFLFPQRENHKGVKKRETLPPKNPGPFLNPPPFALPRGFFAAWAPLNSGSPFPPFYLFPPLNPQGSTL

SEQ ID NO: 177304 - protein, 126 aa, Triticum aestivum
  Clone ID: PAT_TA_71722.pep
SVQIIHGSWPGRSAGKVFCHGVAFPLEEFVLLAFPDGDNPPMDQDGNIRLSRRVVSVDVNQNFQVSVQAYSACGSLKVPIAIGDAVFESKKDSGVTEKECDIGASCRVKIKVAWSLLIWSKRLLQG

SEQ ID NO: 177305 - protein, 108 aa, Triticum aestivum
  Clone ID: PAT_TA_71723.pep
VDINKFMCTGVCPPNCPCDQPQNWRSQTISLAALEEVEIEGSEGTGGEIAFLKLLFRSAPLMKTMTMTLHPENLPTSRGCKKTYRILRENPSVKCRVYCSGGEEVLYP

SEQ ID NO: 177306 - protein, 86 aa, Triticum aestivum
  Clone ID: PAT_TA_71724.pep
HIGIDMYRIVFPCHSSEESEVFKSLLVMLQACGGDADGRREVRGLDGVVAADGFLRPLVVRHEHDIDRGLLELRVRAPDVTASQLK

SEQ ID NO: 177307 - protein, 58 aa, Triticum aestivum
  Clone ID: PAT_TA_71725.pep
HPEHVIFCLLIYLFNNAILPYCCLHSPFWFSVGWIIQISKRTSTQVGLPFICVCTCQL

SEQ ID NO: 177308 - protein, 46 aa, Triticum aestivum
  Clone ID: PAT_TA_71726.pep
GGAHTSIKTKQGLNFQHFSQQFHNLHIRLTFKGLYYTQTLENIGGL

SEQ ID NO: 177309 - protein, 77 aa, Triticum aestivum
  Clone ID: PAT_TA_71727.pep
WPPEGHTLLWLAQTGSIDDFYMVSSCAASHLLVCLAKKCICWVPLGVLNKNWRSSLLFKVGLISTRENPYMEGNYCR

SEQ ID NO: 177310 - protein, 95 aa, Triticum aestivum
  Clone ID: PAT_TA_71728.pep
LFGHGAAAAGVHGRGHGGRGGAAPVRGPAVRQHAGQARRRPAPPEPDGGGDLDGAPAAQARRQGRVRLARALPEPHARRRRRPCGVPLPGVPARR

SEQ ID NO: 177311 - protein, 60 aa, Triticum aestivum
  Clone ID: PAT_TA_71729.pep
LVVHHQKSQAQPLRGNAIMARHIMNYFCNFPFVPSMYSAMYYPLTNENRVTVGIFPIAFA

SEQ ID NO: 177312 - protein, 66 aa, Triticum aestivum
  Clone ID: PAT_TA_71730.pep
PCGGVLIYQRFAAKKKVAVFAGSPRSVFHCFEAESVQTPPLVKKGKLANLLAWRAKEDSLKKGAVL

SEQ ID NO: 177313 - protein, 109 aa, Triticum aestivum
  Clone ID: PAT_TA_71731.pep
KKKLKKNPFKTRGGKQQNLFLLTFKEKGPRGPPPGKKLLKKPFWGGAKFSLVNFSPPRMGLGKRIYFGRRGGFVLFLKILNPLNKRNFPQTGGFLFFPQTKGVSGPKAP

SEQ ID NO: 177314 - protein, 105 aa, Triticum aestivum
  Clone ID: PAT_TA_71732.pep
QHPASTEKSSHSQHPQTNIQHCSSKLAKSRHAKIQLEPKVYSSSLKYYPNRKRFIRRDYSHSKVKTQSMELQLSSELSTFKFHRILIIDQSIRTMSSEKMSGVMQ

SEQ ID NO: 177315 - protein, 219 aa, Triticum aestivum
  Clone ID: PAT_TA_71733.pep
YKRKDELHFLPDVAEYFLSRAIEVSSNEYEPSEKDVIFAEGVTQGNGLSFIEFTLDDRSPMSEPYIDNPEAHSQPLTKFQLIRVSAKGMNDGCKWVEMFEDVRMVIFCVALSDYDLVGTPVNGNLQNKMMQSKELFEATIRQPCFCDTPFVLVLNKYDLFEEKISRAPLTACEWFGDFSPVRTQSNNQTLAQQAYYYVAMKFKEAYNDHTGRKLFVWQA

SEQ ID NO: 177316 - protein, 57 aa, Triticum aestivum
  Clone ID: PAT_TA_71734.pep
GFLQILCIQLLTDLMQFHDNQMQKFPTKRFNQSASFFHSCLSLIPAIDQRNTFFQDI

SEQ ID NO: 177317 - protein, 56 aa, Triticum aestivum
  Clone ID: PAT_TA_71735.pep
KKSLDIPSHFFFVTRLSISHSFSSSMSECKEQLKKPGITSEYVTTSSIAKASLAQE

SEQ ID NO: 177318 - protein, 137 aa, Triticum aestivum
  Clone ID: PAT_TA_71736.pep
AKKTTLFPKKTKKNPKWKIFSSQKRAPGKRNQKKGAKDRAGRALKRGKLFKGGGGPKDLKKTLKKNGPPPVETGWGDSKKKGNWALQPWETNLGPKKIHWGVWGKKDPPGDPRPKFGPKKTFVLFFRVTKGSIQIPG

SEQ ID NO: 177319 - protein, 119 aa, Triticum aestivum
  unsure (1)..(119): unsure at all Xaa locations
  Clone ID: PAT_TA_71737.pep
FLLTLHPGPPPPPAYTGFQKAIFRPPPPFPKGKTRGGEPFXPPYFFPGLKPPFRGPLPPPGAKXGKPRPRFWPPEKPPRGFXCFKPLPTPIGPRGDPLPPPPNFPPVLPFLGEQPPELF

SEQ ID NO: 177320 - protein, 55 aa, Triticum aestivum
  Clone ID: PAT_TA_71738.pep
QIYGGFISRICFFNCSLGWVFIHVKKKFGVGWYHEFCKKAILGYFLQKNGVFCLT

SEQ ID NO: 177321 - protein, 107 aa, Triticum aestivum
  Clone ID: PAT_TA_71739.pep
KGHIIFPLPGLNSNKTSNNIPPIFPHFLGVWKPAAPAGKGNLTFCNTHLQQRAQFTVPHPKQAHNKKKKLMFLKPLDSKFFQKLANCFKLAAELILKITWGSPCRRG

SEQ ID NO: 177322 - protein, 82 aa, Triticum aestivum
  Clone ID: PAT_TA_71740.pep
VINPLGYYFITAKKLLIGQVISIYLFRSWIKMEKGQEDRISILLCCTRFIAFSFFEPFYLDVIVSGKRRTPEGNVTNWCQQT

SEQ ID NO: 177323 - protein, 65 aa, Triticum aestivum
  Clone ID: PAT_TA_71741.pep
FYALYCKQTMSTAMCGLDNPRTARRYTQQMWALISPARKYGHRIPLQPIATIPNPYIPIFFHVCT

SEQ ID NO: 177324 - protein, 51 aa, Triticum aestivum
  Clone ID: PAT_TA_71742.pep
CMLELGARVRDVTLSQRRLLSVRCGSSRLPSVFFCSCRLRDQFGQAPPIDE

SEQ ID NO: 177325 - protein, 99 aa, Triticum aestivum
  Clone ID: PAT_TA_71743.pep
SIPLDFTCPGSQKKTSSQVLDRDSYYSTYHTTPERRKFTKEEYEAFTKEETRKGMQQLLSSPDFNRWALANADRISVTPAGSGRSSSRSQERHRFFGLF

SEQ ID NO: 177326 - protein, 77 aa, Triticum aestivum
  Clone ID: PAT_TA_71744.pep
GQKQFSAARQPGCPTNFPPPIPWVPKPLGPCPSLPPGGQPIKNLPQKKGRRLYQNPIGSNLKPPLALLGRHPPKRAL

SEQ ID NO: 177327 - protein, 64 aa, Triticum aestivum
  Clone ID: PAT_TA_71745.pep
GGGLAFRACGARLIVIGGPRTFIGGTIGVNSGVPKEHPPGGNLVAPRQSGNFGEKCPGMGCWVP

SEQ ID NO: 177328 - protein, 87 aa, Triticum aestivum
  Clone ID: PAT_TA_71746.pep
FSIDACLAFFLKVTDPVVDPKTQDVDGVTLRCLPFSRYFESAVMFVDAIPFCCVQLLVVFEGVLMQRREARIPVPEKGISSRAADAD

SEQ ID NO: 177329 - protein, 148 aa, Triticum aestivum
  Clone ID: PAT_TA_71747.pep
KVKNGWSQTAKQQPPAPPGTSVNPLASSTALTTAWRSPMLAASSPIAPHGRAPGSNLMKNKAVKRDEGVTALKKEFTYDIWGDHFFGHLLGKAREVAPGKVFTAFEGSSYSFFAREPQALMMKQPFAPPDFCGRRSLPSDVASGYAIN

SEQ ID NO: 177330 - protein, 80 aa, Triticum aestivum
  Clone ID: PAT_TA_71748.pep
KIEECLFLPPFNNRGISTSHKMNMPGPPKKKLLGGGRAPIQTRHGFLVPKKSTPPTGQKTQSTYPQNEPPKKLPSPLTKK

SEQ ID NO: 177331 - protein, 187 aa, Triticum aestivum
  unsure (1)..(187): unsure at all Xaa locations
  Clone ID: PAT_TA_71749.pep
LLPGAAVADGVTPSEARLLRDEVKDMFYHAFDGYMQHAFPLDELRPLSCQGEDSLGGYALTLIDSLDTLALLGDKERFAAGVEWVGKNVRFDINKTVSVFETNIRILGGLLSAHLIASDYATGMKIESYDDQLLHLSVDXPRGIPFGSVNLLYGVDDDESKITSTAGGGTLALEFGVLSRLTNNTVF

SEQ ID NO: 177332 - protein, 92 aa, Triticum aestivum
  Clone ID: PAT_TA_71750.pep
CKKRSYIMGRREYLTRNSKNSGTFVFCLKSKKFWHLCLLFKPWGSHQIRSIRPASTRPLMDLYRRTYKSSATRSTTSSPTSSSWNAPTSLLV

SEQ ID NO: 177333 - protein, 50 aa, Triticum aestivum
  Clone ID: PAT_TA_71751.pep
HPSDPYKRMCTMQHALVHSKWILNYIAFNCDMHNFSMLRFLFACAENSTF

SEQ ID NO: 177334 - protein, 67 aa, Triticum aestivum
  Clone ID: PAT_TA_71752.pep
CCPLVFKIVVGPTLGGFFVNSSIFLGMCFQLLLVVAEVWAFHLSGKFIYWSSKNCRRDYKDGMLIFF

SEQ ID NO: 177335 - protein, 94 aa, Triticum aestivum
  Clone ID: PAT_TA_71753.pep
IKRSIIFRSDSNGEDLEGYAGAGLYDSVPMDVEDEVVLDYTTDPLITDSGFRSSILSSIARAGHAIEELYGSPQDVEGVVKDGKIYVVQTRPQM

SEQ ID NO: 177336 - protein, 89 aa, Triticum aestivum
  Clone ID: PAT_TA_71754.pep
FWAFFFFFFFFFGTKELHQIAPPKTKNFPRFPHTKRNQPYLPYQTPKENCSPIKQLRDNLAYLKPNPLPLEAIIPISSPPPNYFPNLIP

SEQ ID NO: 177337 - protein, 74 aa, Triticum aestivum
  Clone ID: PAT_TA_71755.pep
DLLPSSRHQDVASVFKCMDPISIDVPTSSARQNSPHPLLLTSVHLKLTKYHLGFLPEPSKQMSYHVPAHLSSLT

SEQ ID NO: 177338 - protein, 147 aa, Triticum aestivum
  Clone ID: PAT_TA_71756.pep
PQTMAGSTREIITVRRTQKLTRAAHAVTQIGWACPAILLLLALAPALRCPSPAPARCWTSSPCRHRLLRCCYLPRIRTRSIAGPRHVLRRTPGTARRRSPARALSRRRTPAPEPGARKRPAASELAPEAGERTWATAPDSEPASELG

SEQ ID NO: 177339 - protein, 76 aa, Triticum aestivum
  Clone ID: PAT_TA_71757.pep
GNWVLFITWRKHGLERLWMRVELCGAKKFFKFGHLGRYEILKKSPGGNFGGLVHNKEANLIIQDQNPLFAMLSSSF

SEQ ID NO: 177340 - protein, 196 aa, Triticum aestivum
  Clone ID: PAT_TA_71758.pep
DNGLGIINAFVKCLKDDDKSNGYIKRRIIIPPQDLTSDGVLESIAKVVADQGIRRDERIRPGKPKQIEQIFVSSPTIHQQEWFVYFVDVRMKDQISVVHCSLSKHANVMENNAAVMENNAKIFADQLGKAFVQQGCISPFSEIAKIRVSFTSVSAKLRYSGLASMLVLERYSGSQHATDEIFFSNSIKSQKFPIFF

SEQ ID NO: 177341 - protein, 103 aa, Triticum aestivum
  Clone ID: PAT_TA_71759.pep
FYPRPRLTTAVLYYTDDEAPSGTNSRTLFSSLRDDNDVAGPTHTCRAYQTNMAQKGILLASISGDARGGDGHRRTDGRRKVGRIRAWCGRGTPGCGRPSPRRR

SEQ ID NO: 177342 - protein, 87 aa, Triticum aestivum
  Clone ID: PAT_TA_71760.pep
NIKTFLKNGHPNPFFGYPFTTRGWSNHPCLFHSFPGKILKRSSFPISLQYGCHVGGSNVKFPHPGYFWWRGSMSRPLTFTTDSTGPL

SEQ ID NO: 177343 - protein, 111 aa, Triticum aestivum
  Clone ID: PAT_TA_71761.pep
GKKGGVDGLIPDFPGAAPKYKLNLCRNMGDKTPYYMLPPQPGGLVGVIQDKTALPPPMAPKPVFTVSHVGDPPLPPVSNPPVPGPSPAPVEVSVLIPIPAAGVVLCAFLFI

SEQ ID NO: 177344 - protein, 69 aa, Triticum aestivum
  Clone ID: PAT_TA_71762.pep
EESKLYIFIELVTQGFFSSLYQKYKLGDLQVFGYTRQIFNGLVYLHERNVVHRYNGAFLMIYFENNQRL

SEQ ID NO: 177345 - protein, 103 aa, Triticum aestivum
  Clone ID: PAT_TA_71763.pep
REKNPPAFFPITLFFHLKTPLFVLKPLQRGGCFKIHFKNKGGKNNSYPTPPPKFFPKITGHLLPQNPTWGPPCSRAPFFFHDPPSLGPPPLWPVRGVFPWNLF

SEQ ID NO: 177346 - protein, 110 aa, Triticum aestivum
  Clone ID: PAT_TA_71764.pep
KPATSSIPLEYLKFLNNRKTIFRKKFLSSYYLLGPRPPQKNKKTKNFLTPPPFKGPPLILELCTLNSHLIPPPPKREGPRKAPTKSLNQKKGMDQAFLGGNPEAIMTLNS

SEQ ID NO: 177347 - protein, 60 aa, Triticum aestivum
  Clone ID: PAT_TA_71765.pep
VKIQVSIGGLGPPPAPTQVRGGWAPKGPCHWLNRSGQNSRAGPLKGPFPTGGGGNPLQTI

SEQ ID NO: 177348 - protein, 82 aa, Triticum aestivum
  Clone ID: PAT_TA_71766.pep
GFFPWGLGAVNLKVPLPPRKKFQIPWWPWPCNAGWSGAVGCKNKTVEGGGFFSRLVGGVDPTGHRGSGVPGEQVRFLFGLGG

SEQ ID NO: 177349 - protein, 56 aa, Triticum aestivum
  Clone ID: PAT_TA_71767.pep
YEWGPMSFFAKQAGGKGSDGPQRGLDIMPPKVHQRVPLYFGSVEEVEKVEKFLFSE

SEQ ID NO: 177350 - protein, 62 aa, Triticum aestivum
  Clone ID: PAT_TA_71768.pep
GPALDAAADDTAGAIQSMARSIMSACAMALGLLSPPRLDEQSRVNAGGQPAPSPPATRTRNH

SEQ ID NO: 177351 - protein, 163 aa, Triticum aestivum
  unsure (1)..(163): unsure at all Xaa locations
  Clone ID: PAT_TA_71769.pep
MPKKSFRVELTLARPSGYQSFKKYSYSRQTHPHQPKSRQKNSPSSTADALLLLPPLPMLCFSLSADALLLLHRHCSALAPPSLPRPRLDLLMQILRMKVLFFFLLLLAAGHRCAAVASSEDAAYMHLLAAATGADGTLGWKAGTDPCDGGWAXVRCELGRVTG

SEQ ID NO: 177352 - protein, 74 aa, Triticum aestivum
  unsure (1)..(74): unsure at all Xaa locations
  Clone ID: PAT_TA_71770.pep
SVTIFIFLEKYLHEKLDLNTEYFLLKRIVCLRKLCTYCKYGLCSSSRTTRLTLNACAAFYFIQXCSPPPPPKSI

SEQ ID NO: 177353 - protein, 82 aa, Triticum aestivum
  Clone ID: PAT_TA_71771.pep
NKNPALKKVNGTKFGETGEKKKNYFILSLKSGFHEKVPTTQLPSSSPTGTTGGLNGKKFILDSKTVPRDKQGLNPLRSGLHH

SEQ ID NO: 177354 - protein, 107 aa, Triticum aestivum
  Clone ID: PAT_TA_71772.pep
SNLDDKNIIQRVALKDQGQRFLIRFYLVNQNTLMKDNNPQTAKKTIHEFNQRYLNHTHNGNDVTCDSVLNLIHHQSARHHINFPTKDMNQGAKTSSSKPETKNSQNE

SEQ ID NO: 177355 - protein, 95 aa, Triticum aestivum
  Clone ID: PAT_TA_71773.pep
LIPITIFGLKTHLTSTHQLNFPDVRNHPKHHSRKTLRWRGHNLAWDHNLYRALTKRCFLSASAAYTHGPDPMTGIIPRTGKPSSRPSVWCVRKRG

SEQ ID NO: 177356 - protein, 71 aa, Triticum aestivum
  Clone ID: PAT_TA_71774.pep
KKKKKKPGPPKNGGAPQTNPKPGPPPTPPSTGKKTGPPPRGKPPGFPPTKKKKRAGGILKQGPRLNQFFPF

SEQ ID NO: 177357 - protein, 39 aa, Triticum aestivum
  Clone ID: PAT_TA_71775.pep
DFDRFIQNSDKVGVKATSFIRLLTQQRLPISPHLLPFYQ

SEQ ID NO: 177358 - protein, 86 aa, Triticum aestivum
  Clone ID: PAT_TA_71776.pep
CTIRAMQICTNLESPTINQKRFILLLWLIHQAFSSFLHASTNKRIRSKRASTQQHLTSSVSGPPCLFSFLNGGALNSQWHLACSTV

SEQ ID NO: 177359 - protein, 96 aa, Triticum aestivum
  Clone ID: PAT_TA_71777.pep
PCIFWSLAPKKSLINSATLPMLFHHSTDGVQQVSIYFILIFVCLCLCQICSLFCEILWVIVDFIGDFIRPTYSMASNCKSAHTLRDAISNSVSSLL

SEQ ID NO: 177360 - protein, 92 aa, Triticum aestivum
  Clone ID: PAT_TA_71778.pep
TTYRTNQYDMPFGFFVGVYNHFQSIIFGGVLLRDETTKTFEWVFKEFVSLMGGKAPRTILTDQARAMEKAISSQWPDTTHRWCKWHVLQKAR

SEQ ID NO: 177361 - protein, 37 aa, Triticum aestivum
  Clone ID: PAT_TA_71779.pep
YKFILFGRHIIHGGGDQRKNGSFYRAHNDKKFYRFIT

SEQ ID NO: 177362 - protein, 116 aa, Triticum aestivum
  Clone ID: PAT_TA_71780.pep
GAPPALSSPPPRKLKQRLLRVVSASRQSSRLQHLGSNLSSSRRAQAEISTRLGFIKRPEDFNDDTVLEYIQFFRALMPPANIAKLAEIAGLSSPSQLSLPDAELQAIFDELAGRAA

SEQ ID NO: 177363 - protein, 45 aa, Triticum aestivum
  Clone ID: PAT_TA_71781.pep
VKNTKSSNGHLHPSTNLKGGKKLGPSLPQFPQGHVFLIGLLNHLG

SEQ ID NO: 177364 - protein, 68 aa, Triticum aestivum
  Clone ID: PAT_TA_71782.pep
NKFANVIFVPRVGQVCLSFALNLRNSSSSMCCPSVFPFLQKYIQFCRPSISSSFCKIKVCYIIKWVGL

SEQ ID NO: 177365 - protein, 118 aa, Triticum aestivum
  Clone ID: PAT_TA_71783.pep
SHEERQIMGQRTHNQKALAEIYLLSFSDVLLTTGASTFGYMSSSLAGLRPTMLMIPEDGKVPEPPCVRAVSMEPCFHMTPDVECRGKAVNKEELSRHVKECEDVGKGIKWIKGIKLFD

SEQ ID NO: 177366 - protein, 42 aa, Triticum aestivum
  Clone ID: PAT_TA_71784.pep
HAEGFRGGFWVHYYSTGHYRMIMGYLSGSKMNGKNKSPWDVH

SEQ ID NO: 177367 - protein, 42 aa, Triticum aestivum
  Clone ID: PAT_TA_71785.pep
VYTHMHMQNRKMSFLSGGFVIQVAFQVFSYGSYEENNKLSSS

SEQ ID NO: 177368 - protein, 98 aa, Triticum aestivum
  Clone ID: PAT_TA_71786.pep
LADASKAQAPIQAHFGELDSFVGFADVTAAKSLEEKLKASGVAHEVHIYSGCSHAFMNASPEALKRRKGMGLTDENQGAIDLAWSRFSTWMGRFLGSA

SEQ ID NO: 177369 - protein, 48 aa, Triticum aestivum
  Clone ID: PAT_TA_71787.pep
LFFWGFFFFFFQPTYTVELQTSKSLKEQYKTGHGKELVIWSKYKESAI

SEQ ID NO: 177370 - protein, 99 aa, Triticum aestivum
  Clone ID: PAT_TA_71788.pep
DWRFSPWIEGEGTSTVPPKGAQRLRGIAAVMIGQAKEGLSWSHHPTKGVVTTLYVLKFKTFITPYVSKFKTVFDMEGVQYMSSKNQKNDRLFFPVERPY

SEQ ID NO: 177371 - protein, 93 aa, Triticum aestivum
  Clone ID: PAT_TA_71789.pep
TNSDRAKLTTIIHHQSVTVAMSGSGDVRESPSPCCCLVACYCLVCCITSHHETGARRSAASPWERSVTTCTRRPRSGACGRRSSRRGRGRGWR

SEQ ID NO: 177372 - protein, 196 aa, Triticum aestivum
  Clone ID: PAT_TA_71790.pep
RDLELVRPAPTPKKGKEARTAGKTSARIGAVSTPLGPTKILGKPKPVPRQGFLTMGASSAQVQRSKVRNPILLREENRNVQNVSSTLQQDDSHAPAKEEDNSEDTLSLQLELAITETILADEMKARAEAEVRATALGDELKAANLRTLEACRQKEATEKELKDTLSVLDVVESEQICLIKEVEELKKKNLEQVSLI

SEQ ID NO: 177373 - protein, 77 aa, Triticum aestivum
  Clone ID: PAT_TA_71791.pep
PDSTPTIPFYLFFYLGGNPKKVQPKILSFPSWTFLLLLTIPGIFKGPGATVLNNPEKGAYLFFLAGDPKTKLIPFLG

SEQ ID NO: 177374 - protein, 143 aa, Triticum aestivum
  Clone ID: PAT_TA_71792.pep
GVGGVYYIGQNLMDRGSEITGQLKKHAPEILGDICNEALFQMKIPFIGSKESRFELKDYWFNDPNKSLSRQEQRARRALAIQEKDRIRREEFKRAEEERKRAAAPLYEQYMARKDLNDMKVMEQLREERMRHEERMRRLSGNM

SEQ ID NO: 177375 - protein, 94 aa, Triticum aestivum
  Clone ID: PAT_TA_71793.pep
IFKGQTLKMTMNLTIDGRVTILHDQTLAWGHNLTFFPCHLPGGLPPFSQLCHLPPSFLILPFFTSLGCMSTTLGTISKRHVLNLIPTKKIYANA

SEQ ID NO: 177376 - protein, 32 aa, Triticum aestivum
  Clone ID: PAT_TA_71794.pep
KQKKVPFISDEVKIKCKGKEKFKCGSNVIWKW

SEQ ID NO: 177377 - protein, 64 aa, Triticum aestivum
  Clone ID: PAT_TA_71795.pep
LNKMGRAGWGLGQKLVFYGGTFIGFKVFVGMGVLTFKFVVGKMNCFCFRKKKIILSGFILVFWV

SEQ ID NO: 177378 - protein, 90 aa, Triticum aestivum
  Clone ID: PAT_TA_71796.pep
IAAGGGQVLEGISPDGLRENLKRNPAEVYFIYHGGPPRTPTSDFDLEVQECNKYVGSGARMIRHLQLFDAILCYDVLFLKPTGVFTKICK

SEQ ID NO: 177379 - protein, 62 aa, Triticum aestivum
  Clone ID: PAT_TA_71797.pep
NPFITATKKKLKNEQPQKINTKCKQITVYRNKTSLAKHRGDKKKWDYSKKRGIIWHFGPTKQ

SEQ ID NO: 177380 - protein, 97 aa, Triticum aestivum
  Clone ID: PAT_TA_71798.pep
AMRGIKSHAMVLAASNKDHTKVELVEPPESAAVGERVTFAGFSGEPEASFNAKSKTWEKLSADLHSNGELVACYKNVPFTTSAGVCKVKTIANGEIR

SEQ ID NO: 177381 - protein, 66 aa, Triticum aestivum
  Clone ID: PAT_TA_71799.pep
CPHPDIRNLAPLPATEKGFLQILTNRGIHSSRSRILLVSPRYNYFNIYITNKTILYEKFLFCIKQI

SEQ ID NO: 177382 - protein, 78 aa, Triticum aestivum
  Clone ID: PAT_TA_71800.pep
SLNLPANKTLIGFSKKGTYNLVSCRFFGGFGGQRAPISCKKVVNPGMNPGVPLFPLGGIMKTRDGPPPPFFVSDWFAP

SEQ ID NO: 177383 - protein, 89 aa, Triticum aestivum
  Clone ID: PAT_TA_71801.pep
GVNRAGNRVPGSPLCFIGSKQGIYQKFPSIPVPLKKGAELTIKWDLLFVTKMPPGAPQVCFLIFPDKKKTVFGPGHQVGPRFPLDVAKN

SEQ ID NO: 177384 - protein, 36 aa, Triticum aestivum
  Clone ID: PAT_TA_71802.pep
LNTRDADLQPLFTVLPPSFYLSPSVIFMLTLPMGQI

SEQ ID NO: 177385 - protein, 76 aa, Triticum aestivum
  Clone ID: PAT_TA_71803.pep
RQQGRTKVYTFLAQITPTQIGKGAWLNRKCVSRTVCTYLNYAMEKLLLRFLRYASPLAGIGSSLGLKGVRKGVLWI

SEQ ID NO: 177386 - protein, 49 aa, Triticum aestivum
  Clone ID: PAT_TA_71804.pep
CPKCTVESATSIQFTEDSCEQTIRKSMLALVSGQKTMCPASKVKAYGAS

SEQ ID NO: 177387 - protein, 88 aa, Triticum aestivum
  Clone ID: PAT_TA_71805.pep
GEPLSRALFISGFGKPQKKKGPRGAPGGFSKTGTPLRGPREFGQGKKKNFFEKKTEAPGKNPQLTGGRGFWGENLKTPPQKWTKGPKG

SEQ ID NO: 177388 - protein, 75 aa, Triticum aestivum
  Clone ID: PAT_TA_71806.pep
CMHIANPIQGVMYAHVTDTFLGRRATPTNRRRQGHQGFTEAENGAYTGTPNTRGGRSNTRELRAQPCPAPSPTRP

SEQ ID NO: 177389 - protein, 85 aa, Triticum aestivum
  Clone ID: PAT_TA_71807.pep
KAGAVFGKASFKGVHGVPDIVEGFFVPSPGTEVPFFASQVRLGKNGVEEIMGVGELSALEKEGVESLKGELLFSLEKGVKFGPER

SEQ ID NO: 177390 - protein, 87 aa, Triticum aestivum
  Clone ID: PAT_TA_71808.pep
IVFCPQGSCCLCLKWLPSFVLCWKNLPPTFSFFGVGIKAVLGEHGGFFIGSFVSGGVFLGLGLMRGPLNMMGALSLDVGFYPRTCPF

SEQ ID NO: 177391 - protein, 55 aa, Triticum aestivum
  unsure (1)..(55): unsure at all Xaa locations
  Clone ID: PAT_TA_71809.pep
PPPPPKGGPAGFKRPGRPAGWTAPPANGAPRAGGPFASANXPGPQRPAGKGEPQD

SEQ ID NO: 177392 - protein, 142 aa, Triticum aestivum
  Clone ID: PAT_TA_71810.pep
GGDTCYFFFLHLTYPLGYIGGQEKLPWLSYGPHGREGSKFLVPLHTTFNGVKKTAFPGNGEKKGKPPKSLKQNLAPSPSGGDFWSQGPKPPWGYGAGLKGGWAILGELGLGRALPPNPDYKGPHGVPRIWIFATPWHFGGGE

SEQ ID NO: 177393 - protein, 119 aa, Triticum aestivum
  Clone ID: PAT_TA_71811.pep
IIITRRANNFAHPGKETHKRTPKETFLRPQKFNLFFILSHPPRLGNPPGGGTPFFKEIHIPYPKPWPKKKLGVIKPKGQKTVKPNWKATAHGLIFWNLLNKGHLKGLMEPPWAGVTPPL

SEQ ID NO: 177394 - protein, 71 aa, Triticum aestivum
  Clone ID: PAT_TA_71812.pep
NKQQGITLYPQLIEVQCRGLGHSLSTPKSQTTVLLLLGPGLPSLKSMMIAGKSSSLMMIIRISRSCPIPPI

SEQ ID NO: 177395 - protein, 154 aa, Triticum aestivum
  Clone ID: PAT_TA_71813.pep
DARVDAVRILATVAPEMVPYLTRDGTEKRGRVKMAVEAMAAVLSAGGVSEDARKALITALVAADLGRVVATLLSAGPTGVVVLEAILTSPVPDADVKTAIADRSELFPDLVRILKEAASPAAILCMAAAVQVRGRPARASMVRAGAVPALALAV

SEQ ID NO: 177396 - protein, 40 aa, Triticum aestivum
  Clone ID: PAT_TA_71814.pep
PGSEIQNLVFGIAKHFLGFPGNTCLGFYLYGPLKVKVPFP

SEQ ID NO: 177397 - protein, 75 aa, Triticum aestivum
  Clone ID: PAT_TA_71815.pep
LSQVSFQQPQQQYPSGQGFFQPSQQNPQAQGSFQPQQLPQFEAIRNLALQTLPAMCNVYIPPYCTIAPFGIFGTN

SEQ ID NO: 177398 - protein, 79 aa, Triticum aestivum
  Clone ID: PAT_TA_71816.pep
FNKAHIDLLQQPTTEHAHFITKVKGRSPKKRTKQGTRGPPQANQFHRGRCDGKRSLPDQALGRARDYVATAQGMAHRAR

SEQ ID NO: 177399 - protein, 163 aa, Triticum aestivum
  Clone ID: PAT_TA_71817.pep
VSTPAKTQAINTDCRTAGEEEINWSDWSTWLLADEVNWPDQELRCMNRGGRRVALLLLVSAGRSTGGTTGRSRGRLEPVADDEGDAYGKDGPWVLDRSGGRRPAGADAGAAAEGWSLADGNSDGGRGRSERQVFFKLGVVSYFFSFSSGRRIAPMTNKSGQRE

SEQ ID NO: 177400 - protein, 69 aa, Triticum aestivum
  Clone ID: PAT_TA_71818.pep
WAPRFYYILTHQGFVTVDKDEPINQGLISNFMLDPVPGAIKVCAKIRPPVDILVTADPDFVGPEVRQSS

SEQ ID NO: 177401 - protein, 109 aa, Triticum aestivum
  unsure (1)..(109): unsure at all Xaa locations
  Clone ID: PAT_TA_71819.pep
PEENLVSRITVMSFREFTGDPGEVGFLEFFFRSARALETASVSMANPSFTPFSTQEAYAKVKRSSRIMASESNMVVLGSTGPAGGKMWSXERRADFSFHDPFSEVEVVG

SEQ ID NO: 177402 - protein, 87 aa, Triticum aestivum
  Clone ID: PAT_TA_71820.pep
QGVYGVGSRQINWEVVNAMAIHPGWGTLILLIRSHHVLDIYVKESWSTTMTPFVSMSVCKIVNHLLTTATMVDVFEGASMWLIGKPV

SEQ ID NO: 177403 - protein, 75 aa, Triticum aestivum
  Clone ID: PAT_TA_71821.pep
LIRKLPFQRLVRELAQHFKTDLRFQSHAVLALQEAAEAYLVGLFEDTNLCAIHAKRVAIIPKNNHLTTRIRGQRA

SEQ ID NO: 177404 - protein, 27 aa, Triticum aestivum
  Clone ID: PAT_TA_71822.pep
IEAFQEGFSSMCHGVQSMSGIWLCSLL

SEQ ID NO: 177405 - protein, 97 aa, Triticum aestivum
  Clone ID: PAT_TA_71823.pep
VLPMMNNHDFGNHYQQMMASPQSSMSSYNHHQQQQMMEMSVDQGFMVGVDPGYGSSSIVSHEDVVTWLSNNNQGNGGIATSGEILSMNMGMDGMWKY

SEQ ID NO: 177406 - protein, 61 aa, Triticum aestivum
  Clone ID: PAT_TA_71824.pep
TKIEHPKPTSFHLCLIKKTFAGANYVSRKKATQVTTNCWGVLFKQLPIFLYKTLVSYISSG

SEQ ID NO: 177407 - protein, 120 aa, Triticum aestivum
  Clone ID: PAT_TA_71825.pep
HTTHLKKENTNSSATHSPSSKEAKRTPRHMARSAESPGGFRMHLRRRRRRAPCTGSRRELPTTAQCSDKKLEHLTFLDLDELLLVLLPEGLYPRRSVGEPLATAVYRVRPRRGAPPAVRH

SEQ ID NO: 177408 - protein, 90 aa, Triticum aestivum
  Clone ID: PAT_TA_71826.pep
GNIPGKKTKAGCLAQLHKKIPAKGFSGNFPFWGEQGMGFFFFLGRKPPHHHKSLKTGVRPPKIKPHPWEKPGHGAHKNPNPKLPMGLARG

SEQ ID NO: 177409 - protein, 91 aa, Triticum aestivum
  Clone ID: PAT_TA_71827.pep
EINYDSFMYSDPMTFNPWRWLEKNMESHPHFMLFGGDSRMCPGKELGTAEIATFLHYFVTRYRWEEEGKNTILKFPRVEAPNGLHIRVQDY

SEQ ID NO: 177410 - protein, 32 aa, Triticum aestivum
  Clone ID: PAT_TA_71828.pep
YINAMSCRLICLVSWVVVIHKKSIRLVLRLDG

SEQ ID NO: 177411 - protein, 52 aa, Triticum aestivum
  Clone ID: PAT_TA_71829.pep
GINGGRPPNRAQPSPNGSHYFGPGGDSILGLPRDNSSCPGRARGGTRLFGFV

SEQ ID NO: 177412 - protein, 55 aa, Triticum aestivum
  Clone ID: PAT_TA_71830.pep
SFTHGICNIFAVFLFFESSSYLQCFVVEALLTAFAKFLVFFCFLEVQFICNVLWS

SEQ ID NO: 177413 - protein, 56 aa, Triticum aestivum
  Clone ID: PAT_TA_71831.pep
PGQLLHSNQTTNLVKTKSTNGTTTANHSHNTAPSSRESSSAPHARRLANFPSLTKG

SEQ ID NO: 177414 - protein, 85 aa, Triticum aestivum
  Clone ID: PAT_TA_71832.pep
FLPPRVLVPLVKMGPVLWTLLEKFTRDFQFFWGGNLCSFGGTWVLFHGKFCYWGSFSGVGPEAGFHGHDGGSMVVGWVLLKGLPF

SEQ ID NO: 177415 - protein, 69 aa, Triticum aestivum
  Clone ID: PAT_TA_71833.pep
NRRVRTAKYWSIKYLAAAAACSQCVTIIGWLSSVYAAPLIKKNDDVPMFKLIKRMMCFSGFAKSRSSPS

SEQ ID NO: 177416 - protein, 102 aa, Triticum aestivum
  Clone ID: PAT_TA_71834.pep
CMSEYLRIFTHIARSCDFTFLPIIIHNYKKKIVIYCHAFYIFTRSQVCVVALPSVPQLLCQRVYHRAFGAFLRQDLAIRNYGYQHSKQRASPSLCIFGHSFR

SEQ ID NO: 177417 - protein, 78 aa, Triticum aestivum
  Clone ID: PAT_TA_71835.pep
VPLLSFIEGAVPQLERLELRFSVLEGLYGLENLTELKEVHLRVHDKAGECTKSLVAEMTSAAREDDKGARIIVDQYHV

SEQ ID NO: 177418 - protein, 75 aa, Triticum aestivum
  Clone ID: PAT_TA_71836.pep
AGHEPQTNRGNHFHPGFFLWTGETHKKGGFYMYKKPPPHPTFVTKKTGHAMDLQSTCSRSEKLTNSKMFTPSSKN

SEQ ID NO: 177419 - protein, 81 aa, Triticum aestivum
  Clone ID: PAT_TA_71837.pep
KNQKILSSFVGYKRKKKSLLTDSGQHTTNTKLHRLVNSTDLKLRVAPKGTKTVPLYPQESTKRQGPKLPKCEGPKTKPMSP

SEQ ID NO: 177420 - protein, 35 aa, Triticum aestivum
  Clone ID: PAT_TA_71838.pep
SGGFLNTMILTPLPGIKRSEVPGLKRHNDNPTYNG

SEQ ID NO: 177421 - protein, 39 aa, Triticum aestivum
  Clone ID: PAT_TA_71839.pep
AFQKRGFEYLSGGYKILAGIRPFRNRVLVCGNHSDVLIF

SEQ ID NO: 177422 - protein, 82 aa, Triticum aestivum
  Clone ID: PAT_TA_71840.pep
FALVERLNGDNWIPVYDDDDWSLRFKWSRPSKLSPESFATLEWTIPEDAVPGVYRLRHFGASKPLIGSIEHFTGTSRAFAVR

SEQ ID NO: 177423 - protein, 63 aa, Triticum aestivum
  Clone ID: PAT_TA_71841.pep
FKIWALESKHFVQALNPKVQVSKNQIFFCPSFIWRADGTPLYPGYPGGPLRVFKIQPGFPGKG

SEQ ID NO: 177424 - protein, 141 aa, Triticum aestivum
  unsure (1)..(141): unsure at all Xaa locations
  Clone ID: PAT_TA_71842.pep
PTRPAERSAAGHQTLLRPRMRPPEPSSASPMRRRRRRRAPTQPPCGPSATGPSPXPAGQPAQGAAPHEGRPRPPRRGVAAPPPXTRPPATTAPTRRSSPSASAGSGSTNPPTQSPTPSGCPPPTPTSSGPSCATSSRRPIS

SEQ ID NO: 177425 - protein, 87 aa, Triticum aestivum
  Clone ID: PAT_TA_71843.pep
MAVLSHHEDGAVVAQTLLLLLTVSPSLLGAVVPALAADPPFSCGPSSTAATQGYAFCDATLPVAQRAADLVARLTPAEKVAQLGDEA

SEQ ID NO: 177426 - protein, 59 aa, Triticum aestivum
  Clone ID: PAT_TA_71844.pep
RKASIYSSSKVRVSMLILWNKGSLNCCDMLGCKVSISVKLIFSFDYNIVHTTICCFLTH

SEQ ID NO: 177427 - protein, 57 aa, Triticum aestivum
  Clone ID: PAT_TA_71845.pep
LLITYNIMLFSCLDTYVQLTVVNYFHSVNFLLRFSYFNMLYKHTVNIYPYIEIGYCF

SEQ ID NO: 177428 - protein, 123 aa, Triticum aestivum
  Clone ID: PAT_TA_71846.pep
MTVIAALFVLSCLLKTTTSPATSAYSGAWMPASSVLYELRHLGVRALIRYDAEATGRASADFGNVSDAQPPPAAVLYPSCPEDIASLLRASCTHTSPFPVSARGCGHSTRGQASAPRGVVVDM

SEQ ID NO: 177429 - protein, 117 aa, Triticum aestivum
  Clone ID: PAT_TA_71847.pep
MPTQQLTTFQLLPPAHAHGDRRQYQYQHHHQDQQQQLACGGGGGGLWDPASVLDRRASPAAHPTLSSPSPLPAGVAALAKNVSAAPPAQAWPPPPGPGANDDDANDDWVHHLPPLDM

SEQ ID NO: 177430 - protein, 49 aa, Triticum aestivum
  Clone ID: PAT_TA_71848.pep
TLIYRRLRISFCSSCYWLVAFSSNLDNYVHNILYDFGARNVGDSVVGGS

SEQ ID NO: 177431 - protein, 125 aa, Triticum aestivum
  Clone ID: PAT_TA_71849.pep
APPAPPAPAAPPRRGCRRRCRGSPWASSCRSSPGRPPASTARRSSCPWRLATADLGADGRRRELDSAAAAAAEKKKREIEGEIPARFVRSAAAWEGAGWEGVRAGAGSPRTPAGRQAGWLDALHF

SEQ ID NO: 177432 - protein, 194 aa, Triticum aestivum
  Clone ID: PAT_TA_71850.pep
MEVETEKEKETEEEKDKDKEKDEEKEKEVTYENEKEKEMQIESEKVKNTKLVRVDYILEKAETGVHFVNNVLHSNSQIRRAHCWFPCIDSATQRCPFDLEFTVSTDLVAVSNGDLLYQVLSKEDPPRKTYVYKLSTPVSAQWISLVVGPFEVLPDKNGISVSHMCLSPTLSKLDNTVSFFHDAYSCYEDYLAAS

SEQ ID NO: 177433 - protein, 139 aa, Triticum aestivum
  Clone ID: PAT_TA_71851.pep
MCGIFAYLNYNVSRERRYVLEVLLNGLRRLEYRGYDSSGIAVDADLPAPLPSGSAPAPYAGAPPLVYRQEGKIENLVRSVYAEVDEKDVNLDAAFNVHAGIAHTRWATHGVPAPRNSHPQSSGAGDEFLVVHNGIITNY

SEQ ID NO: 177434 - protein, 104 aa, Triticum aestivum
  Clone ID: PAT_TA_71852.pep
HFLLGLIKFKKRSSMICITSFVMEGMDGYLPNIIQDDYHASSDACSLPACMYTWDKVSFYLTKVSQSALFVIQLQRTRRLGETACPPSAGHASPQTRASPPDRW

SEQ ID NO: 177435 - protein, 38 aa, Triticum aestivum
  Clone ID: PAT_TA_71853.pep
LHTYHGGKLSKKEALAPRRKCNTSDQVVLVVTSWGRRS

SEQ ID NO: 177436 - protein, 62 aa, Triticum aestivum
  Clone ID: PAT_TA_71854.pep
FSTRPPTRPVTWRQSIHLTRRIQSRAQRREERERGRAAVIRPQPRVLLRARPGRHVLPLVHS

SEQ ID NO: 177437 - protein, 41 aa, Triticum aestivum
  Clone ID: PAT_TA_71855.pep
SNVNGLISRTTDLCPNWVNDSGLSTNDVDEVLFVGGMTRVP

SEQ ID NO: 177438 - protein, 66 aa, Triticum aestivum
  Clone ID: PAT_TA_71856.pep
CLREKLPNRQTYGMSASIPKVQVLCTHINQMLGTTKKGSGATATVRNCTGKNLNILELQVSNSTAM

SEQ ID NO: 177439 - protein, 89 aa, Triticum aestivum
  Clone ID: PAT_TA_71857.pep
TRPGSNVLEWDKPSTRFAPLLLCSSSPLTGAACAPTKKSPSKTPKPNPWRPSLPPAPSPYSGAAAPSIGTGGEPGRPMRPGRFPGATRA

SEQ ID NO: 177440 - protein, 253 aa, Triticum aestivum
  Clone ID: PAT_TA_71858.pep
PRVRPRVRLQLREDAKRGMHVENLTEHEVSNAREALQQLIEGAANRKVASTNMNRASSRSHSVFTCLIESKWESQGIKHHRFSHLNLVDLAGSERQKSSGAEGERLKEASNINKSLSTLGHVITSLIAVSNKKSQHVPYRDSKLTFLLQDSLGGNSKTTIIANISPSSCCAAETLSTLKFAQRAKHIRNNAIINEDASGDVLSMRLEIQHLKKELSRLQGQSGFTNNGFVCESPSAFKWDQANGTFSPLMFDK

SEQ ID NO: 177441 - protein, 202 aa, Triticum aestivum
  Clone ID: PAT_TA_71859.pep
TRPLDPFNRQWRGPLQWRDCLVAGDSLCASPACISCCEDHATLATASRRSSSYDLGLLGRLHSVEMWPYRPHRMQSGGNSQSSLLFPSRKHLKQRPNKSAGISLLSGDAAGERDLDPPAAVIFWKAFLLRHRALREGPSLRHGTADPAAGPGLAPAGAPPAPFEPPSYPDEPDSPSPETIRWGLEDTDAGLAGPEAMPNASG

SEQ ID NO: 177442 - protein, 150 aa, Triticum aestivum
  unsure (1)..(150): unsure at all Xaa locations
  Clone ID: PAT_TA_71860.pep
PRVRETTQQHPAPARRRLTLADEEWHPLPLSLAELSLPLTLPTGQTFLWRRTSLSPLRFTAAVGPHLVSLSHLPDDDRLAFLLHNDDPASSPSSSVAAAXAALCDYLNAAVPLADLWVQFTAADARLAEVAARLGGGGARLLKHDPVECL

SEQ ID NO: 177443 - protein, 85 aa, Triticum aestivum
  Clone ID: PAT_TA_71861.pep
PRVRPRVRPEEDEEIVSQVVAGKIPSYVLETKLGDCRRAAGIRRESLRRITGREINGLPLDGFDYASILGQCCEMPVGYVQLPVG

SEQ ID NO: 177444 - protein, 244 aa, Triticum aestivum
  Clone ID: PAT_TA_71862.pep
TRPPVAPMQFRQAELRVITSVESQLGEPLREDGPVLGVDFDPLPPGAFGAPIVPEQQKQPVRSYDAKIFSRHDPNLLKVSSFLPSMEHPFVPNSFAGKRKSMVGNPPPQVHPHGGSRAVHEYQFLPEQPSDTYERASRSHYYDTPVEASNSRIPSVTPGPHLLHVSEEMAPGYAFEGQGLLPQPGRPQVFPAVSTDYEMNQSNSNINSVPVDGQFGSSHVAGFEDPLISSETRAYHDEDASRVD

SEQ ID NO: 177445 - protein, 118 aa, Triticum aestivum
  unsure (1)..(118): unsure at all Xaa locations
  Clone ID: PAT_TA_71863.pep
GGKWTETVGLGTGSPALVVXAFVPFRVEGDFGFGPPRLVMPWVRPGRLGSAAMTVIRSPAGDGSWLVTARMWPRLADAVDADPEAVFKPATAERLGFATRRRGELRATGTAQHAVSRM

SEQ ID NO: 177446 - protein, 81 aa, Triticum aestivum
  Clone ID: PAT_TA_71864.pep
MRALTAATISYPIRALLLHHPYFRSTLRLPLTMNPSSSSGYRSNAAAFASTHQLRGGRGGGRRPGGRGDGGGDGGNRIDAL

SEQ ID NO: 177447 - protein, 130 aa, Triticum aestivum
  unsure (1)..(130): unsure at all Xaa locations
  Clone ID: PAT_TA_71865.pep
RPQLLRSPNTTVHAIMTNSGRNEIIPTEAPYXNHQLTHAXTIMLALLTFCRMMVKRVEKQSGRVYDDWDILPAKKKRDPNAKKPEDWEDDEFLHDPEDKKPEGYDDIPKEITEPDATKPEDWDDEEYGEW

SEQ ID NO: 177448 - protein, 144 aa, Triticum aestivum
  Clone ID: PAT_TA_71866.pep
MSDVTAVMALEMEEPKLVLPPGFRFHPTDEEVVTHYLTRKVLRESFSCQVIADVDLNKTEPWDLPGKAKMGEKEWFFFVHKGRKYPTGTRTNRATEKGYWKATGKDKEIFRGKGRDAVLVGMKKTLVFYTGRAPSGGKTPWVMH

SEQ ID NO: 177449 - protein, 128 aa, Triticum aestivum
  Clone ID: PAT_TA_71867.pep
MQGVIPMWKEVEYFKEYQRRLAKHAGRARARHIVANAVYVVSVGTNDFLENYYLLVTGRFFEFTVAEYQDFLVARAAEFLTAIYRLGARRVTFAGLSAIGCVPLERTLNLLGGGACNEEYNQVARDYN

SEQ ID NO: 177450 - protein, 174 aa, Triticum aestivum
  Clone ID: PAT_TA_71868.pep
HASVCLAQSGTLAPPPHKPERVDQWRRQPRAHRAARTHRRSFSWTLRACNSCWMQLTGKPEAENSSSCRCECPALIRLLRASDNNWYITEHRESHNHSMSLTMGQKVHWPSHKHIDVYIKDLIRQLRENNVNLGKVYSIIGSFFGSVEKVPFTKRTLRNICGKISREQADDDVW

SEQ ID NO: 177451 - protein, 151 aa, Triticum aestivum
  Clone ID: PAT_TA_71869.pep
MWAYCGKYNDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVPQDRR

SEQ ID NO: 177452 - protein, 136 aa, Triticum aestivum
  Clone ID: PAT_TA_71870.pep
THPSAHASGKWGNLDLLEASATLTLAELWLALGSNHAKRALSLVYQSLPMILGHGGLELRARSQIVLAKCHLTDPEFSVSEDPCAVLDPLNQAAEDLQVLEYHEMAAEAYYLKAMTYNHLGKEYEREEAAVCFKEH

SEQ ID NO: 177453 - protein, 129 aa, Triticum aestivum
  Clone ID: PAT_TA_71871.pep
MDLVNVVGMSRGMEVIWDPCDFSVLRCTATIGDYKRVKQILDNLLSNAIKFTHEGHVMLRAWANRPIMRRSVISTPTRFAPRLRPGGVFRWLLGRRENCNEHNGCMFLQNDPNSVEFYFEVVDTGVGIP

SEQ ID NO: 177454 - protein, 219 aa, Triticum aestivum
  Clone ID: PAT_TA_71872.pep
MAPPPTEEQLLRGSEETEVLRLSVDGGGHPSVCTDQPSAIGGPAAQTTEEPRDDQALVSTESDQFSLRAPELVSTQVDSDDQRDAQVMEEDSDDKEGSDDEEDTDEYDAQMVDENSDEEEAGDEYYAQVIDKDSETNCPGKNYSKEEADEVVSRWLHSFNKAYHDCLNLRLEILARGDKNARLPSFPLKVLPVVTSLCIESNICYHREYITHDTSTTAS

SEQ ID NO: 177455 - protein, 217 aa, Triticum aestivum
  Clone ID: PAT_TA_71873.pep
HASGGMEHYKDKLIDLITNDREAPLLAITGMAGVGKSTLLKTLCESVPLYDFFEELIYVRAGIKPTVHELQQYVGTYLGIHLPDDHKSRRSAIFTQLADKSFLLILDDVWESINFEEVGIPVPLGELMVQPEYGITRTALRKVVFAARDESACKTWRGHSAYVTRMECLNEQDAFELFAHHAGNTITKDQRILQLAHEIAEECSGLPIALCKIGEAM

SEQ ID NO: 177456 - protein, 177 aa, Triticum aestivum
  Clone ID: PAT_TA_71874.pep
MDHPPPQPQPAAGASSYASPNPPSYTQPQSYPSSYTKFNSALNAGLLNPMSPPPLPIDKTRSSPTLFDMMANEQDYQPRSAAAAAHSAPPHPHPHHPLAPARSMDRQALLQDRVAELIGSCSPGNQFNDADSSDVRLTLSSKDGLSLTLCVHRHILVAHSRFFAAKLSDRWSKQQAH

SEQ ID NO: 177457 - protein, 234 aa, Triticum aestivum
  Clone ID: PAT_TA_71875.pep
QVLNISSNLFTGAFPSTWQVMNNLVVLNASNNSFSGQIPSHFCSSSSLLAVVELCYNQFTGSIPPGLGNCSMLRVLKAGHNNLRGALPNELFDASLLEYLSLPDNHLDGKLDGAQIIKLRNLANLNLGGNNFSGKIPNSIGQLKKLEELHLDHNKMSGELPSALSNCTNLVTVDLKSNQFNGELTKVNFSSLLSLRNLDLLYNNFTGTIPESIYSCSKLAALRIYGNNVPDAWV

SEQ ID NO: 177458 - protein, 90 aa, Triticum aestivum
  Clone ID: PAT_TA_71876.pep
PRVRYNRASGWTDRERVDFSSGLTVYNSTAHLIHNSSLAQDDQKVTRLSPPMRKALRDHKSEKQNYMKNDSGIDACQPEYNVHQVKHLQQ

SEQ ID NO: 177459 - protein, 177 aa, Triticum aestivum
  Clone ID: PAT_TA_71877.pep
RILVYMILSSFLQQQDKIILQLKAQDFYRNIFRNTTPTMKTYVDDIHSSFLKNMTTSSSQNVQIKPALSENTFKVPTSKELLAIQSPRIFPMLDVPTIIDEDKQVNIHDILDSLVNDFPQSVNITSTNLTLSFCGGNLPSFEQLACSELFVKRSIPKVTPTIDASALLHQFFSETKS

SEQ ID NO: 177460 - protein, 55 aa, Triticum aestivum
  unsure (1)..(55): unsure at all Xaa locations
  Clone ID: PAT_TA_71878.pep
VYPPVIMFYAKNKVYTFXVKLSPFWKIQRDYTFCSLTLGKFWKVVRISISGWISI

SEQ ID NO: 177461 - protein, 33 aa, Triticum aestivum
  Clone ID: PAT_TA_71879.pep
NNVLFPYISYEDYESLQLSFTTTSRTNSSPDAW

SEQ ID NO: 177462 - protein, 99 aa, Triticum aestivum
  Clone ID: PAT_TA_71880.pep
MFALSSIKGVGRRFSNIFCKKADIDMNKRAGELSAEEMDRLMAVVHNPRQFKVPDWFLNIKKDYKDGRFSQVVSNAVDMKLRDDLERLKNIRNHRGLRH

SEQ ID NO: 177463 - protein, 76 aa, Triticum aestivum
  Clone ID: PAT_TA_71881.pep
MADGGKMKGVEGSGEGTGHGEDMDEEAREELELALSLGRQGWHLPPVPVPPPAPALRWSMVFPAWDPDAAGSSRAA

SEQ ID NO: 177464 - protein, 207 aa, Triticum aestivum
  Clone ID: PAT_TA_71882.pep
TRPKLFERNEYHNIVEELTAILKDGKSLRVKVDELPFVEKELKRSSCRKQASEALATQMSLQFIKEILIQASILTIEEEQPFVGLSEVLKNATAWEEKAQRMLEQSASLSEFEDHIRWSEDIKAILPSEQVMKTEIIAARLWMDKCQAYLRPRCDRLGFGVCLKVDDLKDLVCQPATMKVILDTSALNSVLSNIEEWEQNSQSLLSS

SEQ ID NO: 177465 - protein, 147 aa, Triticum aestivum
  Clone ID: PAT_TA_71883.pep
MAAEADDPTAASATLEKFRLYETRARFYVIGSSREKRWFRVLKIDRSEPSELHLSEDPVWYSQQEVKSLLQRIAEGNRSTGGLTFVTKAYGIAGCIKFLESYYLILVTKRRQIGCICGHAIYCIDESQMITIPHSSVQTDVATSKNE

SEQ ID NO: 177466 - protein, 117 aa, Triticum aestivum
  Clone ID: PAT_TA_71884.pep
SKTIFDKIRSWACKIRTPEPDRGTLPTRRRAGMEPYLSSLAAGPRRCPHVLSLRASSAPARKPALVVPRKGGGTEIISKAGGGKRGEAGARESRKKGRAAEWSGAEPVLREKRADAW

SEQ ID NO: 177467 - protein, 148 aa, Triticum aestivum
  Clone ID: PAT_TA_71885.pep
MESRWVIAFLFLSLQPLLGASYLRARKNYIVHLDPRGGPVDSVEEWHRSFLPRTAALESEVEADGGAKDHGPRIIYSYSDVFTGFAARLTDEEAEALRSTEGCLRLYPEVFLPLATTRSPGFLGLHLGNEGFWSRSGFGRGVVIGILD

SEQ ID NO: 177468 - protein, 63 aa, Triticum aestivum
  Clone ID: PAT_TA_71886.pep
TEKPLLRVLRDRGERHRISSSIRDLWSNRSATNRSNRDETFPDPITAYWSQARAKDWSKSKQH

SEQ ID NO: 177469 - protein, 224 aa, Triticum aestivum
  Clone ID: PAT_TA_71887.pep
PRVRSVEPSPPGARFSPTPFSASPPILDRDLWFITNWYSEPRNCFPTSVSAADLSHSWSSVKSTGSGEFAQNPVRGLVDLERGHGAIQTFGADPPRARRHVRDHRQSYRTCSRRSSAAWTRIGRQPTSGPRRSSPTMTRSPPSSNSSPNRSISPRPMWMKLARPCPRPILSPQQVRAPCPLWRPWTPSRMDHHHRRPAPRRPPSIRTARRSFRLPGWSTTAPRC

SEQ ID NO: 177470 - protein, 194 aa, Triticum aestivum
  Clone ID: PAT_TA_71888.pep
FVILRVDLLLVAGLGQLLGDATDLGGHTMRIGVRQIHALLIGHDLLLSDPPHCIKLFAPPRHCAFDLRNQGFALPGQLLARDLVPQGRDLPHDLGIVGKNVRLFLDEQVHQGRNLHPQDSCFGNNDRLPIHLFHRHLRRRPKLDSAAAAARHQSLSLSLSLSLSLSLFLSLSLFRLLTRLACGTLAAAAAAGRV

SEQ ID NO: 177471 - protein, 77 aa, Triticum aestivum
  Clone ID: PAT_TA_71889.pep
AQLLRWDLKNQSFFGFSAFMAGDVPILPLPRYRYVYLCPYHSSLILSTLATQHSSAWRSARFPYISFPFLHQIITLS

SEQ ID NO: 177472 - protein, 189 aa, Triticum aestivum
  Clone ID: PAT_TA_71890.pep
FTRPVLQPNGIGKPAHFMRRKRIRKPRALKENRVGGDDPVSCLKTENGTHDQDITTKSCSENDLSVPKLPGEPSKPVHVDKDSAGHAQGHIDVSLEENAAMMLCSLSDNRHDDPLRNRMSSPDRSSKESNLHRSNRLNNPYKNEDDVAGPSRLLRKRDGKGPFRKRRPRRHFYEVSPHDLDPFSIVKER

SEQ ID NO: 177473 - protein, 33 aa, Triticum aestivum
  Clone ID: PAT_TA_71891.pep
PTREMAWLYFPFTLGNSLSPSPLLEQHSPSGRV

SEQ ID NO: 177474 - protein, 143 aa, Triticum aestivum
  unsure (1)..(143): unsure at all Xaa locations
  Clone ID: PAT_TA_71892.pep
HASGFYFDFSCTYVGVGMICPHIVNVSILLGGILSWGIMWPLIANKRGSWFSADLPESSLRGMQGYRVFIAIAVILGDGLYHFLKMLILTVYSLRSRLKTGSASPFPVSDDETCNGTAAISYDEQRRKXLFQKDQIPWYIAYG

SEQ ID NO: 177475 - protein, 81 aa, Triticum aestivum
  Clone ID: PAT_TA_71893.pep
MAPRRFLLLAILLVLLGAHGFGRGAAQAADQFAYNGFADANLTLDGLAAVAPNGLLALINGTSQAAGHAFHPTPFRMRNGT

SEQ ID NO: 177476 - protein, 71 aa, Triticum aestivum
  Clone ID: PAT_TA_71894.pep
LKPLINLMLHQNETNNSTNTFKVEKKIFFLKNPAYSTLTNLLWKKNNPFKLGHLNWKPGNLLNPWVAGGFL

SEQ ID NO: 177477 - protein, 74 aa, Triticum aestivum
  Clone ID: PAT_TA_71895.pep
YGPGNHIKRATYELQLQIVYNRTALLNVFTNEHGIFNQQIIVKYHSMVALCQHITFIYLLKLEGSLLVLILMAY

SEQ ID NO: 177478 - protein, 72 aa, Triticum aestivum
  Clone ID: PAT_TA_71896.pep
MKGADLINVALPEELLEDVLRRVGGEKRDLDACALVCRRWRRLDRATRRSAKLPASGVHADEVVGLFVERFP

SEQ ID NO: 177479 - protein, 80 aa, Triticum aestivum
  unsure (1)..(80): unsure at all Xaa locations
  Clone ID: PAT_TA_71897.pep
TRPVEQFTTGWSIHTRTTNLIKATTEIYPTHSSLSSGKREGGRKLSTATRRSSRSVLLGGSGGRENRWGPPMRRXGPSRR

SEQ ID NO: 177480 - protein, 141 aa, Triticum aestivum
  Clone ID: PAT_TA_71898.pep
MTLGPTRGKIFDKYQKMVHTYDPMSEALETILSITETHSTPYYGPTTSRIIFIQETLAPVHKTDEEIALSSDLSKVIREILLRLPAKAVVHSKFVCKQWFRLIESENLIQSYFQHKNMDKRPKVMLLVKGTGQLAFSFSPL

SEQ ID NO: 177481 - protein, 102 aa, Triticum aestivum
  Clone ID: PAT_TA_71899.pep
HASGLLLMAAGCPHVPLLNSVGRLPAALIAIAFPLVGVSAALDALVDIADGKINIHVLMALAAFASIFMGNSLEGGLLLAMFNLAHIAEEYFTSKSMYDVRE

SEQ ID NO: 177482 - protein, 80 aa, Triticum aestivum
  Clone ID: PAT_TA_71900.pep
NKVAPIATHGYLASHTNCIIGNRKLTLHFEYNSSSANLDNPYCFFFVLAKLKDILSDQFYSRISSLRVLYNILNGDMWCC

SEQ ID NO: 177483 - protein, 181 aa, Triticum aestivum
  Clone ID: PAT_TA_71901.pep
HASASFCNALITMYSKCGDVSESELVFINLKSQDIVSWNTMIAAYAQHGKYQKAISLFHEMETRGLIPNDITILSVLSACGHVGRVDDSLKLFDLMSFKYAIYPGAEHYACIIDILGRAGQFEKACSYIKDMPFESEKNVWGALLGASKTHGNVQLGELAAKMLVQSYSRSSGPYVMLSNI

SEQ ID NO: 177484 - protein, 88 aa, Triticum aestivum
  unsure (1)..(88): unsure at all Xaa locations
  Clone ID: PAT_TA_71902.pep
SGQANAKASKTSNQTIKRYXDVPLMSIAYAETRNVLKDQKLFDIGSQHLEKGETHQGPXVLGIALIAMSEELXAEMAVRSLERLLQYG

SEQ ID NO: 177485 - protein, 88 aa, Triticum aestivum
  Clone ID: PAT_TA_71903.pep
HASASVCGGRLTGLCLVRDWRGAPRSQTTKLQTPLHPRLIASSVALPPPTTAPAAAFPPGEVTPPKQEVRFFRRRPPGYEHHAPPRMI

SEQ ID NO: 177486 - protein, 56 aa, Triticum aestivum
  Clone ID: PAT_TA_71904.pep
MDGDGRSDDCDAGGEWIWVRRPQEAEAAAAAAGWPTEEAPPLKVVFASSARYFTDS

SEQ ID NO: 177487 - protein, 102 aa, Triticum aestivum
  Clone ID: PAT_TA_71905.pep
PRVRSASHLPPFHAATAQISVLETRRQKQVRDHLIATMDPALKAYLDKMSDEATARANKQDGDNNAILQALATQTARIDSLVTWKPELEARFTQLELSVAAF

SEQ ID NO: 177488 - protein, 117 aa, Triticum aestivum
  Clone ID: PAT_TA_71906.pep
LLASQSGAQALVVGVLGAFLVGGERRALSAMRVASQVRNIRLYLGRGRALQQREAADQQEHRSKRRRSTGAPLLHGGTHAAAHLLFRRCTEYWMIVVVERGLRMDPGPGSVSLRTRG

SEQ ID NO: 177489 - protein, 31 aa, Triticum aestivum
  Clone ID: PAT_TA_71907.pep
MDVDDDVEDDDMDFNPLYREGSPFETSSSLT

SEQ ID NO: 177490 - protein, 151 aa, Triticum aestivum
  Clone ID: PAT_TA_71908.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANV

SEQ ID NO: 177491 - protein, 79 aa, Triticum aestivum
  Clone ID: PAT_TA_71909.pep
MDLSDKKFQILESVFMECPNPDEAQRAHLGREFRVEPQHIKFWFKNHRAQMRRARHEQVDNHLSDSENDEIDSESDEIH

SEQ ID NO: 177492 - protein, 48 aa, Triticum aestivum
  Clone ID: PAT_TA_71910.pep
MKMVRNHKLYRLDCLLLKLAELGYKRSAKKCKEKFENVHKYYKRTMEG

SEQ ID NO: 177493 - protein, 147 aa, Triticum aestivum
  Clone ID: PAT_TA_71911.pep
MATMGGDRRQMMEDAADDKFPEGLRILVVDDDRVCLTVLEALLHRCKYQPTTVMDAKTALRMLMAGKQQFDLVITDVRMPDMDGFKLLELIRLQMDLPVIIFFDWELWVKTPTADPNFIEENRYNWLITRSNQVTRKNKKESPTKLA

SEQ ID NO: 177494 - protein, 67 aa, Triticum aestivum
  Clone ID: PAT_TA_71912.pep
HASDPIFQPLCGFFKEVLAHHQDPARPKPESGGGDLVPEYERDYEDHDCSLNHQEDDALDEFVLRVL

SEQ ID NO: 177495 - protein, 158 aa, Triticum aestivum
  Clone ID: PAT_TA_71913.pep
HASERIFRDLGGFFEEVLEHHQDPARPKPESGGGDLVDALVGLCEEHGFTTDHVKAVLVDAFLGGIDTSSVTILWAMSELMRKPRALKTAQEEIRATVGGNGDRVQPDDLPKLTYLKMVVKETLRLHPPATLLLPRETLRRVEIGGYEVPAGTRVLVN

SEQ ID NO: 177496 - protein, 169 aa, Triticum aestivum
  Clone ID: PAT_TA_71914.pep
MNTFLVFALVAVVATSAIAQMETSCMPGLERPWQLQPLQQKETFAQQPPSSQQQQPFPQQPPFLQQQPSFSQQPLFSQKQQPVLPQQPAFSQQQQTVLPQQPAFSQQQHQQLLQQQIPIVHPSILQQLNPCKVFLQQQCSPVAMPQHLARSQMWQQSSCNVMQQQCCQQ

SEQ ID NO: 177497 - protein, 109 aa, Triticum aestivum
  Clone ID: PAT_TA_71915.pep
LLAANQREMRMAARNNSEVIKKTNKIVLYYFLYYVSLRKTGLVVWFFLALWRANIQSLWMFIYPIYINISTLKSTDTGTRTRRHAYGDTGYGIFQKQPIGDTASIYKNK

SEQ ID NO: 177498 - protein, 99 aa, Triticum aestivum
  Clone ID: PAT_TA_71916.pep
PRVRSVPDLSWAQIHHPPRRRPPAWPPQPRRASFSRRRPRTSSPETPSPRLLPPPSSSSTPASRSTPSPSIPSFSAFFSRSFSPSNYSSAGFSSGLAAS

SEQ ID NO: 177499 - protein, 134 aa, Triticum aestivum
  Clone ID: PAT_TA_71917.pep
MAASASTSGEWLKGALQELRGRTGSALELDDGLISGLVSFCELAPPPDAADYLANIVGAEAAQDLIQEYLQRRGYIDPSKGAGSSQSSNLQPYLKPSADAATAQTKKQTRTQKDPASSSSQSSKSQSDAADTHA

SEQ ID NO: 177500 - protein, 205 aa, Triticum aestivum
  unsure (1)..(205): unsure at all Xaa locations
  Clone ID: PAT_TA_71918.pep
MKTLLILTRLAMAITMGTAYIQVDPSGQXHWLQQQLISXLQQSLSQQPQQTFPQPQQTFPHQPQQQVPQPEQPQQPFLQPQQPFPQQPQQPFPQTQQPQQPFPQQPQQPFPQTQQPQQPFSQQPQQPFPQTQQPQQPFPQLQQPQQPFPQPQQQLPQPQQPQQSFPQQQRPFIQPSLQQQLNPCKNILLQQCKPASLVSSLWSII

SEQ ID NO: 177501 - protein, 104 aa, Triticum aestivum
  Clone ID: PAT_TA_71919.pep
HASEPPATSLRHHSAFGHLPPPPPASSHFPPGCTPREEDPPFATYCWPSSWSHYISARMFSFGLSSTSAVCPFLRMFSSISGGSSDQHSVPFQFILQVKKGAPL

SEQ ID NO: 177502 - protein, 74 aa, Triticum aestivum
  Clone ID: PAT_TA_71920.pep
HGDVHQIRAPHLEVVDAVAAHVHLGPPLHLLGSLEFEIAILHGRRVGQVRRHGCRWRMGGRSPRRCGRARRTRG

SEQ ID NO: 177503 - protein, 74 aa, Triticum aestivum
  Clone ID: PAT_TA_71921.pep
RRREPQPDAHAHAHRRGEQAPLLHASPDARARDHRVLEHARFARPRDSSRTQLEEGRPEKRGRRGRVGDVSGRV

SEQ ID NO: 177504 - protein, 154 aa, Triticum aestivum
  Clone ID: PAT_TA_71922.pep
TRRRFATGGGDQKVRIWNMKSVSKDNQNDDSNQRLLATMRDHFGSVNCVRWAKHGRYLASGSDDQAILIHERKAGSGTSEFGSGEPADIENWKVVMTLRGHTADVVDLNWSPDDSTLASGSLDNTVHIWSMTNGICTAVLRGHSSLLKGFTWDP

SEQ ID NO: 177505 - protein, 68 aa, Triticum aestivum
  Clone ID: PAT_TA_71923.pep
QRDLLSIHPDKRKTQRQRKLVVRKVQQCTVSCELARYHKPNSNKQAKVRENHRNTNPPSSVRRKYNLA

SEQ ID NO: 177506 - protein, 89 aa, Triticum aestivum
  Clone ID: PAT_TA_71924.pep
NLKHLMPRESLTTLALSFARSLAWRRLSLVFLPDLSSLSRLDGCKPRSAVSFSRSQLLAAATIARLAQPLPLADPRCPPQPRPQPRADL

SEQ ID NO: 177507 - protein, 224 aa, Triticum aestivum
  Clone ID: PAT_TA_71925.pep
TRPVVKLQLACGSRRLPVIVLHWSAGSAKDTTKGGKLFVYGGDDMGSEEVLTVLSLESSNGLESVRCASRVDLKLDGSFADMILIPDTGVPDKIRTSALFILTNPGQLNFYDGGALFSARKSEEEYAQPEAQKFPVVVPTIDPSITVTDMYSLTGREHPSISLKKFCARQIVAPPISGNMKWPLTGGVPSEMSLKEDHAVERIYVAGYQDGSVRIWDATFPILM

SEQ ID NO: 177508 - protein, 89 aa, Triticum aestivum
  Clone ID: PAT_TA_71926.pep
MEKRGGTPSPSPRSTEKSGKDLTRSGDANGGAGAGGNATPKGDKEKGVNVQVILRCRPLSDDETKGNTPVVISCNERRREVAATQVIAN

SEQ ID NO: 177509 - protein, 153 aa, Triticum aestivum
  Clone ID: PAT_TA_71927.pep
MMDEEEEKEGLSDGMECEEEMEESLPEAGDLRVLPEDQPVITSRQSVKRVVDAVSKFDEYKRWLVSEIGFGGILKLPMITRMDLKMSVWVMTKVNARCHVIEIDDDKKIAFTVEDFHKVFDIPCGNRYVSGRDAQIAAPAIQFIKRTIGMDGS

SEQ ID NO: 177510 - protein, 225 aa, Triticum aestivum
  Clone ID: PAT_TA_71928.pep
HASAHCIHCVMVKGENLMNGEHTNSKLWLIDLAGSERVAKTDAQGERLKEAQNINKSLSALGDVISALATKSQHIPFRNSKLTHLLQDSLSGDSKTLMFVQISPNENDVGETLCSLNFASRVRGIELGQARKQVDVGELSRYKLMVGRAKQDCKSKDAQIKSMEETIQSLEAKNKAKDLLTMNLQDKIKELESQLLIERKIARQHVDNKIAQDVERKQQQQQQQQ

SEQ ID NO: 177511 - protein, 102 aa, Triticum aestivum
  Clone ID: PAT_TA_71929.pep
VGLRAQLAPGALRGAGQGRRQPRHRRRGGRGPDQGPLGGPGAPMLRRGPPLLGREELGRGGSGRGLGLVGRRAAATAGVRSRVEGEREVRHPGGASAGGGRV

SEQ ID NO: 177512 - protein, 214 aa, Triticum aestivum
  Clone ID: PAT_TA_71930.pep
HASGDGVGPAWPGVYSTMVDVLSKSGRLDAAMGMYREMVAVGHRVSTAVSTTMVEGLVKAGKLDAGMELWEEMRRGGLRPSFGLYTMVVEANARSGRLDVAAKLFGDMEKSGFFPTPATYACLVEMHASAGNVDVAMRMYHSMANAGTRPGLSTFTALLTMLANKKLLDLAAKVLLEMKASRFPIEVTASDLLMIYIKDGSTELALRWLRFMGS

SEQ ID NO: 177513 - protein, 70 aa, Triticum aestivum
  Clone ID: PAT_TA_71931.pep
IIQCVSLGIYLSPIFVDKKSPKKSSIAVAKEKGNTYEVSISLNLRQPQLSHESPKIRKTPRVRPRVRGRV

SEQ ID NO: 177514 - protein, 62 aa, Triticum aestivum
  Clone ID: PAT_TA_71932.pep
MDGDDCDAGGEWIWVRRPQEAEAAAAAAGWPAEEARPLKVVFGSPARYFTDAAPIGNGHIGA

SEQ ID NO: 177515 - protein, 175 aa, Triticum aestivum
  Clone ID: PAT_TA_71933.pep
TRPALPAATSCPAPPAPHRLDRDRVPPQTTAMVEGAAQLLADGFAGSPLLGASPSSVSGRASTWRPLGAAAGAGVPCSREGWGPSGGARGATLDGWPAQRGRLLISREGHRQKLVLSRRCYQSASNCWAMRRKRFHEGVYFQNWRKSSPTMHVAWSDELCYAECPVTVQPHSTAR

SEQ ID NO: 177516 - protein, 66 aa, Triticum aestivum
  Clone ID: PAT_TA_71934.pep
SMAMAAAARRRAARRRGPAVAAGTPAAGTGTSSLASWWWGILRRGEAVDRRCGEWEGEGREEEGVG

SEQ ID NO: 177517 - protein, 209 aa, Triticum aestivum
  Clone ID: PAT_TA_71935.pep
MAAPGGSDGAPKGRDLPQPSRSRSSINSTLGTKLENAKRISIEHLEIITDNFSPERVIGRGGYGTVYKGVNSDGKYVAVKVLHKNATGTDNGEFKHEFESLMRLKHHNIIQLVGFCYETRHNPMLHDGETIFAEDIYKALCFEYMQNGNLKEHISVECDGLEWNTRYKIIKGTCEGLNYLHEEFREPIYHLDLKPENILLDENMVPKLA

SEQ ID NO: 177518 - protein, 76 aa, Triticum aestivum
  Clone ID: PAT_TA_71936.pep
FCNYRPEILLISVLVIMFASSSLSSTVTLEANIYPNVMFIRLNFTNVMFSCTPRDCNKVANALAAMGSGGQVPHRL

SEQ ID NO: 177519 - protein, 80 aa, Triticum aestivum
  Clone ID: PAT_TA_71937.pep
HASGRAETEDAGEYARTEQRYELAVSEEPNNSLILANFAQFLYITRKDHKRAEHYFERAVRAEPADAEALSRYATFLWRA

SEQ ID NO: 177520 - protein, 109 aa, Triticum aestivum
  Clone ID: PAT_TA_71938.pep
MDQRTLCLQYYMHYYHYYMWRRRLLAAIIVCLGMYWYKINVRKRKRKSITYAPMFERDVERMSRLNRMYYGTEANCISELRMRKFVFHKLCANLRRRGLLVDTFPVTVE

SEQ ID NO: 177521 - protein, 103 aa, Triticum aestivum
  Clone ID: PAT_TA_71939.pep
LSPLLRSPSRLQAAVTHSTSSAPSSKRRPMTPMAPPLLHAALHAAPPPSSSPPTATATTAPSRRPRPPPPGSARVCRGPSPPDPATCAQVGPPSPGSRRTSFP

SEQ ID NO: 177522 - protein, 103 aa, Triticum aestivum
  Clone ID: PAT_TA_71940.pep
MEDATKRRHQPGALPARRKVVEEPFDPPPPPPAAAAAAATVASPAHLVGAIVEKGFSAAAPSSAPRPTVLPFPVARHRSHGPHWKPVAKAADKKKGEGEGEED

SEQ ID NO: 177523 - protein, 66 aa, Triticum aestivum
  Clone ID: PAT_TA_71941.pep
MLNSCMVNFTYSHPCWFCGRFLWEKNTFGGTQISLWWGSGCLIPPPGFKSPWTQFKGLCSFLKGKH

SEQ ID NO: 177524 - protein, 56 aa, Triticum aestivum
  Clone ID: PAT_TA_71942.pep
PRVRPCVNKSENGTEPSVAESIGMSIGMAVVYTGEYVDYYFKFSMQPAQDPVQDAL

SEQ ID NO: 177525 - protein, 230 aa, Triticum aestivum
  Clone ID: PAT_TA_71943.pep
HASGKVRQQHFETITGLVRASRTFFPEGAAAEIWLEFRPLLENPWHNSAFEGVGFVRLFLPANPRNQDHFTTDWIAQCLHIWDSVTNCNFWDIQWAAIIARCIKNSRSIEWEKFLPLLFTRYLNMFEVPISSGNGSYPFPVEVPRNTRFLFSSKTRSPSKAIAKSVVYLLKPKSLALEQFEKLINFLEQFYHPSNGGRWTYSLERFLRYLVFYFERRLQHEQFDTMDEKN

SEQ ID NO: 177526 - protein, 62 aa, Triticum aestivum
  Clone ID: PAT_TA_71944.pep
MEALTLTSLLKAAAAAFPDRRAIAVHGKIDLTHAALDALVDAAAARLAAGAHGLRPGQTVAL

SEQ ID NO: 177527 - protein, 214 aa, Triticum aestivum
  Clone ID: PAT_TA_71945.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVM

SEQ ID NO: 177528 - protein, 128 aa, Triticum aestivum
  unsure (1)..(128): unsure at all Xaa locations
  Clone ID: PAT_TA_71946.pep
TRPQPLPIPDMAXAHITMDFISALPNSQGKEVILVVVDRLTKYAHFIPLAHPYSVMTVFEALMDNVIKLHGLPVCVVSDRDAIFTSSLYQELFSAFGVQIIFRTASHPQTDGQTERVNQCPESYLRGM

SEQ ID NO: 177529 - protein, 66 aa, Triticum aestivum
  Clone ID: PAT_TA_71947.pep
CAAGRGEGRSSSCQVRWGRGSQPMSFTLGNAYRIVVRRPFHDVVATSALLYLNVKCKPEASSDHGD

SEQ ID NO: 177530 - protein, 53 aa, Triticum aestivum
  Clone ID: PAT_TA_71948.pep
PTRPPHLPVMKGIYRASSGSSGQHRPRHGLISSHPHPRHAAAAGRLRAAAALL

SEQ ID NO: 177531 - protein, 79 aa, Triticum aestivum
  Clone ID: PAT_TA_71949.pep
LAFLGRAMGWWGEEVGGDEAEARVGGKAIERGKEPGRARAACGRVSDGRVGFGSRRSRILMHARARDNGKRTRGSRTRG

SEQ ID NO: 177532 - protein, 32 aa, Triticum aestivum
  Clone ID: PAT_TA_71950.pep
MEGGSSSLDAAIESLLNTEKQCRLAGDVAGTR

SEQ ID NO: 177533 - protein, 71 aa, Triticum aestivum
  Clone ID: PAT_TA_71951.pep
GKVAVVDGNADEGATDAGLHHRPQRRPSHARSEPSLPPTPLRRGCSPSTARRRRRRRRGGRGVRILQPDAW

SEQ ID NO: 177534 - protein, 153 aa, Triticum aestivum
  unsure (1)..(153): unsure at all Xaa locations
  Clone ID: PAT_TA_71952.pep
TRPTWSSTRSCRHTTSTASTPSSSASTSAAATPTAARPPARSPPASSPAPARASRTTSPPPPSPAPPSSPVPPPGSPAPRPSPRRTAGPAATRTSPSAAPSPAATSKSPPSSRATTTRSXAAPRGPPSPFHSPPNAAPPPDFIDDDATAGAAC

SEQ ID NO: 177535 - protein, 65 aa, Triticum aestivum
  Clone ID: PAT_TA_71953.pep
GNGAGRAHHLHHAISHPVDGGGVGDTTEWVMIPEQRGQLLLHGRRRPAGWIRSSRWQPDAWADAW

SEQ ID NO: 177536 - protein, 199 aa, Triticum aestivum
  Clone ID: PAT_TA_71954.pep
TRPPTRPEQLWSTKYHVCKNQERLNLCENHVLEQATTYNIPWHEKLQGGMKTMSMSANWPLLVQREYKRSGHLVKKCNAKQIPGGSRARIHLTILLITFNCCPPFGAKMLGGNAYHLLMIQIIATLLSDLPAKSIGAELQQHVTLPGNYFALFQPKSRRPLHIIVFAQVSLFSKQAIAESLHDKTSPWPLIKFEVLVLP

SEQ ID NO: 177537 - protein, 48 aa, Triticum aestivum
  Clone ID: PAT_TA_71955.pep
TRPDLGPIVRDAFESGRPEALFHNLRGISKRKEVEIEELCRLHYKEFI

SEQ ID NO: 177538 - protein, 177 aa, Triticum aestivum
  unsure (1)..(177): unsure at all Xaa locations
  Clone ID: PAT_TA_71956.pep
PTPPRQVRVLQGYRAHCLLKFVRTEVPLRFVKWYXSKFDLASEIQIRKKFIPIPKYVKHDILDLPVDGEPIMSDADAGREFILCHFNVTSIPPVSFFCNTLKSEELPDEDSFICFMCIALSTFLCPNSSLSPSPKYLHIFRDCSSVMNYDLSRLVYESLLGNIKKFKDSMKVASMRS

SEQ ID NO: 177539 - protein, 57 aa, Triticum aestivum
  Clone ID: PAT_TA_71957.pep
MHEHTLARAWEATVRKVQQHPQPGGRRRVAPMLPADDSETASSSAGVDDADHHGPEE

SEQ ID NO: 177540 - protein, 78 aa, Triticum aestivum
  Clone ID: PAT_TA_71958.pep
SSIMSGISYKTHFYLLLSLLEILHHVKVVHQGNICSSSAPAHLYFLARVVPCRSFASSPEQHHILCFLINRDFYLLFP

SEQ ID NO: 177541 - protein, 147 aa, Triticum aestivum
  Clone ID: PAT_TA_71959.pep
IVDVKTIISFGFCSQIDMIEFVNKAALLLVNLSGAHNIIKFICKILKRRHGLYQQLVHEQKTTNTSLVIGQRVRAGGGREIKPPKDGGLHCIYPVKLEPIGSYSYARDCLRTTSSLCHQASKGDVALQPPPTIAHLCTWLRLEHTIC

SEQ ID NO: 177542 - protein, 135 aa, Triticum aestivum
  unsure (1)..(135): unsure at all Xaa locations
  Clone ID: PAT_TA_71960.pep
HASAFRPVPHGPPFRSGSPPSPPPPPSLSTLPPPAQIPPRATPPVPPPPTASRSLGESRSAPPSIPPGKIGFXRQPPAPRPPSPSPAVPPVYPTRSRPAPRSDLASVRGRDSCSGATVRESVEEISVAAIPASIA

SEQ ID NO: 177543 - protein, 46 aa, Triticum aestivum
  Clone ID: PAT_TA_71961.pep
LFFHLHILRPQQRSRWSFNHRSSLVHHGVTHDGAQRCINCCYSRIR

SEQ ID NO: 177544 - protein, 64 aa, Triticum aestivum
  Clone ID: PAT_TA_71962.pep
RLFLIVHSPSLVYQRTHLHWLGKVARVCSVSPSKITTVAVSWPLGIRIRPGPASEAGSGLPDAW

SEQ ID NO: 177545 - protein, 86 aa, Triticum aestivum
  Clone ID: PAT_TA_71963.pep
PRVRILIHLNQVTMCGSKNMIPHNVSLKKHRAIYLFCYVTSFNSLFNKLSSCTHIYLLLFHLHREPIFCSAVSFPPSWFRCCFNDP

SEQ ID NO: 177546 - protein, 149 aa, Triticum aestivum
  Clone ID: PAT_TA_71964.pep
HASADAWAPRPATQIRPRLGRGSPRCSSRTACSRSTPGAPSRPGPRAPRRAPTGATRGPSPRASTSATGHRSTPPSSSSSSSPSPPSPPSSSSAAPARTPLRSSASTAPAPAPPAAPPSSPTRTSPGPKSRRSPSPGPSTSPPSAPRGG

SEQ ID NO: 177547 - protein, 83 aa, Triticum aestivum
  Clone ID: PAT_TA_71965.pep
HASGDLPAPPGHRRALSHPLRRRPPSPYPCLPPSTYIHQPLYFMDITLYPVRSQACMNIRSYLNFENPFTKTNVQATPERHVD

SEQ ID NO: 177548 - protein, 58 aa, Triticum aestivum
  Clone ID: PAT_TA_71966.pep
HTTAHGHRILAARAAKDTVQHPPTPLAAKPTPSTKSGAAAPASTDHAHPIRASHRTRG

SEQ ID NO: 177549 - protein, 83 aa, Triticum aestivum
  Clone ID: PAT_TA_71967.pep
MARRTTSVTAAAGLLILGASCVFLLSAADGDGGTMRYNAMFNFGDSLSDTGNLCVNKSAAEELLLTFSNPPYGMTYFGHPTCR

SEQ ID NO: 177550 - protein, 197 aa, Triticum aestivum
  Clone ID: PAT_TA_71968.pep
PRVRDGGFRDACMTLQQRPLSVLEGDLQNLLELLQVFKNKVEEQCSKAEDLRNKMFQVSARQAYMKGILTQSSDTQYWDIWNRQNLSPEFEAKRQNILKANQDLTNQLVELERHFNNLEMNKFGETGRVASSRRAVYSNKSRSSQTQLSSVYNALNSQLAAAEQLSECLSKQISALNISSPSKKRGAVTKELFESIG

SEQ ID NO: 177551 - protein, 76 aa, Triticum aestivum
  Clone ID: PAT_TA_71969.pep
KGRDSGYGKRKGTRDAKLPTKILRMRMMRILRRLLRMYRDAKNINKHMYHDMYLKVKGNMFKNKRVLMESIHKSKA

SEQ ID NO: 177552 - protein, 202 aa, Triticum aestivum
  Clone ID: PAT_TA_71970.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAPAPAAA

SEQ ID NO: 177553 - protein, 119 aa, Triticum aestivum
  Clone ID: PAT_TA_71971.pep
GTGLDALLWNTTILIGTCVQHPAGRLQGGRTEDPASCWAAPLIGVAPPRIAFTIAEAWLIPGPARFCQPMVAAASPCRNKGVLPGRPGAPLSGHTPGVQFSWLMAGFACGLSPEGPIRA

SEQ ID NO: 177554 - protein, 177 aa, Triticum aestivum
  unsure (1)..(177): unsure at all Xaa locations
  Clone ID: PAT_TA_71972.pep
FAEAPNYAAAGNIQVDXSGQVQRPQXQHPFSRPKQRCSQRREEIFRQPQQTFAHHPQQAFPKPQQTFPHQPQQQSRQPQQPQEQFPQPQQQQQPFPHQPQQQFPRPQQPQQPFPQPQQPQLPFPQQPQQPFPQPQQPQQPLSQLQQPQQPLPQPQQSQQPFSQQQQSLIQPYLQQQM

SEQ ID NO: 177555 - protein, 126 aa, Triticum aestivum
  Clone ID: PAT_TA_71973.pep
PDMSSTKISIATIMVLVLSLQAIIDAELSYHGGYEYMCFPSYCQCEPKNNLQLGGGEAIVVTNTLSCNVGLAYMCYPAYCQCRPKNNLQHEDYQAMVPRPKRSNTIFPQYTTVSGFIRRSSYAKSN

SEQ ID NO: 177556 - protein, 219 aa, Triticum aestivum
  Clone ID: PAT_TA_71974.pep
PRVRPKCDILLNNMSEVYNSYILEAREFPAISMMECIKGKITARHDNKQREAIKWTGRICPKIRKKLEKEIELSASCFPSHSGLGVFSVLSGNNTYTVDIVALTCDCKRWQLSGIPCSHSIACFREERIDLEEMVHKCYTIDTYLEAYGHNIMPTRVRALWEQVEGPIIHPPVYKKRMGRPPKNRKKTPEEKLQKDGSIALNKKGVSMHCSICGKADHN

SEQ ID NO: 177557 - protein, 140 aa, Triticum aestivum
  Clone ID: PAT_TA_71975.pep
PRVRTGALPPSLAAAAPPTPPPPVQASTRRTQSEQEEEKEDTSAERISCSSRPDPPAQCARRRRGHSSSHEPRLPRPRRRPVRALLQPEQGFIPGRAPGAALTADPAGPRWGHRGAGARTRVPDGVAGEHCRGQDLGVEV

SEQ ID NO: 177558 - protein, 127 aa, Triticum aestivum
  Clone ID: PAT_TA_71976.pep
PRVRPRVRERTVSERRTELRKLGSLQGRCDLLSRLMSSSTGHSDEFLRDFCISFILAVRDTSSVALVWFFWLLASHPDAEARVLDDVRAAHGDVGKMDYLHAALTESMRLYPPVPVDFKEALQDYML

SEQ ID NO: 177559 - protein, 120 aa, Triticum aestivum
  unsure (1)..(120): unsure at all Xaa locations
  Clone ID: PAT_TA_71977.pep
GRPSRGHHCVDASSSRTRTVTGGVIKQKRAHTQLLHLLAEFRPHYMXNHSEANGVAAVTKAAGEKWSSMSDEEKAKYGGXMQMPPASKAVNKKESTSSKNTKTNADEECSDVEDDEEDED

SEQ ID NO: 177560 - protein, 105 aa, Triticum aestivum
  unsure (1)..(105): unsure at all Xaa locations
  Clone ID: PAT_TA_71978.pep
NTKSTVTGYXPDSSNGGIKAVLTGAEIVLIPAGVPRKPGMTRDDLFNTNASIVRDLAKSVAEYCPNANILVISNPVNSTVPITAEVLNKAGVYNPRRLFGVTTLD

SEQ ID NO: 177561 - protein, 60 aa, Triticum aestivum
  Clone ID: PAT_TA_71979.pep
ITKFFFIKEMVWFLGFGLWALPVFIMYRFLLKTFCIKKQKKFPFNGNGNNCNRKPKRPHF

SEQ ID NO: 177562 - protein, 179 aa, Triticum aestivum
  Clone ID: PAT_TA_71980.pep
MELLSGPALAWQQYRSLLRKNAALAWRHRRSSALQLLSSLLFIFLIFCIDRAVRSRFSYTTAYQNVRDPKALVAPPIPPCEDKFFVKTPCYDFLWSGGTSARVPALVDAIRRNNPGRPIPAEKVLGFTTPDEVDAWLFANPMRCPGALHFQDINATQMSYGIQTNSTPVARRGTYEDPT

SEQ ID NO: 177563 - protein, 66 aa, Triticum aestivum
  Clone ID: PAT_TA_71981.pep
TEHRHPRDAGEALAQAASVPPIRRPAPSGCAAAAAAAGCDMAAGELDRGEEGVGSPRDAMGTTGRV

SEQ ID NO: 177564 - protein, 39 aa, Triticum aestivum
  Clone ID: PAT_TA_71982.pep
MGRKHAVLVGINYPATKADLKGCHNDVVRMRRCLVERLG

SEQ ID NO: 177565 - protein, 184 aa, Triticum aestivum
  Clone ID: PAT_TA_71983.pep
MMPMHCQPFQYQGLQVDCYGCSTTFVTQCLELLQVLSKHTNCRKQLVSTGILSELFENNIHQGPRTSRTLARAVLSSFSEGDADAIRELDKLIHKKVMYCLEHHRSMDIAQSTREELQLLSETCALVDEFWEARLRVAFQLLFSSIKVGAKHPAISEHIILPCLRIISQACTPPKSDAGDKESG

SEQ ID NO: 177566 - protein, 37 aa, Triticum aestivum
  Clone ID: PAT_TA_71984.pep
HVRGISPCAAAVALPARCYSMINSDAGASLLDSSSFS

SEQ ID NO: 177567 - protein, 73 aa, Triticum aestivum
  Clone ID: PAT_TA_71985.pep
FHASGERAGRKGDRRSQPGETTVGAGASWPTPCLSSTPRWDGRSDMARARRVRLRGVRIHCLLLPLPLPPLAP

SEQ ID NO: 177568 - protein, 165 aa, Triticum aestivum
  Clone ID: PAT_TA_71986.pep
HASATSPDLLRCRLQWRLQQETLIRTPGTPIPPSRWPCSSGRLPTPRRPPRPCSPAPPARRRTPAPTPTPPPPLPSTSAPTSTTRRIPSPPCPDRSSPSPCPTRTRTPTRALTPWPPRAPTPAPASCSCSAAPARATSSPRYLCPHRRRSSPPRSRRRSRRCHPR

SEQ ID NO: 177569 - protein, 106 aa, Triticum aestivum
  unsure (1)..(106): unsure at all Xaa locations
  Clone ID: PAT_TA_71987.pep
MESKGGKKSSSSSSLMYEAPLGYSIEDVRPAGGAKKFSAAYSNCAKKPSXISFSLCSSLLCSLTRTATMAAPTSAIGFEGYEKRLEITFSEASIFADPHGRGLRAL

SEQ ID NO: 177570 - protein, 69 aa, Triticum aestivum
  Clone ID: PAT_TA_71988.pep
RPRRRRVRRLGRLGRRGRPLLAQRRWHRRQQHRQQDEGSPGRRHCWRSGARWRRWLAVPAWRTRGRTRG

SEQ ID NO: 177571 - protein, 154 aa, Triticum aestivum
  Clone ID: PAT_TA_71989.pep
VRFEQLNIMAPSPKGKQSGKQSVAWEPRQSMSNGPKGVSDPSSSRQFQDSDGVNHPHDSDLNGSTLNKDKLMKDRSSKVHSNTFHQDLGNRDMKSDHVAILNKPAISGNSVSATTSRKPGFKMAVFEDLTEFDDDLEAPVPSKNSKFETDVKAT

SEQ ID NO: 177572 - protein, 112 aa, Triticum aestivum
  Clone ID: PAT_TA_71990.pep
HASAPAPPASCLPQLLLLSPPPPPVPLAFASSSSHLLHPRSAVREPADAGSAPPGALPSVSDASCCYASACTTPPPLRPHQASTARPRAMDEEALAQPTVACLFLSSGFFSD

SEQ ID NO: 177573 - protein, 66 aa, Triticum aestivum
  Clone ID: PAT_TA_71991.pep
INKADRILKILKVESLTFQLGKPCYFIRDTRNRKEIRVDFFLKVSLKGDHHTIRSTDSFTISALCV

SEQ ID NO: 177574 - protein, 184 aa, Triticum aestivum
  Clone ID: PAT_TA_71992.pep
MPSVKRICVEDGAGAEDANIIGGNPNARSRLLNPLVYSGSLDGFKHQDLTPVIGREFEGLQVTDLLRWGDEMIRDLAITVSQRGVVFLRDQDVTPNQMKDLMLRITELSGCPSTSGLHVHPLTEEGSELGDQISVISSEKQKKGGGLTHQLSDVSRLASAGWHSDITFEPVPSDYAMLKIHTPT

SEQ ID NO: 177575 - protein, 88 aa, Triticum aestivum
  unsure (1)..(88): unsure at all Xaa locations
  Clone ID: PAT_TA_71993.pep
QPPPPPPPPPPPPXAPQIHTPLFPTRPHPFXSPSPSHRRRDPDALVCXPPPPDCIHPTPSSAPDDATPPVSKVSPARLVGGVAASARG

SEQ ID NO: 177576 - protein, 155 aa, Triticum aestivum
  Clone ID: PAT_TA_71994.pep
PRVRSPKNLKRGKSYSRSPSPRPSAAQPHHPRPGDPGQPPPHALPMHQQQMSPAAFPGFGAANPFLAMQLFGQAQQLQNLGYLAAAALQQQQHQQHHHHQPQQQQNPFLPGGFPPNPNQFGAFSGPQAGFNGGGVFRPGGAGLAGPRPPLPMMGA

SEQ ID NO: 177577 - protein, 89 aa, Triticum aestivum
  Clone ID: PAT_TA_71995.pep
MNPYFIGFVIPFVASLMLTKRKAEKAEKKRGLPVDVGGEPGYAIRNYRSEQPVETHWEGIFTLAELFEQSCKQYAYMPLHGTRKLISRE

SEQ ID NO: 177578 - protein, 69 aa, Triticum aestivum
  Clone ID: PAT_TA_71996.pep
VHRANLISVQLENTTLTICCNPRQKAYFLLVPRRMAFQHQLSSFMDDIYYRFGFPYQSRTRNPRVRGRV

SEQ ID NO: 177579 - protein, 140 aa, Triticum aestivum
  Clone ID: PAT_TA_71997.pep
MKILGAQRKTLFLLCFIAVCGVVAKENRKGGRPNGGKHHRAISKTIQTEDGDIFDCIDIKSQPAFDHPLLRNHSIQMEPSSHPIGLEGNSIPDTTLESSTHLVSCPLGTIPIWRSEQHYPIVDIKELTHHIYTRNITRDN

SEQ ID NO: 177580 - protein, 81 aa, Triticum aestivum
  Clone ID: PAT_TA_71998.pep
PDPLGLSPLATYPGAVAAAAAAVAADEPRDERPAADPCTPAPPHPAAGRRLPPPPGACPREIRAGLARVYGEPGERGGGGG

SEQ ID NO: 177581 - protein, 99 aa, Triticum aestivum
  Clone ID: PAT_TA_71999.pep
SASGSAAAAGSVSLASSVSAAPGASSLVASTSTGADASTSASAGAGTSSVFGASSAATGVSTAGASSVSMPFAFWTSSVAIAVVDASARVECLRVHRSR

SEQ ID NO: 177582 - protein, 145 aa, Triticum aestivum
  Clone ID: PAT_TA_72000.pep
LQPVLPRRRPVLLARQQARPPPSPPRPPPARPLPRPPWSLSRPRLAPLALWAPRPPARPQLLARSPWPPPSQRRPAPPPWSPQPRRGQTPRPRPPPARGPPPSSGPPRRPPASPPRAPPPSARPSGSGHQRWPLPSWMQENARSG

SEQ ID NO: 177583 - protein, 70 aa, Triticum aestivum
  Clone ID: PAT_TA_72001.pep
PPTPPPPPPPHPPPLTLAGTGRRPGVERSQRPAQIPPPPPPPPAPRRGAGRTTDDISISSCGHRNIYASV

SEQ ID NO: 177584 - protein, 226 aa, Triticum aestivum
  Clone ID: PAT_TA_72002.pep
HASGRPDLQPRPRTVAASPLSCALVPVEAGHERRPPRRLLQYCRPLRLRGRPLHPAQVPGGRGHQGAFVGALSDSAQSPGARERLLSFNSSRHSPRCSAPPHRPNPLPIRGEHRSATMSSVPIDSDVLSLTSTNVPLLVPRKLVVAHTPGIPKRYELLLKHLTYLLCCDNEGKSYVCCSNQRIMFLRWSKADMCLFFEWEEEEEQMICWMHDIANNVCMKFLLNPA

SEQ ID NO: 177585 - protein, 194 aa, Triticum aestivum
  Clone ID: PAT_TA_72003.pep
PRVRRRCRVPRRFRSPEMEASGSWDAIDWNQIEDPRSRRSSQGMEEFLLEDEEVYAQGHGVVLLNTDEAGIVSVTNFRLLFVSQVTKSIIELGTIPLSTIEKLNDDVKLQSVPRQYDKKQPRELLQVIGKDMRVIVFAFRPRTKQKNEVFDALRRYAKPSQLWELYAFSCDPSTVDKKSDPKMRLMKEYHRLLS

SEQ ID NO: 177586 - protein, 141 aa, Triticum aestivum
  unsure (1)..(141): unsure at all Xaa locations
  Clone ID: PAT_TA_72004.pep
GGLSVTKGAPXMTTVRAGSMDRAFPANVRLGNGQVLDGVSVYGGPVLQSGKMYELVYAGATSYSASTCLDGSLDQAAVRGKIVVCDRGVNSRAAKGDVVHRAGAAGMVLANGAFDGEGLVADCHVLPATAVGAAAGEKLRK

SEQ ID NO: 177587 - protein, 125 aa, Triticum aestivum
  unsure (1)..(125): unsure at all Xaa locations
  Clone ID: PAT_TA_72005.pep
QQPPPFSQKQHWALNIHAQVGFSFLCKXICDQQLYIPFVPHQKPPYXQQPLFSQQQQLPFSQQQQPQFSQQQQPPYSQQQQPPYSQQQQPPFSQQQQPPFSQQQQPSFSQQQQQPPFTQQQQPPF

SEQ ID NO: 177588 - protein, 68 aa, Triticum aestivum
  Clone ID: PAT_TA_72006.pep
GGRGTAPATATPPPPACSAAAPAPCATTAASARSCTPWPPPPRTTTAAPMPPPSPSPSPAAAPGPLPG

SEQ ID NO: 177589 - protein, 70 aa, Triticum aestivum
  Clone ID: PAT_TA_72007.pep
PLIFPVNTLMYYHLIANYVLCQGKIILLSSIYIRSYGSHTYKQHHKNKPYTRKYQEYKAINAIISSKQIG

SEQ ID NO: 177590 - protein, 53 aa, Triticum aestivum
  Clone ID: PAT_TA_72008.pep
HASGTILKYLGNHTASATRSRDYEAVYAVLACSCLHRRGDAVDPSVLAGAGTH

SEQ ID NO: 177591 - protein, 123 aa, Triticum aestivum
  Clone ID: PAT_TA_72009.pep
HASAHYSYQNYSESELVEGGNVYQHGGTKLPPTPATPNQRFWKHGRGLRRPNTVLGVICRQSFPGWVTLPGEGQVPELGMTWEHYLAAPALPGERIGSVECHMVADVVIQTFWTFYRCAEGQK

SEQ ID NO: 177592 - protein, 72 aa, Triticum aestivum
  Clone ID: PAT_TA_72010.pep
HASELAYSEAEGRIGRRDRVWQIAFGSGFKCNSAVWRALRTVAPEAEEKNPWADEIDRFPVEVPRVSRVGSA

SEQ ID NO: 177593 - protein, 47 aa, Triticum aestivum
  Clone ID: PAT_TA_72011.pep
PRVRLQASQPGRNSRNSRRREGNGVHRRRHLGAVRLPRVALGRAAAS

SEQ ID NO: 177594 - protein, 129 aa, Triticum aestivum
  Clone ID: PAT_TA_72012.pep
MGTPANIIVGSHVWVEDPTLAWIDGEVVSIKNNEVHVQTSNGKKVTTDRSKVFPKDMEAPPGGVDDMTRLSYLHEPGVLQNLATRYELNEIYTYTGSILIAVNPFQRLPYLYDTHMMDQYKGADFGELS

SEQ ID NO: 177595 - protein, 81 aa, Triticum aestivum
  Clone ID: PAT_TA_72013.pep
GFVLDVCCDPRPCCCRFMVGACSFMVRSASRCSPSFLVFLVVSAIFVPRLLVVGSCVGSFVIHINVWISHRFLDVSFCGLG

SEQ ID NO: 177596 - protein, 155 aa, Triticum aestivum
  Clone ID: PAT_TA_72014.pep
STLLRLTLLAMATTMGTANMQVDPSSRVQWPQEQPSPQSQQPFSQQPQQIFPQPQQTFPHQPQQAFPQPQQTFPHRPQQQFPQPQQPQQPFPQPQQPQLPFPQQPQQPFPQPQQPQQPFPQSQQPQQAFPQPQQQFPQPQQPQQSFPQQQQWMIQ

SEQ ID NO: 177597 - protein, 87 aa, Triticum aestivum
  Clone ID: PAT_TA_72015.pep
PRVRSISSVRRVHLSPLSSILYYSSYSSSASAYQSPTNSPNPAPPRHKSAPPLSIPPPPPRRNPYHHARFQPRPPAGAIRSQGAVLG

SEQ ID NO: 177598 - protein, 77 aa, Triticum aestivum
  Clone ID: PAT_TA_72016.pep
LRNRRPSFCCACIICYARILPITQFYFGISFCIGLLDFKLTCSSWKRSYITIWCLRLVLINKKIVVSCHDEHFIVVA

SEQ ID NO: 177599 - protein, 55 aa, Triticum aestivum
  Clone ID: PAT_TA_72017.pep
MGCLFDCFRAAGGEPRAARARAQLVSSSVVPSPKVGERRAPPSRNALTAAFLLED

SEQ ID NO: 177600 - protein, 200 aa, Triticum aestivum
  unsure (1)..(200): unsure at all Xaa locations
  Clone ID: PAT_TA_72018.pep
MASLANLLVSLLLIAIFSPTPILCYLNQASVRVQQGATNTSAYHTYIVLVEPPPFNADEDMYHHCYESFLPSSRDGDSGKARLVHSYTKVFSGFATMLTDGELDAVAKKPGFVRAFKEKTRYLMTTRTPKFLGLRNNXGFWRDASYGKGVIVGLLDTGIYAKHGSFDDRDIPSPPARWKGSCKATRCNNKLIGAKSFVKH

SEQ ID NO: 177601 - protein, 101 aa, Triticum aestivum
  Clone ID: PAT_TA_72019.pep
GGVRALLAPPPGPGPRAPARPEVVHHRRHHALSPQLLAGIPGLRVPAANPDSCHWFVVLWTAAGAGLCVLPRPRSTQFSSLPLLPPSHLTSPRLTCHRTRG

SEQ ID NO: 177602 - protein, 182 aa, Triticum aestivum
  Clone ID: PAT_TA_72020.pep
YPRVRERGERGADRPEMRKTAVGSASAGAGWPCGLNLNVVFLLSMVATNLLSLYHLCIRASPTTPALQSGSDFEQQQVLQQLSAIRATVSHLRSATPPPPPELVLYSRLAPVASACSAHPDLLHRFMSYVPFAACPDDVHTLAEPLILRGCHPLPRRRCFSPTPDAGSVQLPTDPFAPIPDS

SEQ ID NO: 177603 - protein, 107 aa, Triticum aestivum
  Clone ID: PAT_TA_72021.pep
GPARPTSVATTFRYVRRGPELHRCHRSTPDNRQPHAPDGHHNHPQNWTPGPDLPLIGPFEPTAAGAQSRIQPPRRRTRSCLTLLLCCSTTASTPRPQQGHPPPRTRG

SEQ ID NO: 177604 - protein, 194 aa, Triticum aestivum
  Clone ID: PAT_TA_72022.pep
CEWRAAGSLGPCCYSVFFWQPDLWVRVATLYFSGTEARWLQVHEAHNTPFTWATLLRHTTPPFRWATLLRCSVRQIRPQAVSHTTAPEPPCLAKGGETARHPLSNSRRVSPAAPPMATRRGEGRRDVGPLDLGFRSVARRRETSACFRIPEFHSRKEIYGIHAPLHVLELNADLHANIPMKFRNQNEAPHGKNY

SEQ ID NO: 177605 - protein, 164 aa, Triticum aestivum
  Clone ID: PAT_TA_72023.pep
MAAKGGGGGGVGTLKSTSINGVKLYSVTGKNYVAPWVLAKKKRSLRKDAEYQRRLELIHDLRFETATTRIKVTPDGQYVIASGIYPPQMKVFELKELSMKFERHMISEIIDFEVLGDDYSKLAFLCADRSVCLHAKYGSHYSVRIPRMGRDLAYDCWSCDLLCA

SEQ ID NO: 177606 - protein, 102 aa, Triticum aestivum
  Clone ID: PAT_TA_72024.pep
MASSGEERGVVVDIRSAAESAGDDGARDAPLHVVESLCMRCGENGTTRILLTLIPHFREVVLMAFECPHCSERNNEIQFAGQLQPKGCCYTLKVPKGQPEIL

SEQ ID NO: 177607 - protein, 148 aa, Triticum aestivum
  unsure (1)..(148): unsure at all Xaa locations
  Clone ID: PAT_TA_72025.pep
SRLVRRCRATTVIRGSRERSRHRAXHHVRGGRERSRRRATTVARGSRERSRRRATTATRGGRERSRRRATTAARGNRERSRYRAITTVRGSCKSRRRAATTTCKRRKGSRRRATTTAHGSVERSRHEAAIAIRKYRSNRLQDLRRSTE

SEQ ID NO: 177608 - protein, 171 aa, Triticum aestivum
  Clone ID: PAT_TA_72026.pep
TRPGCCDEMFGVIAGSQRLVDAIGSGEGLGSAQRLIREKLDDRAGLEGSLEQWLKSVFGSEIESPWDQIRGLILKEGKDIFEDWMEEAFVQRMKDIVHSEFDSLVGSVNVMESIQAIGANAGPKDAADFLVHVQKASTGGSVWFSESKIKKGGILAHLKPIADENDFHSCL

SEQ ID NO: 177609 - protein, 219 aa, Triticum aestivum
  Clone ID: PAT_TA_72027.pep
TRPDSSSGSRFQCRSLNINEDLGQIRYIFSDKTGTLTQNKMEFQQASIYGRNYGSSLQVTSDSSHEITIAESSSQHDRKPKSEINVDALLLALLKQPLFGEERLAAHDFFLTLAACNTVIPVSTGGSPDLTNEVSEVGAIDYQGESPDEQALVIAASAYGYKLVERTTGHIVIDVQGERIRLDVLGLHEFDSVRKRMSVVVRFPDDTVKVLVKGADTSM

SEQ ID NO: 177610 - protein, 103 aa, Triticum aestivum
  Clone ID: PAT_TA_72028.pep
SSSIRAATNESRRRMMEALEASGSQLANAAKLSPWLQRTQSKHRPPARRSASRSAPFLPSSRSADRRRGREGGGAGGEPGPVPPVRCCLCLLRCRLRLGARGG

SEQ ID NO: 177611 - protein, 158 aa, Triticum aestivum
  Clone ID: PAT_TA_72029.pep
FRRMMAQALQGIQQQYAPSGLPVQKRYTKETAAQILQLDNMDSDTSPVRLIIKRKIVTYLKGREQFYNLHPRYLLAVSKSIDEQLYKDAESKIHYMDFETLEVRLNALLSRGSFGNSRYALASSASLPTSHSEQLGIKVTDSSIQNGRAVPGSVNPPP

SEQ ID NO: 177612 - protein, 78 aa, Triticum aestivum
  Clone ID: PAT_TA_72030.pep
TRPPHLFHPGLRPGSAGAATPVGHRRRLLPPLHRHTLAPSPVSISSGRTRLCTPSVLNSPTSCTVLRLTANRVREKTC

SEQ ID NO: 177613 - protein, 215 aa, Triticum aestivum
  Clone ID: PAT_TA_72031.pep
HASGKKRRKKVPDEEVLAEEQISSGNTSVIPQACQLDTTEQPSLNSDFEKEAIDIPESTANICAEVSPDAPMEIDPQISMSRKSKRKSKVQCKRNYVFCNEGADNLQAKKLLHCLSSESLRRWCTYEWFYSAVDYPWFMNNEFVNYLNFAKLSHLSRLTRSEWSTIRSSLGKPRRFSNHFLAVEKEKLEDYRQNVRKYYAELSDGLRDSLPTDLA

SEQ ID NO: 177614 - protein, 203 aa, Triticum aestivum
  Clone ID: PAT_TA_72032.pep
HASALPRASLISKRWLGIVSDPGFSRRFRLHHRHNPPLLGFFYHVSDFEPAMDPPNRVPDSHLSSCLETLDDDRIWYLMPLGSRHGLLLTFCELWNKLLVWDTFNVEQHHLAVPPGFDLEKAWASGAVFRAAGDNQYFQVVLVSTETADQQHTRAIARVYSSETGGWGDIVSTPLTPKASSSTMGEGEFPTKITMFLTISVLV

SEQ ID NO: 177615 - protein, 113 aa, Triticum aestivum
  Clone ID: PAT_TA_72033.pep
HASATAYPVGVCASNRILLVPPPPPGTIGLFPTATGHHDAMPHPLSLAPTTQQPIQLHRVCRTRCSDEIHARQYDGRRDKSLPTAAGTGDSTRRGARLGVGAGGVSLLRTIPL

SEQ ID NO: 177616 - protein, 187 aa, Triticum aestivum
  Clone ID: PAT_TA_72034.pep
MLRLRSSDEEAGFTDDDASAWMMAVIKRNARVIHLTGRCSEIASLDRVSFISCHLKVLKLSYAMLDYRILGQLSSSCTSLEVLGLKDCLVAGPRIVSASLKTLIMLECEISCAFSIAAPNLLLLHLITPYVRVPSFKNLGSLVTATIILDDSFLGDDNECISDEDYCDGTTDDDGDDSDNNDWTESS

SEQ ID NO: 177617 - protein, 171 aa, Triticum aestivum
  Clone ID: PAT_TA_72035.pep
TRPPTRSEKGAHETFLRNARNSEETLRKEAIERTDLSHLDGTLLNSIDTSPDSMYQVESTGAVVSLNSAVGLVHFYCSQLPSDRYSILRPEFIMQKHEKPGGSMEYSCKLQLPCNAPFEKLEGPICGSIRLAQQAVCLAACKKLHEMNAFTDMLLPDRGSGQGEKTEQNEG

SEQ ID NO: 177618 - protein, 39 aa, Triticum aestivum
  Clone ID: PAT_TA_72036.pep
LPAGTNPIHHCSCSLDNQESQLRPLLEEIGILGFLRTRG

SEQ ID NO: 177619 - protein, 150 aa, Triticum aestivum
  Clone ID: PAT_TA_72037.pep
MEMEEVVRRIKLGPGGGGGGGGGARRRKLGPGGGGGGADIISALPEDLLLQVLVRLRCAGAAARTNVLSRRWRGLWTSLPDLVFRGVALGSLQAALASVQAAAGPGVTLLDMCVPDALLHSVRESDMPPLLHAAAALSPVELRLAVGKGT

SEQ ID NO: 177620 - protein, 102 aa, Triticum aestivum
  Clone ID: PAT_TA_72038.pep
YPRVRPAADPRACPNPRPPSPPPATSATAGSRPWRASSCRSSSAGTGSPGRCASRSTPTPSPSPAPSSLPAPAPRRGSSPPAPLVCKPWMLQISGLLHVPPA

SEQ ID NO: 177621 - protein, 188 aa, Triticum aestivum
  Clone ID: PAT_TA_72039.pep
MDNGGPRRRGLKPSGAMEGKSSAKKKARTAVPATASLLTDDLILEILSRLPARSVHRFKCVSPAWRDLIADPAHRKKLPQPLAGFLYNTYHRPDPRFYNFHFAKVSGAAAPPVDPSLSFLPSDEYWYVDQLDTCNGLLLCRAHMLPSSPSGDKNTRVESHYIVCNPATGRWVDLPPHPEVPPGGRIFA

SEQ ID NO: 177622 - protein, 186 aa, Triticum aestivum
  Clone ID: PAT_TA_72040.pep
MGGAATASPEHRRELRARLLPPRHGLQGTAPLPIHDELVEEIFLLLPTPTDLIRASAACVSFYRLVATRSFRRRFRKLHAPPLLGFLDHEREFLPAIPPHPSAPAADAVALAADFYLSFLTRDPYFTPAHYWDIEDVRNGRVLISRHPFHDLSLAVCDPLHRQYLLLPPIPEFEGWASLYNLRTGW

SEQ ID NO: 177623 - protein, 157 aa, Triticum aestivum
  Clone ID: PAT_TA_72041.pep
MGGGAMEVDLTHGAVAAMSRLARGLRPVLQVVGAPASAGGTDRYRFLLSDGVHSQEGILVPSLDSLVRTGRLRDGTVIRVLDYVCNSVCGRRVIIVIQLEVVQTECTLIGSPSSYQVNAAQPNIRSGSLGIHGSRAEQGVTDMAFSPAQGLLRSSIA

SEQ ID NO: 177624 - protein, 38 aa, Triticum aestivum
  Clone ID: PAT_TA_72042.pep
HASDLCCNYREIHNDDLFCGFLTLNLDYYVDTTSTNNH

SEQ ID NO: 177625 - protein, 136 aa, Triticum aestivum
  unsure (1)..(136): unsure at all Xaa locations
  Clone ID: PAT_TA_72043.pep
NSRYKELKHCPRRSRTLGIRSWARLGAGGRAPPDDTATDWPPPRSSPRRPRTGAGRRRGTAPARRRRRGRPRXECRRAARTPAVAPPTACGGAPPAMAPRSPATAAWYPSSRPAPRPLSLNLRVCVSLLLLRPGVP

SEQ ID NO: 177626 - protein, 170 aa, Triticum aestivum
  Clone ID: PAT_TA_72044.pep
MEVAGEAKERAGGESAERRRKEAKSSSGIYDDSATSEQIAGNEDDNSMDHYGELFLPEYLTDEEIIQEYRIGWECRCYGMFGGFEDETTIKSMLTTYKTIPHALVSHTLQVYSIKVEKPKLGWPLRVYGMVAARDHVDYNRNFLFNRTSDNCQIITADEPYLTLTGPSGA

SEQ ID NO: 177627 - protein, 161 aa, Triticum aestivum
  Clone ID: PAT_TA_72045.pep
TLLFTRLLDKMDMRILMVGLDSAGKTTILYKLKLGEIVTTIPTIGFNVETVEYKNISFTVWDVGGQDKIRPLWRHYLQNTQGLIFVVDSNDRDRVVEARDELHRMLNEDELRDAVLLVFANKQDLPNAMNAAEITDKLGLHSLRQRHWYIQSTCATTGEGL

SEQ ID NO: 177628 - protein, 226 aa, Triticum aestivum
  Clone ID: PAT_TA_72046.pep
TRPIAPDLLINISKVPAQHQGIILRLVSKAIGECNTRKVDDNIALKYRSISGSDDGLVFADFCFHTILYQTPSQGIGCPAGLSVAQADRVTGKLPLKGDTLASRKLGILNVLEAMQLTSEIVYPIYLAGASDSQESVAKRGDELLKRKASTANLEDAKLINRLFTLFNGTASAENIAAELKVAPAPSSLRVRLMSVFCRSIAAANAFPYTLQCIFGCIYGSGTTSR

SEQ ID NO: 177629 - protein, 124 aa, Triticum aestivum
  Clone ID: PAT_TA_72047.pep
SLKLLPEHTHTRVHGYFEPHNIMADQDNPPCEGFEYISDLGERSYGSISGKIMNLSNGHHLVGQYVQEVMIKKGVHLKMKHFDILKQFQHSCAIPLLNFYPESMNMGRLIIPKVDDAFDNCFLG

SEQ ID NO: 177630 - protein, 195 aa, Triticum aestivum
  Clone ID: PAT_TA_72048.pep
HASASTFFLLRELLYPNSAAMEKPGYDPIEGIKRLRKKRKKGGSGDPTCLPLVTRCLLEGQHLHISAQVEKSGHIMVPKISEEPSKQIQSHMNAVNQFTQFHKKGQYIAHEDAEQVWWDIGANNRGQNEEGQYLAQKHADKEDQHIRAISNFQNKEGLSQLHHGGNNNEILHEQASYGHQSYTTLMQQMTLMSHL

SEQ ID NO: 177631 - protein, 155 aa, Triticum aestivum
  Clone ID: PAT_TA_72049.pep
MDGANLVRTRTIRSENGLKPAEHSSDNLQDMSSPCESPHAGKVKFMCSFGGKILPRPSDGVLRYVGGETRLISIPRNFSWKELVHKTLSLYNQPHTIKYQLPDEDLDALISLSCEEDLQNMMEEYYSLEKANGSPRLRIFLVSPNDCEETSLSAR

SEQ ID NO: 177632 - protein, 70 aa, Triticum aestivum
  Clone ID: PAT_TA_72050.pep
SWLLFSSVLGFNLGSRRLQLLCSPTQDFLIVQFKPCSSGIFLYIFFKRWSVDLAKGFSIVHGLLEYVLLG

SEQ ID NO: 177633 - protein, 72 aa, Triticum aestivum
  Clone ID: PAT_TA_72051.pep
EGGGAARSTAPSRSGESSCSRSLSGSSSRRCSSSCPPAPGVTFPATPTFSPLKFRLVSRWKSQYRSSLRTRG

SEQ ID NO: 177634 - protein, 188 aa, Triticum aestivum
  Clone ID: PAT_TA_72052.pep
MAGMLCVALLLASLVWPAALTAGSAGDGRRQQQQLTALPPRGWNSYDSFSWIIGEAAFLDNARIMANRLLPHGYQYAVIDFLWYRRIAAGSGVGAYGFDSMDQWGRPYPDPQRFPSGRGGGGFRPIADKVHAMGLKFGIHLMNGISTQAVNANTPILDVRTGKAYVENGRQWRARDIGLTHRTCAWMP

SEQ ID NO: 177635 - protein, 77 aa, Triticum aestivum
  Clone ID: PAT_TA_72053.pep
YSPYFFINVHIKCLWYVGSIVDKIESLLPAMTSWSIYIHVQHPKREMSSNFSLTFSGSTFSFTVESIWSAINQYEQL

SEQ ID NO: 177636 - protein, 45 aa, Triticum aestivum
  Clone ID: PAT_TA_72054.pep
MAIRRGSSCAVLALLALASVAAVSADVFFHEKFEDGWQSRWLKSE

SEQ ID NO: 177637 - protein, 137 aa, Triticum aestivum
  Clone ID: PAT_TA_72055.pep
MAPAMRPEQEASCKATEDHRSEFDAAKPPPFRIGDVRAAVPAHCWRKSPLRSLSYVARDVVVVAALAAAAWRADSWALWPLYWAVQGTMFWALFVLGHDCGHGSFSDSGTLNSVVGHLLHTFILVPYNGWRISHRTH

SEQ ID NO: 177638 - protein, 124 aa, Triticum aestivum
  Clone ID: PAT_TA_72056.pep
SRRKRARRPPGGRSPSAIARSPVGSGDTRGRRDERAATRSRVLGRGCRVRSGQAGGGLVAEVLGRAFIPGVSSSSISLQEYLSPDFYQVNNLSKLSFNSFILYTTPFVGEECASRNFRTNYGLE

SEQ ID NO: 177639 - protein, 193 aa, Triticum aestivum
  Clone ID: PAT_TA_72057.pep
HASENFKVGGFNLLMASNLKVLAVHNIIEYYPRSVAADLLSELAVEITRSKKLLPPTAGSLLQLERLNVDSISAVLVAPVCRLVAATLKELVITCDREVENLTEGEEKALQLLTSLQDLIFWRCPNLLSLPRGLHSLPSLTKLEVITCPRIKSLPEEGIPTSLQELTVIGCSDGLHDQAKELIGSKPDLSVST

SEQ ID NO: 177640 - protein, 108 aa, Triticum aestivum
  Clone ID: PAT_TA_72058.pep
MAGMAGKGDESVAPVRSSDRLRQRPKHYGRGYLFYSPNMRNKMNSIMKRTAASHIAKKLLRKPAVREPPADSIAPNLRRSTRKRRMSVTLEDYGTDSSSMEDDDLMRP

SEQ ID NO: 177641 - protein, 91 aa, Triticum aestivum
  Clone ID: PAT_TA_72059.pep
LSRWGRANRSSDDEYIVGMGYHVLIDQLKSNEKEIEQAKRRYVYILLEIEGITHVYERVIPECVWICCVCSKGKVVIRGICLSVLVTWSKF

SEQ ID NO: 177642 - protein, 121 aa, Triticum aestivum
  Clone ID: PAT_TA_72060.pep
MVKDVHEPRNGVSLNSSSSQSIVNSEKVCRGQIPELTWEHKLSHVRYDLPSFGLTWREVRQMAGLGLRLGRHILEETSKGRTAIIDPMKKRTARSGQGVPLGGIGAGSIGRSCKGEFQRWQ

SEQ ID NO: 177643 - protein, 57 aa, Triticum aestivum
  Clone ID: PAT_TA_72061.pep
IEQDTVLGKKDTYQCLFSHVMLQSRVSLLLCSETYILRIWLSFLKIIELLFSTTKRH

SEQ ID NO: 177644 - protein, 57 aa, Triticum aestivum
  Clone ID: PAT_TA_72062.pep
FGLVEHHVRFSLAQGFLCSLRMKGKEGSQCQKYKKAIKTNITTSCTSKQSNLPSKTY

SEQ ID NO: 177645 - protein, 48 aa, Triticum aestivum
  Clone ID: PAT_TA_72063.pep
PRVRKRYMGIAYLSSDMPHSRNICFSVFCINYRDETCNVLLYLANNQL

SEQ ID NO: 177646 - protein, 61 aa, Triticum aestivum
  Clone ID: PAT_TA_72064.pep
SSRQFQGSKGCQDLCAIYQGMNYDVYPIIIIVYAPFYYLKLNRNLLITGLQPFVIHGLKTM

SEQ ID NO: 177647 - protein, 38 aa, Triticum aestivum
  Clone ID: PAT_TA_72065.pep
MAPLAARSRRPACLLALLSVAAALFLTPPALAAGGGGG

SEQ ID NO: 177648 - protein, 98 aa, Triticum aestivum
  Clone ID: PAT_TA_72066.pep
KLFEKSQLLKLQWINHLKLTRMLWLKLRAKPSKSTLNRIVRILGKRRRELASFNSLRLRKLGRRRSFAGLLKEKFLLQRLSQQPLLHLLRQVNKMWMF

SEQ ID NO: 177649 - protein, 49 aa, Triticum aestivum; identical to SEQ ID NO: 147490
  Clone ID: PAT_TA_72067.pep

SEQ ID NO: 177650 - protein, 97 aa, Triticum aestivum
  Clone ID: PAT_TA_72068.pep
MSTAEATREENVYMAKLAEQAERYEEMVEFMEKVAKTADVGELTVEERNLLSVAYKNVIGARRASWRIISSIEQKEESRGNEAYVASIKEYRTRIET

SEQ ID NO: 177651 - protein, 46 aa, Triticum aestivum
  Clone ID: PAT_TA_72069.pep
PTRPLVLDREGPPFFFFFCDGMWHFGHIFPLLLEYITLHHLLIKTI

SEQ ID NO: 177652 - protein, 85 aa, Triticum aestivum
  unsure (1)..(85): unsure at all Xaa locations
  Clone ID: PAT_TA_72070.pep
QTIKQPISKPPPYESPLGNPNLTPCPPGPLPEADGDDDDEVAPPGPPPASRTTPTPPXPPPPPAPPDGASAGAFPRAPRRRGARG

SEQ ID NO: 177653 - protein, 213 aa, Triticum aestivum
  Clone ID: PAT_TA_72071.pep
PRVRRPIGFVHLKISSFSESKSDDKRFYIITPTKTLQLRTGCVKDRVAWIEALVSARSEYSLGGILPSDRNGGSFSTEKLRDRLHAEGVGAEIVKDCEQIVHSEFSQYHVQMKQRCESYLSFIGSLPRELEAVNSEDATIRGNPQSQLFKPDFSSSGKCSEYSNTESSEDAGKQEIGRMSDEDEFHFYDTRQSFSDGVASPELKVRYLNYGNE

SEQ ID NO: 177654 - protein, 87 aa, Triticum aestivum
  Clone ID: PAT_TA_72072.pep
ALEKARRDKEKERQCAALRRFKERRHSREEGGVVVLCDSDDDDDAPPPVRQGDAGQGSSRGTRVKEEKAADDDGGDDFSHFFYFRLS

SEQ ID NO: 177655 - protein, 141 aa, Triticum aestivum
  Clone ID: PAT_TA_72073.pep
HASGCDGFTARGLAVIAEGCRHLRVLDLTEDYFHEEESEVVDWISKFPECNTSLESLVFDCVSVPFNFEALEALVARSPALRRLLVNDHVSIEQLRCLMARAPDLTHLGTGSFRSEPGPGGALSVSDLATFFAASRSLVCL

SEQ ID NO: 177656 - protein, 71 aa, Triticum aestivum
  Clone ID: PAT_TA_72074.pep
MADVEYRCFVGGLAWATDDQSLQNAFSKYGDVIYSKIITDRETGRSRGFGFVTFASDDAMRQAIDAMNGHD

SEQ ID NO: 177657 - protein, 169 aa, Triticum aestivum
  Clone ID: PAT_TA_72075.pep
MAAMRTLHTAPASFIVPPAPHLVSPTPTPRAGALPAKAPPAAAATIQSHARPPLSPRVGRRRPCARAASSGGAVVASLEDAKRDVLIALSQIIDPDFGTDIVSCGFIKDLEISETLEEVSFRVELTTPACPVKDMFEEKANEVVAALPWVKKVNVTMSAQPAQPVYAGD

SEQ ID NO: 177658 - protein, 208 aa, Triticum aestivum
  Clone ID: PAT_TA_72076.pep
PRVREKYFETVVALMSDKIDGDLPLDQLKILTSKESKTENTQYYLQIWPEKKQVQITNFPHPYPQLASLYKEMIRYQRKDGVQLTAKLYLPPGYDQSKDGPLPCLVWSYPGEFKSKDAAGQVRGSPNEFSGIGATSPLLWLARGFAILSGPTIPIVGEGDVEANDSYVEQLVTSAEAAVEEVVRRGVVHPDKIAVGGHSYGAFMTANL

SEQ ID NO: 177659 - protein, 182 aa, Triticum aestivum
  Clone ID: PAT_TA_72077.pep
MDDSSSQSGSCGAGDARYGKDVAHAAAPCPVAHPEGSSSTAKSADPPAPTSRISVKHAASVIQKFDDYKKWLVEQIGFGGMLKLPAVQKLSLKCSAWIMSRVSVSRREMKLRDNKVLRFFPEDVHKVFGIPWGHRSVKGRDAIINPEAVHFIKTTLQMDKTGVHSLRAAENFLLRDINENSS

SEQ ID NO: 177660 - protein, 194 aa, Triticum aestivum
  Clone ID: PAT_TA_72078.pep
TRTDVLTSLAGVGTTKRKELHGTTRVCGLSGTWASERTAVKLQGYRMKFLCDQVGQKYSNFVLLIDKTIAHEAANLDIDLFLHDKMVKASVSPCGLFELDVQQLEQAKLFQALLFNGLFGKLFTGSKSSGVPREFILSKDDTFIWNNPNMYLILPMDPTVESHDISCINWRVIDEAATAVKLLRKIYSEEKMNI

SEQ ID NO: 177661 - protein, 83 aa, Triticum aestivum
  Clone ID: PAT_TA_72079.pep
NRSANWTLECNQPLLICAAILGSTRGRNLIPLSSTAPGIADADQDDTHVVRYPNCFNSKCRLIMRTIVNSLRGVSNAGAPSVQ

SEQ ID NO: 177662 - protein, 94 aa, Triticum aestivum
  Clone ID: PAT_TA_72080.pep
TICYYYFSQKQMVHNWYVIYFQLSEYVLVFSYSLHFKISVLLAPPSFVKITVLHFQSSNAILANVFLLALKNVKKKSVLARPCFVEEKENLMAL

SEQ ID NO: 177663 - protein, 210 aa, Triticum aestivum
  Clone ID: PAT_TA_72081.pep
YDCDVHSSNIFERMVNGLLKTAQGPPAGIATTLVPPQDTTMKSEAMKCLVSILRSMGDWMNKHLRIPNPDSPKIESKQNDNDGGNEFPQTEINGDASSEVSDSHSKVSNGVSEAASLEQRLAYKMELQEGISLFNRKPRKGIEFLINANKVGESSEDIAAFLKSTSGLNKTMIGDYLGEREDLSLKVMHAYVDSFNFQNMEFDEAIRAFL

SEQ ID NO: 177664 - protein, 101 aa, Triticum aestivum
  Clone ID: PAT_TA_72082.pep
TRPKEMKNGWRKGTSCFSFPFVSLFDNYSLRWEGLGIETSYSLIPFSVNGSTASAAVCSSLYWLCLCLPRALRHTRVCGLRAATAVFMVCWLDVCVCARTS

SEQ ID NO: 177665 - protein, 89 aa, Triticum aestivum
  Clone ID: PAT_TA_72083.pep
PEAPPAPLPVRHPPHRPEPRAGMENPDGQAEADAGLPPPPPPPLDAEGAGLGIYPAEVLPPPPPHLPGGAPHEVAAQGADGSAYPADHA

SEQ ID NO: 177666 - protein, 140 aa, Triticum aestivum
  Clone ID: PAT_TA_72084.pep
PRVRRRVHLVRETHSSDLALNKPWRGRYRSGPSGTASVLLLLALALSALVPAPDAYDSLDPVGNITIKWDVKKWSHDGYEATVSLYNYQQYRHMQAPGWNLGWVWAAKEIIWKMSGAQTTEHGDCYRFREEPTPDCCRTD

SEQ ID NO: 177667 - protein, 172 aa, Triticum aestivum
  Clone ID: PAT_TA_72085.pep
MSPSSSAAKTVAFVGADGLSAALAASFARSGAIVRFYIDRKADGSAATALAEQGGGVRCVSPAEATRDSALVVVLSDADGVDELFFGAQGIVQGLCKEAVVLIRSTLVPSHLEKLGQKLADEKKGIFLLDAYIFSGLSDELKQNIVVVASGRKDVAERAGQFFSDLDKTNYF

SEQ ID NO: 177668 - protein, 75 aa, Triticum aestivum
  Clone ID: PAT_TA_72086.pep
PDDTGLALAAVLRMVTRASPHLPRMVNLAPSLKSKCEEERAIGVVAIASKRFVCVRRPCSLRVGLWWRKRGRTRG

SEQ ID NO: 177669 - protein, 74 aa, Triticum aestivum
  Clone ID: PAT_TA_72087.pep
LHSKWALITCCGQLKERELSCCQCCWKIKIYMYTKYMYERSFGISKTLTAFTLALHLSNLTVISFMVTDNLTLD

SEQ ID NO: 177670 - protein, 50 aa, Triticum aestivum
  Clone ID: PAT_TA_72088.pep
LRHQVTNVNSKDKLINLQAWQSDKHPNNINMNIFLKQLYLYFNLQFNQVV

SEQ ID NO: 177671 - protein, 49 aa, Triticum aestivum
  Clone ID: PAT_TA_72089.pep
VERSRTAELIEGAREKASPLASAREGLAFFSVPLLVSPPPLSSNNRTRG

SEQ ID NO: 177672 - protein, 140 aa, Triticum aestivum
  Clone ID: PAT_TA_72090.pep
MAETGDDKLAYFQAGTGIFDPDLWTEILGGNNWDLQLAVFFITGEPFLPEPANYAPAAPASVESDSIGYHPPGPGSEQQQQPGIAWRLVTLPFYVVFGGGGLVTGSIRLGGWVASGVLARSLFLLGLAQRGGDRLLELAP

SEQ ID NO: 177673 - protein, 102 aa, Triticum aestivum
  Clone ID: PAT_TA_72091.pep
MRSCTTRTLKRLGEASKFNITSSGHGQGLHLIFCCSQAIFSLCVSLCSGFYRGISPGATGSFATGATYLESTKTWMEHANPNLRGHWSHFIAAGIGIAIIFL

SEQ ID NO: 177674 - protein, 159 aa, Triticum aestivum
  Clone ID: PAT_TA_72092.pep
MSKQQQSSVCRCDEYSRQFDYSEMAMLNHSDMSPCKLSKSMVAVIAILTVFVASLGTITIVLSRKVRLLGRRPRIKKRIVVNKSITPLTCRPPQQENQQCEITIENCCNMNICETPCFEPDFRPPKMGGLMSLGKSKKEDKANLLSNTDMSSEDEKPLY

SEQ ID NO: 177675 - protein, 96 aa, Triticum aestivum
  Clone ID: PAT_TA_72093.pep
KANGLCNEHPYIIRKNNKMAMNNPYQEQNYKAVIVRQKHPSKRLICTIWLPFLEHGSSTILHAHHEIRTSFFSCFLQNKGKFSTGESIWYGHKAFI

SEQ ID NO: 177676 - protein, 76 aa, Triticum aestivum
  Clone ID: PAT_TA_72094.pep
PRVRSLLLHRADHEQQLVECKPPLSPSPSPSSSSSPTGGAAGNPGRSWPTWISWRAAPPPCTGTILMSSVTSSWCS

SEQ ID NO: 177677 - protein, 52 aa, Triticum aestivum
  Clone ID: PAT_TA_72095.pep
TNTREKKKTNLNWGQEVRTKFYEHPCLALKTITSYYCSDKVVFCKLKTKLLI

SEQ ID NO: 177678 - protein, 230 aa, Triticum aestivum
  Clone ID: PAT_TA_72096.pep
FRQPTLPVFTGILCYMGKGFTAGLSWGGKIDLDSLFIAHYMCAIIPYPREAATFENISKDVHAVIYSLIELYRIDNKLPPYFDDLVSYAERIPNNIATDPAVLEEFLVELINHGSFQPDPNIVAALQEFHSTFKNLGIDEQEDFTEEAEAATLVLPANWPNTVQTDRLLSLIFSRSHALLRTFASEVAFHRHFTVHVIDIIVTPQELQCVVSKPLQLFPTPMDLLHWIFH

SEQ ID NO: 177679 - protein, 200 aa, Triticum aestivum
  Clone ID: PAT_TA_72097.pep
PRVRGRVGDPAAPVRTMCSTDCLVQDGDWVQPVHLVDKSKTWSLPPVRKWIKQQPWPPPIRVQIAMDDNIQVVGIVANDDTGYVWWPPDYQPMVWSKVQKWLLPIPRCLTDFATCFATGPVMIFLDKGIADSQVLLKCNLALHAGSLDSLCNTTTSLPAYKTLQWFVNSFHFPGCIGISAFHSPIAMWCSDARSLSDHRA

SEQ ID NO: 177680 - protein, 192 aa, Triticum aestivum
  unsure (1)..(192): unsure at all Xaa locations
  Clone ID: PAT_TA_72098.pep
MDVPTTPCLLLSPTSKDLITGSSFASPPSPTSSSPDPASPLDAFASDPVLSAFLSPSFSPSDFSSDELYSGLAASRAEQLQDAIRLLRRHLRAEVLRRHPLLLXHLLSLRSASASLSSLPYNLRLLFSHLSLLSSHLSAPRAHLALSSYSLSSLLATADLLLHSHRLVRLSSRLLASSPAPDLARQAELHRE

SEQ ID NO: 177681 - protein, 22 aa, Triticum aestivum
  Clone ID: PAT_TA_72099.pep
MIKRRYYRQDHGDNSASSSSYY

SEQ ID NO: 177682 - protein, 81 aa, Triticum aestivum
  Clone ID: PAT_TA_72100.pep
VTRFACSVAFPTCSRSMSANIQRLVTADLQRSSNLSLSFTHPSFTATMSASICSSMGMIMAACFLRYHGFSRRTTSSDTRL

SEQ ID NO: 177683 - protein, 66 aa, Triticum aestivum
  Clone ID: PAT_TA_72101.pep
SKAVIKRGPIDEDELIHALLKYESIRIQLPKAHHQFNDFTVKSKVIILSIMVKMVGTSLIFTLGYI

SEQ ID NO: 177684 - protein, 105 aa, Triticum aestivum
  Clone ID: PAT_TA_72102.pep
PSCPIHQAGRSSNFESHQADAAPSTGGTTPSPLQHLDLEISLRFVDESRWGVIFMDLMFSFCSQPVDVDAVPDLGGLEEGQGGDECGDGGEDEDTDSPSSSSASH

SEQ ID NO: 177685 - protein, 198 aa, Triticum aestivum
  Clone ID: PAT_TA_72103.pep
PRVRGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLY

SEQ ID NO: 177686 - protein, 168 aa, Triticum aestivum
  Clone ID: PAT_TA_72104.pep
MKTFLIFALLAVAATSAIAQIENSHIPGLEKPSQQQPLPLQQTLSHHQQQQPVQQQPQPFPQQQPCSQQQQPPLSQQQQPPFSQQQQLPFLPQQLLPFVHPSILQQLHPCKVLLQQQCIPVAMPQSLARSHMLQQSSCHVMQQQCRQQLPQIPQHFRYEAIRAIIYSI

SEQ ID NO: 177687 - protein, 135 aa, Triticum aestivum
  Clone ID: PAT_TA_72105.pep
TRPPGSRCRPPPSPPPILARPAPTFSLTPGASRPPYSPSLPAPPRPHLLPHSRCRPTPNLPGSACVDAGFAAALDVERAGVSSSTTTQPQRRRTRIPSQQAHAAMDPWVRIPPLLSEGRTLLCYFLGRHGRNLKL

SEQ ID NO: 177688 - protein, 53 aa, Triticum aestivum
  Clone ID: PAT_TA_72106.pep
MVNISHTHSEVLGYRHTAIPRILQMMLFGRRDQMNKLKSVEPDHGPHLARGRV

SEQ ID NO: 177689 - protein, 121 aa, Triticum aestivum; identical to SEQ ID NO: 167940
  Clone ID: PAT_TA_72107.pep

SEQ ID NO: 177690 - protein, 154 aa, Triticum aestivum
  Clone ID: PAT_TA_72108.pep
SAKPPVLSDQGVGSLRPGLLPIPATPGLKITSGPTAQLGSLTGRSAWASTQFGNQQGPNEKAADSQIVVICGVHSRGEVASVSSQRLRDGGSGGSSKLGYLWSTLVTPIVKSLATGTLQSHGYYSCCCLGGENRGISPPEPDPHPVRSPIRTRG

SEQ ID NO: 177691 - protein, 119 aa, Triticum aestivum
  Clone ID: PAT_TA_72109.pep
PRVREDAWSEGATSALIDAWGERFVALGRGSLRHPQWQEVAEAVSSRDNYSKAPKSDVQCKNRIDTLKKKYKIERAKPVSSWQFYDRLDVLLAPTYNQKPAAHPNGRNAVPTALRAGFP

SEQ ID NO: 177692 - protein, 147 aa, Triticum aestivum
  Clone ID: PAT_TA_72110.pep
TRPPTRPVVLAIPLCTRNVSDFWAWYYEKNGAFTVKSAYKMLVATKQRREAWLEGSAGTSNSIAEEGSWKRLWKTEVPGKIRMFLWRLSKHSLPTNDVRANRHMATSDQCGLCGNRDSWRHSLLECSSSRSVWALIDEDVTHKIIGS

SEQ ID NO: 177693 - protein, 136 aa, Triticum aestivum
  Clone ID: PAT_TA_72111.pep
MSGNKKAGDHPVADAAWPARRRDGMGRAGVLLIACLFTLPFMALLFGGRAGALAVWQNAAKLTAMGGGLLNVSRQSAAGADELFGGLLSPGSDRRACLSRYQSPHYYKHSPYAPSRHLLWKLRDYEARHSRCGPGT

SEQ ID NO: 177694 - protein, 138 aa, Triticum aestivum
  Clone ID: PAT_TA_72112.pep
TRPVDAPARADKRAAPATTTTTTPPPSSSGGNTTTTTSSRAAVAAPEPAACNLYQGWWTYDAEASQVPLYREAECEFLTEQVTCMRNGRRDDSYQRWRWQPSSCDLPRFDARALLERLRNKRLMFVGDSLNRNQWESM

SEQ ID NO: 177695 - protein, 202 aa, Triticum aestivum
  unsure (1)..(202): unsure at all Xaa locations
  Clone ID: PAT_TA_72113.pep
HASAEPERSPPIPPQPPTCFLLFPDSPAAMSTPCAAPPPXSQPPCHPAPDPAVAAPPPTDLAVAPPRSNPSFRPRARLHLAAPRRPPXPTSARRDPSAARQPPTRVPRRRXLPPRDPPPPSTVTFLHLPPRPSPXAARPSPPAVPPASPPPLIASPRVRLPPVPSXPPPAEXSPSLLPPGPYVPGVGHVHHPQTHTSRRVEL

SEQ ID NO: 177696 - protein, 164 aa, Triticum aestivum
  Clone ID: PAT_TA_72114.pep
MLDFGSKVAMSKIFSVTCEPPPHRTRDPAAPAPAWVFLEPQAYLADVRNATTAEAFSSAGHTVQVTVCVSDPLDVSYLCIHCPGVPEANCGRPSIVCSENDFLILSVLFMPALRGCEYFVYKAGPVPSLRLLPGPYPRVLTSSDLGLLPRDDGDHFVLAVLCYL

SEQ ID NO: 177697 - protein, 151 aa, Triticum aestivum
  Clone ID: PAT_TA_72115.pep
PRRPCPRATTHSSSPPEGRPPLFLRPSRRPQSAPSAAGPPRSSRPRRRISTAISAYTSPPSASHPWRSARWTTHCRPPWRTSAPRRPPSCSPRHLLSPSPAPPLGVEPTMEYVRSVDLLPVLGPKARATGLVAGLDSRDWVMVCEALNDAR

SEQ ID NO: 177698 - protein, 134 aa, Triticum aestivum
  Clone ID: PAT_TA_72116.pep
PRVRPSSRSPRVALRTLAARTRSAALHLAPRSSPPATIGASPSAPRVLYGKPAVSPSRPRLHTPHACAISSNASWIGACWWICVAEHTVEFFIGFIHPVLDISCIRISDKQRELLCYMSMWTSQIYHGWEMIDL

SEQ ID NO: 177699 - protein, 83 aa, Triticum aestivum
  Clone ID: PAT_TA_72117.pep
IGAHIRGRHRLTKHIVARIETSSPACQGCSARARLEGAWTLLRTSECRPVSSACHGFDNILKNQFVLHYSLEVASRWHRIKDS

SEQ ID NO: 177700 - protein, 173 aa, Triticum aestivum
  Clone ID: PAT_TA_72118.pep
SDWSMPLFLPPFSTGGGGPIHVMSVFTSLSSSKEVSGKAGVLMHINFWISLLKGRSISFSKLPEVPTCPSNSISNSSQERVASTLSVPPPATPAAAAAASPSPSPSPGPARETTSCRHRSATRSRVSSGAPARDSGKTPTSALMREKSRASSPARASATQWAAPRQAEKGGRV

SEQ ID NO: 177701 - protein, 181 aa, Triticum aestivum
  Clone ID: PAT_TA_72119.pep
RLKNDVRVVDKVPGFIMERFSNNLSNVYNFKIKAWSPIQYYKDVVLPKLIEERLIRISPFANRLSVDAPPAVQRLRCLANFEALKFSKPITALSDTLISRMREKSVENNGKYVAVHLRFEEDMVAFSCCVFDGGDEEKKELDEARERGWRGKFTRPGRVIRPGAIRMNGKCPLTPLEVGLM

SEQ ID NO: 177702 - protein, 194 aa, Triticum aestivum
  Clone ID: PAT_TA_72120.pep
GFAEKLFSRLQKCNERFEVRMMMLKVIARTIGLHHLVLLNFYPYLQRYVQPHQRDVTTLLAAAVQACHEMVPPDAVEPLFKQIVNQFVHDRSRPEAIAVGLNVVREICMRIPLMMNEDLLQDLVLYKKSHEKAVSIAARSLITLFREICPSLLVKKDRGRPIDPTARPKAFGETTIASDVPGAELLDEEMSPEG

SEQ ID NO: 177703 - protein, 70 aa, Triticum aestivum
  Clone ID: PAT_TA_72121.pep
KVSDENYFTNCDCLQEWFSWRTKILTVGEPSWKNHDIKVECNISLFLFYKMTWPYEKYELSFSPYEKRTR

SEQ ID NO: 177704 - protein, 228 aa, Triticum aestivum
  Clone ID: PAT_TA_72122.pep
YPRVRPRVRVIGIHGIGGSGKSTLSQLVCAREEKDGHFNLVMWVHVSQDFSVDTIFRQMSEAASRTPCPQFNNLDTLQTNLQKKLHGKRFLLVLDDVWYNNRDVRQYEKLQQILSPLNAGEAGSKILVTSRTKDALIALGAAEQRCIPMSLLDEDVFLKLFKHYAFHNVCVAADDRIRLEDIATHIAKKLKGSPLAAKLVGGQLRMRPNIDYWRSSRDGNHLDDTMGA

SEQ ID NO: 177705 - protein, 75 aa, Triticum aestivum
  Clone ID: PAT_TA_72123.pep
VSTSRNSSSCCHIITSIVIGKSMYRSIVSLYSAHALIFVFGLILPSISCYVWITRVSNLKLSSLLYVHLHRWLNL

SEQ ID NO: 177706 - protein, 110 aa, Triticum aestivum
  Clone ID: PAT_TA_72124.pep
EHMSSLFKCVFEASENSKQILHVHFRAHYVSSMFCEETSFDLPSAPKRQERAKKQLHLLYFSVAQATEMKQVSSCFRILKKSRSSMIDYSVNLQSHKYEPSICVNFLETF

SEQ ID NO: 177707 - protein, 139 aa, Triticum aestivum
  Clone ID: PAT_TA_72125.pep
MLPRPPSHLLPWRCLLLLLILALAGSSNGVSATAKAKAKAPAAAPKPAGFGYKLVSLVQRPNGGGLVGFLQVKRRTSTYGPDIPRLTLFVKHETMDRVRVQITDAEKQRWEVPYDLLPREPSPPLGATDDSAPFTDGEY

SEQ ID NO: 177708 - protein, 158 aa, Triticum aestivum
  Clone ID: PAT_TA_72126.pep
PRVRVTSLNQEIVRALAREGIPSVGMSPFACGWSTQRRDLASANASQIIESLHAGFVPVSYCTLGSLVIISVEIFFDLSLQPKYGNYVNHMRQKCCFWILVAYSLDLCLMSIVYMDLSLMLLVSCNDSQYIYVPNIALGVLLSNRSVLTFEIARTVFQ

SEQ ID NO: 177709 - protein, 215 aa, Triticum aestivum
  Clone ID: PAT_TA_72127.pep
PRVRPRVRPRVRPRVRGRVGSHSEYLDLRKTLDEDHRSTGGLNFVTNCCGIIGFIKFLGPYYMLIITEQRKIGAIFGHAVYQVTKTAMIQLSNSKMKQTLLNSNDENRYKKLLQTIDLRKDFFFSHSYHIMRSLQKNFNDPQAGWDLYDTMFVWNEFLTRGVRNILQSTCWTVALVYGFFKQDKMKISGKDIMLTLIARRSRHYAGTRYLRRGVN

SEQ ID NO: 177710 - protein, 65 aa, Triticum aestivum
  Clone ID: PAT_TA_72128.pep
TRPMVSNCSEIDTSTWSARPVSKRMTSGTSRSSLIGPRRAYTLTAINRSSSPEPQRSPSNTPAVS

SEQ ID NO: 177711 - protein, 55 aa, Triticum aestivum
  Clone ID: PAT_TA_72129.pep
KDCDPYLFRLLLLLSAFVYPFMFFSNLSSRLLIGSISLGFYFFYNRENCESSKKR

SEQ ID NO: 177712 - protein, 118 aa, Triticum aestivum
  Clone ID: PAT_TA_72130.pep
YLHQPAEINSSRVQPGADTLKFPAQRHGSALTAAAARGTAEPAPLDPARSPASRSLKCSPRAARSGKRRGGGGVFRGAGDGGGGRGGLDWWGRLAAAGDRTDGRTWEHMGRVGNRTRG

SEQ ID NO: 177713 - protein, 171 aa, Triticum aestivum
  Clone ID: PAT_TA_72131.pep
AASTAVVAARARSQHSAMKTDQLASHQPQKVPATCDENHFIALLSLLELRVNCLASKTSVSLCYSCFCGGGLEITRETPPAEMIARAACPRRRPPPPVLWRLVAPCSAAPPLPVPCIRRAPRDSPRRIPRQSAAAPPRRHSTPRHSSSPPRTLLRAAAPPRHRRRRHSSLL

SEQ ID NO: 177714 - protein, 207 aa, Triticum aestivum
  unsure (1)..(207): unsure at all Xaa locations
  Clone ID: PAT_TA_72132.pep
TRPNPSSPDHTSLNPLPARRHQPKPRRRRXPTSAPPPASRLTPXPGEPPPLPVPHPKPQRRAPPRRRPPPVSRAXSPTTRTSRRRPPPPGCPPLRTDPVLPELPLGRMNTGQRHLCWEEQNRGADTRNSKSCLTRPPPRFSLRRSVPTPRIPPPVPLLNSGDAKSLHHLGSLPTQPVAASSSSSRSRSSVEDSRCRLCNPCLSIHRT

SEQ ID NO: 177715 - protein, 84 aa, Triticum aestivum
  Clone ID: PAT_TA_72133.pep
SLWQYVLVIQHDDTVKALKLQCIAFDDVVGHDINCMFPVCFVYTLHHPVNAQLLQLLQPHRWKSITLQLTWQELRKECPGPPSI

SEQ ID NO: 177716 - protein, 185 aa, Triticum aestivum
  Clone ID: PAT_TA_72134.pep
HASAHASASGQSLPASSSSLAGQQVANVHSYGTVDFERRPALRWSSLYRRVAMGHGGRPVGRTLADWDEGERRLDKWELCRIARELRKFRRFNLALEVYDWMTDRRDRFSLSSSDMAIQLDLIAKVRGVPDAEEYFEKLPDPLKDKRTYGSLLNVYAQARMKEKTEYTFEHMRKKAFATDTLPFN

SEQ ID NO: 177717 - protein, 176 aa, Triticum aestivum
  unsure (1)..(176): unsure at all Xaa locations
  Clone ID: PAT_TA_72135.pep
TRPIKKKKITILLPLQLSSPEHLIPPPPSDPATARPPQKPTPPPRAAARHPRMPPPTTLPDRXPPAAAPPMGLSPPLSIPGRHRRRPSRPDALLAAALHPRTPPPTALPAPMHLSPPSPRCALDRPPPPPSNPTTLPPPDLHHPSQPATASPGSAALDWDPPSPSKPCRWTPPPTS

SEQ ID NO: 177718 - protein, 145 aa, Triticum aestivum
  unsure (1)..(145): unsure at all Xaa locations
  Clone ID: PAT_TA_72136.pep
LLGHRALIFDSLEGIKDKVTASRTDSWISAAGDRAMCLLAPCCVLRDLTGSFPVRFLVAFGRCSVQVYLEGTHIVILWFERXVIYDVRARPNLMESTSGXRCHLHMVRIGLRVLSFLHNPCQRLPTMXRTVGDNYNDRVLPSIIH

SEQ ID NO: 177719 - protein, 133 aa, Triticum aestivum
  Clone ID: PAT_TA_72137.pep
FSLATGTRIAKQGKRHEASEPGTVTVTATARNGPVVVSSRIPSHPSLPFPSPTRPSPRPARPYIPPAAVGTSLCLLSAPKRVRRPQAFFLPPPSSREPLHARTIFASARPPVREPRRRVTPFILRHRLPISRA

SEQ ID NO: 177720 - protein, 68 aa, Triticum aestivum
  Clone ID: PAT_TA_72138.pep
TRPLHSILQKVKSTPELLHLGCKLFPRCSFWLPPKCDTQNMAYDCWHCSFIDSLFVNQSIFSGFMRFP

SEQ ID NO: 177721 - protein, 104 aa, Triticum aestivum
  Clone ID: PAT_TA_72139.pep
MSSGDGIDGDEKSEETHGKDIRRIKCEFCTVVRSKMYLIRAHMVAQHKDELDASEIYDSNGEKVVYGVGHTCEECGACFRKPAHLKQHMQSHSKEGLDNRYLTA

SEQ ID NO: 177722 - protein, 102 aa, Triticum aestivum
  Clone ID: PAT_TA_72140.pep
TGPAEGGLALSSADAGATGGGGGGHGGGHGRGRGRGSYRQTVCRHWLRGLCMKGEACGYLHQFDKARMPVCRFFRDYSECREPDCAYKHSYDDGKECNMYKM

SEQ ID NO: 177723 - protein, 175 aa, Triticum aestivum
  Clone ID: PAT_TA_72141.pep
MAPTVMGSSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 177724 - protein, 115 aa, Triticum aestivum
  Clone ID: PAT_TA_72142.pep
RQQHHNVSHGGGSTMLAFLLKVIGTPTCRAASRAAQVAATARTKARRSTSRGCFWTEEKNRRSPLPRSPIQHRRPPPAASVSNPPPPSSSRCSSTDRATPPTDRAPPLTDRAARL

SEQ ID NO: 177725 - protein, 82 aa, Triticum aestivum
  Clone ID: PAT_TA_72143.pep
HLPPSRDRSRPWPTSTGPAIETTTGLARERGAAGRVRSCSSSELWWRICTGPLTASRPVGLGSPHLSLPPRPPWAKTIRTRG

SEQ ID NO: 177726 - protein, 76 aa, Triticum aestivum
  Clone ID: PAT_TA_72144.pep
RTSPPPPWPPRAPAPPPREEEAAAIAATPPTAAISLPSRSPRSVIRSFPPSQLLRAQDDGTRAARGVGSMDRSMIS

SEQ ID NO: 177727 - protein, 95 aa, Triticum aestivum
  Clone ID: PAT_TA_72145.pep
TRPPTRPVCSHMSAHRARLARWLQLLAAKGVQDLALVNRPWPRDVPLPATLFAVTTLTRLYVGMWTLPGTAALRGASFPHLRELGLGCVEMEQGV

SEQ ID NO: 177728 - protein, 32 aa, Triticum aestivum
  Clone ID: PAT_TA_72146.pep
MRECMTIHICHPGIQVGNACWKLYCLQHGIQH

SEQ ID NO: 177729 - protein, 68 aa, Triticum aestivum
  Clone ID: PAT_TA_72147.pep
MPWCSQYSFQHAVPTWMPGRLMWINMHSLMAGSSAGRSTEPLRKWAKSRSNARLRVETRVSRRLSGRV

SEQ ID NO: 177730 - protein, 162 aa, Triticum aestivum
  Clone ID: PAT_TA_72148.pep
MDFDEYDYLEKAVEPSVPSTNGGGEKDRSSRRRSSTAGGGGRDQEERGSKRPRSGEDRERHRSGREHRDREDGKEKVDREKAREKDEGRDREKVREKDGGRSREKVREKDESRDPEKVREKEEGRDREKVREKDGSRDREKVREKEREGRDKLMERDNGRER

SEQ ID NO: 177731 - protein, 195 aa, Triticum aestivum
  Clone ID: PAT_TA_72149.pep
TRPLRAPPAARMPAADAELPAAASPPALPQTAPPRTATSTPEHPDLQPRPSLGAPPSPKVKAGGENRDPWPPGAKASFSGEVERGLGSVGAEPSRLASPTSTPPAPPLSPSESPEADRTVTVSPISRSTSSPTGMWPELSPDKQDSLCQQDDHSQGGDTSTWSWPNLPEDIWCLIHSLMPLRDSAPSACVSRTFL

SEQ ID NO: 177732 - protein, 221 aa, Triticum aestivum
  Clone ID: PAT_TA_72150.pep
PRVRPRVRTNTASKRTNALQNPAVMAAVRGGSYDSTTAKNNASALVTSDQINNFISNINLLDQIGIFELNHIFAHSQRLNSNAIVAFVEALCKVAITELQSPTDPRIFCLTKIVEIVHYNMNRIRLVWSRIWKVLSDFFVSVGSSENLSVAIFVMDSLRQLAMKFLEREELANYNFQNEFLRPFAVVMQKSNASEVRELVVRCVSQMVLSRVNNIKSGWKS

SEQ ID NO: 177733 - protein, 229 aa, Triticum aestivum
  unsure (1)..(229): unsure at all Xaa locations
  Clone ID: PAT_TA_72151.pep
HASENTEENQGQQAELSQELDSVMIHPREHVDEECEEEKISLAELKQESDSAALASLEQVTEISSENTENHVEQPELMHLSTFMAAGVLESPGVNATADQDDIEVDPTESLLPSLHQLSDGHSISSDKSSSDCSDVEDKRVSDTPTDIEDISYLXELPDPKAVTADTRSVDSSVANMFTDLESVELVSVDQLKSALGAAHKSLSTLYAELENERSAAAIAADETMAMIN

SEQ ID NO: 177734 - protein, 190 aa, Triticum aestivum
  Clone ID: PAT_TA_72152.pep
TRPKPRRVPSVPSRDEDDSPSPCRGTSSETMSPESEPQRTVMSRPTPAEFRVFKPTGLMDAATQTDDLGRRSARRVPEMHKKSLSTDHDAVVRDVTEYRQQSHPRRSAKLQGISRDVMSHCATPLSMASTHGKSESLESLIRADNASANSFRILEEDDIVVPTCPKLRPANVLMQLITCGSLSVKDHDNI

SEQ ID NO: 177735 - protein, 73 aa, Triticum aestivum
  Clone ID: PAT_TA_72153.pep
SPEEQSMVGQTMMRIVRPCFKPSLPDGAQVVAAGGGGTREGLLWYRDAGRHACGDFSMAVVQANQLLEDASQL

SEQ ID NO: 177736 - protein, 65 aa, Triticum aestivum
  Clone ID: PAT_TA_72154.pep
PRVRGRRRRAGASIQARLSCDYPFSHLFDARSCIARSAVSTRRRRCPPALAGPARPLRRPRLRRR

SEQ ID NO: 177737 - protein, 162 aa, Triticum aestivum
  Clone ID: PAT_TA_72155.pep
TRPLVPSDINGGILLPTPVPFVDLRYCPLPQSHPPGSLGPLAIAPAAPPNRKPRSPRISAAGRPADPRRLEPSAGPALLARRGAERRRSEPGRFLPLWGVLRPRRLGLQPSCIRRLVGEESWKRGCLLSAASSSYSSCSSSMRRSSRRPYTSSSRSLVYTST

SEQ ID NO: 177738 - protein, 207 aa, Triticum aestivum
  Clone ID: PAT_TA_72156.pep
HASGWNELRYGRRRNGCLPPPGTMGWPLFGETTEFLNQGMSFMKERRLRYGRIFRTHVLGCPTVVCMDPDLNRRMLLQGESSGLVPGYPQSMQDILGRNNIGALHGSMHRFIRGAMLGLVHPAAIRASLLPKIDAFMRSHLDGWSGSVVDIQAKTKEVTLLSMLRQIAGITAGPLSDALNTEFCTLVLGTISLPINLPGTRYYQGLQ

SEQ ID NO: 177739 - protein, 170 aa, Triticum aestivum
  Clone ID: PAT_TA_72157.pep
MALLRRPPLARTAAAASLPHHRLRLATPHTHLTRPPPSTPRLRISAAPSLRPLRGIPSSRCHAAARDPAPAPSQVPGGARAALVRVGEALSLGFPLWVASACALALWRPASFLWVTPTAQMVGLSFTMLGMGMTLTLDDLRTALLMPKELAAGFLLQYTVMPLSGYLISK

SEQ ID NO: 177740 - protein, 211 aa, Triticum aestivum
  Clone ID: PAT_TA_72158.pep
TRPPTRPQPTAMHVMMFPFLAFGHISPFVQLARKLVAAGGVRVTLLSAAANVPRVEAMLGPAAGAVAVAPLRLQRVPGLPEGAESTAEVSADGAELLKVAVDGTRPQVANLLAELRPDALLFDFATPWVTELAAPLGTKVLQFSVFSAVSGAYLMVPARRAGGHGPTADDLASAPTGFPPSSSLATVPAYQAANFTYVFTSFHGEPCVYDR

SEQ ID NO: 177741 - protein, 195 aa, Triticum aestivum
  Clone ID: PAT_TA_72159.pep
TRPPQPQPQPEPVDMDASGCPDVQPGLILRSRNRNHNLNLNASSSSELNALLPPDRDRNPHHISGSDKNRAIQHHNRNAEMPAVSVEPTSSSTLINGTGSQVQEIDVASSPGGEVKLSLKCSAHPSKLNMPDLEAVYKMVEDKYHCSDKLLPPDFSIPGLMAEICQSVVQLGTQHTVEHITQSRTVGNGSTSKCV

SEQ ID NO: 177742 - protein, 66 aa, Triticum aestivum
  Clone ID: PAT_TA_72160.pep
TNPGVYMNHTTNSLGWGKSTPTQKKVGSRGPSPKGIKGGWTSQFLIHQGEKRGEKCLAWHPFLLAL

SEQ ID NO: 177743 - protein, 107 aa, Triticum aestivum
  Clone ID: PAT_TA_72161.pep
PSRPRGLTHTGQRQAQPFPCFAYSSLQPRWQVPRPSPKNIPTPRSPGPRPPQVRLHKIAKYLNARICLAKYYDVFGRPVNIKFLCHKRLQCCGSDKYPFRIAKFDYR

SEQ ID NO: 177744 - protein, 91 aa, Triticum aestivum
  Clone ID: PAT_TA_72162.pep
AFQQSQWMIDQILWFKDFSHAAVVGQFILCCIGVVEPWELDFKCFWWENVNLGGQNVLLGGYWLTPLLNICKRPHKNGGKDRAHVVYIDIQ

SEQ ID NO: 177745 - protein, 57 aa, Triticum aestivum
  Clone ID: PAT_TA_72163.pep
GSSLDFLLQVPKYVPWISVRWMILQTKEYFFDGGLDPKITYASPWVEVPMRMIFCFP

SEQ ID NO: 177746 - protein, 110 aa, Triticum aestivum
  Clone ID: PAT_TA_72164.pep
GKPGPKKLNFFPGQKKKLALGPFWEKTIPGPQKKKTIPKPISGVFSQRAPPKPFLKAPVIFKFRAKKGFLTPLFFKEKGVPPQMPLFCPKGPGCPPFIPYGKIFICRPPF

SEQ ID NO: 177747 - protein, 94 aa, Triticum aestivum
  Clone ID: PAT_TA_72165.pep
KKNKPFLNLNPNVQKHPPLQLFARGPLTKNTTGSFLFLDPPPDQKTINPFLIPPGGKPNGFPLQLAKGTTLSTTLIWPPFPKKSFGWAQGPGCP

SEQ ID NO: 177748 - protein, 80 aa, Triticum aestivum
  Clone ID: PAT_TA_72166.pep
GFFLVQRTHRQGHLFYYPKTHLLYIHKKLTCMPALTPTNPNLPIPYTKHRLFFSLVHPPNTVISNTRPANYLFPSHVHSC

SEQ ID NO: 177749 - protein, 71 aa, Triticum aestivum
  Clone ID: PAT_TA_72167.pep
PFFEKAPFSKECDPVQKGYFSFWERVKEKFGKIAPYFVKLVDARVPWMEAWDELTPFNAVVVVGTGKAPAK

SEQ ID NO: 177750 - protein, 41 aa, Triticum aestivum
  Clone ID: PAT_TA_72168.pep
LEVIRSLVFRIFSTMWKGYVSPEWSPIKGPFSKKVVGIGGQ

SEQ ID NO: 177751 - protein, 51 aa, Triticum aestivum
  Clone ID: PAT_TA_72169.pep
KRPQRQQGKGFFGEGGEQKPQAGWVRFKKGRVPPGGRVEPPEGRVFFSAPE

SEQ ID NO: 177752 - protein, 83 aa, Triticum aestivum
  unsure (1)..(83): unsure at all Xaa locations
  Clone ID: PAT_TA_72170.pep
PPPQLGQCFSPPPQQFEEKFGGNPXQKQLGNGPFFDPPQKVQLEVIVSIGLGAPPKMCRVKVPFLETPPSVPLGVGIGVGVFL

SEQ ID NO: 177753 - protein, 62 aa, Triticum aestivum
  unsure (1)..(62): unsure at all Xaa locations
  Clone ID: PAT_TA_72171.pep
PLGQGSFRPFXQNPQAQGFVHPQQLPQFEEIRNLALQRVPAMCNVXIPPYCPIGPFGIFGIN

SEQ ID NO: 177754 - protein, 111 aa, Triticum aestivum
  Clone ID: PAT_TA_72172.pep
LAQPKLTTTFYPTPPNKQNKNEFLLQSFQFIQGSENHPLCCFHLQNWSNKIHTQGRGVPGPPFFPSINCWASPGGITGITPPPQAGQKPRERGISPRVGGPMTNTTGLFSF

SEQ ID NO: 177755 - protein, 76 aa, Triticum aestivum
  Clone ID: PAT_TA_72173.pep
PQAGPVSSTPSALSGRRVGVENVVDKVFTMGFLKEQVRGIVRRLTKNGQNVDLNVVFDKLMNDIDGQPAQKGWFGK

SEQ ID NO: 177756 - protein, 78 aa, Triticum aestivum
  Clone ID: PAT_TA_72174.pep
TGKLFIFHYYWVLPYLHKKLGTPPPFIGYLRGILPQTPFKLQKILLLGNQKCIPPLHPKHFWNFFLGLLPLSHHWAGP

SEQ ID NO: 177757 - protein, 66 aa, Triticum aestivum
  Clone ID: PAT_TA_72175.pep
ENFFIIIMTENRPPPINPQSSKNCSLKSCPTSCSSRGGLFQNVRGKLALADVPPQRGDPILEGLGR

SEQ ID NO: 177758 - protein, 107 aa, Triticum aestivum
  Clone ID: PAT_TA_72176.pep
APKKFFFLKQNRPRARLMPFCQKGFFFGPAGSFFQKPAPLGGPCFTGLPNPGGQLIGPAKPPPGPGFGGPLPPPQKTPRAQPGRAPFPCPPGFQGMEKTPPWGAIPN

SEQ ID NO: 177759 - protein, 104 aa, Triticum aestivum
  unsure (1)..(104): unsure at all Xaa locations
  Clone ID: PAT_TA_72177.pep
PLKRIPPRVPRRNGGFPTGQGLVFFQGDKCPEIGGFLDPNQVGADQVQWVVEQISKKQGVXVSKGYFPPLSKEKKLEREFKMVFSTDLQGQNFFIVIREVCPSK

SEQ ID NO: 177760 - protein, 125 aa, Triticum aestivum
  Clone ID: PAT_TA_72178.pep
REIFNPKIFFAQVVMLKKNIGKGKPFWGKGTLCRGWRGLNNKFLTAPPPEMWVVPRRIFPFGGGGPAMGGRVPPPIFFFSRFPVWFWGSKGFFSPLFKPPPLFFFFKGGRGSCPQKICFKKGGKS

SEQ ID NO: 177761 - protein, 63 aa, Triticum aestivum
  Clone ID: PAT_TA_72179.pep
YPSGQGSFQPFQQNPQAQGSVQPQQLPQFEEIRNLALESLPAMCNVYIPPYCTIAPVGIFGTK

SEQ ID NO: 177762 - protein, 95 aa, Triticum aestivum
  unsure (1)..(95): unsure at all Xaa locations
  Clone ID: PAT_TA_72180.pep
PPQGGPGIILRPPRKHPPPPLGRVSFPQPLEKNPLGRGPFRPFXQNPQAPGFFPPPQLPPFGEKRTPPPQRVPARGKVYPPPNCPLGPFGIFGGN

SEQ ID NO: 177763 - protein, 94 aa, Triticum aestivum
  Clone ID: PAT_TA_72181.pep
ALGGFFLEPPFLGTLKGFPPKGGVILIPEPILTFFHAPLKKNFFPGWKNTGKTLAGFKGENSQLLFPGKIEGLNFWPKKAPCLGEEINGEGAQK

SEQ ID NO: 177764 - protein, 84 aa, Triticum aestivum
  Clone ID: PAT_TA_72182.pep
NKPKAQTGHTFVYRSMGVSFFEHSLWTNRWSSRYHINRVTDWAMAYFKAPAPCTQFNCRPGTCMHGWMDGSTIQAWKGCLEQGT

SEQ ID NO: 177765 - protein, 126 aa, Triticum aestivum
  Clone ID: PAT_TA_72183.pep
IASNPPLKLQNFHSNRENYKGGGGLYFPTTFWGSWGGTHFLVHILTKHKTFFKQNDQKQNGAPKNKKKLAPNPFQTVPKMKPGPHFYYGRPAPFPQLRASNQGIKQGTNPHPFFCMGDSKIPLPLR

SEQ ID NO: 177766 - protein, 119 aa, Triticum aestivum
  unsure (1)..(119): unsure at all Xaa locations
  Clone ID: PAT_TA_72184.pep
QNPPGRGPFHPFQQTPRARGFVRPQKCPRFGEIGTQGXKPPPPMAKVKTPPNGPMAPVGFLGATGKKKTLRGKNMTPRFLGPGLGGGRGKKKKYQALSGKTPKYIGSTRGKKANPFFCF

SEQ ID NO: 177767 - protein, 43 aa, Triticum aestivum
  Clone ID: PAT_TA_72185.pep
KNKNEFLADFGQGGYDDIVVGWNGKLQRSFFGEQRWGLFFGAK

SEQ ID NO: 177768 - protein, 76 aa, Triticum aestivum
  unsure (1)..(76): unsure at all Xaa locations
  Clone ID: PAT_TA_72186.pep
PLGRVSFQQPLEQNPLGRGSFRPFXQNPQAQGFFHPQQMPPFGEKRTPGVQTLPPMCKVYTPPNCPLGPFGIFGVN

SEQ ID NO: 177769 - protein, 76 aa, Triticum aestivum
  Clone ID: PAT_TA_72187.pep
YHITLALNKKITLLTGPQKMQWCNKNMGGEGKGQPKGPPLILGPGLGYATKKTKGELWAHMPPNFGPNHPFAIKTC

SEQ ID NO: 177770 - protein, 69 aa, Triticum aestivum
  Clone ID: PAT_TA_72188.pep
GKQKTWGAFIPKLELTLGGGTPEGAPPFIWQSYIHWGLWLITKNPLSITIKLGFFIGPQSPQIFWEKGP

SEQ ID NO: 177771 - protein, 116 aa, Triticum aestivum
  Clone ID: PAT_TA_72189.pep
RAKPKMDFQKNCKFFCPLCFGNFPKIKKTCPIWKKPKAQAQNPSCFRLPPKKTFKKLFRGGFPPGNGCRKKKKPRAPLNFLARPKKKKVGGPNPRGFVFSPQFLKNKPPKKDGPLI

SEQ ID NO: 177772 - protein, 57 aa, Triticum aestivum
  Clone ID: PAT_TA_72190.pep
DPMDKVRAKFRAKGGIPRDQKGFFFVGNQFKNARPLADYTIQKGSPLHWGPGFRGGQ

SEQ ID NO: 177773 - protein, 90 aa, Triticum aestivum
  Clone ID: PAT_TA_72191.pep
RLREFQSLRLQGVQGLSPPQGVLKPGLGASHQCIRPPLIVPIIIPSATLEWSSRMVIIKIDKLCSLLGIKHLNKGQFNFFVKVNKSRGWA

SEQ ID NO: 177774 - protein, 123 aa, Triticum aestivum
  Clone ID: PAT_TA_72192.pep
NPNQKAPPGNACLPAWEENHWRRYPFPQSNNGWGDLTKVSPFFQRQCSGVSTGAVLSCPSKTRARYLRFGCNHMNPGPCLNYVHVSQAICSDVGIPPYLHLIKPVQAQTGSDDIESPPRNRGT

SEQ ID NO: 177775 - protein, 92 aa, Triticum aestivum
  Clone ID: PAT_TA_72193.pep
KGPPPAKGPLPGKSPQGSPPPPLFGQNTKRPPPWLQRGTSPRPNFPQFFGLRGGTPFWLPHKKTFFRLHGVWASIPPSYPKNVRGVPRFFCK

SEQ ID NO: 177776 - protein, 58 aa, Triticum aestivum
  unsure (1)..(58): unsure at all Xaa locations
  Clone ID: PAT_TA_72194.pep
GSFQPFQQNPQAQGFVHPQQLPPFEEKRTPGVKTPPPMGKVXIPPNCPLGPVGILGTN

SEQ ID NO: 177777 - protein, 72 aa, Triticum aestivum
  unsure (1)..(72): unsure at all Xaa locations
  Clone ID: PAT_TA_72195.pep
VSFQQLQQQYPLGQGSLRPYQQNPQAQGSVQPKQLPQFEEIRNLGKQRLRAMCNVXIPPXCTIAPFGIFGPN

SEQ ID NO: 177778 - protein, 68 aa, Triticum aestivum
  Clone ID: PAT_TA_72196.pep
LGAITFPRGKPPLFYYTILPIKHSFYENTPKFPEKGNFGGKPQKLNASTRDWAIELPWVGPKLPTPGT

SEQ ID NO: 177779 - protein, 100 aa, Triticum aestivum
  unsure (1)..(100): unsure at all Xaa locations
  Clone ID: PAT_TA_72197.pep
IPKVVQGNIWPQHHQQQQQQQQQQPLSQVSFQQPQQQNPSGQGSFQPFHQNPQAQGFVQPQQLPQFEEIRNLALKTLPAMGKVXIPPYCPIGPVGFFGAK

SEQ ID NO: 177780 - protein, 84 aa, Triticum aestivum
  unsure (1)..(84): unsure at all Xaa locations
  Clone ID: PAT_TA_72198.pep
QQQQQQQHPLSQVSFQQPQQQYPSGQGSFQPFQQNPQAQGFVHPQQLPQFEEIRTLALKTLPPMCNVXIPPNCPIAPVGFFGTN

SEQ ID NO: 177781 - protein, 121 aa, Triticum aestivum
  Clone ID: PAT_TA_72199.pep
GTLNISLNLTYLEFMTTPKSCISQTSATVLTYLDHKQKLKPKLHTYLAQGHKRKSNIYLNLTPKTHHIAPHDLFEGYYRSFDLARPWIKTHPHIKLAILQRPVIGGAKRAGISTLKSPLEN

SEQ ID NO: 177782 - protein, 108 aa, Triticum aestivum
  Clone ID: PAT_TA_72200.pep
KQTLSSRIQVLISLVTPPNQIILKPHPLVLLPLTKKWTCPLFKCLTPKGKHTLSIFFITIRRDHPKVAEGFIFGPIKGGRILCCLPPAPGFNPPGGGDTPCPPCKRNL

SEQ ID NO: 177783 - protein, 55 aa, Triticum aestivum
  Clone ID: PAT_TA_72201.pep
EIAPRKGGYFFSKKKGEVLGSTLTRFGAIYFRTFFWECSHKKIFLFLGKRAFPVF

SEQ ID NO: 177784 - protein, 96 aa, Triticum aestivum
  unsure (1)..(96): unsure at all Xaa locations
  Clone ID: PAT_TA_72202.pep
NLFYGQKARVIFVWGAFRDPQKFLVYXPPNFFAIGPLGSLFXALKEWAGGLVLVTQKFRGVKQGGQKIWGFXNQGGLRWGGEILGFQPPFKKRGGF

SEQ ID NO: 177785 - protein, 63 aa, Triticum aestivum
  unsure (1)..(63): unsure at all Xaa locations
  Clone ID: PAT_TA_72203.pep
YPLGQGSFRPFGQSPQAQGSVQPQHLPQFXQIRTLAAQKLHAMCNVYIPPYCPIAPFGILGSN

SEQ ID NO: 177786 - protein, 67 aa, Triticum aestivum
  Clone ID: PAT_TA_72204.pep
PQHQYPSGQGPFWPFQQNPQAQGFVHPQQIPQFEEIRTLVFQTLPPMCNVYTPPNCPIAPFGIFGIN

SEQ ID NO: 177787 - protein, 111 aa, Triticum aestivum
  Clone ID: PAT_TA_72205.pep
NTQRPPNRASLTSTFLSVSQSHLTTPGFSKANQNKRGNKLHLYKTQPKGGPTGPKPYKNKPNPGPRWATPQQINPAPLMSRHQTKKNFFYLKTKTIKGASCRPPKRPSPPF

SEQ ID NO: 177788 - protein, 48 aa, Triticum aestivum
  Clone ID: PAT_TA_72206.pep
LFVCQRGGAPGGRLNVEFNGSTPQRSRDCQLVNAAKKGFPLYKKNFGV

SEQ ID NO: 177789 - protein, 84 aa, Triticum aestivum
  Clone ID: PAT_TA_72207.pep
PPQNHPPQFWGRFSFQRPQQKYPLGRGPFRPFQKTPRARGFSPPHQCPRFEKKRTQGFQRSPQMGNVTPPPNGPMAPLGFLGIN

SEQ ID NO: 177790 - protein, 59 aa, Triticum aestivum
  Clone ID: PAT_TA_72208.pep
KFGKKPKTLFYPWGYKSRGTPKKDGTCPPHNNNLQKKLFKKLPPNNNWKTNQSPSFLTG

SEQ ID NO: 177791 - protein, 67 aa, Triticum aestivum
  Clone ID: PAT_TA_72209.pep
QKGTNLGPHLFDFYNPKITLTPKNPQNSNKILGGSAPNSGGNLSKNYSKLRFLKTPGKKNRDANRDP

SEQ ID NO: 177792 - protein, 62 aa, Triticum aestivum
  Clone ID: PAT_TA_72210.pep
FGANTAEDPHKRKPDITKAKELLGWEPKVGLRKGLPLMVQDFRTRILGDQKQQQQHPEGSEK

SEQ ID NO: 177793 - protein, 64 aa, Triticum aestivum
  Clone ID: PAT_TA_72211.pep
SSSPGFSSVRNDTAQSWTRDQGRMANPNPNPLDRLVRQDICVTNRNPCDFTTISDANEYMRADI

SEQ ID NO: 177794 - protein, 89 aa, Triticum aestivum
  Clone ID: PAT_TA_72212.pep
GRLNKNIYWIYWMGKKGDRGNPSISFKGGGNPQHPLLKPTPFQKKKGVAPLPLNWTPPKIFFPKKKKKRGTPKKTLTQGGPSFWGNLLK

SEQ ID NO: 177795 - protein, 63 aa, Triticum aestivum
  unsure (1)..(63): unsure at all Xaa locations
  Clone ID: PAT_TA_72213.pep
NPFGRGSFRPFXKNPQAQGFFPPXKMPPFEEKRNLGVPRVPGMGKVXTPPNWPLPPFGIFEIN

SEQ ID NO: 177796 - protein, 49 aa, Triticum aestivum
  Clone ID: PAT_TA_72214.pep
GLKQPYLDFISKFKQLFWAGHTPTWGTLYLAPLDPHIHRLNNGDPTFFY

SEQ ID NO: 177797 - protein, 58 aa, Triticum aestivum
  Clone ID: PAT_TA_72215.pep
QQQQVFQGPFLHPPQIAPLEAVISIALRPLPKMSSVNVPLSSPPPSVPFGVGPGVGAY

SEQ ID NO: 177798 - protein, 165 aa, Triticum aestivum
  Clone ID: PAT_TA_72216.pep
TKFLSAWLAGGFVMSVAWEYVIANELLSLFVSAGLVLGVDPATLGMTVLAWGNSLGDLIANVAVAVAARPGGAQVAVAGCYGGPVFNVLVGLGLSLLLSCWAGYPKPVAIPWEPRLYQTLGWVAAGLLWAFFMLPRRGMKVGRTLGFGLLAIYLCFLCNTPSLFA

SEQ ID NO: 177799 - protein, 116 aa, Triticum aestivum
  Clone ID: PAT_TA_72217.pep
PPLGGFLEKKSKAPSGRGPPKFPPRVFLKVFKRGGKTLEFPVLPKKGALWQLGGSEIDKNFPEIWAKKAPAKGAKKRGPKEPKFLEGENFLFGGRTLLGGPLLRSGIFFKLFYQKF

SEQ ID NO: 177800 - protein, 62 aa, Triticum aestivum
  Clone ID: PAT_TA_72218.pep
GRGFFRPFQQTPRARGFVPPQQFPRFGEIRTQGLQAFPPMGKVSPPPNGWPPLGPLGFMGTN

SEQ ID NO: 177801 - protein, 47 aa, Triticum aestivum
  Clone ID: PAT_TA_72219.pep
RKRNVRCPGNIILVEAKLKGLWYVYHYVNDENGRLDKIFLIAWEKKT

SEQ ID NO: 177802 - protein, 89 aa, Triticum aestivum
  Clone ID: PAT_TA_72220.pep
PPWGKKFDPEAYDCNNVVEQELPCGGVLIYQSFPPKKKVAVFAGSPRSVFPCFEAETVETPPLVKKGKLPTPLAWRAEDFLEEGVVLCK

SEQ ID NO: 177803 - protein, 58 aa, Triticum aestivum
  Clone ID: PAT_TA_72221.pep
GFFHPQKPGQFGGIRSLGLGIFSPMGKVFFPPEGSPPKAPFSGKISPIGGPLKKPPFC

SEQ ID NO: 177804 - protein, 74 aa, Triticum aestivum
  Clone ID: PAT_TA_72222.pep
NLGRPGNLQPIFSTTFNTGLSRIYLHPTRGPQCTNRAAPLALPFFCLLGTCTPTPFSSLLLPGDKKREENLQGG

SEQ ID NO: 177805 - protein, 87 aa, Triticum aestivum
  Clone ID: PAT_TA_72223.pep
IKEHFEWVFQGGGFPRGEFLFQERGVAPPVQLGVVPPPWGGLGKIFKGGWEKPTHCVFVGVFSKTGKNGFWLGFAPRPVNKKVLGST

SEQ ID NO: 177806 - protein, 131 aa, Triticum aestivum
  Clone ID: PAT_TA_72224.pep
NAPPPKNLGFWGTLFGVKGIKKVLKLNPLFSFFSPPPPKRFCFYWGPHFFFFQGAGLVLLCPDQIFAFLNGSTFKGPPRPNKLGGGGFFFPKNSPCGGPPNGPLVFFWNFKNPFWPFLKKRVPWGGGPKVF

SEQ ID NO: 177807 - protein, 117 aa, Triticum aestivum
  Clone ID: PAT_TA_72225.pep
PFKNPFFLGPKKKKKMGVLSKKIPGANIFFQPGGFYSGHISKKIFQTPSLFGVPQRGLFPTHLKGATKKTFFFGNLGGTWAKPPWGGLTFRGFAEGLGFPPFSGKKIPSGLFFCPPP

SEQ ID NO: 177808 - protein, 137 aa, Triticum aestivum
  Clone ID: PAT_TA_72226.pep
LHKNQGDLVAPIKFPVLLMPNGFAKIISHPLQQLGPSKSIEGDVEIKVWLVLGPKSKKKGGGKKKKGKKGVWPKVPKPMGVFKGAPSQEKFSFFLNCFLYVGPCFLGHLIVLYSIQLWGFGPLFLKGLMKMVVFGAH

SEQ ID NO: 177809 - protein, 58 aa, Triticum aestivum
  Clone ID: PAT_TA_72227.pep
VFFWTPKTQLLLMFIKGAPYSFHKLIQHKNPFDKNPHNRQPGKPYFSRVFLPHTNLLI

SEQ ID NO: 177810 - protein, 65 aa, Triticum aestivum
  Clone ID: PAT_TA_72228.pep
LPHVHAPTPFFPKGHACICWTLIKLNFAINRSLVVLVFFYGAGGPCFLCRGLATQKGLTAPRRGK

SEQ ID NO: 177811 - protein, 52 aa, Triticum aestivum
  unsure (1)..(52): unsure at all Xaa locations
  Clone ID: PAT_TA_72229.pep
QGPLLQPPQKGQLGGMASIALGTRPTMCRVNGPGXGPPPIGPFGVGPQVGAF

SEQ ID NO: 177812 - protein, 90 aa, Triticum aestivum
  unsure (1)..(90): unsure at all Xaa locations
  Clone ID: PAT_TA_72230.pep
GPPPPQQQHQQQHPPLSQVSFQKPQEKNPSGRGFFPPFXQNPQARGFFPPQQMPPFGAKRNLGVQTVPPMGKGETPPNCPLGPFGILGAN

SEQ ID NO: 177813 - protein, 58 aa, Triticum aestivum
  Clone ID: PAT_TA_72231.pep
NTLWGGPVAKPEDTPLTEEGRKKRDSFRGFNPMIAPDTRVEPGQVPIADGITVCPRVA

SEQ ID NO: 177814 - protein, 72 aa, Triticum aestivum
  Clone ID: PAT_TA_72232.pep
LISSTPLICHILILKIPQLILKPRTPEPLPAGELLMVWRFINDFFLNHYINPTGDNEDFSMHSPETLSKSYR

SEQ ID NO: 177815 - protein, 132 aa, Triticum aestivum
  Clone ID: PAT_TA_72233.pep
GAPFGGGNNRKKGGNTPGGKWGPKVQWGFNGGSDPWRKPGKNSMGAANPGGGGFGFLKKKGGGPGTGRAPGVTLGGAQKEDLGFDFKREKKGLGFKRSPPFPGWGALKKKVCLTPGFFWSAAVKKKGTPFFP

SEQ ID NO: 177816 - protein, 61 aa, Triticum aestivum
  Clone ID: PAT_TA_72234.pep
GVDFWGLRVRYEFMVENDMTPEKSLKGCPSMGMIFPTLGFLRDLGALVGSLFMWFFMFKDF

SEQ ID NO: 177817 - protein, 84 aa, Triticum aestivum
  Clone ID: PAT_TA_72235.pep
PPQKPPPPLLGRVSFQQPREQNPLGRGSFRPFQQNPPAPGFVPPPQMPPFGEKRNPGVQTVPAKGKVYTPPNCPLGPFGILGDN

SEQ ID NO: 177818 - protein, 103 aa, Triticum aestivum
  Clone ID: PAT_TA_72236.pep
TKKTPRKNPLKGPPKPGGGGGPQGGGKTPQGFQNPPLGPKRARAPRGGDPPPWNWGGDPNSGERNNCSPKFQRPRKNLRGNPRGRKKPKNLNPKKKKTPHLGA

SEQ ID NO: 177819 - protein, 104 aa, Triticum aestivum
  Clone ID: PAT_TA_72237.pep
GFFSRPKKKQYFILTTTTCLKKTQHPVPFGLSYFFQKTKNTSDPPTRVGVTRLIGITGRTYSRLKGNKMKNRFFRGSKAHKKTRQCTGGPLGPQRTYMIHGKIT

SEQ ID NO: 177820 - protein, 85 aa, Triticum aestivum
  unsure (1)..(85): unsure at all Xaa locations
  Clone ID: PAT_TA_72238.pep
FLGKGGFPKGQDPYILSLFFKGFVEGEXTGTGGGAPTICXVVLWQGPPPPGLGFFGGSPFLFLIRGETFGGGLFFGEGGHPPPFL

SEQ ID NO: 177821 - protein, 71 aa, Triticum aestivum
  Clone ID: PAT_TA_72239.pep
ARPPKKFYLPKHPRGVGWLGAIFLPKKKAFFFLLRGQNKRLLLGPTGTYYLLLTTGAAGPPLHFKSNPLKA

SEQ ID NO: 177822 - protein, 143 aa, Triticum aestivum
  Clone ID: PAT_TA_72240.pep
DGSSGSSSETVNEIENHPECRYMTPNEIVWRLPERMKIDSVSRFPVSYVIKKSFSVDNAQVLPFTKPYPCKEMMTHPFLKNIESAMTHTPEDANNTTPPFCQPANNVIEKKNRYSLGKMSIELSEDETPKKEIIVHLGHAREK

SEQ ID NO: 177823 - protein, 135 aa, Triticum aestivum
  Clone ID: PAT_TA_72241.pep
KKQTVDGRVIYAYKHTYIFWLGTSDPEYLHILSLPILTGNGWWGAIALDLFAQPGKPLFGNHGKKIPSKLKPNHETLGCTHLHLDLHQLVVVGRHHWGAPHHFVGGGGHHGEHQTGPYFQTHFGGMQMGPKNFKK

SEQ ID NO: 177824 - protein, 81 aa, Triticum aestivum
  unsure (1)..(81): unsure at all Xaa locations
  Clone ID: PAT_TA_72242.pep
QQQQHPLSQVSFQKPQQQNPSGQGSFHPFQQNPQAQGFVHPQQLPQFEEKRTPGVKTPPPMGNVXIPPNCPLVPVGILGIN

SEQ ID NO: 177825 - protein, 46 aa, Triticum aestivum
  unsure (1)..(46): unsure at all Xaa locations
  Clone ID: PAT_TA_72243.pep
PKKLGGKFLSHPGPLPGLTPKFPFFLAPNGXKVFLVVHGDFPKEPP

SEQ ID NO: 177826 - protein, 90 aa, Triticum aestivum
  Clone ID: PAT_TA_72244.pep
PNPDHRQEVQGGQYASDPGGTPPHHQGGGSPGVPLGGGAHRQGQVFFPKSPHRHQGKGFSGKGAHQNPQPVGVSLKKVGFPPGCGINPQE

SEQ ID NO: 177827 - protein, 96 aa, Triticum aestivum
  Clone ID: PAT_TA_72245.pep
IPAPPDTLIVFLAFLTPSFISTSFGSTMATYTEPHFTSPTFVGNSFQGPGTTGFGRGIPQRKWTPGTRSGTTVMTLEMDPWHKHVRQQREARNGPP

SEQ ID NO: 177828 - protein, 57 aa, Triticum aestivum
  Clone ID: PAT_TA_72246.pep
GFKKRFFFRGGGQGLIFIKQKGAGFLTGGGFFSPRGPRGEKLEKFSPFFVFSAGGGF

SEQ ID NO: 177829 - protein, 98 aa, Triticum aestivum
  Clone ID: PAT_TA_72247.pep
CQPIPNVVQAIILHQQQKQHQHPLSQVSFQQPLQQNPLGQGSFRPFQQNPQAQGFVQPQQLPQFEEIRNLGVQTVPAMCNVYIPPYCPMGPFGILGIN

SEQ ID NO: 177830 - protein, 88 aa, Triticum aestivum
  Clone ID: PAT_TA_72248.pep
QWAPIQGVGHSIFMRQDHHQHQGIQFMGPFFQFIKGKGLIHPQQPVQLEVIRSLGLGIFPTMCKVFVPPEGSPTKAPFARIVAHIGGQ

SEQ ID NO: 177831 - protein, 98 aa, Triticum aestivum
  Clone ID: PAT_TA_72249.pep
APPPNFKGKYCFGPPEGGFFWAPRGFFLPPPLKEPGPKGGPLLGWGRKTGVNLKKKKILGKSWPGGGKIFPPRRFPRFVSKFFFSGERVWAPFGGVVN

SEQ ID NO: 177832 - protein, 79 aa, Triticum aestivum
  unsure (1)..(79): unsure at all Xaa locations
  Clone ID: PAT_TA_72250.pep
PPPPSGRVSFQQPLGQNPLGRGSFRPFXQNPQAPGFFPPPQLPPFGEKRTLGVQRVPPMGKVYTPPYCPLGPFGILGGK

SEQ ID NO: 177833 - protein, 126 aa, Triticum aestivum
  Clone ID: PAT_TA_72251.pep
VSRCDSEHLRSVYNYETRTITSTTNVPRTFTSFTLHRTRPVPFARLEGITPRRMHVLYEMHVWMLYPPANVSCFPRLAPSSTRGNPISWITPPSLHDMLPRLFFLPRHLNELSDHRNVPVYHFRCP

SEQ ID NO: 177834 - protein, 80 aa, Triticum aestivum
  Clone ID: PAT_TA_72252.pep
KKPPPRDKRRPQVVQGQIKSLSPGEFFLGVDPGCFKVKEKRGFLGVPIWSKKRISPPEIWVEPKMVFSQSLGLNLRGSFP

SEQ ID NO: 177835 - protein, 55 aa, Triticum aestivum
  Clone ID: PAT_TA_72253.pep
TLIAQQKNRQAQARSENKKRQNPTSDNTRGKLKFPGLGIQKHLVLTWIKADRTRY

SEQ ID NO: 177836 - protein, 116 aa, Triticum aestivum
  Clone ID: PAT_TA_72254.pep
LCCQQLWQIPEQSRCQAIHNVVHAIILHQHHQQQQQQQHHPLSQVSFQQPQQQYPSGQGSFQPFQQNPQAQGFVQPQQLPQFEEIRNLALETLPAMCNVYIPPYCTIAPVGFFGTN

SEQ ID NO: 177837 - protein, 90 aa, Triticum aestivum
  Clone ID: PAT_TA_72255.pep
KSPSSPPKIFQFTWGPQHKTLHHTNQQKPPPFETPALNPAGKTSPLFPPGLAGDPGYKIASLKTPGPPLVHNPQGFLAPRGDPIAPILFG

SEQ ID NO: 177838 - protein, 99 aa, Triticum aestivum
  Clone ID: PAT_TA_72256.pep
TQYYVDLVTREGFLVSDQALFPKDIPRPIVERFARSQRDFFDQFGVSMGKMGQMRVGPSALGKVPRNCSARNPGPPPPDEFQCPSFVQPIVDAVAKRFG

SEQ ID NO: 177839 - protein, 51 aa, Triticum aestivum
  Clone ID: PAT_TA_72257.pep
ENPQAQGFVHPQQFPQFEEIRNLGVQRVPAMGKVYTPPNCPLGPFGILGAN

SEQ ID NO: 177840 - protein, 79 aa, Triticum aestivum
  Clone ID: PAT_TA_72258.pep
PPLVGYTIIILGIVNIFKGMSILEVGQKWKTGDIIAIAILGGVSVALEVIPWALVVKRRKTEDKAYNGGAFNNNGHLPM

SEQ ID NO: 177841 - protein, 77 aa, Triticum aestivum
  unsure (1)..(77): unsure at all Xaa locations
  Clone ID: PAT_TA_72259.pep
APGPYINGGDISPVDFSLGPKLYPLPVALEPFKGWKVPXTLTRVHAYPEGFFNPELFVKTQAAQENLIPGWGPKMNP

SEQ ID NO: 177842 - protein, 75 aa, Triticum aestivum
  Clone ID: PAT_TA_72260.pep
PPPLEGVPFEILDPINPWTDKAGYKETLLKLAGLFGKNFEVFPRSKIGGGSPPPEEILVVGPKVFFPLNQIKSAI

SEQ ID NO: 177843 - protein, 66 aa, Triticum aestivum
  Clone ID: PAT_TA_72261.pep
VFFERGENQSPPGEIGNLFFAPLESRAALLKNLFPYGPRDKSFFNGVKVGKVKKIFPFVFLGIFFF

SEQ ID NO: 177844 - protein, 68 aa, Triticum aestivum
  Clone ID: PAT_TA_72262.pep
KPLEKNPLGRGSFGPFWENPQAPGFFPPQKMPPFGEKKDPGVQRVPGKGKVFTPPNWPPGPFGVFGVK

SEQ ID NO: 177845 - protein, 74 aa, Triticum aestivum
  Clone ID: PAT_TA_72263.pep
PFKIGFFFSKRGGYPIFTFFTTLINPQMGKKNKPLLPSFFKKIYPNNFFLGNLLGPFPEIFGVFIPSHYKRPYQ

SEQ ID NO: 177846 - protein, 84 aa, Triticum aestivum
  Clone ID: PAT_TA_72264.pep
GWNGCKSFVIGPIEEACTRKECPFACQDGFTKLGHCKNGVVKCGWKSNCVLLDVTALYAEISPVHPYNLGTNNKSLGNNSMFIT

SEQ ID NO: 177847 - protein, 59 aa, Triticum aestivum
  Clone ID: PAT_TA_72265.pep
DMQHKLFNPRFVLFLIRKNFHLALLLGLTLNTQKTGNTPYVYWKNKGHASPNPMQTGKN

SEQ ID NO: 177848 - protein, 100 aa, Triticum aestivum
  Clone ID: PAT_TA_72266.pep
RKGYALKSSRCFPACLVFTHTGVPVPELLYEEVQYKLTALIPKVQELKVYFVLKNEWSMNEWTKINFKKNKIPVKPFDIMNSIIRSWSRLEFVFYPKSKV

SEQ ID NO: 177849 - protein, 145 aa, Triticum aestivum
  Clone ID: PAT_TA_72267.pep
KRGPKPPQKPLKILKKKKKTPFLPPKKKKPQSTQTENGAPAQKNPPFPFRLTLPSPTQSGKGNIFGTPPPPPVGGKKKENLPQGFALGIKKTLGPQKKPGKGPPPPNKRGFGGPNQPTLGGAPFRAAQNLRGGFYPPPSPRLKNE

SEQ ID NO: 177850 - protein, 104 aa, Triticum aestivum
  Clone ID: PAT_TA_72268.pep
QVFGIVPLSLNEWLLVLVVALPVVFIDEVLKFVGRSTTASGPKRGLKKQKGELRRRRWLTAVVPNAVVINHQQKNSNLFRMFGPYNSGRQRKDVYSGYNIYIRN

SEQ ID NO: 177851 - protein, 114 aa, Triticum aestivum
  unsure (1)..(114): unsure at all Xaa locations
  Clone ID: PAT_TA_72269.pep
KVLEKNPLGRGSFGVFXENPLGQGFVQPXKLPRFGGIRDLGVQRVPAMGKVXIPPNWPLGPFGFFGVNWERKNFGVRNMKPRFFSPWFGCWRGEKKMWHGFFCKNPKYIGLNLG

SEQ ID NO: 177852 - protein, 60 aa, Triticum aestivum
  Clone ID: PAT_TA_72270.pep
IRVFFFYCKLSTILQTVLTLKNMPHYLFTATTTKPCTHKTGFHISNTTPILFSLKTEHPK

SEQ ID NO: 177853 - protein, 92 aa, Triticum aestivum
  Clone ID: PAT_TA_72271.pep
NNLIRGLALKGLSLFFFPPSKTQPWAKKTGGYFFPPKSFFFLIYPQKAHFGQGAIWGGLKLCHWGGRLLPPGPFFPKPGEFFRGEKTPGPGG

SEQ ID NO: 177854 - protein, 90 aa, Triticum aestivum
  Clone ID: PAT_TA_72272.pep
HHFFFFFNPKNFSFFIITGLYINYIKKFNTPPIYFITKGHSFLNTKPTPKNFITWWPKIPSPPLTRTFPATLPQTSFPFPTLRLPPWAPP

SEQ ID NO: 177855 - protein, 94 aa, Triticum aestivum
  Clone ID: PAT_TA_72273.pep
SSRSAKNKAIPLLKGPPPAGLRPRGDWWWGGLRPPWWQGWGGLKPPWWDGWGGPGPHVMKPFLFPGPFMLCGAKKPFFAFLKGIKKGHPLGGFW

SEQ ID NO: 177856 - protein, 84 aa, Triticum aestivum
  Clone ID: PAT_TA_72274.pep
KNNFGLPGHFIWGKLPGEELHTHRPTPWSGLGYRYNPLDLLQSCSSLHTGANTQKLGVPSGKVNHLGITGYQLFFLLLKKSRAH

SEQ ID NO: 177857 - protein, 68 aa, Triticum aestivum
  Clone ID: PAT_TA_72275.pep
FLKIHSLERKAGFSLTTFVFQYLFKLTQTVNAHPNLFKIITISGCQQWEKLHFSMVPGNDPSNQKKSP

SEQ ID NO: 177858 - protein, 37 aa, Triticum aestivum
  Clone ID: PAT_TA_72276.pep
GLRIFFWWERKVWVKWEILKKKRFWELRGKRGNFRLS

SEQ ID NO: 177859 - protein, 68 aa, Triticum aestivum
  Clone ID: PAT_TA_72277.pep
GKLKGIMGYVEKNLVSIDFVGDSRWSIFNAKVGIVLKAHLVKLVWWYDNKWGYSTRVVDLIPHMAKIQ

SEQ ID NO: 177860 - protein, 85 aa, Triticum aestivum
  Clone ID: PAT_TA_72278.pep
VNQNRDFCPPKFTFYPLFHFSPHFPIKPGKKKRKNKPPLFFHLNDRIFTALHFLPTKMPGQKNLPNSFYKFGGGPPNCLPLPRDH

SEQ ID NO: 177861 - protein, 66 aa, Triticum aestivum
  Clone ID: PAT_TA_72279.pep
KKRFFPHTETLKKDKSPIPQKPFSFFKETANFSIENGPISFPKTPCFLPLTPNSKNPSPQFLAGPF

SEQ ID NO: 177862 - protein, 88 aa, Triticum aestivum
  Clone ID: PAT_TA_72280.pep
FVELVTKIDRRFGKELEALPKFLKNGDVGIVKMIPTKPMVVETFATYPLFGRFVVGDMRQTVAVGVIKGVEKKDPPGAKVTKVAIKKK

SEQ ID NO: 177863 - protein, 56 aa, Triticum aestivum
  Clone ID: PAT_TA_72281.pep
HLIQWFLSMTWEEVHFFVWSDFYYNKCLLFIKIFWVEVVSNNFSKKFFLVGPQTLF

SEQ ID NO: 177864 - protein, 93 aa, Triticum aestivum
  Clone ID: PAT_TA_72282.pep
KKILAWPSKYKPFKSWHFGFLCLSQIQTFPHQFCSPMGCLLALRPKGVGWPPFFPGPWKPQKPKTHGRNTMGLTQMPLPNKIIVWTPLKGKTK

SEQ ID NO: 177865 - protein, 81 aa, Triticum aestivum
  unsure (1)..(81): unsure at all Xaa locations
  Clone ID: PAT_TA_72283.pep
PIFLHQSGQGHQSGQGHQSGQGPQLGQGQQLGQEHQGXANPSHVNTEQQRASPKVAKVQQPGTQLPIMCWMEGGDALWVSQ

SEQ ID NO: 177866 - protein, 93 aa, Triticum aestivum
  Clone ID: PAT_TA_72284.pep
KQTFCPKHLPQNGTPGPLNPNHHFPPHWHFLGIDFSHPQKNPIFPRGIPLNPNPQVQLVKHPGKYPIMPSPPFFFQKTKTCSPKFNSFAGGGN

SEQ ID NO: 177867 - protein, 54 aa, Triticum aestivum
  Clone ID: PAT_TA_72285.pep
QKKHHHPPWARFSFKNLLKKNRLGRGSFGPFKKNPRAKGFFHPKKFPHFGKIRT

SEQ ID NO: 177868 - protein, 94 aa, Triticum aestivum
  Clone ID: PAT_TA_72286.pep
KMPPVGGKKDPTPKKGPGKGKGLPPPNWPLGPIGVFGGKWEKKKFWAKKNEPRFFHPRVWGWEGEKKNVKGLLRKDPEIKRFKLGKKKKTRFFF

SEQ ID NO: 177869 - protein, 52 aa, Triticum aestivum
  Clone ID: PAT_TA_72287.pep
TTKNPLPFNITLQFFIGPQCPQIFWQMGPPLWNPQGGHTPFPWVEKFSTPMI

SEQ ID NO: 177870 - protein, 51 aa, Triticum aestivum
  unsure (1)..(51): unsure at all Xaa locations
  Clone ID: PAT_TA_72288.pep
GIFLQPPQKFQLEGMISIALGTLPKMWGVKGPLXRLPHIMPLSIGIGVGGY

SEQ ID NO: 177871 - protein, 65 aa, Triticum aestivum
  unsure (1)..(65): unsure at all Xaa locations
  Clone ID: PAT_TA_72289.pep
QQYPLGQGFFQPFKENPQAQGFFHPQQLPQFXAIRNLGVQTLPAMCNVKIPPNCPIGPFGILGNN

SEQ ID NO: 177872 - protein, 73 aa, Triticum aestivum
  Clone ID: PAT_TA_72290.pep
TCYKKEVREKVIYAASHQIFFLLNCPGAHNPTKKDFLNWGLDQQRGYGEGSPQRCHEIPEHPGNLQQNEPLPG

SEQ ID NO: 177873 - protein, 63 aa, Triticum aestivum
  Clone ID: PAT_TA_72291.pep
PIFFQQTGQGEQSGQGQQGYSRSSHVRVGPQGASLKVAKGQKFGGKLPAMCRVEGGEAFLATQ

SEQ ID NO: 177874 - protein, 94 aa, Triticum aestivum
  Clone ID: PAT_TA_72292.pep
FGVLPETGWPFFFFPLPPPNPGLKKRGVICSPPKVFFFQFTPKKPPGARGPFGGVLTLPLGGGGFYPWGLFSPNRGHFWGGTKPRARGVFRKGG

SEQ ID NO: 177875 - protein, 83 aa, Triticum aestivum
  unsure (1)..(83): unsure at all Xaa locations
  Clone ID: PAT_TA_72293.pep
PQKQHPPPLGRVSFQKPLEKNPLGQGSFRPFXKNPQAQGFFHPQKMPQFEEKRNLALQRVPAKGKVXTPPNCPIGPFGILGIN

SEQ ID NO: 177876 - protein, 91 aa, Triticum aestivum
  unsure (1)..(91): unsure at all Xaa locations
  Clone ID: PAT_TA_72294.pep
GVHYAIKPGGAHHQGGGSPGVPLGGGAKRKEQFFFXKSPQGHKEKGFSGKGGKKNPQPVGLSLKKVGFPPGSGLDPQECGFFPPAQYYWVS

SEQ ID NO: 177877 - protein, 44 aa, Triticum aestivum
  unsure (1)..(44): unsure at all Xaa locations
  Clone ID: PAT_TA_72295.pep
GPLERLKPKKPIXMILKAGQPKMEPFPFYKNTGLPVKDYTNVGE

SEQ ID NO: 177878 - protein, 108 aa, Triticum aestivum
  Clone ID: PAT_TA_72296.pep
KPKTPPFWGGPKKKGPPKQWPPPLFLKKKKTVSLGKPPLFPFYFQNHYFKTKRPLSTNGGETGPQFKFSEQPPGIPLGKKPPGFSFFKKPPNLGPGNQTFSPSKKRAP

SEQ ID NO: 177879 - protein, 65 aa, Triticum aestivum
  Clone ID: PAT_TA_72297.pep
HQCRPMSVPFPQTPVHKPPKCQRVQAQMCRQVAQIPKKFRCQAIHNVVEFIREQQHSQPQQKVQL

SEQ ID NO: 177880 - protein, 70 aa, Triticum aestivum
  Clone ID: PAT_TA_72298.pep
KNPPAPNPPSRGWPFAEGPETNLPAAFKNPALKRTFCSPPTFFLRGVCPQIKPQTKVTINPSSPHTILPI

SEQ ID NO: 177881 - protein, 60 aa, Triticum aestivum
  unsure (1)..(60): unsure at all Xaa locations
  Clone ID: PAT_TA_72299.pep
GRGPFPPFQKTPRARGFVPPQQCPRFGEKRTQGLKPPPPMAKVXTPPNGPMAPVGFLGIN

SEQ ID NO: 177882 - protein, 84 aa, Triticum aestivum
  Clone ID: PAT_TA_72300.pep
PQKKHHHPPWGRFSFHPLLQKNRLGRGPFGPFKKTPRPRGFFPPQKFPRLGKKRPLGFQPPPQMANFYPPPFAPLAPLGFLGIN

SEQ ID NO: 177883 - protein, 60 aa, Triticum aestivum
  Clone ID: PAT_TA_72301.pep
KGKSPKFQTFLKTTNPPFFPKKITGKTLCQKKPFWFFKQVFPPFKKTLNWGPPKKFLGGP

SEQ ID NO: 177884 - protein, 57 aa, Triticum aestivum
  Clone ID: PAT_TA_72302.pep
GVCPQGVKWGPRVFGFVLIWPKPFFVRQNLIKAPPRRGPRFWGKVSPRNPNPKNCST

SEQ ID NO: 177885 - protein, 54 aa, Triticum aestivum
  Clone ID: PAT_TA_72303.pep
FYIFYFIRPRILLTSFPNGCCGGFCGFGEGFWNCWGGFGFENGCWGNCWGGSWG

SEQ ID NO: 177886 - protein, 47 aa, Triticum aestivum
  Clone ID: PAT_TA_72304.pep
WAQHKLSYQLNIHEHYTGCLDQKNLTGFFSDPITCNIKEAPQIMGTS

SEQ ID NO: 177887 - protein, 67 aa, Triticum aestivum
  Clone ID: PAT_TA_72305.pep
APIPITGTGINPARSFGAPVINNGDKAWRDQWVFWGGPFIGGGIAGVYPQRILRARARGYGSFRSKA

SEQ ID NO: 177888 - protein, 77 aa, Triticum aestivum
  Clone ID: PAT_TA_72306.pep
IWACPPPQKAPQKPKLGQAGKTKTKTWAPGETFFRPQRDPKNPAPGGPRGGDGKQTPWAWTFGPPPGGPWAFPWPPG

SEQ ID NO: 177889 - protein, 67 aa, Triticum aestivum
  Clone ID: PAT_TA_72307.pep
FKGDPLNFLKKNFDFPKKFFFTRLRAFRFFVGKRRNNNGGVVLGYKKEGVVDPIFLYFANGLKRVKC

SEQ ID NO: 177890 - protein, 133 aa, Triticum aestivum
  Clone ID: PAT_TA_72308.pep
GSSQVLQQSTYQLVQQLCCQQLWQIPEQSRCQAIHNVVHAIILHQQQQQQQQQQQQQPLSQVSFQQPQQQYPSGQGSFQPFQQNPQAQGFVQPQQLPQFEEIRNLALETLPAMCNVYIPPYCTIAPVGFFGTN

SEQ ID NO: 177891 - protein, 109 aa, Triticum aestivum
  Clone ID: PAT_TA_72309.pep
HYGVEIGRKKKVVAVAKKEPVEGQKVKVVVAPPEEAKKSTNVQRKFEKRQQGRTLDSPIKDQFSGGRLLACILFPPGQCGKVDGYILKGKELEFYMRKLQKKKGKGAPA

SEQ ID NO: 177892 - protein, 72 aa, Triticum aestivum
  Clone ID: PAT_TA_72310.pep
VSFQQPLQQYPLGQGSFRPFQQNPQAQGFVHPQQMPQFEEKRNQALQTIPAMCNVYIPPNCTITPFGIFDIN

SEQ ID NO: 177893 - protein, 61 aa, Triticum aestivum
  Clone ID: PAT_TA_72311.pep
PGPPLGQGQPSGPEQQGFGNPYPVYPEQQTARPKVAKVQQPPTQLPIMCWMEGGDALLGSQ

SEQ ID NO: 177894 - protein, 73 aa, Triticum aestivum
  Clone ID: PAT_TA_72312.pep
FFPPTNRPQFRKKRPPGVEATPKDGSFLTPPLSPSSQKGFLGRGRKKKNFLGSKKKPPFFFPPVGGWSAGKKK

SEQ ID NO: 177895 - protein, 70 aa, Triticum aestivum
  unsure (1)..(70): unsure at all Xaa locations
  Clone ID: PAT_TA_72313.pep
PFGPGSFRPXSKTPRPRGFSPPHHCPRFXEIRDPGVPTLPPICQVSPPPNCPPAPLGLFGANLKKKNLWP

SEQ ID NO: 177896 - protein, 96 aa, Triticum aestivum
  Clone ID: PAT_TA_72314.pep
GRVIPHRKRPGTFFFTAPGGGPLTKQGGAVFGILNLSIPAPAGGDLNGGGFGGGTIWGNMPLPHWGKGMNHPCSFDRNPTLIQLGLLVGLAKTLTL

SEQ ID NO: 177897 - protein, 85 aa, Triticum aestivum
  Clone ID: PAT_TA_72315.pep
PTQGVGHPFFRRQDPHHHQGIQFMGPFFRFIQGRGFIHPQQPVQLEVTRSLVLGIFPPMSKVFVPPEGSPPRAPFARIVPPIGGQ

SEQ ID NO: 177898 - protein, 84 aa, Triticum aestivum
  Clone ID: PAT_TA_72316.pep
KTIFGGSFGVFLSQCGCSGALFKDKERGGPLGFPCPLVPPYFSPPGAFCQKGGELPPRVPPPGLKGGPVFFIIPPRGQILGGPI

SEQ ID NO: 177899 - protein, 111 aa, Triticum aestivum
  Clone ID: PAT_TA_72317.pep
EKGPPGFWGEVHQNRDFSGDPPNRDHRQRVQGGHFAINPGEPPPPPRGGGPPGVPLGGGAHRKDRFFFPKGPHRHQGKGFSGGGAHQNPQPVGVGLKKVGFPPGSGLDPQE

SEQ ID NO: 177900 - protein, 61 aa, Triticum aestivum
  Clone ID: PAT_TA_72318.pep
LHKNLGPPLMFIGYLRGIPTKPHASCKKFYYWLTQNASPPSIQHIIGHWVPGCCTFPTFGL

SEQ ID NO: 177901 - protein, 102 aa, Triticum aestivum
  Clone ID: PAT_TA_72319.pep
RIPSPMGESFVDCGRIASKPDIAFSIGGKQFVLTPEQYILKIGEGDVTQCIRGFPAMDIPCPRGPFWILGEKFMGASQPVFDYGNIKIGFAKAAKGSPVVGG

SEQ ID NO: 177902 - protein, 121 aa, Triticum aestivum
  unsure (1)..(121): unsure at all Xaa locations
  Clone ID: PAT_TA_72320.pep
PHSPGGVFFSPPGLRAKIVNFPWNFSDPWPLVGVFXNGETPGGGGPFPKWGMGVFFSPPRDGVFSKVGPFNFPLARCPPGGWVLKKGFFAPFNPWSGPLRVNPPPLGPLRGLGGYLTCWKI

SEQ ID NO: 177903 - protein, 55 aa, Triticum aestivum
  Clone ID: PAT_TA_72321.pep
KAQGVFHVDMIMLGHTPGGRERYKREFEPLAKGAGFPPIKPPYIYAKAFPMGFPK

SEQ ID NO: 177904 - protein, 121 aa, Triticum aestivum
  Clone ID: PAT_TA_72322.pep
PPQKGGWSFPWGKFFEMGQQNFGFFLPQGGKLTQGFPFAPQAWGAMEKINFSKKGGVFSQIFFGLGGGGKNFFPPPKPGPKKGGIFIFLGKRGNEGPPQRGDPYFVTIDLERWKGKQFFLN

SEQ ID NO: 177905 - protein, 45 aa, Triticum aestivum
  Clone ID: PAT_TA_72323.pep
GYASPYHVRAEYQAAPLKVAKGQQLWAQLRAMCGLEGRDAFLTRQ

SEQ ID NO: 177906 - protein, 88 aa, Triticum aestivum
  Clone ID: PAT_TA_72324.pep
IIWPPPQNPPPPLSGRVSFQQPQQQNPLGRGPFRPFQQNPQAQGFVHPQQLPPFEEIRTPGVQTLPAMCNVYTPPNCPLGPFGIFGIN

SEQ ID NO: 177907 - protein, 94 aa, Triticum aestivum
  unsure (1)..(94): unsure at all Xaa locations
  Clone ID: PAT_TA_72325.pep
GFFFPDPPKKSPPKKKKKPRPMKPPTGASVSKPGCPPPSRGEPGGLFXKRKPGDPPEGPPLDGGAAGPWLFYLKKEPPGVQPPRGQKTGVGGPP

SEQ ID NO: 177908 - protein, 112 aa, Triticum aestivum
  Clone ID: PAT_TA_72326.pep
AQPERGEFVNHKFDGPFPTQQLDFNHFENPALIILLVLKLLPLCLGPAQGLGPTAQKLGLLHFNFTPMLGDLQLVPAPWLNFFNPTFAWFGVGPMPQQLTVFPKLMGGEDQM

SEQ ID NO: 177909 - protein, 70 aa, Triticum aestivum [sequence omitted]

SEQ ID NO: 177910 - protein, 72 aa, Triticum aestivum
  Clone ID: PAT_TA_72328.pep
VCFQQFQQQYPSGQGSFQPFQQNPQAQGFVQPQQLPQFEEIRNLGLETVPPMCKVYIPPNCTIGPVGILGIK

SEQ ID NO: 177911 - protein, 77 aa, Triticum aestivum
  Clone ID: PAT_TA_72329.pep
ETNKNHMILVMLNSLFFMITLHLGTWYQFPIAKINQGFNQKMTKTNSVNTLGTISNVTWINLMNYPDGHFCNHWSPT

SEQ ID NO: 177912 - protein, 109 aa, Triticum aestivum
  Clone ID: PAT_TA_72330.pep
KRQWKRGGQRGRGKRLGNPLSFFRNGLSKGKRGRFFLFIQKKGEKFFYLGEFFCPNKGGGFWGPKGSPKVYKKIPAGWEKKVFLVLGFWFGGRRGKFWSKYFFWGNFFF

SEQ ID NO: 177913 - protein, 129 aa, Triticum aestivum
  Clone ID: PAT_TA_72331.pep
GKTQPLHLLTLTKKMNPPFFKSFNPQKKHNLSIFFITIRQDHPNFVDGITIGTNKIGPTHCFFPPCPGFKTPSRRDNPFTPCKIKLQISPNPCKTGFPPPQPLEPTDEEAPTQLFVSPTPTKKCGPIPG

SEQ ID NO: 177914 - protein, 93 aa, Triticum aestivum
  unsure (1)..(93): unsure at all Xaa locations
  Clone ID: PAT_TA_72332.pep
QLLRLHHQHHHHHQQPSSQVSFQQPQQQYPSSQVSFQPFXLNPQVQGSVQPQQLPQLXEIRNLALHTQRAMCNVYILPHWWTTIAPFGIFGTK

SEQ ID NO: 177915 - protein, 71 aa, Triticum aestivum
  Clone ID: PAT_TA_72333.pep
GGWVFGTLQTPRGQVVFKGLDWGAQIFWFEKARWGFLSQFRRGRITGTRGGGINIWGGVSGSGLVLGVDPC

SEQ ID NO: 177916 - protein, 51 aa, Triticum aestivum
  Clone ID: PAT_TA_72334.pep
QKSRAQGCVQPQQVPQFEEIRTLALQTLPAMCNVYIPPYCTIAPFGIFGIK

SEQ ID NO: 177917 - protein, 89 aa, Triticum aestivum
  Clone ID: PAT_TA_72335.pep
AYIHVSTPRPQPKRLKGQPNQGTQALLQQGSKLQTQPKGQAREGGEVATARIRRHGFRLPHPFLPSTTTAKLLHGLHRQRLPPEMNPWF

SEQ ID NO: 177918 - protein, 106 aa, Triticum aestivum
  Clone ID: PAT_TA_72336.pep
TPPIFQNPLPPKKRAPPRDPLSGGTKNPWGKRVSLQKIPIPPTLLIVPKFPPWVTPTCITPPPWITKKIPSGKAPPQTPFNCLKGPPPGPKPEWAKKNPIPTPTIG

SEQ ID NO: 177919 - protein, 164 aa, Triticum aestivum
  Clone ID: PAT_TA_72337.pep
PLFPPPSGQGPPPGLWPPPGQWVPPGQGPPGGYPIFFPPAGQGGPSGQGAPGGSPLFFWAPGQGAPPGQGAQGFPPPPPVGGGAPGAPPKGGKGQQLWGQLPAICRVGGSDPFLPRPGKNFFPVAGGLGGPAPLFSKKRGGGSPLFGGIGESPLIMQSEKVFPF

SEQ ID NO: 177920 - protein, 64 aa, Triticum aestivum
  Clone ID: PAT_TA_72338.pep
TDDGYVPLLIESGPPKDALKVPPNNVLFGQIKIGFFYGKALILFFMSPPGEKQIFPFKEIGGGK

SEQ ID NO: 177921 - protein, 129 aa, Triticum aestivum
  Clone ID: PAT_TA_72339.pep
GGVFFSPFLSTKGGGRFFKARAGGFSPPTTRANWGGLNFWGSKFSPPWARVFSPLGVPFWGPLFPKKLGALGANKKLNPFFNGEGVLCCLVEAPLSGPMQKKGGGPLLGAPARGYFKFGIKNPPKFFFP

SEQ ID NO: 177922 - protein, 51 aa, Triticum aestivum
  Clone ID: PAT_TA_72340.pep
PIRHQEKDRRNHQPKAKFQRMKKRVGQKPIGGYINPPSNNPGRLNDPRPAS

SEQ ID NO: 177923 - protein, 140 aa, Triticum aestivum
  unsure (1)..(140): unsure at all Xaa locations
  Clone ID: PAT_TA_72341.pep
EKKPLFFFFSPPTPPQFGAQGPPQKNFPKKGGGPWKIFKPGTPFPQKGPPRFSGGPFPPNYPKFFPWGKGGPXSLMGGKRGPPHGRGPKKNSPFLPPPGGFFSPKNPPNFNPLGGGFYGPFPPNPPRGARPLEKNPGVPW

SEQ ID NO: 177924 - protein, 87 aa, Triticum aestivum
  Clone ID: PAT_TA_72342.pep
GAPTQGVGHSFFRRQDHPHHQGSQFMGPFFRFIRGGGFIHPQHPVQLGVTGPWVLGIFPPMSKVFVPPGGPPPRAPFPSKVPPIGAQ

SEQ ID NO: 177925 - protein, 63 aa, Triticum aestivum
  Clone ID: PAT_TA_72343.pep
TKSLGAGALPPLSGKPPGPGVCPPPPNAPGLGKKGPRGKDAPPKGQGLNPPQLPPWPRGVFWG

SEQ ID NO: 177926 - protein, 78 aa, Triticum aestivum
  Clone ID: PAT_TA_72344.pep
HHHKGRDFFFPFFHHHQVGQVFLFKGRGFFHPQNPVNLGGIRSWVWQIFPPMCKVYVPPGGPLMGAPFPRKFGGIGAQ

SEQ ID NO: 177927 - protein, 96 aa, Triticum aestivum
  Clone ID: PAT_TA_72345.pep
NPWGNPHPVDFGKKGQKGPNANEFPGVRNLENVGGFGKLVIWGGAPQKQFPFGQFGGGGLKKKGPGLGGKNGAPPGAPRVIKKQGVPPPKKGFFPV

SEQ ID NO: 177928 - protein, 129 aa, Triticum aestivum
  Clone ID: PAT_TA_72346.pep
KTVKKGECNPQTLWKQKKGKKKKKKKKKVSFFQSWGKKKKRGIPMSNPGGILANPPPKKKTKKVFMLAPRGTINPLGGQPLLVQKRQHLGRFWNPKIFLKTFQLTSFYSPDFVAKKTGPGGGGFQPPTP

SEQ ID NO: 177929 - protein, 114 aa, Triticum aestivum
  Clone ID: PAT_TA_72347.pep
QKLCCQPLWQIPYQFQCQAIPKVVHAIILRHQQKHHHHPLSRVSFQQPLEQNPLGQGSFRPFQQNPQAQGFVHPQQLPQFEEIRTLGVQTLPAMCKVYTPPYCPIPPFGIFDIN

SEQ ID NO: 177930 - protein, 188 aa, Triticum aestivum
  Clone ID: PAT_TA_72348.pep
TRAVVVVDPVFFEVDLRVKGKTEFEDRALSYLVVSCRDSGCRESYMFKRVETSKLSTVELTLADMAEFVEAPISVKVVDGEWPKGFGGLIFARTASISDMEIKLLAFDKLPVAADGTIQLSRCVLSVEADGMLRVFVMAMANCLKDQTVEEDFKAFPAREASKSMGMLEVGFCKLEVPIAWFFVPAMV

SEQ ID NO: 177931 - protein, 65 aa, Triticum aestivum
  Clone ID: PAT_TA_72349.pep
KTGNPPHIYCITKGPPSLNPIPPAKIFIPGWPKMPPPPPPRTLPAPAPQPSAPFPPLSWPPGPPP

SEQ ID NO: 177932 - protein, 104 aa, Triticum aestivum
  Clone ID: PAT_TA_72350.pep
NHSKLHWSRELAKQLTHHIISSIHHSLPETIWQQILLQTDQIKCLWATPQLYMISQHKCIRHRAPDFAVTPPPTNSRPFHQKRTFPLVVVGHKSNMLVYIKSAS

SEQ ID NO: 177933 - protein, 91 aa, Triticum aestivum
  Clone ID: PAT_TA_72351.pep
YFGMLNGLLVVKKFPEKSRERCQAIFCNACKKKGRFQFHWLSHKWVSCGFSNPRVIKIDPADCFPPNKRGENFFFLSFGFGKKIFTDPCVE

SEQ ID NO: 177934 - protein, 142 aa, Triticum aestivum
  Clone ID: PAT_TA_72352.pep
FWGPPQKHRPPPWGGVSFQHPWEKNPLGRGPFGPFKKNPRARGFFPPQKIPPFGEKRTLPPQGVPQRGKVHPPPNGPLGPFGILGVKGKKKTFGVKKINPRFSPPGFGFWPGKKKISPALSCKTPKKIGSTLGKKTNPGFFF

SEQ ID NO: 177935 - protein, 65 aa, Triticum aestivum
  Clone ID: PAT_TA_72353.pep
PKGGGGALNPLGDPPGGGTPPQIGPGSPVPRDAPPGQKVGFFFSRRIGFFKGQGSPFFSKAAKAP

SEQ ID NO: 177936 - protein, 95 aa, Triticum aestivum
  Clone ID: PAT_TA_72354.pep
NPQKTKDPPFQTYLGPKPPSDFPPPPPFFYSPTPEKGSTPKPNPDPPQSDSPGQGNPSPLTPFPTDPPNQLNALGHKGPPLGMGGPQVGVPKKTP

SEQ ID NO: 177937 - protein, 74 aa, Triticum aestivum
  Clone ID: PAT_TA_72355.pep
GKSGVELWKNMVTSTHNAPTQNFRASNSLGTLYHTNRLAYHTGKPNNSNSKVFYGLSNLCNTTTTGLKKRDFRI

SEQ ID NO: 177938 - protein, 119 aa, Triticum aestivum
  Clone ID: PAT_TA_72356.pep
QQLCCQQLWQIPEQSRCQAIHNVVHAIILHQQQQQQQQQQQKQPLSQVSFQQPQQQYPSGQGSFQPFQQNPQAQGFVQPQQLPQFEEIRNLALETLPAMCNVYIPPYCTIAPVGIFGTN

SEQ ID NO: 177939 - protein, 110 aa, Triticum aestivum
  Clone ID: PAT_TA_72357.pep
FTKTPGPGVLSPPKNAPGSRKKGIWGAGRAHKGERFKPPQMGGPPWGHWAFGGLIEKKKTLVLKKGTPVFLMPGLTLGGGKKKRVRPFQGKPRKILVQIGEKKPTPFFVG

SEQ ID NO: 177940 - protein, 69 aa, Triticum aestivum
  Clone ID: PAT_TA_72358.pep
IGGGTGCLKNFARNWLWPGKFTGSFFLRCPKAPARGGTGLGGFSIEQRGKFAGRFWPCNKTGGGLVNEC

SEQ ID NO: 177941 - protein, 108 aa, Triticum aestivum
  unsure (1)..(108): unsure at all Xaa locations
  Clone ID: PAT_TA_72359.pep
PLWEIPYHFQCQPPPNFFQAIFLPPQKKHHPPPLGRFSFQHPFQKIPLGRGSFRPFXKNPQAPGFFHPQKSPPXGEKRTLGVPTAPPMANFXTPPNCPLAPFGFFGFN

SEQ ID NO: 177942 - protein, 100 aa, Triticum aestivum
  Clone ID: PAT_TA_72360.pep
PGQGHQFGQWVQPGQGPQGGSPLFLPQTGQGHQSGQGPQGYSSSTPVRVEPQGAPLKVAKGHQLWAQIPAIFRVEGGDPFLAPQKKNFFQLAWGLGKQAL

SEQ ID NO: 177943 - protein, 49 aa, Triticum aestivum
  unsure (1)..(49): unsure at all Xaa locations
  Clone ID: PAT_TA_72361.pep
VVPQGTSGFPPMDTPPPRGPFWILGGVFRGPSPPVFDXGKWGVGFPKGA

SEQ ID NO: 177944 - protein, 46 aa, Triticum aestivum
  Clone ID: PAT_TA_72362.pep
YYIFSFHRPQILITSLPNGCWWGYWWDGERSCDCWGGYGIGNCCWG

SEQ ID NO: 177945 - protein, 59 aa, Triticum aestivum
  unsure (1)..(59): unsure at all Xaa locations
  Clone ID: PAT_TA_72363.pep
GGTPPGGPPKSPQPPFLGFEKPKKAGWPPPWPPPLGDPQQKEPRXFSKQGPKEKGGPPF

SEQ ID NO: 177946 - protein, 86 aa, Triticum aestivum
  unsure (1)..(86): unsure at all Xaa locations
  Clone ID: PAT_TA_72364.pep
IFGVNVEKFYYKYFARGKKTRAKKXKGGCFRFKRSPPKICPNFKKXVPKALDVGLIKGIGGVPAPKKNFGGGFFFREGAKPPEMPF

SEQ ID NO: 177947 - protein, 94 aa, Triticum aestivum
  unsure (1)..(94): unsure at all Xaa locations
  Clone ID: PAT_TA_72365.pep
FLGVIALLISVKDEIFSTLQHFWVGLRLLWVNVRIXLSRLLLKVANGKRLFKKERSQVTRPAADLFKVVPLLVFVGVPFFVFPCTKTIAGLDSG

SEQ ID NO: 177948 - protein, 119 aa, Triticum aestivum
  Clone ID: PAT_TA_72366.pep
KKKKLGGKKKKKTLPPKHKNFGGPFNPSPHTIFSQGLASFSKKPPGKTGPPKRGAPEPLPLRGGKKPKGEPFPPLLGRPPSQKPKIFFPGGDGAPPPGFQKKGGPTPGGPGEPFFKKLG

SEQ ID NO: 177949 - protein, 52 aa, Triticum aestivum
  Clone ID: PAT_TA_72367.pep
IITPFFITGQVPPTKDHYLDTINNPSTPITKFFNFKLLTNSMATHYLKKYYT

SEQ ID NO: 177950 - protein, 98 aa, Triticum aestivum
  Clone ID: PAT_TA_72368.pep
GANGVIFEMDWMELKRVIPSRGYDRSVLGFLFRGIKFQFKGGFDYVKVNVCLRACNNAAPPKGENGNGLGRGVFKKWLGPFPGFVLNFVVGGLASLFW

SEQ ID NO: 177951 - protein, 59 aa, Triticum aestivum
  Clone ID: PAT_TA_72369.pep
PKKNLFFFFFPNLKKSNSGFYIKMHFTFFFTPSTTKPFFKKTGFHFFKKRGLFFLINPH

SEQ ID NO: 177952 - protein, 78 aa, Triticum aestivum
  Clone ID: PAT_TA_72370.pep
PFQIFLINQTPNWIMETRGKIPPLGASNACPMLNLSNVTPQFPFIFLPPSQIFKKPHLIPFPHKNLWPPKNTKKRGQF

SEQ ID NO: 177953 - protein, 61 aa, Triticum aestivum
  Clone ID: PAT_TA_72371.pep
KTLNTPYIYCITKMHSFLNPIPTAKNSFTCLPTIPSPPPTRTFPATFPPTSSPFPPLSWPP

SEQ ID NO: 177954 - protein, 101 aa, Triticum aestivum
  Clone ID: PAT_TA_72372.pep
QAIPNVVHGIILHQQQQQQQQQQQHPLSQVSFQQPQQQYPSGQGSFQPFQQNPQAQGFVQPQQLPQFEEIRNLGLETLPAMCNVYIPPYCTIVPVGFLGIN

SEQ ID NO: 177955 - protein, 86 aa, Triticum aestivum
  Clone ID: PAT_TA_72373.pep
QTFFKIFKNVIENPTDFWYKRLGKTNLHFQRRVGNYKVAMGVLELIGFCKDFVLDKIGGGEPFLVFKRNDFGLLWVGKSSLEGSRG

SEQ ID NO: 177956 - protein, 41 aa, Triticum aestivum
  Clone ID: PAT_TA_72374.pep
PSHVRAKQQGASPMVGKGEKPGKKLPTVCWMEGGEALLGSQ

SEQ ID NO: 177957 - protein, 90 aa, Triticum aestivum
  Clone ID: PAT_TA_72375.pep
GVLAFEGFFPRAFMLNGGQCFFKRGFSGFPCKGFSGPNGVFPANWVFYLFLGFFLKQFSLFFSVFLGGKIFFPQFFLKKPFFKKEKTLFF

SEQ ID NO: 177958 - protein, 43 aa, Triticum aestivum
  unsure (1)..(43): unsure at all Xaa locations
  Clone ID: PAT_TA_72376.pep
EKARGGFLVRWKGNFXGPLGTYKGDATLAEGALESLHVKEYKE

SEQ ID NO: 177959 - protein, 64 aa, Triticum aestivum
  Clone ID: PAT_TA_72377.pep
QYPSGQGSFHPFQQNPQAQGFVQPQQLPQFEEIRTLGLKPLPAMCNVYIPPYCPIAPVGFLGIN

SEQ ID NO: 177960 - protein, 87 aa, Triticum aestivum
  Clone ID: PAT_TA_72378.pep
KNEIAGISQEGDPIEGVRKLLLTHDLATAQEFKDMEKEFRKEVALAIAKAKESPMRDTSELLKNVYVNDCGLDFFGVDRKVVKTVFQ

SEQ ID NO: 177961 - protein, 82 aa, Triticum aestivum
  unsure (1)..(82): unsure at all Xaa locations
  Clone ID: PAT_TA_72379.pep
FCQQSGQGHQSGQGQQGXYPIFLWQPGQGQQPGQGQQGYASPYHVSGEYQAARLKVAKVQQLAAQLPAMCRLEGSDALSTRQ

SEQ ID NO: 177962 - protein, 74 aa, Triticum aestivum
  unsure (1)..(74): unsure at all Xaa locations
  Clone ID: PAT_TA_72380.pep
IKKLEEAVRSVXKEGFTWGGFKVKPVGYGIKKVQIMLTIIDGLVSVDTFIXEVVWEGPIKENVQLCEIVAFNKI

SEQ ID NO: 177963 - protein, 55 aa, Triticum aestivum
  Clone ID: PAT_TA_72381.pep
IGGGGAAPVPVSPEAAAALANDVSYGVVSLRVVLFGRVRLVSGPFRSGWRSMYAR

SEQ ID NO: 177964 - protein, 65 aa, Triticum aestivum
  Clone ID: PAT_TA_72382.pep
VFSRIDHKFDLMYAKGAFVHWYVGEGMEKEKFFKAREDFVALEKDYEKVGVEFNKGEDGDKGDEY

SEQ ID NO: 177965 - protein, 62 aa, Triticum aestivum
  unsure (1)..(62): unsure at all Xaa locations
  Clone ID: PAT_TA_72383.pep
PLGQGSFQPFXKNPKGQGFVQPXKLPQFGEKRNLGVKRVPAMGKVXIPPNWTIGPVGIFGVK

SEQ ID NO: 177966 - protein, 128 aa, Triticum aestivum
  Clone ID: PAT_TA_72384.pep
KTKNLKNQPREKKGKTQTPPPFSPQKGKFKNKTPTKNPKKIVYTKINGKNFPPSGPGGVFPKKAKFLKTLENLGNPPRKGANPPPQGGVFPFPRGNEPKPLQKKLFDFKPQTKPFLQKLGGPPKPPLG

SEQ ID NO: 177967 - protein, 64 aa, Triticum aestivum
  Clone ID: PAT_TA_72385.pep
KKCSTKTRNFHLKKRVFNPMQLEKINPYLLKKKNLVKKKGLGKKNSSKNFAFKTGPPPFTIQKP

SEQ ID NO: 177968 - protein, 54 aa, Triticum aestivum
  unsure (1)..(54): unsure at all Xaa locations
  Clone ID: PAT_TA_72386.pep
LGRGPFLKPHQKVKFEVMISIGVGILPKMGRVNVRLXKTPNSVPFKVGPGVGAY

SEQ ID NO: 177969 - protein, 107 aa, Triticum aestivum
  Clone ID: PAT_TA_72387.pep
SNFFENPNRPSPPIMMCPSLTLEKSTWLFKTSPPSALCFFKNFSPQYNQTTFKDSKCGPTNSPKIPHPPLEKKNNIFFLGNFYPTPSKKIKKNHEDLGPNQTNQSFL

SEQ ID NO: 177970 - protein, 61 aa, Triticum aestivum
  Clone ID: PAT_TA_72388.pep
KDEGVVFWGKAVLGYIDVEPIGVKDAADGKAIFGSKKGFTGGDSSKKGINFVLGSPAKDNK

SEQ ID NO: 177971 - protein, 73 aa, Triticum aestivum
  Clone ID: PAT_TA_72389.pep
QVCFQQFQQQYPSGQGSFHPFEQNPQAQGFVHPQQLPQFEEIRNLALKTVPAMCNVYIPPYCPIAPVGIFGSN

SEQ ID NO: 177972 - protein, 36 aa, Triticum aestivum
  Clone ID: PAT_TA_72390.pep
KKSLVYPCDKRVFSVHGLLTLPFNGQKFLCNAFMLI

SEQ ID NO: 177973 - protein, 93 aa, Triticum aestivum
  unsure (1)..(93): unsure at all Xaa locations
  Clone ID: PAT_TA_72391.pep
PPKNPYSRWIFGPPLEVIPKKRVXKPLIPXFPPKISSLEIKGGLQKPQVXKRPQKARVPHSPNSPGGKGPLQKVSKGPKISGGGGKLLNFFPP

SEQ ID NO: 177974 - protein, 63 aa, Triticum aestivum
  Clone ID: PAT_TA_72392.pep
LGQHPQQQQLAQGPFLHPPQKVRLGVMISIGAGFLPTMSSVNVPLYKPPPSVPFAVGPGVGPS

SEQ ID NO: 177975 - protein, 75 aa, Triticum aestivum
  Clone ID: PAT_TA_72393.pep
KKKHFSTLLLKKCGAPQGSTGKKNLKKTPPWKKPFPPKEKNQKNCPPGFMGNPPFSQNFPRDPFFQTLLLKTPTL

SEQ ID NO: 177976 - protein, 97 aa, Triticum aestivum
  unsure (1)..(97): unsure at all Xaa locations
  Clone ID: PAT_TA_72394.pep
QEQQQVQGSIQFQQQQPQQLGQCVSQPQQQSQQQLGQQPQQQQLAQGTFFXPHQIVRVEVRASIGVGPVPAMCRVNVPLYRPTISVPLGVGGGVGAY

SEQ ID NO: 177977 - protein, 119 aa, Triticum aestivum
  Clone ID: PAT_TA_72395.pep
FRQMLYSGTFIHHSHIATIFSPPGKPWAFFFFGPYIDHLPCPTRAGTPHGNVVGGGGGALPRFVNVAHPPQGLNQHPNALMLGWLLRVEHTLPLLWGLLFPETPTHFLDGLATKLPRDL

SEQ ID NO: 177978 - protein, 105 aa, Triticum aestivum
  Clone ID: PAT_TA_72396.pep
FPAGQSDFLGSSPVRVFFPKCEVFPYPGSRSQGTFDGASLGRPSPLFFLRTTPPLNPQSPSQQYVPRVLGFKFPKHSWGIFPSGGYLFFPRVKKGPPGPKNVGPF

SEQ ID NO: 177979 - protein, 93 aa, Triticum aestivum
  Clone ID: PAT_TA_72397.pep
QGNPNLLYTKREKHKRVKKKENPTPKKPGTFFKPVPFALLKGIFAAMGPPNSCRPFSPFYLVSTLNHQGFNLFYMKEQAFGFSSLKNCGGYRG

SEQ ID NO: 177980 - protein, 65 aa, Triticum aestivum
  Clone ID: PAT_TA_72398.pep
SKRPAPWWERGTSPGHRFPQFFGWRGGTHFWVASDKTFCRLQGGWAGMPLRYPINVRGVSSFLCK

SEQ ID NO: 177981 - protein, 83 aa, Triticum aestivum
  unsure (1)..(83): unsure at all Xaa locations
  Clone ID: PAT_TA_72399.pep
HHHHHHHPLSRVCFHHFHHQYPSGRGPFHPFQQNPRARGFFHPQQFPRFGEKRTLALKPPPPMANVXTPPYCPLAPVGFLGTN

SEQ ID NO: 177982 - protein, 93 aa, Triticum aestivum
  Clone ID: PAT_TA_72400.pep
HIVVKFVELVIKIDRRFGKELEALPKFLKNGDVGIVKMIPPKPMVVETFATYPLFGRFVVGDMRQTVAVGVIKGVEKKAPPGAKVTKVAIKKK

SEQ ID NO: 177983 - protein, 98 aa, Triticum aestivum
  unsure (1)..(98): unsure at all Xaa locations
  Clone ID: PAT_TA_72401.pep
NPLGRGSFRPFXQNPQAPGFVPPQQLPPFGEKRDLGVQTVPPMGKVYTPPNWPPPPFGIFEINWKKKNFRAKKMKPRFFRPRFGCWSGEKKMCPSPFM

SEQ ID NO: 177984 - protein, 71 aa, Triticum aestivum
  Clone ID: PAT_TA_72402.pep
GKKNPGWAFIPKVEPKKGGVLHERALAKYFFPGPTTKPGAGKTGVQKSRTKGISLPSRIQKPQGGGGAKWG

SEQ ID NO: 177985 - protein, 70 aa, Triticum aestivum
  Clone ID: PAT_TA_72403.pep
HYKGQRGNTNFWTKKPINLTYLKRGETLQGGGGNKKFNLPMEYTKHGDLLPNMGDFLAPFFKNSTLDKKL

SEQ ID NO: 177986 - protein, 72 aa, Triticum aestivum
  Clone ID: PAT_TA_72404.pep
PQFACPPLPPLGSWGLTEKGKTLFLEILNPGFLKHGLVVGTVKNKVTGPFLLEPQLDFFQLGNKKQTPVLFA

SEQ ID NO: 177987 - protein, 65 aa, Triticum aestivum
  Clone ID: PAT_TA_72405.pep
NVVETLQWHESIVKNCFWHPPPPTLVSSSWDGYLVRWEATEDDDDPPPPNKGKQRMCPKGYPFPL

SEQ ID NO: 177988 - protein, 55 aa, Triticum aestivum
  unsure (1)..(55): unsure at all Xaa locations
  Clone ID: PAT_TA_72406.pep
KSVKPFKLVPKKLGGKFLRHPGPLPGLNPKIPFFLAPNGXKVVLVDHGDFPKEFP

SEQ ID NO: 177989 - protein, 58 aa, Triticum aestivum
  Clone ID: PAT_TA_72407.pep
YRAGVHIMGHITLFIIGTLNTHWLNNNDPFVLYYRASFHWPPMLGKLLPYGCCWGYGW

SEQ ID NO: 177990 - protein, 102 aa, Triticum aestivum
  unsure (1)..(102): unsure at all Xaa locations
  Clone ID: PAT_TA_72408.pep
NPLGQGSFRPFQKKSQAQGFFHPQKMPPFEEKRNLGVQPPPAKGKVXTPPNWPLGPFGILGVKRKKKNFRTKKMKPRFFNPRKGCWNGEKKICQALSCKNPN

SEQ ID NO: 177991 - protein, 80 aa, Triticum aestivum
  Clone ID: PAT_TA_72409.pep
KWPEGCVKGLRARGDTTVSIFWEKGEVQEAVLWFNNRNNLGLRLHYGGQVAEATVEVGHVYRLDGFLQCVEIWALYKCPF

SEQ ID NO: 177992 - protein, 73 aa, Triticum aestivum
  Clone ID: PAT_TA_72410.pep
FNLGGCQKTFQKGPLFCFGFLGWLKKTLSFWKRGHWGFGGPPIKPPRFLWGLVLWLKKKGPISPGPPSGGGGI

SEQ ID NO: 177993 - protein, 126 aa, Triticum aestivum
  Clone ID: PAT_TA_72411.pep
NYWWNKNLGGGAQRAIQQQGLISQIDQWGFIFPSTGGTNWNRLQSNPIITTTTPSEGPDKMNKTPRGPNPLFLEGYVHRRRVGTEPFGLPLAQVQRETNVLRRTLQVGVFQLAVASLLVAHWGHAH

SEQ ID NO: 177994 - protein, 62 aa, Triticum aestivum
  Clone ID: PAT_TA_72412.pep
KFSVPQECVVSFKTGIHCFFPGRNGLVSFSGPHEQSIVQIFPNQANIFLGFVQKKKHADPSP

SEQ ID NO: 177995 - protein, 73 aa, Triticum aestivum
  Clone ID: PAT_TA_72413.pep
FFQQPQQIQQLGQQPQQQQIPQGIFLHPPQKFQLEGMTSIALRTLPKMGGVKGPLYSSPPIMPFSIGTGVGGY

SEQ ID NO: 177996 - protein, 77 aa, Triticum aestivum
  Clone ID: PAT_TA_72414.pep
GGPPGAPQKGGKGQQVLGKVPANVPVGGGKPILAPPKKKFFPAGRVFRQPPLLVNQKISGVSPFFQEKKESPGNNPK

SEQ ID NO: 177997 - protein, 81 aa, Triticum aestivum
  Clone ID: PAT_TA_72415.pep
PSPFEIPITISNIPPSKGKKPGTPALQGVFWRNINPGENQTTTPSAGALTPWGGDQSSPLLNLSTPCWRGATLTTRGGTEK

SEQ ID NO: 177998 - protein, 63 aa, Triticum aestivum
  unsure (1)..(63): unsure at all Xaa locations
  Clone ID: PAT_TA_72416.pep
NPLGQGSFGPFXKNPKAQGFVHPQKMPQFEEKRNLALKRVPAKGKVYIPPNCPMGPFGILGVK

SEQ ID NO: 177999 - protein, 66 aa, Triticum aestivum
  unsure (1)..(66): unsure at all Xaa locations
  Clone ID: PAT_TA_72417.pep
QNPSSRVSFHPFQLNPQGQGSVQPQKMPQFGEKRNLGVQTVPPKGKVXTPPHWWPPLGPFGIFGPH

SEQ ID NO: 178000 - protein, 86 aa, Triticum aestivum
  Clone ID: PAT_TA_72418.pep
VPGAPPKLCMDAALLEDFRARALSLLSIAGLSGFCQVSIPLGTPDGVPVSVSLLAGHGGDRFLVAVAQELHEALQAEAAAAWGSSA

SEQ ID NO: 178001 - protein, 83 aa, Triticum aestivum
  Clone ID: PAT_TA_72419.pep
YPYRVGMVKKKKKPGGEKQYITKGLPKRENHNTRPVSPRQKTTINKAFPTYPKRETVGTGGSPQGPGPCIKNGQQLKMAKPTL

SEQ ID NO: 178002 - protein, 111 aa, Triticum aestivum
  Clone ID: PAT_TA_72420.pep
FLGEGFPPPPNLILNKGGKTHGHHRAILGIELGSLGGKTGCPTKKPRVGFRVCLVWPTTKTKNFFFSKKSRFKGSFAAKYKSKSKFALESGSFKGLKPSIPFPPEPPPTGG

SEQ ID NO: 178003 - protein, 55 aa, Triticum aestivum
  Clone ID: PAT_TA_72421.pep
FLKHFIPYKETNKFPIQKFPPVLYLKTKIPILKWTGSTSKIFGNTNLKPVQTQTI

SEQ ID NO: 178004 - protein, 72 aa, Triticum aestivum
  Clone ID: PAT_TA_72422.pep
WGTSAGGSSFRGTWLWIRRETSCGPRPGQAKKRPPRSKPRINQGLDPRGIKVGGGGLIKSSRGFFGSILGGG

SEQ ID NO: 178005 - protein, 74 aa, Triticum aestivum
  Clone ID: PAT_TA_72423.pep
TKKGGKKKTWLAFIPKPEITPGGGTHEGAPPFIWQPYIEWGLNLTTKNPLPIKIALQVFIGPQCPRLCWEKGPP

SEQ ID NO: 178006 - protein, 58 aa, Triticum aestivum
  Clone ID: PAT_TA_72424.pep
GPFWPFQQNPQAPGFFPPPQFPPFEEKRTLVVPAPPPMGKVYPPPNCPFGPFGIFGVN

SEQ ID NO: 178007 - protein, 55 aa, Triticum aestivum
  Clone ID: PAT_TA_72425.pep
RPFNQTPQPQGFFHPQQFPRFEKIRTLGFQPFPPMSNVSPPPYCPFAPFGFLGTN

SEQ ID NO: 178008 - protein, 76 aa, Triticum aestivum
  Clone ID: PAT_TA_72426.pep
GGRPREGDLGCPLPLGKSKSLSGPLKEKKVPIAGIVFSPLFWGPLSPKKGKPGINLGFNPLAWEKNSGVPTLLDEG

SEQ ID NO: 178009 - protein, 64 aa, Triticum aestivum
  Clone ID: PAT_TA_72427.pep
PACPKHNKPKGFFDDVLKKADPANYGGIGYGKFVALMTQGKIGGGGRTIRNRLNISIKDAPGAI

SEQ ID NO: 178010 - protein, 132 aa, Triticum aestivum
  Clone ID: PAT_TA_72428.pep
RESLQKLWRYRVDIAFFGHVHNYERTCPLYQSQWVTNERSNYSGTMNGIIFVVAGGNGSHLSRYTSAIPKWSVFRDKEYGFTKVTAFNHLSVLFEYKKSSEGKVYDSFTIHREYRDVVGCVHDSWFPTTLGT

SEQ ID NO: 178011 - protein, 106 aa, Triticum aestivum
  unsure (1)..(106): unsure at all Xaa locations
  Clone ID: PAT_TA_72429.pep
QNPRAPGFVPPQQLPPFGEKRAPGVKAPPPRGKVXTPPNCPLGPGGFLGANWKKKNFWGGQMNPRFFSPRVGGWSGEKKKGPPGSCKTPQLFCSTRGKKTHPLFFF

SEQ ID NO: 178012 - protein, 76 aa, Triticum aestivum
  unsure (1)..(76): unsure at all Xaa locations
  Clone ID: PAT_TA_72430.pep
GQWSPSGADRAAGRVPGFGVFTHIFSGGIXWGPRPSTGVADGIGFSKFFCDLLGVGGGDNFFCYNHSPFAFLVKDV

SEQ ID NO: 178013 - protein, 74 aa, Triticum aestivum
  Clone ID: PAT_TA_72431.pep
FLPAPPVRGGSPVGFGLLNKGGKRIFQVFPYYGGGTGDHPGLKLGGFSLPIFFLKGFLKEGPGPISLEKGPLEG

SEQ ID NO: 178014 - protein, 118 aa, Triticum aestivum
  Clone ID: PAT_TA_72432.pep
VKIGVLGSQFRSRGAEQFKGPVFRGVFSTPGVFPVVQGDYKVFDEIGVDPKAIELVMPRAGVLGPKVVKGFKFVAGDIVGVFRELGNYPGPPWEIWPVFPCFHGKPWVVPFGGHGGEL

SEQ ID NO: 178015 - protein, 80 aa, Triticum aestivum
  Clone ID: PAT_TA_72433.pep
PPLMPPPRAPPPGFQGSGGFFLQGPRRFFFVPKIFPELFWVSFRNWGKGAFFQFFCPSQNKNGGAPWFPKLFFFKNCLFP

SEQ ID NO: 178016 - protein, 65 aa, Triticum aestivum
  Clone ID: PAT_TA_72434.pep
EEKEDPRSLRMEPRMGKFMRKFFFPKNPHMEKISPVFPEGGFPVPVKKIPPPEPKKPKPLQVQVP

SEQ ID NO: 178017 - protein, 66 aa, Triticum aestivum
  Clone ID: PAT_TA_72435.pep
NQLIPYPFTGVLIMPPLENWGLNYGPPPQKAWPGRAVFQSSPFRPGFGGGKGGLQWGKPQGGEHWT

SEQ ID NO: 178018 - protein, 64 aa, Triticum aestivum
  Clone ID: PAT_TA_72436.pep
PLEVESFDPLANVKAKIQDKEGIPPDQQGLIFVGKQLEDGRPLAGYNIQKGSPPPLVLPPRGGQ

SEQ ID NO: 178019 - protein, 87 aa, Triticum aestivum
  Clone ID: PAT_TA_72437.pep
KNLCFGNPWIPQLPKTSPKTLGSKKFKGETFRGGFFGGFNPRGPKKQLFSKKPGGKLKKRSPPCFQGGGPPWGPKKFGEPGPHPKGF

SEQ ID NO: 178020 - protein, 87 aa, Triticum aestivum
  unsure (1)..(87): unsure at all Xaa locations
  Clone ID: PAT_TA_72438.pep
ILPPPQKPPPPLLGRVSFQQPXQQNPLGRGSFRPFQQNPQAPGFVHPQQLPPFEEKRTPGVQTFPPKGKVYTPPNCPLAPFGILGVN

SEQ ID NO: 178021 - protein, 88 aa, Triticum aestivum
  Clone ID: PAT_TA_72439.pep
NPPFQKPWAPHWRGPDPSWWAPESSPGPVLKPPPPLKEKPAWFVNQKKQNLGGQRVLRSGFCGVGEKPLWVGRFFLLGDWLTFFGFLN

SEQ ID NO: 178022 - protein, 70 aa, Triticum aestivum
  Clone ID: PAT_TA_72440.pep
PKDFPKLVLGSHSDDPAPLGFCNLGGRFSLWENMVNPVVYDKKIKFYLDQCGEACVNFCNGDGGLPSLNG

SEQ ID NO: 178023 - protein, 80 aa, Triticum aestivum
  Clone ID: PAT_TA_72441.pep
QQKQPLSQVSFQQPQQQYPSGQGSFQPFQQNPQAQGSVQPQQLPQFEEIRNLALETLPAMCNVYIPPYCTIAPVGIFGTN

SEQ ID NO: 178024 - protein, 82 aa, Triticum aestivum
  Clone ID: PAT_TA_72442.pep
RPLLVPCCSSQVMYLGFNFFQFGMAKCLMSILWAGFFFFCTANVTPRGPWYFPHQIVSVLRVIFSSPGCCPPLLNNGLCILA

SEQ ID NO: 178025 - protein, 64 aa, Triticum aestivum
  Clone ID: PAT_TA_72443.pep
RIGSPAPAREAGHVYCCRSEGGRCSCEKSMGSHTPSSGLCSPLELPWEAKCSFALIYSGSPFVF

SEQ ID NO: 178026 - protein, 139 aa, Triticum aestivum
  Clone ID: PAT_TA_72444.pep
PPQNPPPPPWGRVPFQQLLQKIPLGRGPFRPFRKTPRARGFVPPQKCPRLGEKRTLPPQGAPAMGKVNPPPNGPLAPLGFLGVNGKKKTFGLKKINPRFSPPGFGGGTGEKKMCPPLSCKTPTYIGSTWGKKTNPGFFF

SEQ ID NO: 178027 - protein, 65 aa, Triticum aestivum
  Clone ID: PAT_TA_72445.pep
QGQQGYAGPNHVGGGGQGAPLKVAKGQQLGAQLPEMCRVEGKDAFLTRRGKNFLQLAWGLGRDAP

SEQ ID NO: 178028 - protein, 59 aa, Triticum aestivum
  Clone ID: PAT_TA_72446.pep
RGPFGPFRQTPRAQGFVHPQQWPRFKKIRTLGFQPFPPMANVTPPPNGIIPPLGFLDIN

SEQ ID NO: 178029 - protein, 71 aa, Triticum aestivum
  Clone ID: PAT_TA_72447.pep
TLTGKTITLEVESFDTIDNVKAKIQDKEGIPPDQQGLIFAGKQLEDGRTLADYNIQKESTLHLVVRFRGGQ

SEQ ID NO: 178030 - protein, 70 aa, Triticum aestivum
  Clone ID: PAT_TA_72448.pep
LPGKTIILGVEGSAPLDNVKVKIQDKGGIPPDQKGLFFFGKQLEDGRPLGGYNIQKGSPPPLGVRPPGGQ

SEQ ID NO: 178031 - protein, 88 aa, Triticum aestivum
  Clone ID: PAT_TA_72449.pep
KINSHFFPKSFHINLVHNLPPPIQIFYRGGIPFFQKSNFINLSLFQKTIPHALWHKQKRVKSRCQFLKMKSPGGPPIWEKNKKWSTNF

SEQ ID NO: 178032 - protein, 48 aa, Triticum aestivum
  Clone ID: PAT_TA_72450.pep
NNSLPQIRKGPNTKPPFLWKKKKQMGRGNPTTQLTQTRGAITGLTLPH

SEQ ID NO: 178033 - protein, 131 aa, Triticum aestivum
  Clone ID: PAT_TA_72451.pep
GGIKKTISRLMILFKPMGNGVVCPTLGGVPFKVLLLGVTNFLGFELVDISENVGTINDISGKAKVFLVLPEAFLEGFFKLWIFISLSRPFEKIQARGGFVKLDKYRKFPNARGVFVIGSVVWIGYEGGKSP

SEQ ID NO: 178034 - protein, 78 aa, Triticum aestivum
  Clone ID: PAT_TA_72452.pep
KLVCQNPIRDILPPPGIMQNYHWESMEFPTLVALGEPPKPMGGTIVGPLFFLTFQRGQKAFILNPLFTPFLWKKWGQR

SEQ ID NO: 178035 - protein, 65 aa, Triticum aestivum
  Clone ID: PAT_TA_72453.pep
TAPPGGQVKGFRGAQKQKRGWLGKVPRRGPFVFIWPGQSPSGGGFSFLLGVEWEFYGGGWVTRVK

SEQ ID NO: 178036 - protein, 118 aa, Triticum aestivum
  unsure (1)..(118): unsure at all Xaa locations
  Clone ID: PAT_TA_72454.pep
PQKPPPPPLGRVSFPPPLGQNPFGRGSFRPFXQNPPAPGFFPPPQMPPFGGIRAPGVPTVPAMGKVFTPPIWPPPPFGVFGFNWEEKNFGARNINPPFFRPRFGCWSGEKKMCPGPFL

SEQ ID NO: 178037 - protein, 91 aa, Triticum aestivum
  Clone ID: PAT_TA_72455.pep
RGSIQFQQRHPHQLGQCVSPPHHQLHQQLGEHPQQQQWARGPFFPPPQKAQLGGMTPLGPGTPPTMARVNGPLSKPPPRGPFTVGPGVGPF

SEQ ID NO: 178038 - protein, 63 aa, Triticum aestivum
  Clone ID: PAT_TA_72456.pep
KTGNPPHIFCIPKGLASLTPMPTGKNFITGWPKMPPPPPTGKLPEIGPQTAAPLPPLGGPPGA

SEQ ID NO: 178039 - protein, 128 aa, Triticum aestivum
  Clone ID: PAT_TA_72457.pep
GINLACPLINITNLELGVQKYTHACVRANQKIKKPTYYLFTPSPYIYIYMYLQLDKGRDLTTSFFLWIFTYSHAGRIHICEITNTIYKYRCSCLDSQPACLLTKTLDFFGNRGGIFDGEPFATVALGV

SEQ ID NO: 178040 - protein, 89 aa, Triticum aestivum
  Clone ID: PAT_TA_72458.pep
KPKGPPFFGGMEGNFFCLPKTPLGGKPFNSFFKIYKNSTTLNSKQKTSKRVLPKLPTRTGFNWENPPFFLEPPFCTRFFATGKKRAGGF

SEQ ID NO: 178041 - protein, 63 aa, Triticum aestivum
  Clone ID: PAT_TA_72459.pep
NVVGVEVGVAGILEGIEGGNFSSKWILNVSLRGRSRDPWNCLVVQGYLNFVTPELGGQLRTDC

SEQ ID NO: 178042 - protein, 77 aa, Triticum aestivum
  unsure (1)..(77): unsure at all Xaa locations
  Clone ID: PAT_TA_72460.pep
PPLSQVCFPQFQPQNPSGRGSFPPFQQNPQAQGFVPPQQLPPFEEKRTPALKTPPPMGKVXTPPNCPLAPVGILGVN

SEQ ID NO: 178043 - protein, 89 aa, Triticum aestivum
  Clone ID: PAT_TA_72461.pep
GSCNRQGGMWGGLFPSVVDPPGGQHEASALGRTRGFSIFVGKRPRFTRIIALQTSFCKKCAVGGGLNRPQGFEVQKMVFFKGQLCPLPG

SEQ ID NO: 178044 - protein, 113 aa, Triticum aestivum
  Clone ID: PAT_TA_72462.pep
VRCGYPPPAHVGRALATGIFERVHVRPYESAKWCTQTLGWEGSWDKWTAGYPPTRFYVGLTGDDKSPQWVPPKNVYYGVAPVAQKKDNYGGIMFWDRYLAKQTNYSSLIKYYA

SEQ ID NO: 178045 - protein, 87 aa, Triticum aestivum
  Clone ID: PAT_TA_72463.pep
PYVGNPWLVLAQVLLNAEGRWKKPKPPPKKGFRLVVEWATSWAKRMSWKGWVSWGRVMRDKAKENQWPRSAWGIITLGLVKQIHAPN

SEQ ID NO: 178046 - protein, 61 aa, Triticum aestivum
  Clone ID: PAT_TA_72464.pep
GGLFPLQQNFPWILWGGYTSGKNKMWGALFRSGKKGLRWCGVDPCIRCMWFGVWVGKPDFF

SEQ ID NO: 178047 - protein, 58 aa, Triticum aestivum
  Clone ID: PAT_TA_72465.pep
KIVGKGVKSRLDGAKVIKFYLAPKGGTTPESKLEPFFAVSPGFCGKNVVFESPGIEPP

SEQ ID NO: 178048 - protein, 57 aa, Triticum aestivum
  Clone ID: PAT_TA_72466.pep
PIFPPPSGQGPQGFATPSPFGGGPQGAPLKVAKAQRLGAQFPAMCRVKGGDPFLAPQ

SEQ ID NO: 178049 - protein, 134 aa, Triticum aestivum
  Clone ID: PAT_TA_72467.pep
SPKKTLLCFLSKGPNHIFQNPFLVTPPRQTNNGDQTFYRSKSSSSPPSSKVSDSGEPAKKARAGVFGHVGNLLSSSSSPRPMGSREVKPGGGRKRANHSTTSSVFWGFDGGYHPRALRPARGPPTPGYFLFLRA

SEQ ID NO: 178050 - protein, 68 aa, Triticum aestivum
  Clone ID: PAT_TA_72468.pep
HDQTLTFINSTHGAIVRFHDQASSIRYEGFGHPPHCSTFVTNKLSPKTHKHQTRRRPFSSSRPAVTVN

SEQ ID NO: 178051 - protein, 79 aa, Triticum aestivum
  Clone ID: PAT_TA_72469.pep
PPPGPRGPVKRPPRQAGGFGKWLRGVGGKFFLGSVGGQKVCEIQMELGLGQKRVVFKGWEKKGALFPSGFFFSPGYFFS

SEQ ID NO: 178052 - protein, 64 aa, Triticum aestivum
  Clone ID: PAT_TA_72470.pep
QYPSGQGSFQPFQQNPQAQGFVQPQQLPQFEEIRNLALETLPAMCNVYIPPYCTIAPVGFFGTN

SEQ ID NO: 178053 - protein, 88 aa, Triticum aestivum
  Clone ID: PAT_TA_72471.pep
HTTIFFFPQRAHKLTYIQTDDSLFPGFDNTNNYKQSGFSSPLLHLQQTNRRTHSCPGGWFMLSHTLQTRFLSVARSLIAPSGGRGPRE

SEQ ID NO: 178054 - protein, 72 aa, Triticum aestivum
  Clone ID: PAT_TA_72472.pep
CFFQHPQQQLGQHPQHQQGQKGPFLHPPQKAPPEVKISIALRTRPTMCRVNVPLYSPIPSAPLGVGTQVGAY

SEQ ID NO: 178055 - protein, 53 aa, Triticum aestivum
  Clone ID: PAT_TA_72473.pep
PPPPPPPPPPPPVEPVSFPTPSTKIPFGPGPFPPFSENPPAPGFCPPPTIPPV

SEQ ID NO: 178056 - protein, 139 aa, Triticum aestivum
  Clone ID: PAT_TA_72474.pep
YFVPFAGEVWIKDPSNVPKISPWSCRSWEIQPCPPQKRPEWGKGLPPILGRWGIPPPPVVKGSLFGMGGLRAPPPPQNGGLGFPRGTLGIFRFNWLKGFLFLFKMCQVLCYTPFVSPGSQIKKVFCLILCVPHLVLKCF

SEQ ID NO: 178057 - protein, 70 aa, Triticum aestivum
  Clone ID: PAT_TA_72475.pep
FKDYINPFFCSPPTVGLMVPVFLDNTLKVKNVGRARGIPWWVPFRSFKGASRNEEFYSLPFTFTGFFPPW

SEQ ID NO: 178058 - protein, 99 aa, Triticum aestivum
  Clone ID: PAT_TA_72476.pep
NLPIIEIPHDVDIWGVNPEEFDPSRFANGKSYPLGEYFPFGMGPAICVGQNLAMVKAKLALAMVLHRFGFNVPPSYVHAPIKVMPLHPQYGVQFFVPKI

SEQ ID NO: 178059 - protein, 90 aa, Triticum aestivum
  Clone ID: PAT_TA_72477.pep
VASMPMTPKGVIIMCLKKGSYIHSTGSWVQLSFLDLPGIMLTKKRGGQTDGTMGNIIWTLGENKRIWYSIFNPIWYVPGPMASSFTDTSN

SEQ ID NO: 178060 - protein, 72 aa, Triticum aestivum
  Clone ID: PAT_TA_72478.pep
IIVSSNIIKIHTGGKKKKKSFPALIYLNLKARGKGTKKGKLIYKGELPQWGSTYQNRQKGTSSICFSPKQPK

SEQ ID NO: 178061 - protein, 45 aa, Triticum aestivum
  Clone ID: PAT_TA_72479.pep
LKPPFLVFFLKIKTTGWGGPHMTWGDIFLGPVTWTFPSTKQGGPN

SEQ ID NO: 178062 - protein, 68 aa, Triticum aestivum
  Clone ID: PAT_TA_72480.pep
TTGDPLFFTKNPSFLKGTNSGANTQGAPRGGFLQRAIEPGHFWRGPGPKGNHPPKRNFLGGGEKGTLG

SEQ ID NO: 178063 - protein, 128 aa, Triticum aestivum
  Clone ID: PAT_TA_72481.pep
GALKNLPPLIYSSPGGGGGLPFQKFFPRPPPEKTLPSFGGKTPWPHPRGPFHWNQTKGFPLPFGPPKGEGLGAGPKKFNGPKNPTWGNPWGPPKKFYFPLKKTIGGLFLKNLPGKPLFPIKTPKFLIF

SEQ ID NO: 178064 - protein, 56 aa, Triticum aestivum
  Clone ID: PAT_TA_72482.pep
FRPFQQNPQAQGFVHPQQLPQFEEIRNLALQTVPAMCNVYIPPNCPMAPFGILGTK

SEQ ID NO: 178065 - protein, 45 aa, Triticum aestivum
  Clone ID: PAT_TA_72483.pep
EFLFWVGFLRGQKFKSCCFKAWMGSNGSSGIFPYIALGTWGGFLS

SEQ ID NO: 178066 - protein, 138 aa, Triticum aestivum
  Clone ID: PAT_TA_72484.pep
KAVNPQQKPKLTSKQLKSLVVVWGHVLNHLRKLLGILLQVGHSNPRCELLKNHTCTFLHLALGEEGGNTCSATTRLCKRRRRKRATKGVESGSGLRLGAGMVAMRLEAAHEAVALEHHASHKIRCFLINKMNTQLSGA

SEQ ID NO: 178067 - protein, 74 aa, Triticum aestivum
  Clone ID: PAT_TA_72485.pep
KLGGHFSDTKTLVFSITPHVGRDLTGWGYGGGTIWGNMPLSHWRGGLNHPCAYHRNPTLIQLGLVLWVAKTQTL

SEQ ID NO: 178068 - protein, 80 aa, Triticum aestivum
  Clone ID: PAT_TA_72486.pep
NPQKNPLAPHWTWSQFWPTNPPLNHNSPWIFWKKKRKKSPPPWVPWLGQNPLAPLPFIGRSHWSPRGELTQPQPPRGFCL

SEQ ID NO: 178069 - protein, 75 aa, Triticum aestivum
  unsure (1)..(75): unsure at all Xaa locations
  Clone ID: PAT_TA_72487.pep
LSQVSFHQPXQQYPSGQGSFQPFQQNPQAQGFVHPQQLPQFEEIRNLALKTLPPMSNVYIPPYCTIAPVGIFGIN

SEQ ID NO: 178070 - protein, 93 aa, Triticum aestivum
  Clone ID: PAT_TA_72488.pep
GFFILFFFLFWFQNPKTTNPLVLQAFTGHWKNLNLQGVTPNQRNPPPLKKTGGPDPKLFQSWKKPQTGNRDPFNGKLFFRKGGALKSNRAPPP

SEQ ID NO: 178071 - protein, 66 aa, Triticum aestivum
  Clone ID: PAT_TA_72489.pep
PAPTTNPIGSGVDFGERALGDSAPSGNVGRACSPQLVPPPIPPPWGPSRQGGVFKGLGSQKRARLV

SEQ ID NO: 178072 - protein, 73 aa, Triticum aestivum
  Clone ID: PAT_TA_72490.pep
GHPNPIFLKPKKNGGQTPIGHTFNPLKPPNTTWLFPFQKKPPGPILTHLKKGAFSCHIPPPSFFWAGVFFHNI

SEQ ID NO: 178073 - protein, 86 aa, Triticum aestivum
  Clone ID: PAT_TA_72491.pep
FFWKGPPQNWGGGFLELGVKGNNPGVIGEEIAPLPQEKVPPPPRGKKKEVLGQGGPPPFPGFFYGEKPPFFNEKGPKKIKNRLLRA

SEQ ID NO: 178074 - protein, 97 aa, Triticum aestivum
  Clone ID: PAT_TA_72492.pep
KRPPVMEASPFNSRLTKTPWFVPSPEKNPFLGPCPFRSFPKPLGFFGPKVGPPNFPGKRRWGVFFLNSGQGFLKVFLRGKKSPPPRAWVKFKIRSWY

SEQ ID NO: 178075 - protein, 94 aa, Triticum aestivum
  unsure (1)..(94): unsure at all Xaa locations
  Clone ID: PAT_TA_72493.pep
GRVINWDPQKKSKPHMLGVNRVGPAKNFGCQASQPKKGMKPVAIPXVFQVLRXKLGVIKIKLVFGFSNRKKVPPSKDFCYRDQKKERHRRVFLS

SEQ ID NO: 178076 - protein, 101 aa, Triticum aestivum
  Clone ID: PAT_TA_72494.pep
FFQGVVFFPWGVSVAGADVPRPGDAPQLKGGVEKDRVRGGVLFPLRPEGGPRRGGQGFFALGGVFFYFGSGGSPGRDLGKGKVNLCIGGRGDCNPTWALFF

SEQ ID NO: 178077 - protein, 83 aa, Triticum aestivum
  Clone ID: PAT_TA_72495.pep
NFSVLWCGPSGVIAPVYVEMSKISPQFMFLPIDVDALMDFGSTWDIRAPPRFFFFKNGQQFDKFVGANNLGFEKKVQVFGDGS

SEQ ID NO: 178078 - protein, 50 aa, Triticum aestivum
  Clone ID: PAT_TA_72496.pep
PCFSQAPWGGTKPRGFGGEFEKGGFANSLGIKRVRGYTFNAPWGGYKAPV

SEQ ID NO: 178079 - protein, 70 aa, Triticum aestivum
  Clone ID: PAT_TA_72497.pep
KKPPTPIGFIYVLTWTCLGNREGGNLDYYTEPGPLLFILLPHSYEPLHSTHKLHSSPAFKRDGVQHPTPT

SEQ ID NO: 178080 - protein, 69 aa, Triticum aestivum
  Clone ID: PAT_TA_72498.pep
TLHQCFVYVAQMQIVGNNVDCKEKKWWVIQVVINILAMWNVRNNIMGQPINLEGFFVNKNEQFFGQQFL

SEQ ID NO: 178081 - protein, 81 aa, Triticum aestivum
  Clone ID: PAT_TA_72499.pep
TQLFLFGNTLTHKKYPFPFLPAAIQNQETPPKFHSTRNPHPKIIGSHLGELIFNLSPSPFHKIFSPGNPPPQNGPHFLTSL

SEQ ID NO: 178082 - protein, 80 aa, Triticum aestivum
  Clone ID: PAT_TA_72500.pep
LKGKKRSPFGLLSCKKVFFLSQRVKRFAEVLFNKWGLGGFESGCLYGPGREKGGKCFFKNVFKKKKVPFRLKRDLRGGGY

SEQ ID NO: 178083 - protein, 96 aa, Triticum aestivum
  unsure (1)..(96): unsure at all Xaa locations
  Clone ID: PAT_TA_72501.pep
GEKPKQWFXPKKGAKGFYPIFSQQLGQGDQFGQGGQGYYPIFFHQLGKGEKGLDSPTHFRGGPQGASLKVGKGKKFWGKLREICRLKGGEAFLASQ

SEQ ID NO: 178084 - protein, 80 aa, Triticum aestivum
  Clone ID: PAT_TA_72502.pep
GSPPPPQGGGSPGGPVGGGGQRQGQGFFFKRPQRQQGKGFFGEGGQQKPQAGWVRFKKGGVPAGGRVEPPGGRVFFPAPD

SEQ ID NO: 178085 - protein, 60 aa, Triticum aestivum
  unsure (1)..(60): unsure at all Xaa locations
  Clone ID: PAT_TA_72503.pep
GSFHFFKQNPQAQGFVQLKKLPQFQEIRNLGLQRLXKKCEMXIPPNGWTPMGPLGILGIN

SEQ ID NO: 178086 - protein, 55 aa, Triticum aestivum
  Clone ID: PAT_TA_72504.pep
FGFLHESACQIIFSPLQQPNHGLKKRGFIYLLLKLFSFHLEPKIPNGPMVQYGGI

SEQ ID NO: 178087 - protein, 100 aa, Triticum aestivum
  Clone ID: PAT_TA_72505.pep
MGCEGGAVITACEVGRWGCENDKGGSDLRLLLLVGGWVAITPLKMGVPYVLLVSGCTEGTPSLGRKAPNTEVGSWVTRNNPEIRSQICFELFYTLLLHFR

SEQ ID NO: 178088 - protein, 83 aa, Triticum aestivum
  Clone ID: PAT_TA_72506.pep
HKKHPPPPWGGVSFQRLLEKNPLGRGSFGPFQKTPRARGFFPPQKWPRFGEKRTQGLQGPPAMGKVYPPPNGPLGPLGFLGIN

SEQ ID NO: 178089 - protein, 48 aa, Triticum aestivum
  Clone ID: PAT_TA_72507.pep
GQKGYASPSHVRGEYQGAPLKVEKGQKFGAKLREMCGLEGSNAFLPRQ

SEQ ID NO: 178090 - protein, 168 aa, Triticum aestivum
  unsure (1)..(168): unsure at all Xaa locations
  Clone ID: PAT_TA_72508.pep
GALAQKTPLLFIGFLIKTAFPQGGMGVPGPPFFKTPTKHPPNNLPQKTGPGGKTPTPGGPTRTPGGTPPFLNPTQPAGGFFCPPPPKNPFPCGPWGLFEKKTFLCPGPPPPRGPPGNPPPGGGPPPGXWQNEPPGPPGPCPGSGNPPKTPCFFEPPPKKPGAPFPKGG

SEQ ID NO: 178091 - protein, 72 aa, Triticum aestivum
  Clone ID: PAT_TA_72509.pep
PPPQAQINIGLKQPYFYFISKIKQPFWAGHTKNWGTLYFSPLDSHIPRLKNGDPIFFYQKTFLIKKPPPPGP

SEQ ID NO: 178092 - protein, 121 aa, Triticum aestivum
  Clone ID: PAT_TA_72510.pep
TPKKKLFNFQTWELNWPSPHAQFNLCFKQTFLVFFLKIKPLIWAGHPPTLGNLFFSPLDSHFPSLNNREPTFFFLKPFLFNKAQIPGPPPMGHFWGVFSTGHLPRTFFVRVRTPLKLLPQT

SEQ ID NO: 178093 - protein, 149 aa, Triticum aestivum
  unsure (1)..(149): unsure at all Xaa locations
  Clone ID: PAT_TA_72511.pep
DAKTPLPLKTKGVIFHLFLPQTGGEFPKTFPGGEKNPPPKCFIKPRQTKTPPFPSFRVPNPPPFTQLGPTPMNXPKTPSPHPKTGWASPRAFLPPPLAPGPGTPPXQPGPYPLHLGGPPQPEPPDQIAPGGPHPGPPGGPGPPFPGAPP

SEQ ID NO: 178094 - protein, 101 aa, Triticum aestivum
  unsure (1)..(101): unsure at all Xaa locations
  Clone ID: PAT_TA_72512.pep
LVKGLGLQIPFGGETGFLEKGGFPMGQNLCILSIFSKGFVXSEXTGNGGGGTTIGKVVLCQGPPPPVLGFIGGSPFLFLIRGETSGGGLFIGQGGNPPPFL

SEQ ID NO: 178095 - protein, 115 aa, Triticum aestivum
  Clone ID: PAT_TA_72513.pep
TFRGLKFTSTTATTVILAMPSNIECNGTRVVVGGGGLGSSRISLRGDVRSPPYLYGLAPSRSWGGPLENLQGTNTQEEAMKEGIQWITDEPGGGPFSYLFFSPRCKLPLFFSSMG

SEQ ID NO: 178096 - protein, 78 aa, Triticum aestivum
  Clone ID: PAT_TA_72514.pep
NHNPLSHNFPASNTIGLPTQPAGVIIKHKTTGAAILGSNFPTSSSHFSLGNGLGYPFTPLPKKALPPPTSPTVPLKNP

SEQ ID NO: 178097 - protein, 79 aa, Triticum aestivum
  Clone ID: PAT_TA_72515.pep
KTGVYIFSPKGLFFLIYTQKPHWGNGAIWGGFKLAPWGGRFLRQGPFFPKPGPVLGVEKTPGPGGFPKRGERTPPPRNF

SEQ ID NO: 178098 - protein, 76 aa, Triticum aestivum
  Clone ID: PAT_TA_72516.pep
RLSRVSFRDPQHQYPSGRGSFQPFQQTPRAQGFVHLQQLPQFGELRTQGLKRHPPMCNFYIPPNGPVVPVGILGIN

SEQ ID NO: 178099 - protein, 118 aa, Triticum aestivum
  Clone ID: PAT_TA_72517.pep
NPSGGGSFPPFWENPQARGFFPPQKMPPFWEKRTPGVKRPPPMGKVLIPPNCPLGPGGIFGVKWKKKNFWGKKINPPFFSPRFGGWRGEKKKRPALLFKNPKYICLNRGKKKKPFFFF

SEQ ID NO: 178100 - protein, 81 aa, Triticum aestivum
  Clone ID: PAT_TA_72518.pep
RGGPFFQFLLEKPPPTSKILGGPIWPMGPQTIKKGGPKPLVKMAPPWVNPKKFFFFLKKKSFFPPPFGSRVKKGPPRPPFP

SEQ ID NO: 178101 - protein, 85 aa, Triticum aestivum
  Clone ID: PAT_TA_72519.pep
KSIVRLKFSLTTAQKPTANFPLFVFLHYLTHLFLTNCWSCISILTAPPFTLTIVCRCFTQHIRTKRETLRDLLWPKVFLLGGTRD

SEQ ID NO: 178102 - protein, 85 aa, Triticum aestivum
  unsure (1)..(85): unsure at all Xaa locations
  Clone ID: PAT_TA_72520.pep
EEEPPQVGQCVFQPQQQLEEEIGEKPXQKQLGQGAFFQPPPKGQVXGKTFIGVRILPKMCRVNGPLYKTPPRGPFDVGPGVGAFL

SEQ ID NO: 178103 - protein, 117 aa, Triticum aestivum
  Clone ID: PAT_TA_72521.pep
KKASPKGVKPQIKNSPAGIITGFLEKKTGIGGGAGIKKGGPIGKKGILGPKSQKKKKKKHPPRAFNSTIAKGAPGAKPLNPLWAKTPPPPVGLKPNLKTRGNLISGGALEKFCSQGT

SEQ ID NO: 178104 - protein, 111 aa, Triticum aestivum
  Clone ID: PAT_TA_72522.pep
ECLEFLRLRKAGALRVWQIPTSISLVGSNELHRGTFLAPGVCCFCWTGPLGGYYFFIGFVPSLLLTVPLLVIAAVFKYRGFCPVLSSMCCVCRVCKYAALVSHHDLIHFYV

SEQ ID NO: 178105 - protein, 91 aa, Triticum aestivum
  Clone ID: PAT_TA_72523.pep
PPPGGKIFMKKSVGPNFKASAQGPFVTQKALFKTVAPAVAGVKFLWGQRGPNGFFFPGAPPGFFMVNPAPGVGFLGPLGPPFFWGRLKPLC

SEQ ID NO: 178106 - protein, 68 aa, Triticum aestivum
  unsure (1)..(68): unsure at all Xaa locations
  Clone ID: PAT_TA_72524.pep
GIPKMQIPFPFRPKGLGFAVWDMIRGRGIGXASXGKINVDTPFGNMKVPFDKVGGTPRLKKVAGDDEE

SEQ ID NO: 178107 - protein, 107 aa, Triticum aestivum
  Clone ID: PAT_TA_72525.pep
PALEKKGRLPWNPSVFNGSMKVRKMFFYKGKKLVLGCPSNFPTGEKKRPPPEEGLRVPWEQLERKARKADPAFRPANTPPFLAPPRGPPGTRPGAENFPPPPPLVSS

SEQ ID NO: 178108 - protein, 71 aa, Triticum aestivum
  Clone ID: PAT_TA_72526.pep
NPLGRGSFRPFPQNPRAPGFFPPPHLPPFGGIRSPGVPAAPPMGQVSPPPYCPPGPFGVFGAKWEEKTLWA

SEQ ID NO: 178109 - protein, 70 aa, Triticum aestivum
  Clone ID: PAT_TA_72527.pep
FLPLFQQPQGGQGFLVQGRGFIPPQQPGQLGGARSLGVQIFPPLGKGDVPPGGPLMGAPFARKVGGLGGQ

SEQ ID NO: 178110 - protein, 83 aa, Triticum aestivum
  Clone ID: PAT_TA_72528.pep
PQKPPPPLLGRVSFPQPQQQNPLGPGSFRPFQQKSQAPGFFPPPQLPPFGEIRNPGVQPPPPMGKVYPPPNCPLSPFGIFGAK

SEQ ID NO: 178111 - protein, 63 aa, Triticum aestivum
  unsure (1)..(63): unsure at all Xaa locations
  Clone ID: PAT_TA_72529.pep
NPLGRGPFRPFXQNPPAPGFFPPQQLPPFGEKRNPGVPTPPPMGKVYPPPNCPLGPFGIFGAN

SEQ ID NO: 178112 - protein, 61 aa, Triticum aestivum
  Clone ID: PAT_TA_72530.pep
LWGPKTFYLTYSPRYYGGGKKRVAYYPNATTGELIHFKRPGTPPWLTENQPRVFLTGGAPE

SEQ ID NO: 178113 - protein, 79 aa, Triticum aestivum
  Clone ID: PAT_TA_72531.pep
GPLFGYGGNFWFPPPPPKVPPGGYMPNPPMPPPFFGTPIYAPLRSPAGVKTLLDRFFKGGGFPPENSFFKKGELPPPSK

SEQ ID NO: 178114 - protein, 99 aa, Triticum aestivum
  Clone ID: PAT_TA_72532.pep
FFGVHPPPGQARPGGPGQRRAPGGIAPPPGGVPPPGGGPPLKPRGRGPPPKNPVGSHVRNPSVSARSIPPGDYISPTPGGINSRGGENYGAGLGFFRSG

SEQ ID NO: 178115 - protein, 50 aa, Triticum aestivum
  Clone ID: PAT_TA_72533.pep
LFPLWPVDGDKVGFFRVARARALSPKGLSRFKARGWDMVVINVSVQGYIF

SEQ ID NO: 178116 - protein, 57 aa, Triticum aestivum
  Clone ID: PAT_TA_72534.pep
GSNFGGGTGNPKKNPDPKPGWKNLLHPHQTPPGVKGPQINRGGPGPISGPPLIPTSP

SEQ ID NO: 178117 - protein, 40 aa, Triticum aestivum
  Clone ID: PAT_TA_72535.pep
IKLYLHKLPPGVCWLAATYLPKNKACYFLRGKNKQILLWP

SEQ ID NO: 178118 - protein, 73 aa, Triticum aestivum
  Clone ID: PAT_TA_72536.pep
GGRIRGPLFQVVQGQGIFPPPQPGQLGGVRSLGLGTFPPRGKGDVSPGGSPPKAPFAHKVVGLGGPLKKPGFW

SEQ ID NO: 178119 - protein, 93 aa, Triticum aestivum
  Clone ID: PAT_TA_72537.pep
VEWAFPRRLPKGGGPKTWDLATFATFMGRKPPSKTRVMIVQFQGRECFDVCLQRPSLTPRPGDKNSSQSLPTYELVLLVPKCKCPFRWITRNF

SEQ ID NO: 178120 - protein, 61 aa, Triticum aestivum
  Clone ID: PAT_TA_72538.pep
SPGLGKQAWGGEGILVVFGPLPVLPKYRVGNFFGCKGGVFPVKSRVSRAPMFFFFGGKSEN

SEQ ID NO: 178121 - protein, 81 aa, Triticum aestivum
  Clone ID: PAT_TA_72539.pep
KTKPSHGFQISKNKGHRAPNRGLRASPLGFFRGPWDFTPWENLKGGVNTPMGGVKSLTPKGAGGKRGPQFAHNPGATAPGG

SEQ ID NO: 178122 - protein, 96 aa, Triticum aestivum
  Clone ID: PAT_TA_72540.pep
AIPKVGHGIILAPPQKPPPPLLRQVSFQQPQQQNPLGQGSFRPFQQKPQGPGFVQPQKLPPFEEIRNLGVQTLPAMCKVYIPPYCPLGPIGIFGSN

SEQ ID NO: 178123 - protein, 55 aa, Triticum aestivum
  unsure (1)..(55): unsure at all Xaa locations
  Clone ID: PAT_TA_72541.pep
FFPWVVVAGNPLYNDYGNFKGYVCKGAKGYPPLKGCXSLGLEATTKVLGPLCLCR

SEQ ID NO: 178124 - protein, 43 aa, Triticum aestivum
  Clone ID: PAT_TA_72542.pep
IMFEIQLSKTRDGKYLLNMQRVIGPQLLFLEFCVAFLTTLRVL

SEQ ID NO: 178125 - protein, 129 aa, Triticum aestivum
  Clone ID: PAT_TA_72543.pep
PGSFPVPLGRFWPPMVLSARCAPIKVALRLLPALRLAPFLLSGEGFYTPPVRPPLSPCEGIGFPPRVKKGRCPVLDPLFFKSNPCDDWLCPPVLPFPCPFLVPMCGGPPPSSFVCRFDYSWMLVGVFFV

SEQ ID NO: 178126 - protein, 56 aa, Triticum aestivum
  Clone ID: PAT_TA_72544.pep
VFLFLTQKNFPFCIKTGLYSNYLKNWEHTSHLLYNKSACIPNHHANCKKIYHWLAH

SEQ ID NO: 178127 - protein, 161 aa, Triticum aestivum
  unsure (1)..(161): unsure at all Xaa locations
  Clone ID: PAT_TA_72545.pep
ACPSFQAQATCPSGCICDQPLNWKSEELILNCLPEIEINGFGGTEHEVALVKLLFNWAAVLKXMTIAFHYSIPKRKAEELGHMLLGFSSPEILMDFLHIKYFREGVHSTRLQLFVTPNLWLVGPASWPNKWCAWVVLKWPPVAVVDHVCVDTLNFEFFLCD

SEQ ID NO: 178128 - protein, 122 aa, Triticum aestivum
  Clone ID: PAT_TA_72546.pep
KKKAGVHLSKPGGGTKTKGGPSKNPPPLFGGLHEASKQFPPFLGVPPLRGGIRPYKSLNLKKNIPLPKITDRRAPQKRGQIFKGLLFPNTKSFWGERQPPTNSLGFLGQRTEQIFGKTFSKT

SEQ ID NO: 178129 - protein, 64 aa, Triticum aestivum
  Clone ID: PAT_TA_72547.pep
PQKRGFGPFLGPLTPFRGRPFLAPRVLNKRPGPGFFRAGAKKLFRALNSGLKPLFFFWKSLFFF

SEQ ID NO: 178130 - protein, 93 aa, Triticum aestivum
  Clone ID: PAT_TA_72548.pep
GHGPSPKGQIWITPPLYVLGSVLGRPLGNIFCFWGIFFCMKGFPPRPKGFPLGITLGGLLFRPLWAGFIGWGKVCFVGVPENFIPERGSCQGF

SEQ ID NO: 178131 - protein, 93 aa, Triticum aestivum
  Clone ID: PAT_TA_72549.pep
TKPKIVFFLGGKKFFFTPKQKIFKIGEGGVPQGIKGFSAKEIFFSRGPFWVLGEKFLGGPQPVFCYGKIKIWFLKGGKGFPRGGGKTPKRFNF

SEQ ID NO: 178132 - protein, 55 aa, Triticum aestivum
  Clone ID: PAT_TA_72550.pep
KRPQRQQGEGFFGEGGQQKPQAGWVRFTKGRVPAGGRVEPPGGRVFFSGPVYLGK

SEQ ID NO: 178133 - protein, 66 aa, Triticum aestivum
  Clone ID: PAT_TA_72551.pep
NPPQRELDFLSQMQNHLHPSDQPQIKFLRPPKLQLYTPEQRGVVGTTSGPNGGWIPERNSSYNFME

SEQ ID NO: 178134 - protein, 117 aa, Triticum aestivum
  Clone ID: PAT_TA_72552.pep
SQVFDLGPETRPTLEKIMFFQGPKQMGLPPSDLMPKPDMVQKFMFPPPEKGFSRGKKGLDWVGPRGRQSFLWRNWLYPSFFQVGGFGGKGLGKVAKDKGFVKVWEKKWTKFFVVGTG

SEQ ID NO: 178135 - protein, 53 aa, Triticum aestivum
  Clone ID: PAT_TA_72553.pep
LEILHIYPTIHQVFVFDYRVGPPVCYHRTFSSPTNPFLFVKTLNTGTGEAHCP

SEQ ID NO: 178136 - protein, 82 aa, Triticum aestivum
  Clone ID: PAT_TA_72554.pep
HRSQTNSGAKPSPTWGRVSGTNNPDNNGRVCTSPSSRGILKASGSGFRPPGGWVAYASQFNAPPPPRSAFHWWLPSLVGGAK

SEQ ID NO: 178137 - protein, 53 aa, Triticum aestivum
  Clone ID: PAT_TA_72555.pep
NESFSIPKMAPPCLVNGPIPVPVKNKGQCNIMCGLDGPKFKFGKKRPIKLFFA

SEQ ID NO: 178138 - protein, 60 aa, Triticum aestivum
  Clone ID: PAT_TA_72556.pep
CNPGIPPPPEVMLPDPVPPPPPVVVPPPNPAPNSPAPPGGVARAPGFFFWVTRGPFPANR

SEQ ID NO: 178139 - protein, 82 aa, Triticum aestivum
  Clone ID: PAT_TA_72557.pep
QQQHPPPLGQVSFQQPQEQYPSGRGFFPPFQQNPRARGFFQPQQMPPFGAIRALGVQTLPAMGNGEIPPNGPLGPFGILGAN

SEQ ID NO: 178140 - protein, 69 aa, Triticum aestivum
  Clone ID: PAT_TA_72558.pep
PPQGVQVMGPLFRVIQGGGVIPPQQPGQLGGIRSLVLGIFPPLGKGFVPPGGSPPKGPFARKVAALGGP

SEQ ID NO: 178141 - protein, 85 aa, Triticum aestivum
  Clone ID: PAT_TA_72559.pep
RKRGWPTQGWGESPFEGGVVLWMFLKKETLRFLKTFVFPPNNRPLGGRVLFGGFSRGDELGLWVPLCLMIFRAGPFLPEWNNFSP

SEQ ID NO: 178142 - protein, 113 aa, Triticum aestivum
  Clone ID: PAT_TA_72560.pep
GCPPARAGSWGFPGVAALGPLLEVLWGRCPGALGEGNDAACGRFPRWSAPMVMPLAMVRRCDVELILFPYFTRRSGWCDDELMLFPYLPGVRGDFRGWMGGAGGGARSVKGIL

SEQ ID NO: 178143 - protein, 85 aa, Triticum aestivum
  Clone ID: PAT_TA_72561.pep
GWGTSPFYELVPPLCGLYGVAKYFPHFRSKGWGPPPSCPMGGFFVFHVEGFCPPFIWYAGWPGPPLIIAPPFWIVGPVLTPPHVF

SEQ ID NO: 178144 - protein, 81 aa, Triticum aestivum
  Clone ID: PAT_TA_72562.pep
LNTEFTGPARHPLWAEMMKIIPWIQLDSQALIMSRPANRFQQGIGCPLLQFSGQKIKVANAKASFFFINISTTELLIMRAF

SEQ ID NO: 178145 - protein, 74 aa, Triticum aestivum
  Clone ID: PAT_TA_72563.pep
VSYQQPQQQYPWGQGSFQPFQQDPQAQAFVQPQQLPQFEEIRNLAGQPLPAMCNVYIPPYWSTPRGPFGIFGVN

SEQ ID NO: 178146 - protein, 78 aa, Triticum aestivum
  unsure (1)..(78): unsure at all Xaa locations
  Clone ID: PAT_TA_72564.pep
KPPLGRVSFQQPQHQYPSGRGSFQPFXQNPQARGFVQPQQLPPFWEIRTLGLETLPAMCNVYIPPYCPLAPVGIFGAN

SEQ ID NO: 178147 - protein, 53 aa, Triticum aestivum
  unsure (1)..(53): unsure at all Xaa locations
  Clone ID: PAT_TA_72565.pep
VNPQVQGFVQPQKLPQFGEIRNLGLQTVPAMCKVXIPPHWWTPLGPFGIFGPN

SEQ ID NO: 178148 - protein, 37 aa, Triticum aestivum
  Clone ID: PAT_TA_72566.pep
AKSFKWDPQLYLLLHFLTLELQLAILNRGAYKFSGNT

SEQ ID NO: 178149 - protein, 99 aa, Triticum aestivum
  Clone ID: PAT_TA_72567.pep
QCQAIHNVVHAIILHQQQKQQQQPSSQVSFQQPLQQYPLGQGSFRPFQQNPQAQGFVQPQQLPQYEEIRNLALQTLPAMCNVYIPPYCTIAPFGIFGTN

SEQ ID NO: 178150 - protein, 61 aa, Triticum aestivum
  unsure (1)..(61): unsure at all Xaa locations
  Clone ID: PAT_TA_72568.pep
FIPLASEARVLNEYFSTMAPSPVXGLVCAQNWFRPNPKVVNSDGPVDYKVPRGDELFLAPN

SEQ ID NO: 178151 - protein, 108 aa, Triticum aestivum
  Clone ID: PAT_TA_72569.pep
GPPPGHGPPPGQWLPPGQGPQGDYPIFSPPSGQGPPSGQGPQGVSPLFFWPPGQGPPPGQGPQGYPRPSPFGGGSPGAPLKVAKGHQLRAQLPAICRVGGSAPFLPRP

SEQ ID NO: 178152 - protein, 157 aa, Triticum aestivum
  Clone ID: PAT_TA_72570.pep
NIKYEALMRCCRKAEFKSVVALLKGFSMKGLMNEADKVYQSMLDRDWKLDGSVYGVLIHGHCRGGNVLKALNFHKKMLQCGFPPNSTSTISLVRGLFEEGMTVEADTVIQELLNCCSLADAETSKAFIDLNRKEGNVDAVVDVLRGMTRDGLLPSSG

SEQ ID NO: 178153 - protein, 78 aa, Triticum aestivum
  Clone ID: PAT_TA_72571.pep
REMELQNNHFFFREKVAETERGPPPPLNMMGAGLPSNESEPNMFPCDPRTFLRFNFMQQQPQFYSPPGGPQSFNSVGR

SEQ ID NO: 178154 - protein, 101 aa, Triticum aestivum
  Clone ID: PAT_TA_72572.pep
APPFCPPGIFPPGLFRVFSGPSGLSWKRGSPLQLITSFFWPFLPWPPFFFPGFFPPNNSPPLSFFFPPKVASPFGFAPFCPRFFYAPINPFLLFWGSKNHF

SEQ ID NO: 178155 - protein, 115 aa, Triticum aestivum
  unsure (1)..(115): unsure at all Xaa locations
  Clone ID: PAT_TA_72573.pep
GRGSFPPFQQNPQAQGFFPPQQLPPFEEIRTPGLKPPPPMCKVXIPPNCPLAPVGFFGSNRKKKNFCGSHMNPRFFSPRFGRWTGEKIKCHPVSCKNPHYIGSNLGIKDQPIFFF

SEQ ID NO: 178156 - protein, 126 aa, Triticum aestivum
  Clone ID: PAT_TA_72574.pep
SPKNHHYLLLLMIHSLCSAHLISTNHTFFCKSQLVFSTLPLHRSSPCCKAPQFLIKFNLLHILCTTRFCCCTTILIKRVSCVSYSLDMPRRSTRYLLCSRRAQLLRRRVSCTSYSLDMPMRTTRYL

SEQ ID NO: 178157 - protein, 58 aa, Triticum aestivum
  Clone ID: PAT_TA_72575.pep
SCPAGPYVRRKTNPRMWSPSPNCNLVGWGGSPFYLTRGNFLCKYGGGWVKPPMDVLCP

SEQ ID NO: 178158 - protein, 97 aa, Triticum aestivum
  unsure (1)..(97): unsure at all Xaa locations
  Clone ID: PAT_TA_72576.pep
PSGRGSFPPFXQNPPAPGFVPPPQLPPFWGKRAPGVKAPPPKGKVXIPPNCPPGPGGFFGGNWEKKNFWGGQINPPFFRPRVGGWTGEKKKGPPGFC

SEQ ID NO: 178159 - protein, 89 aa, Triticum aestivum
  Clone ID: PAT_TA_72577.pep
ETIWVLRGTLHTTREQETYCPKKGEFTGPGQQKPKQIGQIILGYMETKLPRKRMIITGWGRKQTQTMQHKLRRVTWRAKLARKVTGPQT

SEQ ID NO: 178160 - protein, 83 aa, Triticum aestivum
  unsure (1)..(83): unsure at all Xaa locations
  Clone ID: PAT_TA_72578.pep
PQKPPPPLLGRVSFQQPXEQNPLGRGSFRPFXQNPQAQGFFPPQQMPPFEEKRNPGVQTFPAMGKVYIPPNCPLGPFGIFGVN

SEQ ID NO: 178161 - protein, 118 aa, Triticum aestivum
  unsure (1)..(118): unsure at all Xaa locations
  Clone ID: PAT_TA_72579.pep
AKKPFPFEKFRGPTFFSLKTGNPPPFFGGAKGHPGQTPFRPRESSFPGGQKRGPPPQPAKIPAFDPGPTPPSXPLRAPPGGPPPTGNNPETPWAPYPEQGPCPPGAKKMGGAPKGPPP

SEQ ID NO: 178162 - protein, 87 aa, Triticum aestivum
  Clone ID: PAT_TA_72580.pep
LALFPTPPKGALFLWPPGLCPFVKKDFLLIKIGAPLFIVGIILSPRSKKNFPPFFFLPPPHRFFYFSPKKKKSFFQPKFFLALWGFP

SEQ ID NO: 178163 - protein, 88 aa, Triticum aestivum
  Clone ID: PAT_TA_72581.pep
PAMAGGLFLGSSPRGVYSEAMPFDTPQREAGFFLVPGGSTFLLWMRNEDPVCLEKGGMKTPKKIKKKGDGQSEKPKNRKVYIKKKSEG

SEQ ID NO: 178164 - protein, 99 aa, Triticum aestivum
  Clone ID: PAT_TA_72582.pep
RKWMASVQTRENLSEWDIGAIQENLQLSSPEISFAIQISSRKYFMSLTMNKRNQTGIEPDGVFLLYGTESGSKQMLAYVGAESHAWDCGLHIKMGLCCM

SEQ ID NO: 178165 - protein, 70 aa, Triticum aestivum
  Clone ID: PAT_TA_72583.pep
PTPPRKAHFGAQGCHFPPPRRWAKFTSLVNAQPPPPPPIAFPGPLVIPMGPASWSINPGPNKMSGLLLGA

SEQ ID NO: 178166 - protein, 98 aa, Triticum aestivum
  Clone ID: PAT_TA_72584.pep
NPSNSNGSPPRVSKHKPINSPPPVQNGGAELSPGDLGGKKKYHGWGPPLFRNLSFFFNPPGIGGPTRLFPNLNLGPSQKSSGTLPWRGTKYNPNPFFW

SEQ ID NO: 178167 - protein, 55 aa, Triticum aestivum
  Clone ID: PAT_TA_72585.pep
NPKTYPLEIKLGPKTPNMREEVPRAGTLKRGKNSLPLAFKHTNKGLHSAALATNF

SEQ ID NO: 178168 - protein, 67 aa, Triticum aestivum
  Clone ID: PAT_TA_72586.pep
NLNYQGQAGIIMNGSDCLLSLMNGCQCMGTSRLYPKLGTKRFLNFPYIVVKGSVFCPPEYIVNKAFI

SEQ ID NO: 178169 - protein, 80 aa, Triticum aestivum
  unsure (1)..(80): unsure at all Xaa locations
  Clone ID: PAT_TA_72587.pep
PPPGGRVFFQEPQQQNPPGWGPFPPFQENPXGPGFVPPQHLPPPGGIRDPGGPGVPPMGKVYPPPNWGPPPGPFGVLGAN

SEQ ID NO: 178170 - protein, 143 aa, Triticum aestivum
  unsure (1)..(143): unsure at all Xaa locations
  Clone ID: PAT_TA_72588.pep
PPPPEEGPPPPWGRVFFQQPQQQNPPGGGPFPPFQQNPXGPGFVPPQHLPPPGEKRNPGVQGVPPKGKVYPPPNWWPPPGPFGILGANWEKKNFGFWFLTPGFLAPGLGGGPLKKKGARPFHVRTPPKLVPTWGKKPNPCFFC

SEQ ID NO: 178171 - protein, 120 aa, Triticum aestivum
  Clone ID: PAT_TA_72589.pep
NPLGQGSFRPFQQKSQAQGFVQPQQLPQFEEIRNLGVKTPPAMCKVYTPPNCPIAPFGIFGTKKKEKNFSTRKKKPRFFSPRKGCFNGKKKIWQALSCKNPHYISSNLGKKNKPRFCFQI

SEQ ID NO: 178172 - protein, 69 aa, Triticum aestivum
  Clone ID: PAT_TA_72590.pep
WFPPPAPKGSPGGYRPNHAMAPPIFGAPIYAQLRDPGGVKDMLDRDFKGGGFPRGNYIVKEGGLPRPSK

SEQ ID NO: 178173 - protein, 93 aa, Triticum aestivum
  Clone ID: PAT_TA_72591.pep
YFPSSYFTMDPMEDPLTGNISTVGKNNLYFTQVPTPKGKKSTEIPVLFLRGGKWQPSSHEVAQKTGKKQGPPQSFVHLTSSWRGKKEIKTFQR

SEQ ID NO: 178174 - protein, 84 aa, Triticum aestivum
  Clone ID: PAT_TA_72592.pep
SNNPPHIQGLKTGYNQRGAPFPPFSSRVLLGNPIYPPFPFKIKSPADQACKNFQKRASTRVGIFPPQADLTGGGIKKGPEIQIQ

SEQ ID NO: 178175 - protein, 138 aa, Triticum aestivum
  Clone ID: PAT_TA_72593.pep
EGPKWPQIKPLKRLKNSFWACRVSKKNCFARWFEENAGTPREKMPTCSDKRDSVLAFTIGGGLKLPIVGNSHAFGGGTKNRGHVQIGQVPSVPVESKPGRFLEGWKWVDFHLLPRRGPRREIVRFMVGGGQVLGSFAC

SEQ ID NO: 178176 - protein, 91 aa, Triticum aestivum
  Clone ID: PAT_TA_72594.pep
FAIGVFLTPSGFAFWGAPLKESKRILGPVFPLEKFFAIQGRMMIPIPVTQVGILVTNKGVSPMPIFARIIPFPPGFFVPPQRGSPRGPLFF

SEQ ID NO: 178177 - protein, 83 aa, Triticum aestivum
  Clone ID: PAT_TA_72595.pep
SYFGGGKNILYPRTWLKKGWAPLFPKLQIPGFAPRLKGRRAEPDVIPFFEKPFPFFRVHLFSWRGMIQLRFKGPSWQTFFGNS

SEQ ID NO: 178178 - protein, 87 aa, Triticum aestivum
  Clone ID: PAT_TA_72596.pep
KLRAQKAKLMKFKDGYMFSFGQPVNEYIYFAVRHVFFRQGVFGIKVKIMLDWGPKGKVGPTPPLPGLVTIPPPKEEDEVGPPALVEV

SEQ ID NO: 178179 - protein, 60 aa, Triticum aestivum
  Clone ID: PAT_TA_72597.pep
VSPLEPFNRGRGDGKKVVHGGSPFPRVGKGEPEIRFEFLIPGPFWVWAGLKTGTRAPFFP

SEQ ID NO: 178180 - protein, 86 aa, Triticum aestivum
  Clone ID: PAT_TA_72598.pep
APAAGAGPLAGPPNVPHYMGQMALPLGKLSPLENFLRQGGLLRQQTLQQMPRILTTRQAARALFVIKEYFSRVRAVSSLWLGRPRD

SEQ ID NO: 178181 - protein, 111 aa, Triticum aestivum
  Clone ID: PAT_TA_72599.pep
TPNFFNPPKLWVYPPSQNGFLNKKVFPKKITRVKKGNKLNFSGKRAKTPTNKTRKNFQAPGGPKKGGKQKSPWPKGPRQKKKNQKGGNKAKGIPRGGQEPWGEVFTGGRKN

SEQ ID NO: 178182 - protein, 40 aa, Triticum aestivum
  Clone ID: PAT_TA_72600.pep
TKCLFQNYPPGFNRRCPSPLKPPNLGKTPQRDGNGTPTFF

SEQ ID NO: 178183 - protein, 79 aa, Triticum aestivum
  Clone ID: PAT_TA_72601.pep
GLFVWPLSKAKGQVCFLGRKMDILGWEVYTKVKGGPPAPKKRLVFPSHPVGLFCLSLGFFFSRAPAYGNPVVNLKINLW

SEQ ID NO: 178184 - protein, 55 aa, Triticum aestivum
  Clone ID: PAT_TA_72602.pep
NNLIAIFKNHFGILKPNWGNNNLPKGGFSFFFPIGGSCLWGPMGNFIGKGTGGFF

SEQ ID NO: 178185 - protein, 75 aa, Triticum aestivum
  Clone ID: PAT_TA_72603.pep
NIFPIKKPGGKGKTTHHAVGFFLGPMFLITSPFIATQILIDLCKFLNKSFQKTNLFFLPFSTKWSHLFGDGGSPK

SEQ ID NO: 178186 - protein, 126 aa, Triticum aestivum
  unsure (1)..(126): unsure at all Xaa locations
  Clone ID: PAT_TA_72604.pep
PPPPGGPGFGAPFPGSPGGGGFPPPTTGSIGGGPALGFGDFSPPGQGFCSPRGAPPPGPLFPQSFPPWGPIKKAPPXGKRGRGPRGLGEAPLGGTMKKKGGGPPRVAPPPGWFQVGEKNPPKFFFV

SEQ ID NO: 178187 - protein, 90 aa, Triticum aestivum
  Clone ID: PAT_TA_72605.pep
PGVFGPLSPPFFPKRAKVKGFVFKEKEFPEKVLARDAPRGFRVQKKPGGPNKKNRVGFPPPKIFWLRAKGEFFFKAPHQKLRGPGLFPNP

SEQ ID NO: 178188 - protein, 59 aa, Triticum aestivum
  Clone ID: PAT_TA_72606.pep
KLKGFSKRGRGSCWLGEAPPHVTVAKKRGGPPLFSPPPGLFQLWEKKPPKFFFSPLFFS

SEQ ID NO: 178189 - protein, 48 aa, Triticum aestivum
  Clone ID: PAT_TA_72607.pep
FGATKPVCSKVALPSYPPFKVFYYGEKVPKNKGPRDVESLQPLFFNQA

SEQ ID NO: 178190 - protein, 120 aa, Triticum aestivum
  Clone ID: PAT_TA_72608.pep
GYYPIFPQQSGQGHQPGHEQQPGQWLQPGQGQQGYYPTFSQQSGQGHQSGQGQQGYYPTFLWQPGQGQQPGQGQQGYASPYHVSAEYQAARLKVAKGQQLAAQLPAMCRLEGSDALSTRQ

SEQ ID NO: 178191 - protein, 65 aa, Triticum aestivum
  Clone ID: PAT_TA_72609.pep
TPSWGLICLKNRQNLVPSRPFKRLGRSGTSRIPGKVYKSSCPSYCGVYTRAMFLKGPPATNVLKR

SEQ ID NO: 178192 - protein, 79 aa, Triticum aestivum
  Clone ID: PAT_TA_72610.pep
KASQKPRPTKGTFRLKKKTTKTYRGGHPPRDWAQPHPGLGKSSPGFGHPFQKEGPPFLKTPPFLKKSWGFPHFLTPQPF

SEQ ID NO: 178193 - protein, 81 aa, Triticum aestivum
  Clone ID: PAT_TA_72611.pep
GFKEPERAPKKVKNIKPRGNISLEEVIEIAKIMKVRSMAKEMAGPVKEILGTWVRVGCPVDGKDPKDLQTEIDAGEVEIPA

SEQ ID NO: 178194 - protein, 58 aa, Triticum aestivum
  unsure (1)..(58): unsure at all Xaa locations
  Clone ID: PAT_TA_72612.pep
AKKNPGCSKGATPPANGPGDPKKGGGPXGKTPQKKPPLDDPNLGDEKDYYPPPVSGLF

SEQ ID NO: 178195 - protein, 172 aa, Triticum aestivum
  unsure (1)..(172): unsure at all Xaa locations
  Clone ID: PAT_TA_72613.pep
QQQQQQQQQHQQQQQQQQILQQILQQQLIPCMDVVXQEHNIAHGRSQVLQQSTYQLLQELCCQHLWQIPEQSQCQAIHNVVHAIILHQQXKQQQQQPSSQVSFQQPQQQYPLGQGSFRPFQQNPQAQGSVQPQQLPQFEEIRNLALQTLPAICNVYIPPYCTITPFGMHFRY

SEQ ID NO: 178196 - protein, 124 aa, Triticum aestivum
  unsure (1)..(124): unsure at all Xaa locations
  Clone ID: PAT_TA_72614.pep
IPQQFQWAAIHRVGHSIIMHQEQQQGVPILRPLFQLAQGLGIIQPQQPAQLEGIRSLVLKTFPTMXNVYGPPDCSPIKVPYAKKNAGIGGQLKRQDHHWLGDAPIVVAMTNKVGGTIMWDPPQW

SEQ ID NO: 178197 - protein, 118 aa, Triticum aestivum
  unsure (1)..(118): unsure at all Xaa locations
  Clone ID: PAT_TA_72615.pep
NPLGRGSFRPFQQNPQAQGFVHPQKLPPFEEIRNXGVQTLPSMGKFYIPPKCPLGPFGILGENLKKKNFRFKKINPPFFSPRFGPCNGEKKMLQALSFKNPNNISSNLGKKNKPRFFF

SEQ ID NO: 178198 - protein, 115 aa, Triticum aestivum
  Clone ID: PAT_TA_72616.pep
AGSWAGRRRSWAEENLGKVGRKEIPARWGEKLGGEPATRWEAMHLAKRSRWFLNFKLMEGYCCPLAFLGGCQKFPSPAYKSERREYYFVWRIVPMASSMSVEVVVTYCRYASSSQ

SEQ ID NO: 178199 - protein, 55 aa, Triticum aestivum
  unsure (1)..(55): unsure at all Xaa locations
  Clone ID: PAT_TA_72617.pep
GPFQQNPQAQGFVQPQQLPQLEEIRNQAVQTXPAMCNVXIPPYSPMAPFGIFGNN

SEQ ID NO: 178200 - protein, 42 aa, Triticum aestivum
  Clone ID: PAT_TA_72618.pep
QLEAIRSLVLQNFPTMCNVYVPPEWSIIRAPFARIVVGIGGQ

SEQ ID NO: 178201 - protein, 99 aa, Triticum aestivum
  Clone ID: PAT_TA_72619.pep
GGGFFPPFWENPRGRGFFPPQKMPPFWGKRDLGVQRAPPMGKGVFPPNWPPGPFGVLGVKWEKKNFWGGKLNPRFFRPRVGGWGGEKKKGQALFWKNLK

SEQ ID NO: 178202 - protein, 93 aa, Triticum aestivum
  Clone ID: PAT_TA_72620.pep
KMIQMLIQTPWTKKRPKFPFKFNIPIKIRNWPFNFSPHLGHFLYPPLFSPPPMQGLGHLKINQWATSLFTPPTRQGSTPTLNQPKFPFHFLKT

SEQ ID NO: 178203 - protein, 66 aa, Triticum aestivum
  Clone ID: PAT_TA_72621.pep
GGQIRRPLFQFVQGQGFIHPQQPVQLGGVRSLVFKIFPPLGKGEVSPEGSPLKAPFANKVVGLGGP

SEQ ID NO: 178204 - protein, 125 aa, Triticum aestivum
  unsure (1)..(125): unsure at all Xaa locations
  Clone ID: PAT_TA_72622.pep
GPTTPGGGAPFFFPENPRPPHGQKNPGAGPPSGQTPPKPNPGPPPPPLGPPPVGGNPPPGLLFFPGTTKGPPLPAATPXGPLPPPGKPPSNGGNPALLLGAGEKTGPRGAREKPGPKPPPRGGEP

SEQ ID NO: 178205 - protein, 114 aa, Triticum aestivum
  Clone ID: PAT_TA_72623.pep
SPLDLKDFDKAKFYVEKFGDSEQAFFKEQAAIHRNSGQVDTVISQAQATLGGFMFQRSTFGGLTPQISNVSSRIPPINPILGSIRKKKSMGPIIFSLVGSGGAFFMFIYWLSKK

SEQ ID NO: 178206 - protein, 49 aa, Triticum aestivum
  Clone ID: PAT_TA_72624.pep
EQFNGGRVVACILFCPGQCGKADGYILEGKEVEFYIRKVQKKKGKGAPA

SEQ ID NO: 178207 - protein, 98 aa, Triticum aestivum
  Clone ID: PAT_TA_72625.pep
GQGPPGGFPLFPPPPGQGPPFGQWVPPGQGPQGGSPLFFPPPGQGPPFGQGPPGFSRFSPFWVGPPAAPLKVAKGHQLLAQLPAIFRLEGGDPFLAPP

SEQ ID NO: 178208 - protein, 57 aa, Triticum aestivum
  Clone ID: PAT_TA_72626.pep
QQQLGQGPLLPPPPKGPPGGMTSLGARFPPTMGRVNGPLYRPPPRGPFDVGPGVGAP

SEQ ID NO: 178209 - protein, 117 aa, Triticum aestivum
  Clone ID: PAT_TA_72627.pep
GKTSPLSQTTKRSLTRGGWQPFWKKHIFLNTLKGSHARARDLYPPVHPNPHFFWIKKGPTSHQPKLFEPKPFFPSLIHRGGKNPPPQAIKKNTPPPPGLTTPPFTPGNPSNPPPLNP

SEQ ID NO: 178210 - protein, 40 aa, Triticum aestivum
  Clone ID: PAT_TA_72628.pep
QLINEKPQVIQEYESGKVIPNHQIIGKLERGFGPKLGGKK

SEQ ID NO: 178211 - protein, 64 aa, Triticum aestivum
  Clone ID: PAT_TA_72629.pep
LNSPLVLFYLLRLCFVFAPPGQRVDFRVQKSEHVICFSGHGCTHAMWLTICVGQFEEIKNYFFM

SEQ ID NO: 178212 - protein, 86 aa, Triticum aestivum
  unsure (1)..(86): unsure at all Xaa locations
  Clone ID: PAT_TA_72630.pep
QTGFFKRVMQGLPILEEVPLLDGHVVEDXKRELVGLEIVPPFPEWPEFEKFEVVYEITNGKSLLHPKKILERLLVKRFLGRWPSVL

SEQ ID NO: 178213 - protein, 75 aa, Triticum aestivum
  Clone ID: PAT_TA_72631.pep
RVSFPQPQQQYPSRQVSFQPFQVNPQGQGFVQPQQLPQLGEIRTLAVQTLPAMCNVSIPPHGSPPLAPFGIFGTT

SEQ ID NO: 178214 - protein, 86 aa, Triticum aestivum
  Clone ID: PAT_TA_72632.pep
LKTFTVKKKTFFLVPKTSPTSDYKHKGATTYLLPGVTKQTKPHMIFIKRGLPMKAGLIRDPRWGNHRHLPLLIQWPKGFTSSKVSR

SEQ ID NO: 178215 - protein, 58 aa, Triticum aestivum
  Clone ID: PAT_TA_72633.pep
QNLGGEYKSKPPIWSPPKQKFPGQTQKFPSNSLAKPIMAKTPHLLFFQPKGKNDLFVP

SEQ ID NO: 178216 - protein, 90 aa, Triticum aestivum
  unsure (1)..(90): unsure at all Xaa locations
  Clone ID: PAT_TA_72634.pep
PPPPPQQHQQQQHHPLSQVSFQQPQQQYPSGQGFFPPFQQNPQAQGFFQPQQLPQFEAIRNLGLQTLPAMGNGXIPPYCPLAPFGIFGTN

SEQ ID NO: 178217 - protein, 97 aa, Triticum aestivum
  Clone ID: PAT_TA_72635.pep
FFGGGGLPFFWENQSRFGAYKGLGVWGNWVRFWPFWGTAGFSNPGFFFKGGVFPPPPLGNRGPFLKGSFGGGLFFFEAKGLVGLFFPPDFSQGRVGP

SEQ ID NO: 178218 - protein, 61 aa, Triticum aestivum
  Clone ID: PAT_TA_72636.pep
PGLFPPFQQNPPAQGFFPPQPLPRFGEKRNLGVQTVPPMGKVYTPPNWWAPLGPFGILSTN

SEQ ID NO: 178219 - protein, 92 aa, Triticum aestivum
  Clone ID: PAT_TA_72637.pep
PTRAVGSPKSLAVVGPGGVSKSFTVDFWEKSFWVRRGGGTACLLIYLHFLVGVSHLLGDEMDFEGPGQNHFGSGLVKGIMVCLFYVNDEAGR

SEQ ID NO: 178220 - protein, 101 aa, Triticum aestivum
  unsure (1)..(101): unsure at all Xaa locations
  Clone ID: PAT_TA_72638.pep
GAPTPPVFFKRAXWFLNNGPGPKPXTHFLFPGHWNPSGPIRPPGGGPGFGFFPPPFNGGLKWGPGQATRFPAGLGFSKGFWTTLGVGSGATLVCSTQGPLV

SEQ ID NO: 178221 - protein, 115 aa, Triticum aestivum
  unsure (1)..(115): unsure at all Xaa locations
  Clone ID: PAT_TA_72639.pep
LQELCCQPLCQIPEQSQCQAIPNVVHAIILHHHQKPPPPPSSKVSFQQPQQQYPSGPGSFRPFQQNPXAQGFVQPQQLPPFEEIRTLAIQTLPAMCNVSIPPYCPLTSFVIFGIN

SEQ ID NO: 178222 - protein, 55 aa, Triticum aestivum
  Clone ID: PAT_TA_72640.pep
FPPQSGQGQQGYASPPPVRWEPQAATLKVAKAHQLWAQIPAMFRLKGGDPFLASQ

SEQ ID NO: 178223 - protein, 31 aa, Triticum aestivum
  Clone ID: PAT_TA_72641.pep
VFKGAMKGKLIVFCPLPPERIPRFQLLFKDV

SEQ ID NO: 178224 - protein, 90 aa, Triticum aestivum
  Clone ID: PAT_TA_72642.pep
PPKKNITYQFFLSPSPKTILIFPMALLSPQTKGPLYIFFSPQPQFLTPLKKGIPLLPLSNLTFKIPLIFIKRFALNHPPLNKLVKNPHPP

SEQ ID NO: 178225 - protein, 57 aa, Triticum aestivum
  unsure (1)..(57): unsure at all Xaa locations
  Clone ID: PAT_TA_72643.pep
RGKGKKSGKGEKGYXKXYHVRVEHKGASLKVEKGKKIWGKMPEICRVEGGDAFLASQ

SEQ ID NO: 178226 - protein, 46 aa, Triticum aestivum
  Clone ID: PAT_TA_72644.pep
NKTHNPNYPLLLKANKIKNTVTPIHSVGVLKKMAFHPGNPLTASLG

SEQ ID NO: 178227 - protein, 96 aa, Triticum aestivum
  unsure (1)..(96): unsure at all Xaa locations
  Clone ID: PAT_TA_72645.pep
AIPKVVQGIILGPPQKQQQQFLGRVXFLKALXKYSLGRGFFGPFXENPQGQGFFQPXKLPQFGEIRNLGVQRFPAMCNVXIPPYWPIGPFGIFGVN

SEQ ID NO: 178228 - protein, 139 aa, Triticum aestivum
  Clone ID: PAT_TA_72646.pep
GKKTRVFFFFPNLNLLFWGFSHKRPCQFFFSPLQQQTRGGKKGGFFFLTQKFFFFVLPPKTPRGPRGQLGGIKTFPFGGTLWPPGSFFSPPGGIFGGGKNPGPGGFSKKAQKAPPPKDFFQKAFEKKPPPKGGGGVFWG

SEQ ID NO: 178229 - protein, 37 aa, Triticum aestivum
  Clone ID: PAT_TA_72647.pep
NLPPPPPSTFRRNGLSIFREVFLDRESTTICRALYFN

SEQ ID NO: 178230 - protein, 52 aa, Triticum aestivum
  Clone ID: PAT_TA_72648.pep
KQNPQAKGFVKLQQLPQFKEIRTQGLKTLLAMCNVYIPPYGTIAPVGILGIN

SEQ ID NO: 178231 - protein, 119 aa, Triticum aestivum
  Clone ID: PAT_TA_72649.pep
QQTQNFLLHRPTKTKGQNKWPHQILLMAGTAAPRQNIHHTFGDFYVQKPFNNKGDYIFLLNIPLKRLTLLAPPNILLTTVAGATPWPEKDKFFRICNNKTAWAPINPGQATVDWWHLPW

SEQ ID NO: 178232 - protein, 105 aa, Triticum aestivum
  Clone ID: PAT_TA_72650.pep
GNQNKKFRVWDVRNLLKTVHVFKGNLGGIRWIRFNFYGQFLGKGEQGEFVQIFYGRGDYTKREEVGFFGEKFGISFRPEMEGFFVGGWDKKKGSLLQKGGLQNDK

SEQ ID NO: 178233 - protein, 85 aa, Triticum aestivum
  Clone ID: PAT_TA_72651.pep
KPMVKGGNAYPKYRVKRNFWPKVGGVAINPVEDPPGGGNPQQIGYGSPVRRDAPPGQKVGFISARRTGCFKGQGGAFAAKADKAP

SEQ ID NO: 178234 - protein, 91 aa, Triticum aestivum
  unsure (1)..(91): unsure at all Xaa locations
  Clone ID: PAT_TA_72652.pep
PLGRGSFWPFXKKSQAQGFFHPQQMPPFEEKRDLGLRAPPAMGKVYIPPYWPIGPFGIFGVKKKKKNFSPKKKKPRFFRPWEGGCTGEKKI

SEQ ID NO: 178235 - protein, 77 aa, Triticum aestivum
  Clone ID: PAT_TA_72653.pep
IPSGMPCKVQTLNSIIHPSPSLATYQIIQGSGWFNNPNTNTNDNLPCRTSMVWFPTQQTDLLVHFTGTHTATVQGAI

SEQ ID NO: 178236 - protein, 135 aa, Triticum aestivum
  Clone ID: PAT_TA_72654.pep
FRPKQFSFFYFIPHSKPSNNRVIQKQNPFFLNRGNKNLATNQGFPAKPNPKPRPSQNPNPNPFPNPPQPYPPPSPYPNPKPKPPPPPPPYPCPPPKPPPKPGKNPPPDPANPGLNPTLDPKNKLAPPKKTNPDLN

SEQ ID NO: 178237 - protein, 61 aa, Triticum aestivum
  Clone ID: PAT_TA_72655.pep
HLTQMSLKFFPTLLGKMGTTPYPPAKNDPLPHLRGAGIPKKREKEIPIPRGNCPRGQQQPI

SEQ ID NO: 178238 - protein, 116 aa, Triticum aestivum
  Clone ID: PAT_TA_72656.pep
FGRLWWDETVPTVVTRAEPHNQIILHPNQHRVLTVRENARLQGFPDYYRLFGPIKQKYIQVGNAVAVPVARALGYSLGQAYRGALVGGQPLFELPENFASVGQAAATASPVGVVEK

SEQ ID NO: 178239 - protein, 125 aa, Triticum aestivum
  Clone ID: PAT_TA_72657.pep
GSFLKGFFLFKTLGPGFPPQGAFLKGGAPPFFLTKGENFLFVLKRVISPFLKKGFFGFVLQVKFPENKKNPGKFFLAFFPGWNYGQMGGNFVRFPPILGFYGFPPGQKWNPISPPSGGGIFPFCF

SEQ ID NO: 178240 - protein, 83 aa, Triticum aestivum
  unsure (1)..(83): unsure at all Xaa locations
  Clone ID: PAT_TA_72658.pep
PQKPPPPPLGPVSFPQPXNKIPLGRGPFGPFXQNPQGPGFVPPPQMPPFEGIRDPALXTLPPMCQVYIPPNCPLGPFGIFGAN

SEQ ID NO: 178241 - protein, 50 aa, Triticum aestivum
  Clone ID: PAT_TA_72659.pep
PKPELKPEPLLKPELKPEPKPEPMLKPGPKLKPEPKPEPPPKGNPPMTAN

SEQ ID NO: 178242 - protein, 68 aa, Triticum aestivum
  Clone ID: PAT_TA_72660.pep
GILGPQFTGRNFFVPIFWAKRTERWPRPGGELWVHVGRVFCGKESVRVKQGCLGSVVLGKKIPKAVFK

SEQ ID NO: 178243 - protein, 101 aa, Triticum aestivum
  unsure (1)..(101): unsure at all Xaa locations
  Clone ID: PAT_TA_72661.pep
LVSLVASPRIGRETVEXTEHGKGTIKFYGNSFIAGPTEEIIKLANDEDEEVLAAEFDLDEVNSXIYTGCCWGIFRDMGPDLYKXVLLTLDGKTSSSWVPLV

SEQ ID NO: 178244 - protein, 112 aa, Triticum aestivum
  Clone ID: PAT_TA_72662.pep
KVPHKLYNRPWDKDIVSIISDRAILWAKSYFFSHKRDLSSLQPLGILKLMLGHRRVLLLHGGLLLLELLMLNRQLIQIKIGVIDHGNLNPSRGHFPYFQAPQSFTFDPTNRT

SEQ ID NO: 178245 - protein, 52 aa, Triticum aestivum
  Clone ID: PAT_TA_72663.pep
PTYNNFHFFPFNPISNIKFSNIPSQSIKKGIASYPTTTQPKLKNNPFCFFLP

SEQ ID NO: 178246 - protein, 104 aa, Triticum aestivum
  Clone ID: PAT_TA_72664.pep
SEGNKPYMKNSNKIRTCLGGGLPTKGDKAPKLAKGPGKIKGNPAPPFKGGPKFFNPPPTFRWLKNPGKQGPPPQKGGSGEGKKNNGGGGPLVPGQGKCPSGKPP

SEQ ID NO: 178247 - protein, 131 aa, Triticum aestivum
  Clone ID: PAT_TA_72665.pep
PRLGVAGAGRKMGIGWQVPQFVLVAGSDVFFGIAQLEFFYGEAPGSMRSICSAFSFLGGWVGFYVNSVVVTPVAALRPGWLAATLNEGPLGYYFWVWAVIRAGNLVLYLLLAARDTPKQVLRHLPKPPAPS

SEQ ID NO: 178248 - protein, 65 aa, Triticum aestivum
  Clone ID: PAT_TA_72666.pep
KKQGANKLIWVYKAVGDSGILTFYPQGNKATYPKSGFATPTSLQNTLTGTSLRQKSPKLHFDPLA

SEQ ID NO: 178249 - protein, 55 aa, Triticum aestivum
  Clone ID: PAT_TA_72667.pep
KKAGLQGGVRVLLFWGGPFFKLFVLGFFAKQNSPLCLENRVGGGGAPLSLSCVPP

SEQ ID NO: 178250 - protein, 79 aa, Triticum aestivum
  Clone ID: PAT_TA_72668.pep
GGAKKSLRVPLKKFLPFRPKRFTPFLGLMEKKRGRLNLPQNIMFFRGAKKWGLYKLKGGFSNRGLGWGFFCYWGFGVVF

SEQ ID NO: 178251 - protein, 55 aa, Triticum aestivum
  Clone ID: PAT_TA_72669.pep
FGFLHDSACHIIFSLLQRPNHGLKKRGFIYLVLKLFSSQLVPKMPNGAMVQYGGM

SEQ ID NO: 178252 - protein, 97 aa, Triticum aestivum
  Clone ID: PAT_TA_72670.pep
QPIPKVVQAIILGSPQKQHQQLLRRVSFQKPQQQYPLGQGSFRPFQQNLQAQGFFQPQQLPQFEEIRNLGVQTLPAMGNVYIPPNCPIGPFGILGVK

SEQ ID NO: 178253 - protein, 77 aa, Triticum aestivum
  Clone ID: PAT_TA_72671.pep
GQIQETPFSSVIPKGSVNNIPQLFLWPLFFYQLYMSEEAFWGNFGGVTLAWGAIEVIPVMILGVVAIFMESRYKTCY

SEQ ID NO: 178254 - protein, 83 aa, Triticum aestivum
  Clone ID: PAT_TA_72672.pep
KKGGPPLKKKKPLFAAPQTPILSTPPPPLSLTSTDPAPTTTTRTQNPTRVGEKNAKQKTLPPPKKNDCRGGKTPPPGKKKPPP

SEQ ID NO: 178255 - protein, 132 aa, Triticum aestivum
  Clone ID: PAT_TA_72673.pep
GGNNPSSTGKGWEKGWDYGWDDEEAPPKPLKKGPGGSILGKGLFFRFPTQRFPPQSKGGWDVNWDGLGTTKCWKGPSFFFKRGKISLFERVAAKTGFPLYLKIDGSQVCKGALFLENQRVGCIRTGWAKGFP

SEQ ID NO: 178256 - protein, 87 aa, Triticum aestivum
  unsure (1)..(87): unsure at all Xaa locations
  Clone ID: PAT_TA_72674.pep
VQGGPTQRLGGSFFMQQKKRQGGQIRGPLFXVFLGLGVYSTLKTRXLEGIRSLVFKIFPPMGKGYFFPDCSPIKGPFSKKFLGIGGQ

SEQ ID NO: 178257 - protein, 75 aa, Triticum aestivum
  unsure (1)..(75): unsure at all Xaa locations
  Clone ID: PAT_TA_72675.pep
KGGRGKSIPHARVLFRQRHIRVGRQIVNVPLFMVRVDFXKPIVFFLKSPFGGGPPGRVKRKTPKKASGGGDPGGY

SEQ ID NO: 178258 - protein, 39 aa, Triticum aestivum
  Clone ID: PAT_TA_72676.pep
KNFGEWGGVCKIDFEGKAKKGVGCSWVVVKEYGENFEGF

SEQ ID NO: 178259 - protein, 129 aa, Triticum aestivum
  Clone ID: PAT_TA_72677.pep
GKKKTFLGFFPKPETTPGGGTQEGAPPFFWHRYLHGGLHLTTKNPFPFYLTLPVFIGPQWPPIFWEKGPPLRGPPGGKTPCPWGGKIGTPKIWTPPNEPGGGGGKNPRPGTKKPDPPGGGEKRGKKNPP

SEQ ID NO: 178260 - protein, 67 aa, Triticum aestivum
  Clone ID: PAT_TA_72678.pep
SIGGNPRLCSQKAPGFVLLVKVNPVGYPQQGINRLQVSKGEVEVSFPGVKTGRKWGTGVHGYLVQIG

SEQ ID NO: 178261 - protein, 99 aa, Triticum aestivum
  Clone ID: PAT_TA_72679.pep
GSNLNYTQTYPKTGSHIMGAPWALKTKLGKFIPTKNITYNSRAHLRGITGPPGGGTPRGGGAPFGSCNPQGGRPSPTGCQQKISPSGQGGNPPWPGTWA

SEQ ID NO: 178262 - protein, 82 aa, Triticum aestivum
  Clone ID: PAT_TA_72680.pep
APPVFLPDPVTLGALVRPEFFPFRKGVVRVEPQGFCRGPPPMDMGLKKFKSEKGWSGNPPISGGWPVAKAKVVPFVKELLKN

SEQ ID NO: 178263 - protein, 83 aa, Triticum aestivum
  Clone ID: PAT_TA_72681.pep
QKEPRERFTSQRGQENENLHNPLRQLGGRGKRGDLWALREGHRGVVVVGIGVGGRIRLSKGPGEGPHGRGARPGAPSQGGGAR

SEQ ID NO: 178264 - protein, 79 aa, Triticum aestivum
  unsure (1)..(79): unsure at all Xaa locations
  Clone ID: PAT_TA_72682.pep
PVLVPAAIAVTMLTAGFVLSGAFGAAAVGVLAXMYKYLSHGGSLPPGADTVDHAGGKLDSKAHEVKNWGQHCLDQARTP

SEQ ID NO: 178265 - protein, 94 aa, Triticum aestivum
  Clone ID: PAT_TA_72683.pep
QHNGGKNNPPKTKIQPNKKQINPPGQIRGNPPPPWGNPQGGGFNPRPPGNRPNPGKTKHQFFNSPSPGQKNPQGPKKTFPPPGPHPRTRGQRPP

SEQ ID NO: 178266 - protein, 37 aa, Triticum aestivum
  Clone ID: PAT_TA_72684.pep
DWFKPGTTCPLLQIFSSNWALKKPPPWGGSIQHGAPQ

SEQ ID NO: 178267 - protein, 60 aa, Triticum aestivum
  Clone ID: PAT_TA_72685.pep
QPKRGWGNNPLEPEKKHGAFITIFKTLHLICKFLKFIIFIKKILQMILKSNLTILIKGQK

SEQ ID NO: 178268 - protein, 77 aa, Triticum aestivum
  Clone ID: PAT_TA_72686.pep
GTKTKKKKKPFISKKWGGGGGETPKKRALTQGSGPRGGNFHPPPARGSFLGGPQPLKFFFTGPPYGKGGVPRPFLEG

SEQ ID NO: 178269 - protein, 83 aa, Triticum aestivum
  Clone ID: PAT_TA_72687.pep
GPKKNRPISRVRKNPGNPQGGGNRKFFYLGPGAKILKRALGWVLTRGGVSKKFPKKAFNLRPKGSKKNFLGPLFPPSKGALIL

SEQ ID NO: 178270 - protein, 71 aa, Triticum aestivum
  Clone ID: PAT_TA_72688.pep
TLGGHFLDTKTLVFLITPHVGSDLTGWGYGGVTIWGNIPLAHWRDGLNHPCSYYRNSTLIQLCLLVGVAKT

SEQ ID NO: 178271 - protein, 45 aa, Triticum aestivum
  Clone ID: PAT_TA_72689.pep
LKFHKAGQKEDELSPQKLAKGNLGRPNLKKLLKRQVSNLRLLNIV

SEQ ID NO: 178272 - protein, 76 aa, Triticum aestivum
  Clone ID: PAT_TA_72690.pep
KRGFSVDNMEPVSKKVHVPTRVVPPRAKSTRAPPKIPKGSTPKKLPYNQRRATLFKRFNPLKNFAGPPDDDGDDDE

SEQ ID NO: 178273 - protein, 85 aa, Triticum aestivum
  Clone ID: PAT_TA_72691.pep
MRSLATSLSWASLALGYYLSSVLVTVVNSATGRGGHRAWLEGASLNHYHLERFYWLMCVLSALNYVFFLVLAIRYKYRNAGVIKG

SEQ ID NO: 178274 - protein, 53 aa, Triticum aestivum
  Clone ID: PAT_TA_72692.pep
FFLTHDILFCHCYFDQLTGTIGITSCHGNAIRGGGGGWALYRDVNFAHPREGV

SEQ ID NO: 178275 - protein, 107 aa, Triticum aestivum
  Clone ID: PAT_TA_72693.pep
PPGLGPPPGQWLPPGQGPQGGFPIFFPPSGQGLPSGQGPPGGSPPFLWPPGQGPPPGQGPPGFPRPPPVRGGSPGAPLKGAKGQQLGAQLPAMCRVGGSDAFLPRPG

SEQ ID NO: 178276 - protein, 64 aa, Triticum aestivum
  Clone ID: PAT_TA_72694.pep
TDDGYVTLLTESGNLKDALKLPPDNVLFGQIKTGFFYGKDLILFLMSPMGEKQICPFKEIGGGK

SEQ ID NO: 178277 - protein, 70 aa, Triticum aestivum
  unsure (1)..(70): unsure at all Xaa locations
  Clone ID: PAT_TA_72695.pep
FPQFQPQNPSGRGPFPPFQQNPPAPGFVPPPQMPPFGEKRAPGVKTPPPRGKVXIPPNCPLGPVGILGEN

SEQ ID NO: 178278 - protein, 70 aa, Triticum aestivum
  Clone ID: PAT_TA_72696.pep
TLITKLNRALFNWLLQKKHFRGQNTKKQLFDRETPAGAGSITGGLRKIPRPFGNCITPSHPNTIPRDPGI

SEQ ID NO: 178279 - protein, 85 aa, Triticum aestivum
  unsure (1)..(85): unsure at all Xaa locations
  Clone ID: PAT_TA_72697.pep
ENGPRLFFPDPSGAFWPGKSQAIWLGFXGGDRSFPKPVPQGFPLLWAKAQAPFFLKPVFEKKVAPPHVCLWKVSPRYPLYPPPKV

SEQ ID NO: 178280 - protein, 96 aa, Triticum aestivum
  Clone ID: PAT_TA_72698.pep
GILPGKGPIYPGQFKMVPGTNPGERPPHNWAPPFLNQRGQNSQTPGGGSPPKFKNQNPLGPFFQPEPTKLTPPPLGKKKPTPKGCFGNSYQKPPQF

SEQ ID NO: 178281 - protein, 114 aa, Triticum aestivum
  Clone ID: PAT_TA_72699.pep
GGGGFSFLLKPKCLGPREPPLLGKKNLGSKTPFCLPWVKKKGVFFCPLWGKTGKSFFGCWPQPKGGRGGVTFFFLAPLGGAAPLFGGGGSPRCLGGPPPPFPNFLGLKVEGEKC

SEQ ID NO: 178282 - protein, 101 aa, Triticum aestivum
  Clone ID: PAT_TA_72700.pep
GPQKPSPFFQGKVPLGDPPPHPPGGGPLLETPMGPPKRAPLKPTHWGFCKHWEPLLPCFRPLPPSTPFSYKGGGPFSPRDKAKTPGIVGPEKTKFWGPGES

SEQ ID NO: 178283 - protein, 93 aa, Triticum aestivum
  Clone ID: PAT_TA_72701.pep
SSLGHPCIVQEPDNVPNTDDAEASDAEEEETASGADIMNPRGLDVPATVRAKIVGSSSPVGSASPVPAMGCFEAVIRTSPLGKVPVSMPRMVH

SEQ ID NO: 178284 - protein, 146 aa, Triticum aestivum
  unsure (1)..(146): unsure at all Xaa locations
  Clone ID: PAT_TA_72702.pep
PGPQKKIFALSPNLFFGFGPPKPPKLGAKKTRGPPGPLGYSSRGPPPGPPPPGVACTGRPGGGSPPTYGGPPPLLKGPDLSLPPPMKKXGVAPPPPPNPGGGGPPGPPTPGGGPPRSLPRGGTPPLWGRGPGTPKGTAPGGPPFCR

SEQ ID NO: 178285 - protein, 93 aa, Triticum aestivum
  Clone ID: PAT_TA_72703.pep
SPGPPKNWEPGFFPILGPVGPKNKRAGFPPLVSNFWAHVLIKCSCFLGGVGKFVSRFPKFFFGIHCFCFLKRIKGPLGFFPPHGLGAHQYFSP

SEQ ID NO: 178286 - protein, 54 aa, Triticum aestivum
  Clone ID: PAT_TA_72704.pep
GGGTHEIGGNFICHPCIDIFIHLTTGTPFFFTKKLSLLIGTNSRAHLQWDTYGG

SEQ ID NO: 178287 - protein, 102 aa, Triticum aestivum
  Clone ID: PAT_TA_72705.pep
PKGLKVMQNVVGFSKENPKIIVDTFESLGFNVYGAKNAPYVWVHFFGRNSWDVFAEILEKAKVVITPASEFGPGGKGFVRVSAFGPKENIIEVARRLKQLYK

SEQ ID NO: 178288 - protein, 82 aa, Triticum aestivum
  unsure (1)..(82): unsure at all Xaa locations
  Clone ID: PAT_TA_72706.pep
QKPPPPPLGRVSFPHPFPQNPLGRGSFRPFXQNPQAPGFFPPQQMPPGEEKRNLGVQTLPPICKVFTPPNCPLGPFGIFGVK

SEQ ID NO: 178289 - protein, 78 aa, Triticum aestivum
  Clone ID: PAT_TA_72707.pep
PPPPGRGKFFPLFWPPQRGQGTFFPGQGIIPPQQPGQFGGIRSLGLQIFPPLCKGDVPPEGSHIRAPFARKVPEMVAH

SEQ ID NO: 178290 - protein, 57 aa, Triticum aestivum
  Clone ID: PAT_TA_72708.pep
QQQKPQGIFLHPPPKFPLGGMTSIAPRPLPKMCGVNGPLYSSPPIIPFTIGPGVGGY

SEQ ID NO: 178291 - protein, 70 aa, Triticum aestivum
  Clone ID: PAT_TA_72709.pep
GLIYFFFFFFFFSPGNLFLLHYYGGLPHLHKKLGTPLPFFGYLRGIPAQTPCKPEKVLSLASPQWLPPLH

SEQ ID NO: 178292 - protein, 108 aa, Triticum aestivum
  Clone ID: PAT_TA_72710.pep
TGIHLPTPSQILPGPPPPGSCHGDFVNGGGNGPPRGGGPILGDVSPAPPRKGLNPPPLFFNRNLLLRLPKTFPLLLLRLAKTFPLLLPHDNLCHPTNRLAPTLLQNLG

SEQ ID NO: 178293 - protein, 88 aa, Triticum aestivum
  Clone ID: PAT_TA_72711.pep
NPRCGFITKVCCVKIWPFFLQKPLHFFIAGPFCGFAFPKVQALYLVLTRWIFVRPNAHFFPVVFQLFAISRKCMSMSLGFLYPRYWCV

SEQ ID NO: 178294 - protein, 56 aa, Triticum aestivum
  Clone ID: PAT_TA_72712.pep
FYFTNPSPVKYKNQSQWPNNKLPLLPRNKNSKSAFVHRGPVFLQIKINLNLLFRRG

SEQ ID NO: 178295 - protein, 49 aa, Triticum aestivum
  Clone ID: PAT_TA_72713.pep
KLMASWINHFLVTANTVLVTYSRTHTLQYTFSVSMKLAKYSLATLSMFL

SEQ ID NO: 178296 - protein, 87 aa, Triticum aestivum
  Clone ID: PAT_TA_72714.pep
TGYLFQNLIFYITPPNPGFALFCLLYIILLSTGAKTPWENSPGLPFIPHIFHQFNHRTLPLTFHGTPLNRKLFPGFFSSSERSCPLN

SEQ ID NO: 178297 - protein, 87 aa, Triticum aestivum
  Clone ID: PAT_TA_72715.pep
FQGAPIPRVGHSFFMHQDHHQGGPFLGPLFQFPQGLGFIHPHHPVQLEGTGSLVLKIFPPMCKVYVPPDCPPIKVPYPNIDVGIGGQ

SEQ ID NO: 178298 - protein, 57 aa, Triticum aestivum
  Clone ID: PAT_TA_72716.pep
KMIPPKPMVVEPLAPYPLLGGFVGGDIRQTVAVGVIKGVEKKAPPGAKVTKVAIKKK

SEQ ID NO: 178299 - protein, 78 aa, Triticum aestivum
  Clone ID: PAT_TA_72717.pep
IRAPGCPGDREKQTFNLATGAIKWTSTQGQYKLGLETTFFLFYSKIKTTSGGGQHRKWGDLFLGPGASTFPWTKQGGP

SEQ ID NO: 178300 - protein, 104 aa, Triticum aestivum
  Clone ID: PAT_TA_72718.pep
IEDLSSQLQSQAVEQFKALDFSRVISNLEVFTAIQEDDEDCDEPGVDPKDIELVMTQAGVLRPKAVKAFKFVKGDIVSVIMEMTNYRCPTCDIMPVFPCLHGKT

SEQ ID NO: 178301 - protein, 69 aa, Triticum aestivum
  unsure (1)..(69): unsure at all Xaa locations
  Clone ID: PAT_TA_72719.pep
VLGTPEGTFVSMGVDFDGLNGGPGGFIXSFPVKCSGGEWTIVXGVPIDEFLRKKMDAPPQELLEEKGVA

SEQ ID NO: 178302 - protein, 84 aa, Triticum aestivum
  Clone ID: PAT_TA_72720.pep
GGGGGLERGCFWVGPPYPTLAVNGKPLAILKKRGGETQERDFLNLFGSKKCDGYWGCLGEVLEFLGKIKKKRGGVMEGNLRVLG

SEQ ID NO: 178303 - protein, 83 aa, Triticum aestivum
  Clone ID: PAT_TA_72721.pep
CHKCLPNHPAFGSKIKNPINNIYLQQNWVSRETFCKVHNKGENGVNKMGSHQNSSNTFGFSFIQGTWEGVPSIWLILKPEMVN

SEQ ID NO: 178304 - protein, 99 aa, Triticum aestivum
  Clone ID: PAT_TA_72722.pep
VSLSLVDFDSLIINKKLQLGEDDKPGGEKFLENFNPCTRREALAFGDPNMRNIKRGEVIQLERKGYYRCDVPFVGSSKPIMLFAIPDGRLKSTSIVFGP

SEQ ID NO: 178305 - protein, 71 aa, Triticum aestivum
  Clone ID: PAT_TA_72723.pep
KTQIFLVPQGVNPKKKAIFFERFGPFCQKGWGGPGGKKKRAGGWFKKRISLNPPFWETGGTPLGVIIDPTF

SEQ ID NO: 178306 - protein, 110 aa, Triticum aestivum
  Clone ID: PAT_TA_72724.pep
NQKTFHLPLLLGFTLFPQKPGNPPHLYCITKGHPSPTPIQPAKNFIPARATMPPSPPPPTFPAPFPQPSPPFPPLSRPPGTPPQHGMGRPTPVPLAPVVPLVPVPTKKLG

SEQ ID NO: 178307 - protein, 75 aa, Triticum aestivum
  Clone ID: PAT_TA_72725.pep
KFFCLNIPQRFGKYTPIFFPFSPVTILTAGVNKTITQPRGENNSQIPLQDGDPGTQNLQIPTKTYSTFGPFPMTD

SEQ ID NO: 178308 - protein, 87 aa, Triticum aestivum
  Clone ID: PAT_TA_72726.pep
FFNTLQGPFPKKPIQITSKFKIQNHGPFFHFFQHSFFPYKNARLIIQSQGDTLTQTPLPHFLHGFILTQQHYSLPAAKDYYYNGRTD

SEQ ID NO: 178309 - protein, 89 aa, Triticum aestivum
  unsure (1)..(89): unsure at all Xaa locations
  Clone ID: PAT_TA_72727.pep
GGGSFHPFKKTPRARGFVHPKKFPRFGEKRTQGXETSPQMANVKTPPNGPMAPVGFLGITEKKKTFSGKNITPGFFSPGLGGGTGKKKK

SEQ ID NO: 178310 - protein, 64 aa, Triticum aestivum
  Clone ID: PAT_TA_72728.pep
KNPLGRGSFGPFKKTPRARGFFPPKKFPQFGKKRTQGFQAPPQMGNFNTPPNGPLAPLGFLGIN

SEQ ID NO: 178311 - protein, 55 aa, Triticum aestivum
  Clone ID: PAT_TA_72729.pep
FGVLHYRGWYIFFLPVQPPNHGLEKRGFIFLILKLFFFQLIPKIPNGAMGQFGGV

SEQ ID NO: 178312 - protein, 103 aa, Triticum aestivum
  Clone ID: PAT_TA_72730.pep
GTRGSDDVGGPARVEIARSLGRPWWSWTAAARLLVGAGAADRSKAAACTEGRRGAAGSGRGHGQRRGLEQIGRGAPPGAGCVRVAALEGDDGEAKGSRERVSK

SEQ ID NO: 178313 - protein, 203 aa, Triticum aestivum
  Clone ID: PAT_TA_72731.pep
MKTGLVFGLLAVAATSAIAQMDTRCIPGLDRPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIY

SEQ ID NO: 178314 - protein, 210 aa, Triticum aestivum
  Clone ID: PAT_TA_72732.pep
MKTSLILTIIAVALTTTTANIQVDPTGQVQWPQQQQPFSQPQQPFSQQPQQIFPQPQQTFPHQPQQAFPQPQQTFPHQPQQQFPQPQQPQQQFPQPQQPQQPFPQQPQQQFPRPQQPQQPFPQPQQPQLPFPQQPQQPFPQPQQPQQPFSQLQQPQQPLPQPQQSQQPFSQQQQSLIQPYLQQQMNPCKNYLLQQCNPVSLVSSLVSMIL

SEQ ID NO: 178315 - protein, 216 aa, Triticum aestivum
  unsure (1)..(216): unsure at all Xaa locations
  Clone ID: PAT_TA_72733.pep
GQQTGQGQQPEQEREPGQGQQGYYPTSLQQPGQGQQQGQGQQGYYPTSLQQPGQGQQGHYPASLQQPGQGQPGQRQQPGQGQHPEQGKQPGQGQQGYYPTSPQQPGQGQQLGQGQQGYYPTSPQQPGQGQQPGQGQQGHCPTSPQQSGQAQQPGQGQQIGQVQQPGQGQQGYYPTSVQQPGQGQQSGQGQQSGQGHQPGQGQQSXQEQQGYDSPYH

SEQ ID NO: 178316 - protein, 216 aa, Triticum aestivum
  Clone ID: PAT_TA_72734.pep
SQLPYLRLQPCAQPQLPYSQPQPFRPQQPYPQPQPQYSQPQQPISQQQQQQQQQQQQQQQQQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 178317 - protein, 102 aa, Triticum aestivum
  unsure (1)..(102): unsure at all Xaa locations
  Clone ID: PAT_TA_72735.pep
LPSPSSPCRRPPRARLYPAPPPPNLVLVEPDATKSRTRAAPPTLPRHAAANPHPHCTGIPHPEPPPPIPIXSTPHQHPQSSAATPFPNPYPRPCFASQCSPV

SEQ ID NO: 178318 - protein, 46 aa, Triticum aestivum
  Clone ID: PAT_TA_72736.pep
MLFVVQSAHLVRPPTTDAASALATVIASRTPRTSALEAAMSECATC

SEQ ID NO: 178319 - protein, 196 aa, Triticum aestivum
  Clone ID: PAT_TA_72737.pep
NPNNTFSQPQLQLPQQPEQIIAQQPQQPFLLESQQPFPQQPQQPFSQPQQLIPMQPQQPFPQQSQQSQQPFPGPQQLFPELQQPIPQQPQQPFPLQPQQPFPQQSQQPFPQQPQQPFPLQPQQPFPQQPQQPFPQQPQQPFPLQPQQPFPLRPQQPFSQQPQQSQQSFPQPQPQQPQQPSILQPQQPFLQPQQQLS

SEQ ID NO: 178320 - protein, 178 aa, Triticum aestivum
  Clone ID: PAT_TA_72738.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIHTIPAMCDV

SEQ ID NO: 178321 - protein, 75 aa, Triticum aestivum
  Clone ID: PAT_TA_72739.pep
SPCGQCSSTNHQEARRQRAQCRNAPSTTRETPPHGSERSYHGSSSCTSKLASAVLSVHPASPAQTNSSHTASQAS

SEQ ID NO: 178322 - protein, 90 aa, Triticum aestivum
  Clone ID: PAT_TA_72740.pep
MADRANHPSVMQKFGGQFHLASSFSEGVRARNICPSVPSYERRFTTSCYMTQNLGISVPMMSSSPLFANAPPENKGVKNFAIDFLMGGVS

SEQ ID NO: 178323 - protein, 211 aa, Triticum aestivum
  Clone ID: PAT_TA_72741.pep
MKTFLILALLAIVATTATSAVRVPVPQLQPQNPSQQQPQEQVPLMQQQQQFPGQQEQFPPQQPYPDQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCCQQLFQIPEQSRCQAIHNVVHAIILHHHQQQQQQPSSQVSY

SEQ ID NO: 178324 - protein, 168 aa, Triticum aestivum
  Clone ID: PAT_TA_72742.pep
LSTTTANIQVEPKGQVHGSLHRQHFCHPQQPFSQQPQQIFPQPQQTFPHQPQQAFAQPQQTFPHQPQQQFPQPQQPQQQFPQPQQPQQPFPQQPQQQFPRPQQPQQPFPQPQQPQLPFPQQPQQPFPQPQQPQQPFSQLQQPQQPLPQPQQSQQPFSQQQQSLIQPYL

SEQ ID NO: 178325 - protein, 103 aa, Triticum aestivum
  Clone ID: PAT_TA_72743.pep
GLPRIILPRTPTGPGTFLSTEKAYWVIFPYRKWFYKAYPKSSRIDLSVSAEKVGLWSSSIWAKHLLLVLFRTMKKLGMVHPLLLPRGKGEGKGPTLYQIKSIP

SEQ ID NO: 178326 - protein, 73 aa, Triticum aestivum
  Clone ID: PAT_TA_72744.pep
SVFPAFQNGKHRKLIPYGRTNHETLSWHGLGSPPQSPTPNRASDSIRRPGKLVTEPDLAATTATSRRIGQITA

SEQ ID NO: 178327 - protein, 181 aa, Triticum aestivum
  Clone ID: PAT_TA_72745.pep
MNTFVILAVLAIVTTTVTIAVIVTVPQLQTQNPSQQQPQEQVPLVQQQQFPGQQQPFPPQQPYPQPQPFPSQQPYLQLQPFPQPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCQQ

SEQ ID NO: 178328 - protein, 140 aa, Triticum aestivum
  unsure (1)..(140): unsure at all Xaa locations
  Clone ID: PAT_TA_72746.pep
QQQSLLPKQPLFSQXQPPFSQQQQHPPFSQQQQQPILLQQPPFSQHQQPVLPEQQIPSVHPSILQQLNPCKVFIKQQCSPVAMPQSLARSQTLWQSTCHVMQQQCCRQLPHIHEXLRYDVIRAMIYLIVLQKHQHGQGLN

SEQ ID NO: 178329 - protein, 42 aa, Triticum aestivum
  Clone ID: PAT_TA_72747.pep
LRTRSPRRQQNPRVANTSSEDLRPGSVGTEGLRPANPGGGLP

SEQ ID NO: 178330 - protein, 64 aa, Triticum aestivum
  Clone ID: PAT_TA_72748.pep
LAAFGCLSARRGPPPVGRTGSPSWMTLGSTWQQCCAGRVMATRTAHCARRAPGFGGGRFNYNNA

SEQ ID NO: 178331 - protein, 69 aa, Triticum aestivum
  Clone ID: PAT_TA_72749.pep
IGSAPDAEVRLGWAAGTRHLLGSSLPSPEGYYGNCVYPGGLARASKDVEEASLVEIVTAIREAKDALSA

SEQ ID NO: 178332 - protein, 227 aa, Triticum aestivum
  unsure (1)..(227): unsure at all Xaa locations
  Clone ID: PAT_TA_72750.pep
MKTFVILALLAIVGSSDTTXGLRVPVXNLQPQNPSQQQPQEQVPLVQQQQFLGQQQPFPPQQPYPQPQPFPSQQPYLQLQPFSQPQLPYSQPQPFRPQQPYPQPQPQYSQPQQPISQQQQQQQQQQQQQQQQQEQQILQQILQQQLTPCMDVVLQQHNIARGRSQVLQQSTYQLLQELCCQHLWQIPEKLQCQAIHNVVHAIILHQQQKQQQQLSSQVSFQQPQQQY

SEQ ID NO: 178333 - protein, 126 aa, Triticum aestivum
  Clone ID: PAT_TA_72751.pep
LLLLLPPIPNQGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKITPLWRHY

SEQ ID NO: 178334 - protein, 188 aa, Triticum aestivum
  unsure (1)..(188): unsure at all Xaa locations
  Clone ID: PAT_TA_72752.pep
LLLSILAIDLTICTYNIHVHTILQLHWAQXTSNPLXQQPLFHHPQQSFPQPQQTFPHQPQQQLPQPHQPQQPFLQPQQAFPQQPQQPFPQTQQPQQPFPQQPQQPFPQTQQPQQPFPQQPQQPFPQQPQQPFPQTQQPQQPFPHQPQQPFPQTQQPQQPFPQFHQPHQPFPQPQQQFPHPQQPQQSFP

SEQ ID NO: 178335 - protein, 156 aa, Triticum aestivum
  Clone ID: PAT_TA_72753.pep
LSSMPDEICCARVVALALALAGLHRAKSCARAPPSSTFFSTDVPPHPDQQRSTPHERTRSPAPDRGRSDPALCFSLPGVVLHPAASTPRRIDASRGWDLCFLFDPVPSHPTTTTKGGSGCSGHPLQIPTSDGPFCSRAPWRSRIMWTSTRSTEQWM

SEQ ID NO: 178336 - protein, 170 aa, Triticum aestivum
  Clone ID: PAT_TA_72754.pep
MKTFLILALLAIVATTATTALRVPVPQLRPQNPSQQQPQEQVPLVQQQQFLGQQQPFPPQQPYPQPQPFPSQQPYLQLQPFLQPQLPYSQPQPFRPQQPYPQPQPQYSQPQQPISQQQQQQQQQQQQQQQQQQQIIQQILQQQLIPCMDVVLQQHNIVHGKSQVLQQSTY

SEQ ID NO: 178337 - protein, 58 aa, Triticum aestivum
  Clone ID: PAT_TA_72755.pep
QVQDGPLQRPLAARRVVHGHPDPALPVRVRAAGHPFQIRSSTSAACFSSHVARWRVFA

SEQ ID NO: 178338 - protein, 164 aa, Triticum aestivum
  Clone ID: PAT_TA_72756.pep
RRFLILPLLGIVATTATSAVTVPVPQLQPQNPSQQQPQEQVPLMQQQQQFPGQQEQFPPQQPYPHQQPFPSQQPYPQPQPFPPQLPYPQTQPFPPQQPYPQPEPQYPQPQQPISQQQAQQQQILQQILQQQLIPCRDGVLQQHNIAHASSQVLQQSTYQQLQQL

SEQ ID NO: 178339 - protein, 51 aa, Triticum aestivum
  Clone ID: PAT_TA_72757.pep
YKVHTLILGWREYYVYGQGTHDFVDIFLNKSLCFFLLKQSHWKVHIFSMRT

SEQ ID NO: 178340 - protein, 55 aa, Triticum aestivum
  Clone ID: PAT_TA_72758.pep
VSQLQSQHGAFNNIIDDGEARLQHPPVRMLTKKLGVQTNLCHELRSLLHCITCHP

SEQ ID NO: 178341 - protein, 214 aa, Triticum aestivum; identical to SEQ ID NO: 177527
  Clone ID: PAT_TA_72759.pep

SEQ ID NO: 178342 - protein, 202 aa, Triticum aestivum
  unsure (1)..(202): unsure at all Xaa locations
  Clone ID: PAT_TA_72760.pep
RSSKQEQIHNSIVXTLLALMDGLDSRGQVVLIGATNRIDAIDGALRRPGRFDREFYFPLPGYEARAEILDIHTRKWKEPPPKELKMELAASCVGYCGADLKALCTEAAIRAFREKYPQVYTSDDKFVIDVNSVRVERNHFLEAMSTITPAAHRGSIVHSRPLSPVIAPCLNRHLEKIMERISDIFPYLSALDLSKYSTLSYG

SEQ ID NO: 178343 - protein, 155 aa, Triticum aestivum
  Clone ID: PAT_TA_72761.pep
LQQPLFSQHKQPLLPQQQIPSVQTSILHHLNPCKVFLQQQCRPVAMPQTLARSQTLRQSICHVMHQQCCRQLPQIPEQSHYDAIHAIIYSIVLQEQQHGQGLNHPQQQQPQQSVQGVSQPQQQQKQLGQCSFQQPQQQQLGQWPQQQQVPQGTLL

SEQ ID NO: 178344 - protein, 218 aa, Triticum aestivum
  Clone ID: PAT_TA_72762.pep
MRTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQC

SEQ ID NO: 178345 - protein, 85 aa, Triticum aestivum
  Clone ID: PAT_TA_72763.pep
FSGKNIAFIIFLIQYLSITFYLLSGFEEGRNCSGVKKTVQTDSPEHEQVYPKLIILEDFKYQTKDKDKTTTGKYIQVQHRPRLKV

SEQ ID NO: 178346 - protein, 187 aa, Triticum aestivum
  Clone ID: PAT_TA_72764.pep
GETDSLSANVAKGWASVQTIPRTVELDEKTRTNLLQWPVEEIETLRFNSTDFGVITIHNGSIIPLCLRQATQLDIEASFRLDTSASAIINEADVNYNCSTSGGASTMGVLGPFGLLIHATGNGGSEQLAVYFYVSRGRDGALRTHFCHDKLLSSRANDVMKRVVGSTVPVLDGEALSVRVLVDHSIV

SEQ ID NO: 178347 - protein, 172 aa, Triticum aestivum
  unsure (1)..(172): unsure at all Xaa locations
  Clone ID: PAT_TA_72765.pep
SMSAPSPGAQAPPWPRLPATEAPPPSPACVLPSSVGTNGSSSLLRPPATPPSDRRVVIFSHLHSHLVCSTTCCAAHYGRRCVSVRRCFHHEPRAHFHRCSRAALPCLLPARGPFVLPLFWVXKRGAKNYNQDHQASSLRFLPSTTTTRHVCLLSSSESLKTTSTLMPDAYNN

SEQ ID NO: 178348 - protein, 86 aa, Triticum aestivum
  Clone ID: PAT_TA_72766.pep
MEKDLPQEIVDFKRIGGRLQRGAVAHLARVSLGAEALTAAAAGESVAPLARLDLGAPTLTGAAVAGHSSAILIGVDLGAPARAAWA

SEQ ID NO: 178349 - protein, 192 aa, Triticum aestivum
  unsure (1)..(192): unsure at all Xaa locations
  Clone ID: PAT_TA_72767.pep
MKTFLILALLAIVATTATIALRVPLPQLQPQNPSHQQPQXQVPLVQQQRFXPGQHQPFPPQQPYPXPQPFPSQQPYLHLQPFTHPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCHQLWQIPEQSRC

SEQ ID NO: 178350 - protein, 143 aa, Triticum aestivum
  Clone ID: PAT_TA_72768.pep
DPGAAQLSSQTSLMSSSSRVRVGTLVPFAEGKSGSPNASPPMPSIPILEGSNVVGRSNLVAVDKRVSRKHLSLRALPDGSVEVVVEGPNPIVVRSEGQRRKVCAHHKAKVMHDDVLELIPGEYFMKYVNTSDERKSSTSVESH

SEQ ID NO: 178351 - protein, 64 aa, Triticum aestivum
  Clone ID: PAT_TA_72769.pep
VVAVVMDTPTDLLLHLRGYGGRGPILLLRSYGRSSEQHRHEKEEPPNTTLVNEHHCCLRETRRD

SEQ ID NO: 178352 - protein, 122 aa, Triticum aestivum
  Clone ID: PAT_TA_72770.pep
SAAAGPASPSRTSPALARPSPPPIPTPASALLPPEAPAPPLPSRSCSASPPSRSRAAPLCTNCGRRLPLPPEAPAGRPPLHLKATAAGCAATNTKTAIKIISYGHNIWAKTSAHLMLLLTIT

SEQ ID NO: 178353 - protein, 143 aa, Triticum aestivum
  unsure (1)..(143): unsure at all Xaa locations
  Clone ID: PAT_TA_72771.pep
PPSRSRSPHPSCSGPQPTPLTRRRRPTPPPHTTAPSPHPGPIQSNPARTPMPPPXPLPPSPASHPWRLRSRPPPPPPSPLPPQRRSPPSQLPPRCPGAAPPRPGESRSAGPHPRPATPRPRQLQQLARSLAAAGECWWSSYRG

SEQ ID NO: 178354 - protein, 181 aa, Triticum aestivum
  Clone ID: PAT_TA_72772.pep
QHQQLVQQQIPVVQASILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFDVGTGVGAY

SEQ ID NO: 178355 - protein, 217 aa, Triticum aestivum
  Clone ID: PAT_TA_72773.pep
HHLNQASCGQYKSGVNTFLILALLAIVATTATTAVKVPVPQLQPQNPSQQQPQEHVPLVQQQQLLGHQQPFPPHQPYPQPQPFPSQQPYLQLQPFLQPQLPYSQPQPFRPQQPYPQPQPQYSQAQQPISQQQQQQQQQQQQQQQQQQQILQQILQQQLIPCMDVVLHQHNIPHGRSQVLQQSTYQLLQELCCHHLWQIPEQSQCQAIHNVVHAIILH

SEQ ID NO: 178356 - protein, 158 aa, Triticum aestivum
  unsure (1)..(158): unsure at all Xaa locations
  Clone ID: PAT_TA_72774.pep
MKTLIILTILAMAITIITAXMQVHPIRQIQWSQQQLIPHPQYPLSHQPQPIISSNLQQHIPPHQSTYNIVPHPHQPQQPFLQPQQPFPQQPQQPFPQTQQPQQPFPQQPQQPFPHTQQPQQPFPQQPQQPFPQQQPQQPFPQQPQQPFPHTEQPQQPF

SEQ ID NO: 178357 - protein, 199 aa, Triticum aestivum
  Clone ID: PAT_TA_72775.pep
QLPFPQQPQQPFPQAQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPILRPLFQLAQGLGIIQPQQPAQLEGIRSLVLKTLPTMCNVYVPPDCSTINVPYANINAGIGGQ

SEQ ID NO: 178358 - protein, 223 aa, Triticum aestivum
  Clone ID: PAT_TA_72776.pep
MRTFLILALLAIVATTATNAVRVPVPQLQPQNPSEQQPQEQVPLVQQQQFLGQQQPFPPQQPYPQPQPFPSQQPYLQLQPFSQPQLPYSQPQPFRPQQPYPQPQPQYSQPQQPISQQQQQQQQQQQQQQQQQQEQQILQQILQQQLIPCMDVVLQQHNIARGRSQVLQQSTYQLLQELCCQHLWQIPEKLQCQAIHNVVHAIILHQQQKQQQQLSSQVSFQQP

SEQ ID NO: 178359 - protein, 225 aa, Triticum aestivum
  Clone ID: PAT_TA_72777.pep
QPLAPQQPYPQPKPVPSQQPYLHLQPFTQPQLPYPQPQPFRPQQPYPQPQPQYSQPQQPISQQQQQQQQQQQQQQQILQQILQQQLIPCRDVVLQQHNIAHGSSQVLQESTYQLVQQLCCQQLWQIPEQSRCQAIHNVVHAIILHQQHHHHQQQQQQQQQQPLSQVSFQQPQQQYPSGQGFFQPSQQNPQAQGSFQPQQLPQFEAIRNLALQTLPAMCNVYIPPY

SEQ ID NO: 178360 - protein, 112 aa, Triticum aestivum
  Clone ID: PAT_TA_72778.pep
MGKEVDGGALEAGGARDYSDPPPAPLVDVDELGKWSLYRAVIAEFVATLLFLYITVSTVIGYKHQTDASASGPDAACGGVGILGIAWAFGGMIFILVYCTAGISGGHINPAV

SEQ ID NO: 178361 - protein, 213 aa, Triticum aestivum
  Clone ID: PAT_TA_72779.pep
MKTFLILALLAIVSTTATIAVIVPVPQLQPQNPSQQQPQEQVALVQQQQFPGQQQPFPPQQPYPQPQPFPSQQPYLQLQPFPHPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCQQLWQIPEQSRCQAIHNVVHAIILHQQQQQQQQQ

SEQ ID NO: 178362 - protein, 104 aa, Triticum aestivum
  Clone ID: PAT_TA_72780.pep
LPGSVAGRFVVFRHVGDAERIVGDEALQGLEDPLLLGDPRQLGLRGSVEEIHGRSPSAARAGGARNGPGGRLGSTPRGRGRAAEVAPSPPGPRAAARVGGGGIS

SEQ ID NO: 178363 - protein, 144 aa, Triticum aestivum
  Clone ID: PAT_TA_72781.pep
KALNNLFAVRMRLGHFDGDPRANIYGGLNAADICTPEHRSLALDAAQDGIVLLKNDAGILPLDRAAVASAAVIGPNANNPGLLIGNYFGPPCESVTPLKGVQGYVKDARFLAGCRSAACDVADTDEAASLAASSDYVLLLMGLS

SEQ ID NO: 178364 - protein, 190 aa, Triticum aestivum
  unsure (1)..(190): unsure at all Xaa locations
  Clone ID: PAT_TA_72782.pep
QYPSSQQQPGQGQQGQYPASQQQPPQGQQGQYPASQQQPGQGQQGHYLASHTQPRQRQQRPYPSSLQQPIQGQQGHYTASLQQPRQGQQGHYPASLQQVRQGQQIGQLGQRQQPGQGQQTRQGQQLEQGQQPGQGQQTRQGQQLEQGQQPGQGQQGYYPTSPQQSGQGQQPXNDNNHXQGQQGYYSSSLQ

SEQ ID NO: 178365 - protein, 122 aa, Triticum aestivum
  Clone ID: PAT_TA_72783.pep
ATAGSASATASLVYVSTTAGSFGASASGSAAVAGSGSLVSFVSAAAGASSLVASTSTGAGASTSASTGAGTSSVLATSSAETGVSSAGASSVSAAVGFWTSAVAIAVVDARKCPEWQTLPPS

SEQ ID NO: 178366 - protein, 178 aa, Triticum aestivum
  Clone ID: PAT_TA_72784.pep
EPFTAFRSAWEPQHPSSPEHQPTPQPQQHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPAMCDVHVPPYCYTTISPSSDVTTD

SEQ ID NO: 178367 - protein, 93 aa, Triticum aestivum
  unsure (1)..(93): unsure at all Xaa locations
  Clone ID: PAT_TA_72785.pep
MWQPRAMALAVRVVYCGAXGYKSKYLQLKKKLEDEFPGRLDICGEGTPQATGFFEVMVAGKLIHSKKKGDGYVDTESKFLKLVAAIKAALAQG

SEQ ID NO: 178368 - protein, 154 aa, Triticum aestivum
  unsure (1)..(154): unsure at all Xaa locations
  Clone ID: PAT_TA_72786.pep
SYKSNGVINHSWRDNFNTWVDIWSSLEIKLSSRKYTCANNQVGIIMSTIHRMFRDTDLDIFRLDYCNALPRMGSDHTLNVWDSGISKXARTTSYKFENTCLLREDIKDLVEKIWNIPSLGGSSIELLQEKISKHGKITEGCSANTQVELRKLKK

SEQ ID NO: 178369 - protein, 120 aa, Triticum aestivum
  Clone ID: PAT_TA_72787.pep
QASSDLLRFGGGGGGGMAARLNHLLSSSNAPSFRHLPPPQAPPFHLGSAQEFIDGNGSPAFLQGKPFHGLMQLPDLQGNGSGGTSSSAPGLFNLGYIANSGNTSGTSSHGHSSHGHMAND

SEQ ID NO: 178370 - protein, 237 aa, Triticum aestivum
  unsure (1)..(237): unsure at all Xaa locations
  Clone ID: PAT_TA_72788.pep
IIAELLKAGLIRPSTSPFSSPVLLVKKKDGTWRLCIDYRKLNAITIKNKYPIPIIEDLLDQLKGATVFSKIDLRSGYHQIRMAEEDIHKTTFSTLQGHFEFLVMSFGLTNGPPSFQALMNFLFGSFEFVVVFFDDILVFSTTMAEHKLHLKKVFQVLQENHLYAKLNKCSFGQSEIEYLGHVINKEGVATDPSKIAAIKEWPTPKTVTELXSFLGLSGYYRXLFRDMASFAGPLLTV

SEQ ID NO: 178371 - protein, 212 aa, Triticum aestivum
  unsure (1)..(212): unsure at all Xaa locations
  Clone ID: PAT_TA_72789.pep
MNTFLGFALLAGAATSAIAQMETTCIPGLERPWQHQPLPPQQTFPQQPLFSQQQQLFPQQPSFSQQQPPXWQQQPPFSQHQPILPQQPPFSQQQQLLLPQQPPFSQQQQPVLPPQQSPFPQQQQHQQLVQQQIPVVHPSILQLLNPCKLFLQQQCSPVAMPQRLARSQMLQHSSCHVMQQQCCHQLPHIPHQSRYEAIRAIIYSIILQEQQQ

SEQ ID NO: 178372 - protein, 142 aa, Triticum aestivum
  unsure (1)..(142): unsure at all Xaa locations
  Clone ID: PAT_TA_72790.pep
RRQDDSSPPRRRARHDSEEPQDISPPRRRTRHDSKEPHNRSPPRRRTRHDSEEPHNRSPSRRRTRHDSEEPQNRSPSRRRTRHDSEEPGDISPPRRRKHQASAQLDDLSLARRQNLGQSLXDGDISPPRKGRKSASDDLSPT

SEQ ID NO: 178373 - protein, 165 aa, Triticum aestivum
  Clone ID: PAT_TA_72791.pep
LHVLIQNARSEGRLDSGIVDIKANRVEMNDPPKTVHVDSLSGASTVLFTLTIDRGVTWESAKAILEERHKDGACSSNDGFYESRREWMGKTHFMLPFEGSTEGMYRVTRPAVGEASNEMPLAELEGKYKNASSADKTGEGWHEEYDVSSKQCMHGPKCILGSDCT

SEQ ID NO: 178374 - protein, 162 aa, Triticum aestivum
  unsure (1)..(162): unsure at all Xaa locations
  Clone ID: PAT_TA_72792.pep
MKTFLSFALLAIAATSAIAQMETSRVPGLEKPWQQQPLPPQQQPPFSQQQQPPFQQQQPPFXQQPSFPQQHQQFPQQQIPVVQPSVLHHLNPCKVFLLQQRSHVALSQRLARPQLWQQSSCHVMQQQCCQQLSHIPEHSRSEAIRAIVYSIILQEQQQGFVQ

SEQ ID NO: 178375 - protein, 214 aa, Triticum aestivum
  unsure (1)..(214): unsure at all Xaa locations
  Clone ID: PAT_TA_72793.pep
KTLLIMTIIAEALXSTTDNIQVDPSGQVQWPQQQQPCSNPQQPLXXQPQQMLPQPQQTLPHQPQQAFPQPQQTFPHQPQQQFPXPQQPQQQFPQPQQPQQPFPQQPQQQFPRPQQPQQPFPQPQQPQLPFPQQPQQPFPQPQQPQQPFSQLQQPQQPLPQPQQSQQPFSQQQQSLIQPYLQQQMNPCKNYLLQQCNPVSLVSSLVSMILPRSDL

SEQ ID NO: 178376 - protein, 198 aa, Triticum aestivum
  Clone ID: PAT_TA_72794.pep
QPQPFRPQQPYPQPQPQYSQPQQPISQQQQQQQQQQQQQQQQQQQIIQQILQQQLIPCMDVVLQQHNIVHGKSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 178377 - protein, 203 aa, Triticum aestivum
  Clone ID: PAT_TA_72795.pep
SETWDWAIHPWVEIGGDNSLKYNAGMLVDGSVYWPFHGEHRMIRINTATMEVINVDLPLQVDVESCNYNAGETRDGQLCIVYAADDFHLHVWIRGVDGDGIGIWVPQNILSLSAEIGRVTRGWLGHLRVVQVRSGYVYLSMKCITPVGILRCWFLSLSLETMKIESLIHGTFGDSAYPYIMAWPPCLIGHDGSSTGHEVEASH

SEQ ID NO: 178378 - protein, 198 aa, Triticum aestivum
  Clone ID: PAT_TA_72796.pep
QPLPFRPQQPYPQPQPQYSQPQQPIAQQQQQQQQQQQQQQQQEQQILQQILQQQLIPCMDVVLQQHNLAHGRSQVLQQSTYQLLQELCCQHLWQIPEQSQCQAIHNVVHAIILHQQQKQQQQLSSQVSFQQPQQQYPLGQGSFRPSQQNSQAQGSVQPQQLPQFEEIRNLALQTLPAMCNVYIPPYCTIAPFGIFGTK

SEQ ID NO: 178379 - protein, 92 aa, Triticum aestivum
  Clone ID: PAT_TA_72797.pep
ELNAMVERMESSDLDTVNLTDNDLSKYHLIYFIGGRSKVKDELVYRFIFPERPCALMNFLDTLSPRWNISLFHYRAQGETGANVLFGIQVPP

SEQ ID NO: 178380 - protein, 109 aa, Triticum aestivum
  Clone ID: PAT_TA_72798.pep
CAPHQWGPTSPASASNEQWPELVSSFFCSCTSRLDPAVCGHKRCSPLCIQVVQCARILLLEVTAAPRHPSPSSTAEGRLATSPCSSPLAATPWLCVACMRLVKPKPNPK

SEQ ID NO: 178381 - protein, 58 aa, Triticum aestivum
  Clone ID: PAT_TA_72799.pep
LSCICKKNNANEGVTCYKFMTSKKRNNTLDGSVQIISSLAVPCKTLNRYASLIISKRL

SEQ ID NO: 178382 - protein, 196 aa, Triticum aestivum
  Clone ID: PAT_TA_72800.pep
PYESSRSFTRPSPPSSPLSGSQPRDRWFNLALRDCPAALENFDLWRQSNLEPLVIDIVMLRRDNPNTTCAEGGKIIERWVIQYETSKPGSGNGNGSKNHSRKSRNSPAEDHSLYRSTYKGSTVLLRSLHLVVRLLPAYNLFRELNSSGRIRPLNLSHKISSFVEPFTRAEDAEMKHYAFAPIETLFGRLSLSVSYV

SEQ ID NO: 178383 - protein, 189 aa, Triticum aestivum
  Clone ID: PAT_TA_72801.pep
MAVGGDDDMERDFAARLRLAPSNPSSASASASASPTAASPTAGGGGIAFRAPQEQFTAGDFELGKIYGVGSYSKVVRARKKDTGNVYALKIMDKKFITKENKISYVKMERIVLDQLDHPGVIRLFFTFQDTYSLYMALESCEGGELFDQIVRKGRLSEDEARFYAAEIVDILEYLHSVGLIHRDVKPEN

SEQ ID NO: 178384 - protein, 229 aa, Triticum aestivum
  unsure (1)..(229): unsure at all Xaa locations
  Clone ID: PAT_TA_72802.pep
SLVRQTFNAEDXRVILQIPIYDRTPDSIAWHFDXKGIFLVKSAYKVAVDSIERDSTHGQPSSSRSDGEAIDFEWKKLWALPLPNKVLHFLWRIATYSLPLRMKLKNIGMEIDSRCPVCLRYDEDGGRCFLKCKMVRRLWSLAQMDNIRNRLMLCNDPLSLFNELFRLTEEESIKXLKKQRSTQKQTSTAKWSPLANEFLKVNSNGAFKEASKSGGWGFTLRNSNGMLLA

SEQ ID NO: 178385 - protein, 217 aa, Triticum aestivum
  Clone ID: PAT_TA_72803.pep
FPQQPQQPFPQTQRPQQPFPQQPQQPFPQTQQPQQPFPQFQQPHQPFPQPQQQFPQPQQPQQSFPQQQRPFIQPSLQQRLNPCKNILLQQCKPASLVSSLWSIIWPQSDCQVMQQQCCQELAQIPQQLQCAAIHSVVHSIIVQQQQQQQQQQQQQQQGMHILLPLSQQQQLGQGTLVQGQGIIQPQQLAQLEAIRSLVLQTLPTMCNVYVPPECSII

SEQ ID NO: 178386 - protein, 211 aa, Triticum aestivum
  unsure (1)..(211): unsure at all Xaa locations
  Clone ID: PAT_TA_72804.pep
MNTLLILTIIAVALTTTTANIQVHPSGQVQWPQQQQPFSQPQQPFSQQPQQIFPQPQQTFPHQPQQAFPQPQQTFPHQPQQQFPQPQQPQQQFPQPQQPQQPFPQQPQQQFPRPQQPQQPFPQPQQPQLPFPQQPQQPFPQPQQPQQPFSQLQQPQQPLPQPQQSQQPFSQQQQSLIQPYLQQQMNPCKNYLLQQCNPVXLVSSLVSMILP

SEQ ID NO: 178387 - protein, 173 aa, Triticum aestivum
  Clone ID: PAT_TA_72805.pep
MDFVSSMSVEQGIHDVVVQQLVTTGERGEQSLEQRLHDAVVKREWPMEVEQGSSSGGTASPACADEAGTSLNWLLGARQRVVLTSERPNKKRKLIGVDAGLEQLVLLPRLGAQAGTMCDVCCLGETDMASNRMLCCNNCKVSVHQWCYGLHVVPDGQWLCTWCKYVESTGCSL

SEQ ID NO: 178388 - protein, 202 aa, Triticum aestivum
  unsure (1)..(202): unsure at all Xaa locations
  Clone ID: PAT_TA_72806.pep
QQPGQGHQPGQGQGGYYPTSLQQSGQGQQPGQWQQPGQGQPGYYPTSSLQPEQGQQGYYPTSQQQPGQGPQPGQWQQSGQGQQGYYPTSPQQSGQGQQPXQWLQPGQWLQSGYYLTSPQQLGQGQQPRQWLQPRQGQQGYYPTSPQQSGQGQQLGQGQQGYYPTSPQQSGQGQQGYDSPYHVSAEHQAASLKVAKAQQLAAQ

SEQ ID NO: 178389 - protein, 118 aa, Triticum aestivum
  Clone ID: PAT_TA_72807.pep
MAELGPAGWEEVLRVVPSMDAVVKVFCVHTDPNFSLPWQRKRQYSSSISGFIIGGRRVLTNAHSVEHFTHVKLKKRGSDTKYLATVLAIRTECDIALLTVSDDDFWEGVTPVEFGSLP

SEQ ID NO: 178390 - protein, 79 aa, Triticum aestivum
  Clone ID: PAT_TA_72808.pep
LYTDYSTVSINMACTNKIPLQWSLDCMSIRLFVNQLWPRCADSSQASPRLPIKPKQLKAKKKEHRYINLMQLLVTPECW

SEQ ID NO: 178391 - protein, 206 aa, Triticum aestivum
  Clone ID: PAT_TA_72809.pep
GKYICYLSTGDFYGEDIFSFKDEIQEKNVVCEDLKKAPESLSSSSEHCFPVPGETFMPVPEMEEREKSINNVQSVSLPERKGFTSDSVEEKRLECDPVPLSAMETKKPERVGKPHSSISQRIRQWECGNLKGVLDEIEDNPVEIFFEKGSFKVVEEAMPLETESWDQKQSQDQLAQEESDRKQLPEEELVHVKEESAQSKVAEECI

SEQ ID NO: 178392 - protein, 221 aa, Triticum aestivum
  unsure (1)..(221): unsure at all Xaa locations
  Clone ID: PAT_TA_72810.pep
QGQQPGQGQQPGQGRPGYYPTSPQQSGQEQQLEQWQQSGQGQPGHYPTSPLHPGQGQPGYYPTSPQQIGQGQQPGQLQQPTQGQQGQQPGQGQQGQQPGEGQQGQQPGQGQQPGQGQPGYYPTSLQQSGQGQQPGQWQQPGQGQPGYYPTSSLQPEQGQQGYYPTSQQQPGQGPQPGQWQQSGQGQQGYYPTSPQQSGQGQQPXQWLQPXQWLQSGYYLTS

SEQ ID NO: 178393 - protein, 209 aa, Triticum aestivum
  Clone ID: PAT_TA_72811.pep
PRVDRKRRRRSVPLAGPVSKVLGYDNLLIEILVRLPPKPSSLPRASVVCKRWGSILSDPQFLKRFREHHRKPPLLGFFRGYAKNFIPAMDSPDRIPAARFSLPKSSIPYHTDEAYMGCRHGLSLLINIHKRETVVWDPLTGEERIVAFPPGFNSTLMWSYSGWHGTVLCVNAEDGHVHGDCFSSPFKLVLVCAEYNTPAVCSVYDSASD

SEQ ID NO: 178394 - protein, 202 aa, Triticum aestivum
  Clone ID: PAT_TA_72812.pep
LPYSQPQPFRPQQPWAQPQPQYSQPQQPISQQQQQQQQQQQQQQQQEQQILQQILQQQLIPCMDVVLQQHNLAHGRSQVLQQSTYQLLQELCCQHLWQIPEQSQCQAIHNVVHAIILHQQQKQQQQLSSQVSFQQPQQQYPLGQGSFRPSQQNSQAQGSVQPQQLPQFEEIRNLALQTLPAMCNVYIPPYCTIAPFGIFGTK

SEQ ID NO: 178395 - protein, 187 aa, Triticum aestivum
  unsure (1)..(187): unsure at all Xaa locations
  Clone ID: PAT_TA_72813.pep
HHSSQASSGQYKSTVKTFLILALLAIVATTTTTAVRVPVPHLQPQNPSQQQPQEQVPLVHQQQFLGQQQQHLPGQQQPFPPHHAYPQPQPFVPLLPYPKPXLFPPHQSYPQPLPQYTHPQQPISQXQAHLHLRQQQLQQHQILXQILQQQLIPCKDVVLQQPNIAHASSQLSQQSYQLLQQLCCQQL

SEQ ID NO: 178396 - protein, 90 aa, Triticum aestivum
  Clone ID: PAT_TA_72814.pep
MCSKRNTCYGGPSQQEHDTPAVANEVFAIDEEVSHLTRLKSEPSERTRACLHAGKSHIYTFKLSSSRESNRSGFGRFSSVHCCYALHKHL

SEQ ID NO: 178397 - protein, 80 aa, Triticum aestivum
  Clone ID: PAT_TA_72815.pep
RSEGGFPTGLGTVGRKDGSKNFRMGTQFFGSMVNVPFTNGARKNLCGKISHEQSRGRCTEDDGGFRGCRFKRYTLHLSLC

SEQ ID NO: 178398 - protein, 79 aa, Triticum aestivum
  Clone ID: PAT_TA_72816.pep
LHDVAIAAYCSSHDVATFLSSHDVAIFLSLLFLHDVQAMFCQCSSSLVYTTLSSNLVHSHISIRFLHLVIFTCSKLVAF

SEQ ID NO: 178399 - protein, 216 aa, Triticum aestivum
  Clone ID: PAT_TA_72817.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQ

SEQ ID NO: 178400 - protein, 102 aa, Triticum aestivum
  Clone ID: PAT_TA_72818.pep
WEQGLRPRRHNCSGAPTKLATATQVPWPLSHICRPAVPRVGGGSYSACCGLHLLPQQRPATRFAIGVLQHCPLSVILHDFLSHPGLPILFQHDFFVFIGARR

SEQ ID NO: 178401 - protein, 168 aa, Triticum aestivum
  Clone ID: PAT_TA_72819.pep
MQITRCYKVESIFGRRLHQGQSSSSIQQGASCILEVPSSTPGAGVERLTLERCDGLTGALHLPQSLMYLHLWHCDQLASLESCSGELPSLRRLMLEYCPTLSSLPDGPQAYSSLEDIRIRGCPGMKTLPASLQQRLGSLEWESIDAHYYGNKPMLLKPKTWKYAIRRD

SEQ ID NO: 178402 - protein, 45 aa, Triticum aestivum
  Clone ID: PAT_TA_72820.pep
GYSVVGGHPCMGSTFDVELDDFVTEELVDAPEIMYVAGRKHYGMQ

SEQ ID NO: 178403 - protein, 200 aa, Triticum aestivum
  Clone ID: PAT_TA_72821.pep
MNPHPLRLGALLAALVLAAGGGWWARAEASIHTYGRESFREVGNAFLLSGGSEGIVADGADLAAPDSSFIKFVNVTFWRNSESAESHTKMAHSTGLVQAILFEAADRDNIGGSAYGGQRSICCTPDLAKLEGCKQGEVIRRPSSDDPGWPVVVNTHFSANHLSVKLDDEEVHITKTGMYNLFFISCDPKLRGLAMSGKTI

SEQ ID NO: 178404 - protein, 42 aa, Triticum aestivum
  Clone ID: PAT_TA_72822.pep
HIKIEYVNSGQQIAYCLTKGLGTRECSLPRDKMGMIYIYHPS

SEQ ID NO: 178405 - protein, 223 aa, Triticum aestivum
  Clone ID: PAT_TA_72823.pep
MKTFLILTLLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQS

SEQ ID NO: 178406 - protein, 153 aa, Triticum aestivum
  Clone ID: PAT_TA_72824.pep
PRPRGPPPLQPVLPRRRPVLLARQQARPPPSPPRPPPARPLPRPPWSLSRPRLAPLALWAPRPPARPQLLARSPWPPPSQRRPAPPPWSPQPRRGQTPRPRPPPARGPPPSSGPPRRPPASPPRAPPPSARPSGSGHQRWPLPSWMQENARSG

SEQ ID NO: 178407 - protein, 207 aa, Triticum aestivum
  unsure (1)..(207): unsure at all Xaa locations
  Clone ID: PAT_TA_72825.pep
MNTFLVFALLAVAATSAIAQMETTCILXLERPWQQQPLPPQQTLAQQPLFSQQQQLFAKQPSXSQQQPPFWQQQPPFSHQQPILPQQPPFSQQQQLVLPQQPPFSQQQQPVLPAQQSPFPQQQQHQQLVQQQIPVVQPSILQQLNPCKLFLQQQCSPVAMPQRLARSQMLQQSSCHVMQQQCCQQLPHIPQQSRYEAIRAIIYSIIL

SEQ ID NO: 178408 - protein, 138 aa, Triticum aestivum
  unsure (1)..(138): unsure at all Xaa locations
  Clone ID: PAT_TA_72826.pep
ANWRIIEAXRISRDTKSIIKSIVITSRIQLTLVSTWRRNPASSRAGDSGAIRFSPRAPPPSSPSLAAVAGGGSSSTSCSFPPYASSICSPTLSPVARVVKVTAAGSHLGDVPADWGLASCRRSARGACVAAACCYPVW

SEQ ID NO: 178409 - protein, 57 aa, Triticum aestivum
  Clone ID: PAT_TA_72827.pep
WGLLPQLQIHKQNKEENKLNCCILGLQSRFYNLDKTVSTYRHIFNGTEAHFCIPKFM

SEQ ID NO: 178410 - protein, 154 aa, Triticum aestivum
  Clone ID: PAT_TA_72828.pep
QILQQILQQQLIPCMDVVLQQHNIAHGRSQVLQQSTYQLLQELCCQHLWQILEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 178411 - protein, 183 aa, Triticum aestivum
  Clone ID: PAT_TA_72829.pep
NDHIPDSVVYIKGIRDSILRNEFILQDGTAQCDMDIHKIKMDIQKINTEKKMTKDVLSTMEKYKEPSSNIMKVANLTFSGDDGKTKSTKRMELKFKEALAQRDKCMELNDICCDCDWMAPTYTVLPSLTYGMHVGEVRSKCPDFESSITSDPCPTPHDARCSAAANMILELGKKVEDTEHHAN

SEQ ID NO: 178412 - protein, 149 aa, Triticum aestivum
  unsure (1)..(149): unsure at all Xaa locations
  Clone ID: PAT_TA_72830.pep
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAPAEREAAKPAKKKESGXSSVLMDIKPWDDETDMKKLE

SEQ ID NO: 178413 - protein, 168 aa, Triticum aestivum
  Clone ID: PAT_TA_72831.pep
MTFLILALLAIVATTTTTAVRVPVPQLQPQNPSQQQPQEQVPLVQQQQFVGQQQQHFPGQQQPFPPQQPYPQPQPFLPQLPYPQPQPFPPQQSYPQPQPQYPQPQQPISQQQAQLQQQQQQQQQQQILQQILQQQLIPCRDVVLQQPNIAHASSQVSQQSYQLLQQLC

SEQ ID NO: 178414 - protein, 122 aa, Triticum aestivum
  Clone ID: PAT_TA_72832.pep
LSPRRSPLATPWTAGFSPPSAPPRRPPVSTPSTVAVLRRRMCPAKSPAPREPFAAGCASPSAPPHASPSSPDPRPARPAPRRWICAVKSPFCTAPQPDPGPATVLPRRLWPRLEYSHPANLP

SEQ ID NO: 178415 - protein, 155 aa, Triticum aestivum
  Clone ID: PAT_TA_72833.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLE

SEQ ID NO: 178416 - protein, 142 aa, Triticum aestivum
  Clone ID: PAT_TA_72834.pep
LAVLLAALAYVLSVLRSLVWIPYRLERRLRRQGIRGPPRSLISGNGADYGALLAAAQSKPLASFHHAIVGRVAPHYREWPARYGRPFVFWFGPRSWLVFSSPEVAKAALNDSTGTFDKAGNGGGSNPLARQLIGEGLVGLTG

SEQ ID NO: 178417 - protein, 70 aa, Triticum aestivum
  Clone ID: PAT_TA_72835.pep
SFFFPKKYHKINLQEFYITVYKRSSIRTLTFLYILILPSSLNMITRDMLCALHIGSDSKQCKKLFICIVA

SEQ ID NO: 178418 - protein, 163 aa, Triticum aestivum
  Clone ID: PAT_TA_72836.pep
VLGVLRDSEDGGRGTLVVGELDETQGDGSHSGRVVEVVVHRGEELGNHGLDVNGARQRRARTTGHDRSCAWQQGVELAPARVKRSRARLSSTWTRREELLPFVLVLDRMMQAGLGSGASTVGRHGHGRARPIRTRSTLDSGGRREAEEERLRGAMARRRRRAR

SEQ ID NO: 178419 - protein, 216 aa, Triticum aestivum
  unsure (1)..(216): unsure at all Xaa locations
  Clone ID: PAT_TA_72837.pep
RRISDRSKPGLSRPWLPKIFVKTLTGKTITLEVESSDTIDNVKAKIXDKEDISLDQQRLIFAGKQLEDGCTFADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTIMLEVESLDTIDNVKAKIQDKEGIPLDHQHLIFAGK

SEQ ID NO: 178420 - protein, 74 aa, Triticum aestivum
  unsure (1)..(74): unsure at all Xaa locations
  Clone ID: PAT_TA_72838.pep
AVANITPGSMTAPYXNTQSFKLAVVLEGEGEVDIVCPHFGRDTERREHGKGRWSEEQEDDRRQGGVPHGAGRGG

SEQ ID NO: 178421 - protein, 163 aa, Triticum aestivum
  unsure (1)..(163): unsure at all Xaa locations
  Clone ID: PAT_TA_72839.pep
QGQQMGQGQPWYYXPVLHSRSGQGQQSGQRQQGYYPTSPQQXGQGQQPGQGQSGYFPTYRQQSGQGQQPGQXQQSGQGQQGQQPGQGQQAYYPTSSQQSRQRQQAGQWQRPGQGQPGYYPTSPQQPGQEQQSRQAQQSRQWQLLYYPTYPQQPRQLQQPSHGQ

SEQ ID NO: 178422 - protein, 112 aa, Triticum aestivum
  Clone ID: PAT_TA_72840.pep
RVKVLTGLNDLEHVQELALYNMDVLVDTLKLADEKLCDKIKCLTTPTKVDRGVLAGSWLRKLGAPAMTSSDSAAPELPCGDLERSGSVGRKATDDIEVHYSSGGAWTRLAQV

SEQ ID NO: 178423 - protein, 225 aa, Triticum aestivum
  Clone ID: PAT_TA_72841.pep
MYTFGKHEMGIATLSHYLSTSRLLLKHDLSRTSALDKTSAISTVIDLLDYNIAFSVSWLCHDIKALLIMSNPVLGASANDESFQVLLDRLMQAAHHKSHGISINTEAVMPNGSLDKRQPGGSEDSSLSIDEKWHLIGASLWIGLSSFMKHLLKEFIGNEKLECEACTSDVKEFKGLASSVAAKFVIDSLQFVSSSLVRLHASFFRDKLSNNLHPSVLFWLEYMSS

SEQ ID NO: 178424 - protein, 227 aa, Triticum aestivum
  Clone ID: PAT_TA_72842.pep
NYTAHTIDSVQRLVLGISTIIRAGAWFNSRCNETKHGPTDTKTHASSSWAELKGIICTGLELRHYKPWENSETPYLKLLALIQVQQSGSHFWPVKFLSTDVYAHEAWYYCIPDTCIRRTLMGIVDSCSARMSIPAILEDASGHHCEVPICAIIQADGDQCKCEWKLQCSLSKWPDEVGRGQNGDYCIPLDCYAWGLLHPNCYKEVTQGGRGDGAHAGHVCCIYYTYY

SEQ ID NO: 178425 - protein, 145 aa, Triticum aestivum
  Clone ID: PAT_TA_72843.pep
SLPPDLDRDRGLGSALDAAAAWITTSPEPPPPPSMSTSASLTAPPECFFLVSSTSPTRSGLRPWRTRRHRRTPSPPRPATASPNLAASSSPPMTAYNRPRRPRRRWTTSLLPRTPPQPPPRRTLRPRPLPRRPPASLGAPSTHQR

SEQ ID NO: 178426 - protein, 218 aa, Triticum aestivum
  Clone ID: PAT_TA_72844.pep
SQQQSPFSQQQQRVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPFGVGTGVG

SEQ ID NO: 178427 - protein, 96 aa, Triticum aestivum
  unsure (1)..(96): unsure at all Xaa locations
  Clone ID: PAT_TA_72845.pep
QLQQPAQWQHPGQEQHGQQPGQGQQPGQGQPGYYPTSPQQSRQEQHLXQWQQSGQGQPVHYPTSPLQPXQGHPGYYPTSPQQIGQGQQPRQLQQPT

SEQ ID NO: 178428 - protein, 209 aa, Triticum aestivum
  unsure (1)..(209): unsure at all Xaa locations
  Clone ID: PAT_TA_72846.pep
KQRQQAGQWQRPGQGQPKFYPSSHTAPXQDQLSGQTQQSRQWQLVYYPTSAKQPRQLQQPAQGQQPAQGQQSAQEQQPGQAQQSGQWQLVYYPTSPQQPGQLQQPAQGQQGYYPTSPXQSGQGQQGYYPTSPQQSGQGQQGYYPTSPQQSGQGQQPGQGQQPRQGQQGYYPISPQQSGQGQQPGQGQQGYYPTSPQQSGQGQQPGHEQQ

SEQ ID NO: 178429 - protein, 79 aa, Triticum aestivum
  Clone ID: PAT_TA_72847.pep
SAGGKYSWEACIRLLPDSVLVIIEIFGWFACRSPDHFFTAKQNVNQLRSMMANSPEEMCWRYPELSMQSVSSTETECKA

SEQ ID NO: 178430 - protein, 198 aa, Triticum aestivum
  Clone ID: PAT_TA_72848.pep
KRQPANLPPGSLGLPVIGQSLGLLRAMRGSGGGSRWIQDRIDRYGPVSKLSLFGTPTVLLAGPAANKFLFFSSALSTRQPRSVQRILGENSILGLHGADHGRVRGALLEFLKPDMLKMYVGRIDAEVRRHVEENWAGRGTVTVLPLMKRLTFDIISALLFGLERGAVRDALAGDFARMVEGMWAVPANLPFTAFSRSL

SEQ ID NO: 178431 - protein, 83 aa, Triticum aestivum
  Clone ID: PAT_TA_72849.pep
SVDVGDGCTVSFWFDSWLPCGALAIAFPILFTHATDVEVTVWQVRGDGLRRHLAPRLTSAGARDLACVSTLIGSAPRRAGGDD

SEQ ID NO: 178432 - protein, 228 aa, Triticum aestivum
  Clone ID: PAT_TA_72850.pep
DEARLRSKVKKRVRGALVRLFHRRPVNEFRPFFESIGLRPSECDYLLPQDLTFLADAEMLLESYHALCSYGIARRKIGRIYWNATEVFSLGQGVLASKLEALEGLGFSKASVIKLVISTPTVLVHDPAVELKTFLLWLDDIGIQRDWIGQFLSERVSYNWPKMVQALQSLSDLEFTKDDIGKVVRKNPHSLLEQSGGELHSTVDTMQMVGSGKRELLDLFLNHPNVDS

SEQ ID NO: 178433 - protein, 210 aa, Triticum aestivum
  unsure (1)..(210): unsure at all Xaa locations
  Clone ID: PAT_TA_72851.pep
QQLALQPLQQFAKIQQPQQSFPQQPHRPHPFPXQLKQVIXQYPQQPFLLQPHQPFPQQPEQIIFQQPQQLFPXSQQPFLQQPQQPFPLQPQQPFPQQPAQIIAQQPQQPSPLQPQQSFLRQPQQPFPQPQQVVQINPQQPQQPFSQSRQPFPQQPQQPFPLQPQQPFPQQSAQIIPQQPQQPFPLQPQQSFLRQSQQPFLQQPQQPSPQP

SEQ ID NO: 178434 - protein, 134 aa, Triticum aestivum
  Clone ID: PAT_TA_72852.pep
GVLPGPPLGSGGPRGGLGRGGGLPECPILPGRHGIGLRRGRAPSSSAARARFQRFPRELADKLLPHGGRIRRHQHHIKFSPNQRTIARNPSSRESAVKFLAEILCKRRTLRQQQEIAMAGRGGLRRQQQPEISG

SEQ ID NO: 178435 - protein, 84 aa, Triticum aestivum
  Clone ID: PAT_TA_72853.pep
NFPKKIRKKRRSEGEQPNDSAVRILLPVHTRYNSATPSSPSSPHHHSLPTSLPIPPPPPPPRLALLARSDPTPPRARAAARRRG

SEQ ID NO: 178436 - protein, 222 aa, Triticum aestivum
  Clone ID: PAT_TA_72854.pep
QTFPHQPQQQVPQRQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGI

SEQ ID NO: 178437 - protein, 136 aa, Triticum aestivum
  Clone ID: PAT_TA_72855.pep
MQQELAALAYQSAGFVGLPTSYLPPHPHDVDVDLVDGWLVGGSGGAGDNGRGPPSCGSGLSHVADAVSETRKARRLASNRESARRSRMRRRRQLDELSACAAELRAANQRLVVELNRAEARHAQVARDNARLREEL

SEQ ID NO: 178438 - protein, 224 aa, Triticum aestivum
  Clone ID: PAT_TA_72856.pep
EVKAKFKISLLGQDRQPVPQYSFSSLIHTFSTKEAAWGFAQFIKKYDLEESLHLKDDVFSIRCDVTVLKEIFTEPIRPPVVVPVPPSDMHQHFGQLLLAGEAADVNFEVGAETFAAHRCILAARSSVFKAELLGTMKEKTATHIRIDDMEPKVFKALLHFIYTDSLPVMDEGDGAATAQHLLVAADRYSMERLKLICEGKLCDHICKSTAATTLALAEQHGRVA

SEQ ID NO: 178439 - protein, 204 aa, Triticum aestivum
  Clone ID: PAT_TA_72857.pep
MGPRQLPTVLLACCATLLALATPLLAGDPDMLQDLCVTDYKSLNGPLRLNGFPCKRPENVTADEFFSAALAFPGNTCNSVGSAVTAANVEKLPGLNTLGVSMSRVDYAPWGVNPPHTHPRATEIIYVLEGSLDVGFVTTAGKLFARAVCKGELFVFPRGLVHYQKNNGGAPAAAISAFNSQLPGTQSLALALFAASPPVPTDVL

SEQ ID NO: 178440 - protein, 199 aa, Triticum aestivum
  Clone ID: PAT_TA_72858.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPAMCDVHVPPYCYTTISPSSDVTTDMG

SEQ ID NO: 178441 - protein, 242 aa, Triticum aestivum
  Clone ID: PAT_TA_72859.pep
SAESVATWLPIAARRLSGGILLYNAVPQNQARERGVFELPRFENTTSIVFDLGFLGLAVPHSSVFARLVSLWLFGVHLHGPCELGDALSSPRCPSLRELKIRNAWGLGNFTIHSESLLQMELNNLYGLQQLTVEAKVLQELYVSSCFENSITAVSRPVANISAPQLASLHWTDAYEPSSVQLGEMAHLQRLETGHFFVFGHYLDDYTPNRNCLRLLQQFEVMHHLKLSLIYLLDKGHHQYLM

SEQ ID NO: 178442 - protein, 225 aa, Triticum aestivum
  unsure (1)..(225): unsure at all Xaa locations
  Clone ID: PAT_TA_72860.pep
MKTLLIVTILAMATTIATANMQVDPGYQVQWPQQQPFPQPQQPFCQQPQQTIPQPHQTFHHQPQQTYPHXPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQ

SEQ ID NO: 178443 - protein, 144 aa, Triticum aestivum
  Clone ID: PAT_TA_72861.pep
KGLVLNLENEHLMVNGIFLLLACHLHPVPVDVNSYGKDLQTSERGEANWRGTSRWACRWERGEAEMVEEPAGTCRWEREEADGKKPAGGVPVCLLRWPAGYLRSASCDGGGGGCVLRMCVCGWVIRVSPYWNLLVLRARRLPYW

SEQ ID NO: 178444 - protein, 163 aa, Triticum aestivum
  unsure (1)..(163): unsure at all Xaa locations
  Clone ID: PAT_TA_72862.pep
QASSQRPRQGQQPXRGQQGYYPTSPQQPVQWQQPEQGQPRYYPTSPQQSGQLQQPAQGQQPGQGQQGHQPGQGQPGYYPSSSQLQSGQLQQPVQGQQGQQPRXGHQGQQPXQGQQPXQGQQGQQPGQGQQPXQGQQGQQLGQGQQGYYPTSLQQSGQGQPGYY

SEQ ID NO: 178445 - protein, 227 aa, Triticum aestivum
  Clone ID: PAT_TA_72863.pep
MKTLLILTIIAVALTTTTANIQVDPSGQVQWPQQQQPFSQPQQPFSQQPQQIFPQPQQTFPHQPQQAFPQPQQTFPHQPQQQFPQPQQPQQQFPQPQQPQQPFPQQPQQQFPRPQQPQQPFPQPQQPQLPFPQQPQQPFPQPQQPQQPFSQLQQPQQPLPQPQQSQQPFSQQQQSLIQPYLQQQMNPCKNYLLQQCNPVSLVSSLVSMILPRSDCQVMRQQCCQQLA

SEQ ID NO: 178446 - protein, 218 aa, Triticum aestivum
  unsure (1)..(218): unsure at all Xaa locations
  Clone ID: PAT_TA_72864.pep
MKTLLILTILAMAITIGTGNIQVDPSGQVQWLQQQLVPQLQQPLSQQPQQTFTQPKQTXPHQPQHQVPQPQQPQQPFLQPQQPFPQQPQQPFPQTQQPQQPFPQQPQQPFPQTQQPQQPFPQQPQQPFPQTQQPQQPFPQLQQPQQPFSQPQQQLSXPQQPQQSFPQQQRPFIQPSLQQQLNPCKNILLQQCKPASLVSSLWSIIWTQSDCQVMRQQC

SEQ ID NO: 178447 - protein, 223 aa, Triticum aestivum
  Clone ID: PAT_TA_72865.pep
MKTLLIGPILARATTIATANMQVDPGYQVQWPQQQPFPQPQQPCCQQPQQTIPQPHQTFHHQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCADIHSVVHSIIM

SEQ ID NO: 178448 - protein, 220 aa, Triticum aestivum
  Clone ID: PAT_TA_72866.pep
LFQASCGQYKSTVNTFLILALLAIVATTDTTAVRVSVPQLQPQNPSQQQPQEQVPLVQQQQFLGQQQPFPPQQPYPQLQPFPSQQPYLQLQPFPQPQLPYSQPQPFRPQQPYPQPQPQYSQPQQPISQQQQQQQQQQQQQQQQQQQQQILQQILQQQLIPCMDVVLQQHNIVHGRSQVLQQSTYQLLRELCCQHLWQIPEQSQCQAIHNVVHAIILHQQQ

SEQ ID NO: 178449 - protein, 221 aa, Triticum aestivum
  unsure (1)..(221): unsure at all Xaa locations
  Clone ID: PAT_TA_72867.pep
QGQQLGQGQGGYYPTSQQSEQGHQPGQGKQPGQGQQGYYPTSPQQSGQWQQLGQGQPGYYPTSPQQSGQGQQSGQGQQGYYPTSPQQSXQGQQPGQGQSGYFPTSRQQSGQGQQPGQGQQSGQGQQGQQPGQGQQAFYPTSSQQSRQRQQAGQWQQPGQGQPWYYPTSPQQPGQEQQSGQAQQSRQWQLVYYPTSPQQPGQLQQPAQGQQPAQGQQSTQEQ

SEQ ID NO: 178450 - protein, 179 aa, Triticum aestivum
  Clone ID: PAT_TA_72868.pep
SQPQQPISQQQQQQQQQQQQQQQEQQILQQILQQQLIPCMDVVLQQHNIAHGRSQVLQQSTYQLLQELCCQHLWQIPEQSQCQAIHNVVHAIILHQQQKQQQQPSSQFSFQQPLQQYPLGQGSFRPSQQNPQAQGSVQPQQLPQFEEIRNLALQTLPAMCNVYIPPYCTIAPFGIFGTN

SEQ ID NO: 178451 - protein, 233 aa, Triticum aestivum
  Clone ID: PAT_TA_72869.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQ

SEQ ID NO: 178452 - protein, 227 aa, Triticum aestivum
  Clone ID: PAT_TA_72870.pep
MNTLLVFALLGAAATGAIAHMETICILGLERPWQHLPLPPHQTFAQQPLFSQQQHLFPQQPSFSQQHPPLWHQQPPFSQQQPILPQQPPFSQQQQLVLPQHPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQL

SEQ ID NO: 178453 - protein, 173 aa, Triticum aestivum
  unsure (1)..(173): unsure at all Xaa locations
  Clone ID: PAT_TA_72871.pep
PKGRSLYPGETTPLXLLQQGIFWGTYSQTVQGYYPRVTSTRKGSYYPRQASTQQPGQGQQPGKWQEPGQGQQWYYPTSLHYPGQGQQIGKGHQGYYPTSLQHPRQGQQGYYPSSLQHTGQRQQPLQGQQPKQGQQPGLWQQGYYPTSAQQLRQGQQPIQWQQSGQGQQGHYPT

SEQ ID NO: 178454 - protein, 126 aa, Triticum aestivum
  Clone ID: PAT_TA_72872.pep
CGNSTACGWIFCGIQQAARQDNRSWGIRTIATPFLPSSLANWLRTRRCAAPRCPHATRPRPALPWGSARRRRRRPTGRAPRRSVEAEDGGGGRRSGGLILSDLHVSVCGLPPGGGVWNPSPGMETR

SEQ ID NO: 178455 - protein, 85 aa, Triticum aestivum
  Clone ID: PAT_TA_72873.pep
GVKMELIDPPFPLLKGVVATTDVVEACTGVNVAVMVGGFPRKEGMERNDVMTKNVSIYTAQASALEAHAAPNCKVLVVANPANTN

SEQ ID NO: 178456 - protein, 218 aa, Triticum aestivum
  Clone ID: PAT_TA_72874.pep
CKSGCLHEALTVFSEMSQKGVAPDVVTFTSLIHAMCSAGNLERAVALVGQMKERGLRMNEIAFTALIDGFCKNGFLDDALLALKEMRECRIKPSVVCYNALINGYCKLGRMEEAGQLVDEMEAKGVKPDVVTYSTILSGYCKIGDTDSAFELNRKMVKKGVVPDAITYSSLIRGLCEEKKLGDACELFEKMLQLGLQPDEFTYTTLIDGHCKEGDVDK

SEQ ID NO: 178457 - protein, 70 aa, Triticum aestivum
  unsure (1)..(70): unsure at all Xaa locations
  Clone ID: PAT_TA_72875.pep
WPCRPCSSPPRPPMPSPRPRPPPLLPSRIARGGXXDGGLPLPRLGGRCRGEGEGEAGDRQWGGRRGGGRR

SEQ ID NO: 178458 - protein, 233 aa, Triticum aestivum
  unsure (1)..(233): unsure at all Xaa locations
  Clone ID: PAT_TA_72876.pep
QPFPSQQPYLQLQPVPQPQLPYPQPQLPYPQPQPFRPQQPYPQPQPQYSQPQQPISQQQQQQQQQQQQKQQQQQQQQILQQILQQQLIPCRDVVLQQHSIAYGSSQVLQQSTYQLVQQLCCQQLWQIPEQSRCQAIHNVVHAIILHQQQQQQQQQQQPLSQVSFQQPQQQXPSGQGSFQPSQQNPQAQGSVQPQQLPQFEEIRNLALETLPAMCNVYIPPYCTIAPVGIFGTN

SEQ ID NO: 178459 - protein, 69 aa, Triticum aestivum
  Clone ID: PAT_TA_72877.pep
AWIGASGEWLALGVLSTDGSCGGGWSWPRRGVVADPDPLPGSTPGRFPDRTRRRESRWLRMPRASPDPG

SEQ ID NO: 178460 - protein, 73 aa, Triticum aestivum
  Clone ID: PAT_TA_72878.pep
MDVRDGGAPQLVARGRTAGAPNLPGAYSTEAGVPGIQAGGLPTGHPTYLFCWLETGVASDISTLITVRTRSIL

SEQ ID NO: 178461 - protein, 193 aa, Triticum aestivum
  Clone ID: PAT_TA_72879.pep
NCSFEGKVRAAQRAGFDAALVHDDEDKASLYSMVGDPEGIHIPAVFVSKMAGETLKKFARGEDGECCINSSMDETAGTVLVMSFVSLVVIISVVASFLFARNCRLLRHGVDNRPPYIKKHVVEKLPSVVYKAPCSSGNNCEEACAICLEDYDNGDMLRLLPCKHEFHVECIDPWLTKWGTFCPVCKLEVLTGE

SEQ ID NO: 178462 - protein, 88 aa, Triticum aestivum
  Clone ID: PAT_TA_72880.pep
YIGVSHNRARETKRRWRWPSTRHRRRRPSRRRRRRSWNGRNFLSPSPRRSSTWIQIGMGGIEVVWCWWTAAAIIPPPTCSCTCSSLQR

SEQ ID NO: 178463 - protein, 149 aa, Triticum aestivum
  unsure (1)..(149): unsure at all Xaa locations
  Clone ID: PAT_TA_72881.pep
MKTFLFLALLAIVGTTATTAVIVPVPQLQPQNPSEHQPHEQATLVQQQQFLGQKQPFSPQQPYPLPQPFSSHQPYLQLQPFMHPQLPFSQTQPFXPQQPYAQPQPQYSQPQQPISQPPPPPPPPPQPPPPPPQPIIQHILQQQLIPCVD

SEQ ID NO: 178464 - protein, 77 aa, Triticum aestivum
  Clone ID: PAT_TA_72882.pep
DVHFYVGLLYFFSNPVGPVSFVLYVMDPKPAFWTSIGQYCILRLQFHESTELGIESHPIELKLAFISETRTYSSLLK

SEQ ID NO: 178465 - protein, 223 aa, Triticum aestivum
  unsure (1)..(223): unsure at all Xaa locations
  Clone ID: PAT_TA_72883.pep
KHVAQPQQTFPHQPERQVPQPQQPQQPFLQPQQPFPQQPQQPFPQTQQPXQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSL

SEQ ID NO: 178466 - protein, 219 aa, Triticum aestivum
  Clone ID: PAT_TA_72884.pep
QQPAQGQQGQQPGQGQQGQQPGQGQQGQQPGQGQQPGQGQPWYYPTSPQESGQGQQPGQWQQPGQGQPGYYLTSPLQLGQGQQGYYPTSLQQPGQGQQPGQWQQSGQGQHWYYPTSPQLSGQGQRPGQWLQPGQGQQGYYPTSPQQPGQGQQLGQWLQPGQGQQGYYPTSLQQTGQGQQSGQGQQGYYSSYHVSVEHQAASLKVAKAQQLAAQLPAMCR

SEQ ID NO: 178467 - protein, 129 aa, Triticum aestivum
  Clone ID: PAT_TA_72885.pep
EKGIQEKISKGNRPALSALSELLSSTKGFYTGIEELHLLEEIIKKGCDFKSSLVQILHDVDSCNGNDLSVMCKPLLVALKATSAAGLYDQQINRNIELVLNRYIWKKRIHKILYGGKKASIQHVIRLDK

SEQ ID NO: 178468 - protein, 93 aa, Triticum aestivum
  unsure (1)..(93): unsure at all Xaa locations
  Clone ID: PAT_TA_72886.pep
FLGRKLIFGPDVKALITTRWLIGIPMIIFAGGVSSPLXHGYQNQIGGWVASVSIIFTAYILVLLLLTSGRDPGIVPRNSHPPEPEDIGESSNL

SEQ ID NO: 178469 - protein, 203 aa, Triticum aestivum
  Clone ID: PAT_TA_72887.pep
MKTFLILSLLAIVATTVTSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQILQQILQQQLIPCRDVVLQQHNIAHACSHVLQHSIYQQVQQLCCQQLSQIPEQSRCQAIHNVVHAITLHHHQQQQQQPSS

SEQ ID NO: 178470 - protein, 155 aa, Triticum aestivum
  Clone ID: PAT_TA_72888.pep
PLFPAPSHETLAAARAATAALPAPPRLDATAHSSFHLLAGAQPLQLSFPPRARNPSSAGGAAERSQRPRRRIHGKSTSRPGGATSGGQVESAFATGWRIDGRRPGLGDFDSGSSPPSLLHPTHAPRWCADPRPRRLDDGLWFRGCRRATPLPDLL

SEQ ID NO: 178471 - protein, 191 aa, Triticum aestivum
  Clone ID: PAT_TA_72889.pep
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGEN

SEQ ID NO: 178472 - protein, 157 aa, Triticum aestivum
  Clone ID: PAT_TA_72890.pep
MLSIGHGDFPCDGLTGEESSLASTKTIDHVDLLREQLKILSGEVALHTSVLKRLTEEAGRNPNSEKIQMKMKKISDEIKAKQQQISSLEKQMPHSLSNSQVKVDKLDLSPSYGELLEQLNEKSFELEVKVSDNRVIQEQLQEKTTECMELQEAVACL

SEQ ID NO: 178473 - protein, 215 aa, Triticum aestivum
  Clone ID: PAT_TA_72891.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMR

SEQ ID NO: 178474 - protein, 88 aa, Triticum aestivum
  Clone ID: PAT_TA_72892.pep
VGQDVDPVSAADVLLDGAVGGVGVPFREQRRRRLRRRRRRGEGGRGPGAGEPRLHLGPTPPGRSRDGRKCGLFTCCCYYEPLKKLLFF

SEQ ID NO: 178475 - protein, 214 aa, Triticum aestivum; identical to SEQ ID NO: 177527
  Clone ID: PAT_TA_72893.pep

SEQ ID NO: 178476 - protein, 218 aa, Triticum aestivum
  Clone ID: PAT_TA_72894.pep
RRVLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPHIPQQSRYEAIRAIIYSIILQEQQQVQGSIQS

SEQ ID NO: 178477 - protein, 82 aa, Triticum aestivum
  Clone ID: PAT_TA_72895.pep
PFFVLTITLICCLSMVIIVLLTYQMFAITALQVLFEEQEFIKLAVKQGFTEAVQEMEQRSTCQTPLQKGVFDTAIVGLKRDL

SEQ ID NO: 178478 - protein, 214 aa, Triticum aestivum
  unsure (1)..(214): unsure at all Xaa locations
  Clone ID: PAT_TA_72896.pep
MRTFLILALLAIVATTATNALTVPAPQLQPQNPSQQQPQKQVPLVQQQQFLGLQQPFPPQHPYPQPQPFPXQQPYLQLQPFWQPQLPYSQPQPFRPQQPYPQPQPQYSQPQQPISQQQQQQQQQQQQQQQQQQEQQILQQILQQQLIPCMDVVLQQHNIARGRSQVLQQSTYQLLQELCCQHLWQIHEKLQCQAIHNVVHAIILHQQQKQQQQL

SEQ ID NO: 178479 - protein, 78 aa, Triticum aestivum
  Clone ID: PAT_TA_72897.pep
AGTTTMMPAHPGSSATFPCWRPTLPASPGISVAAQGVASPPRSPSSAAAPPPRLGARAVGNQTKRSRGTTTVRRDAKE

SEQ ID NO: 178480 - protein, 212 aa, Triticum aestivum
  Clone ID: PAT_TA_72898.pep
MSTFMILALLAIVATTATTAVRVPVPQLQPQNPSQRQPQQQVPLVQQQQFLGQQQPFPPQQPYPQPQPFPSQQPYLQLQPFPQPQLPYSQPQPFRPQQPYPQPQPQYSQPQQPISQQQQQQQQQQQQQQQEQQILQQILQQQLIPCMDVVLQQHNIAHGRSQVLQQSTYQLLQELCCQHLWQIPEQSQCQAIHNVVHAIILHQQQKQQQQPS

SEQ ID NO: 178481 - protein, 99 aa, Triticum aestivum
  Clone ID: PAT_TA_72899.pep
PVIFSLCLPIFFIRLPIVVAALLTSNFSYVAHPQQQFRNDQNQIQYRHLVSELYTKCESSGPCPRKALVYLSSGCPFSAAASFLRTLYIKPRGQQALPN

SEQ ID NO: 178482 - protein, 190 aa, Triticum aestivum
  Clone ID: PAT_TA_72900.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISS

SEQ ID NO: 178483 - protein, 56 aa, Triticum aestivum
  Clone ID: PAT_TA_72901.pep
KFLLLQCLTTFTGSHETNIFSIANSQPRLNLKLNQRSKRRTNIVFTSNRRAFLKDG

SEQ ID NO: 178484 - protein, 136 aa, Triticum aestivum
  Clone ID: PAT_TA_72902.pep
MKTSLILALLAIVATTTTTALRVPVPQLQPQNPSQQQPQELVPLVQQQQFLGQQQLQFPGQQQPFPPQQPYPQPQPFLPQLPYPQPQPFAPQQSYPQPQPQYPKPQQAISQPQAQLQQQQQQQQQQQQRHLRPQQR

SEQ ID NO: 178485 - protein, 102 aa, Triticum aestivum
  Clone ID: PAT_TA_72903.pep
ARRPRTAAARLSVCMAFWAAPWPGLVLMVILSAPLRPVPSIDPWLLYPRCCRSGASAAGGGPGGSSREGRHPLLWTATLLPWVLESSPDPCPDLEGLDLEPT

SEQ ID NO: 178486 - protein, 58 aa, Triticum aestivum
  Clone ID: PAT_TA_72904.pep
PTFLCFHGYFPTAHYKISSTQILQLSWVKTVDPNLLFLSTQRSLQRSRRVSKLNVLTS

SEQ ID NO: 178487 - protein, 220 aa, Triticum aestivum
  Clone ID: PAT_TA_72905.pep
SFGQLRMLTYLSLSHNSFQNSIPYSFRNLISLGTLDLSSNNFSGTIPKYLTNLTYLTSLNLSFNELQGSIPDEGVFRNITLQSLIGNFGLCGAPCLGFLPCLGNSHPVNNGHLLKFLLPSFALTLAAMAMCLYLLIRRNNLKQGEVTPAADGVDPVSHRLVSYHEVARATENFNEDNLLGVGSFGKVFKGQLDDGLVVAIKVLNMQFEQAVRSFDAECQV

SEQ ID NO: 178488 - protein, 216 aa, Triticum aestivum
  unsure (1)..(216): unsure at all Xaa locations
  Clone ID: PAT_TA_72906.pep
MKTFLILSLLAIVETTATTAVRVLVPQLQPQNPSQQQPQEQVPLVQQQKFLGXQQQFPPQQQDPQPQPFPSQQPYLQLQPFPQPQLPYSQPQPFRPQQPYPQPQPQYSQPQQPISQQQXQQQQQQQQQQQILQQIMQQQLIPCMDVVLQQHNIAHGRSQVLQQSTYQLLQELCCQHLCQIPEQSQCQAIHNVVHAIILHQQQKQQHQPSSKVSFQQ

SEQ ID NO: 178489 - protein, 124 aa, Triticum aestivum
  Clone ID: PAT_TA_72907.pep
SPVSWRSRPNLVELQEDTNGEFRTGRTAGNHLVQRLSENHPDGSQTKGEQQHQRCVHDDKQEESSNTNGVFMMTNKRRAATPMDEQLCCSLSPWPEMAECGHAAAGLHCPSRFWCWPRRVFMVL

SEQ ID NO: 178490 - protein, 205 aa, Triticum aestivum
  Clone ID: PAT_TA_72908.pep
MKTFLILALLAIVATTDTTAVRVPVPQLQPQNPSQQQPQEQVPLVQQQQFLGQQQPFPPQQPYPQPQPFPSQQPYLQLQPFLQPQLPYSQPQPFRPQQPYPQPQPQYSQPQQPISQQQQQQQQQQQQQQQQQQQIIQQILQQQLIPCMDVVLQQHNIVHGKSQVLQQSTYQLLQELCCQHLWQIPEQSQCQAIHNVVHAIILHQQ

SEQ ID NO: 178491 - protein, 85 aa, Triticum aestivum
  Clone ID: PAT_TA_72909.pep
WSSRRQLKGSIRPERRSAGRIWAPTSRTLLIQCKRRPGRGTMAEAAPRPKRGGRWYPGSRYGGGGRRSGRRGSRKLAPAVGVDGR

SEQ ID NO: 178492 - protein, 194 aa, Triticum aestivum
  unsure (1)..(194): unsure at all Xaa locations
  Clone ID: PAT_TA_72910.pep
MKTFLILSLLAIGETTATNAVRVPVPQLQPQNPSHQQPQEQVPLVQQQKFLWQQQQFPPQQPDPQPQPFPSQQPYLQLQPFPQPQLPYSXSQPFRPQQPYPRPQPQYSQPQQPISQQQXQQQQILLQILQQQLIPCMDVVLQQHNIAHGRSQVLQQSTYQLLQELCCQHLWQIPEQSQCQAIHNVAHAIILHQQ

SEQ ID NO: 178493 - protein, 181 aa, Triticum aestivum
  Clone ID: PAT_TA_72911.pep
MKTFLILALLAIVATTTTTAVRVPVPQLQPQNPSQQQPQEQVPLVQQQQFLGQQQQQFPGQQQPFPPQQPYPQPQPFLPQLPYPQPQPFPPQQSYPQPQPQYPQPQQPISQQQAQLQQQQQQQQQQQQPSSQVSYQQPQQQYPSCQGFFQPSQQNPQAQGFVQPQQLPQFEEIRNLALQTL

SEQ ID NO: 178494 - protein, 147 aa, Triticum aestivum
  Clone ID: PAT_TA_72912.pep
PDASCSAPILQSLLACSRAAAANPALAAAELAKVRAAATESGDPAERVAFYFSDALARRLPCGGAASLETASDARLAFDEVTLCYKTLNDACPYSKFAHLTANQAILEATGAATKIHIADFGIVQGIQWAALLQALATRPEGKPSRI

SEQ ID NO: 178495 - protein, 80 aa, Triticum aestivum
  Clone ID: PAT_TA_72913.pep
PSASMTSTSSLKWSHAAGCGLSTATSIILSPPHKVLRYCIKDLSGLGPAPLCILYCWRRRGLNLHASSRSRVWCGEEEKG

SEQ ID NO: 178496 - protein, 205 aa, Triticum aestivum
  unsure (1)..(205): unsure at all Xaa locations
  Clone ID: PAT_TA_72914.pep
MKTLLILTILAMAITIGTGYIKVHPSGQVQWLQQQLVPQLQQTLYHQSQQTFPQPKKTFLHXPKEQVTHSKQSQQPFLQPQQPFPQQPQQPFPQTQQPQQPFAQQPQQPFPQTQQPQQPFAQQPQQPFPQTQQPQQPFPQLQQPQQPFPQPQQQLPQPQQPQQSFPQQQRPFIQPSLQQQLNPCKNILLQQCKPALLVSSLWSII

SEQ ID NO: 178497 - protein, 220 aa, Triticum aestivum
  Clone ID: PAT_TA_72915.pep
LTLSWDPGQHAIDSGAIFCDRGILAICHQQLSVPNAINSLSTCYGIPQFEHLQDVFTVLLQLWRAWFQLLSSSDQRLLFWNGVMCRNCFHPSIIRMTSCQELGLNSSYTSQHLQIAWSFVWEFSSVGSRRIAVSFLFDPAYGLAVVVSSTWCWVLAYCVANTVSLDYSQFDVESALGMCLPTIVPPASFHSSLMPLADANLKCTHVKKANMFQLLNNNDN

SEQ ID NO: 178498 - protein, 60 aa, Triticum aestivum
  Clone ID: PAT_TA_72916.pep
SFSRIIWMAFFLLLLCILISAAIVSYAHHVIRRQRQGCAHGRHEQAALKLPPGSMGLPYI

SEQ ID NO: 178499 - protein, 200 aa, Triticum aestivum
  Clone ID: PAT_TA_72917.pep
AGWPTHGSHIVSSAGQSHPNARHGFLRFGRDIPRHDHAHSTPLLFTGSGYSQSSMYYIHVFSISLNGKRLNGVKTAMFRRDPQTRRGGFVVDPGTPLTRLARAAYDVVEAEVAANMHKQGARRSTVPVQGYRLCFGSWGHAHLPSLTVTLYEDATRLFIKPELLFMRVNHEHLCFAVVPDEEMTVLGAAQQVDTRFTFDL

SEQ ID NO: 178500 - protein, 202 aa, Triticum aestivum
  Clone ID: PAT_TA_72918.pep
MIRYFVAGMPWITLILFNALVVSLTMFFYIKAGWIGNDPLTVVIGPSDPYVSIGGREINHLHAAAVLMTVVMIIAFLTSIAIVRRILIATSTTVLKVAAKVIGEVHALIIFPVVPYFALAIIYMFWFAATLYLFSSGQVLQNDCNAECCSFDLKLGKVNCDSCCGYSVHYTPHIGIAILFHLFGCYWATQFFIACSSTVIAG

SEQ ID NO: 178501 - protein, 179 aa, Triticum aestivum
  Clone ID: PAT_TA_72919.pep
WNEEQRKWEDSLRATLCSVGGSGIVIIVTTRSPRAASIMGTLQTHELAHLSEQHSWELFSKKAFKGNVREQAELMSIGKRIVSKCKGHPLALSAMGGLMCSKGRAWEWEAIAESNIGDSVAGKQEIISILKLSYQHLSSEMKQCFAFCAVFYKNSEMEKSMLIQLWMANGFIQEEGMMD

SEQ ID NO: 178502 - protein, 215 aa, Triticum aestivum
  Clone ID: PAT_TA_72920.pep
LRRQCHARSQPRGDSLAGPAPPPAPVVHKRKPGRPQEKSLPPAATREELESRESLEGPLKVLALPAPGARGAYVVSDDKMVCRARAPTRRASAVSNDKMMDRNEITPVVRRRKPGRPQEKSPPPAAIREELESRESREGPLKVLALPAPGAPRTHAVSGDKMMRRARAPTRHANTVSDDKMVSRARAPTLHANHVSDDKMMDKNEMAPGPGVPRM

SEQ ID NO: 178503 - protein, 151 aa, Triticum aestivum
  Clone ID: PAT_TA_72921.pep
PFVHPSILHQLNGGKVFLQHQCSPVAMPQSLAKSQMLQQSKCHVMQQQCCQQLPQIPQQSRYEAIRAIIYYIVLQEQQQVRGSIQTQQQQPQQLGQCVSQPQQQSQQQLGQQPQQQQLAQGTFLQPHQIAQLEVMTSIALRTLPMMCRVNV

SEQ ID NO: 178504 - protein, 167 aa, Triticum aestivum
  Clone ID: PAT_TA_72922.pep
TLLIVTILEMATTIYTANMHVDPIYQIQLTQQQPFTMSKQPFCHLPQQTIHQHHQTFHHQPQHTYPHQPQQQFPYTHQPQHPFTQPQHIFPQQPQLPFPQQPQQPFPHPQQPQQLFPQSQQPQQPFPQPQHQLLQPQQPQQSFPQQQQPLIQLSLQQQMNPCKNFLL

SEQ ID NO: 178505 - protein, 141 aa, Triticum aestivum
  unsure (1)..(141): unsure at all Xaa locations
  Clone ID: PAT_TA_72923.pep
MKTLLILALLAIVATTTTTAVRVPVPQLQPQNPSQQQPQEQVPLVQQQQFLGQRQQHSSGQQQPFPPQQPYPXPQPFLPQLPYPQPQPFSPQQSYSQPQPQYPQPQPPISQPQAQLPQQQQQQQQQILQQILQQQLIPCMD

SEQ ID NO: 178506 - protein, 146 aa, Triticum aestivum
  Clone ID: PAT_TA_72924.pep
TGLQSFTGQCRHHHRQGPRYTNMVLEEWEAVFRQAQVEQAYNLRLLDEHRCTDELPVPGAAIMPDVDMGEQEALLDSYRAARDIRRDYWLYRQADLKAAYKGIDEVADEVYGPDDGNEVAGGSVAAAWRNNDEAGMFAGAVDSEAD

SEQ ID NO: 178507 - protein, 199 aa, Triticum aestivum; identical to SEQ ID NO: 178440
  Clone ID: PAT_TA_72925.pep

SEQ ID NO: 178508 - protein, 194 aa, Triticum aestivum
  Clone ID: PAT_TA_72926.pep
QQPQQPYPQPQPQDSQPQQPISQQQQQQQQQQQQQQQQQQQIIQQILQQQLIPCMDVVLQQHNIVHGKSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFQEIRNLALQTLPAMCNVYIPPYCTIAPFGIFGTN

SEQ ID NO: 178509 - protein, 119 aa, Triticum aestivum
  unsure (1)..(119): unsure at all Xaa locations
  Clone ID: PAT_TA_72927.pep
MQPGQGQQPGQGQPGYYPTSPQQSGQGQPRYYLTSPQQSGQGQQSAQLQQSAQGQXGQQPGQCLQPGLGHQGQQPLQGQQGYQPAQGQSGYYPPSMXQSRQGQQPRQWQQPRQRQPVFY

SEQ ID NO: 178510 - protein, 58 aa, Triticum aestivum
  Clone ID: PAT_TA_72928.pep
QLLIIILARGAWTTSYPLTKKRANPAVPLPAYYRLIDFLVHISVNKRISMIYVLTQCI

SEQ ID NO: 178511 - protein, 72 aa, Triticum aestivum
  Clone ID: PAT_TA_72929.pep
VDYTYFCLALFLSKIEQGVCSVQTINKIEYPHAVNIPQFFFSMDKTHLRLVSFPVHYISIELCAVFSLMSLI

SEQ ID NO: 178512 - protein, 164 aa, Triticum aestivum
  Clone ID: PAT_TA_72930.pep
RATGKEEFLRYTVGKADCFGGVGWAMTEFSWDVKYAGLQVLASKLLLDGDPQGERHRVVLEQYKAKAEHYLCACLRLNNGSNVDRSPGGMLYVRQWNNLQYASNAAFLLTVYSHYLAGAGARLRCPDAPAVPPYELLALTRSQADYILGRNPLRLSYMVGYGPR

SEQ ID NO: 178513 - protein, 88 aa, Triticum aestivum
  Clone ID: PAT_TA_72931.pep
GGDRTRGKTLIMLALLAIMDNSGADHAQIPNPLCHELHACLRCRLDQTYYQFKQQFLGHQQPFPPQQPYPQLQPFPSQQPYLNLQPFA

SEQ ID NO: 178514 - protein, 213 aa, Triticum aestivum
  Clone ID: PAT_TA_72932.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCCQQLFQIPEQSRCQAIHNVVHAIILHHHQQQQQQPSSQVSYQQ

SEQ ID NO: 178515 - protein, 93 aa, Triticum aestivum
  Clone ID: PAT_TA_72933.pep
KQIASVVLPPPHVATGRVACCHPCDRLAAPPSPKPPPPHVLPPPPSIPLASGYDRFFSSELAPPPCHLPHPDPKIDGGVPCQRASSSPPASFF

SEQ ID NO: 178516 - protein, 67 aa, Triticum aestivum
  Clone ID: PAT_TA_72934.pep
MLVYQDKLSGDELLSDSFPYRELENGVLWEVDGHWVVQGAVDVDIAANPSAEGGGHDHAFPYHHLYM

SEQ ID NO: 178517 - protein, 207 aa, Triticum aestivum
  Clone ID: PAT_TA_72935.pep
LPPLSHQQPPFSQQQQPVLPQQPPFSQQQQPILPQQPPFSQQQQQPVLPQQQIPFVHPSILQQLNPCKVFLQQQCSPVAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRTLPTMCRVNVPLY

SEQ ID NO: 178518 - protein, 228 aa, Triticum aestivum
  unsure (1)..(228): unsure at all Xaa locations
  Clone ID: PAT_TA_72936.pep
QQLFPQPQQPQQQXPQPQQPQQPFPQQPQQQFPRPQQPQQPFPQPQQPQLPFPQQPQQPFPQPQQPQQPFSQLQQPQQPLPQPQQSQQPFSQQQQSLIQPYLQQQMNPCKNYLLQQCNPVSLVSSLVSMILPRSDCQVMRQQCCQQLAQIPQQLQCAAIHGVVHSIIMQQEQQQQQGIQIMRPLFQLIQGQGIIQPQQPAQLEVIRSLVLGTLPTMCNVFVPPECSTT

SEQ ID NO: 178519 - protein, 114 aa, Triticum aestivum
  Clone ID: PAT_TA_72937.pep
TIFFCDCYIRIKLTHPMLDCILACLSSTSLMSFLEINSFVSSIAFCHMNMTSCHILACQIYRVSSSLAMFLILFLLILMLVCVLLVKICSPFFLNMCMPLTDVIVSNLYLLYPL

SEQ ID NO: 178520 - protein, 191 aa, Triticum aestivum
  Clone ID: PAT_TA_72938.pep
KLQALVRGNIVRRGAAETLRCMQALVSVQSRARASRATRSRQAAAHPGATTPEKYEQAAYEGSLRHGRSGSLKGGSSKTPGGERMSRERSESCGRNWLDRWVEERYMDDEKNAKILEVDPGKPGRHASKRRSSGGGGHHQSSCSTRTSEQNSRSYATMPDSPSRDSTTAQQSVPSPSSVGMVMGAAEALSP

SEQ ID NO: 178521 - protein, 210 aa, Triticum aestivum
  unsure (1)..(210): unsure at all Xaa locations
  Clone ID: PAT_TA_72939.pep
GQQGHYLASQQHPXGGQQGHYPASQQQPGQGQQGHYPSSQQQPGQGQQGHYPASHHEPRQRQQGQIPASQQQPGQGQQGHYPASLQQPGQGQQGHYPTSLQQLGQGQQTGQPGQKQQPXQGQQTGQGQQPQQEQQPGQGQQGYYATSLQQPGHGQQQGQWQQGYYPTSLQQPGQGQQGHYPASLQQPGQGQPGQRQQPGQGQHPEQGKQP

SEQ ID NO: 178522 - protein, 100 aa, Triticum aestivum
  unsure (1)..(100): unsure at all Xaa locations
  Clone ID: PAT_TA_72940.pep
MCGGAILFEVIPPPRRASGGIVWRADKMRRARPDAAAGRPRRVPEDEFLXEEGDAEFQADFQGFVEADEDSHCDDNPFLVRMTGFCGDGLNATVADDDDC

SEQ ID NO: 178523 - protein, 91 aa, Triticum aestivum
  Clone ID: PAT_TA_72941.pep
ATKDRSSVGRTDRGGSRVRPADGRVPPRPGRLSPPLGGWGGLVLGGPVEGLDLPAGAWEGERDGAANAEREGAGLHSWWRVLMKPATARSV

SEQ ID NO: 178524 - protein, 121 aa, Triticum aestivum
  Clone ID: PAT_TA_72942.pep
RWCRWAVRVFASQGRGASNRGAPCRATEEKRHMLATSSTDRTARIWDLRRLKRKKDQSLKVLKHNRSVQSAYFSPRGSMLPTTSLDDTDRVFCGDDCDRSNIIMHNNHTGRWISTFKAIWG

SEQ ID NO: 178525 - protein, 209 aa, Triticum aestivum
  unsure (1)..(209): unsure at all Xaa locations
  Clone ID: PAT_TA_72943.pep
MKTLLILTIIAVALTTTTANIQVDPSGQLQWPQQQQPFSQPQQPFSQQPQQIFPQPQQTFPHQPQQAFPQPQHTFPHQPQQQFPQPHQPQQQFPQPQQPQQPFPQQPQQQFPRPQQPQQPFPQPQQPQLPFPQQPQQPFPQPQQPQQPFSQLQQPQQPLPQPQQSQQPFSQQQQXLIQPYLQQQMNPCKNYLLQQCNPVSLVSSLVSMI

SEQ ID NO: 178526 - protein, 80 aa, Triticum aestivum
  Clone ID: PAT_TA_72944.pep
QIREIEIGTTIIMCTPTDQVDNPRLEGPWGRCLGNRTAVGMGMVSRKWGREGSSPRSGSRPLRRRQRWGIKRVNVAVVAI

SEQ ID NO: 178527 - protein, 65 aa, Triticum aestivum
  Clone ID: PAT_TA_72945.pep
CISVRMSERRPFRRTTEPATPAPTSMTTRVRPKPACATIAMAARRRASEVHAGGGGGGGGKHGLG

SEQ ID NO: 178528 - protein, 71 aa, Triticum aestivum
  Clone ID: PAT_TA_72946.pep
MGKINIGINGSGRIGRLVTSVALQSDNVELVADNDPFITTEYMTYMFKYDTVHGHWKHSDVNLNDDKTLLF

SEQ ID NO: 178529 - protein, 174 aa, Triticum aestivum
  Clone ID: PAT_TA_72947.pep
MKTLLIVTILAMATTIATANMQVDPGYQVQWPQQQPFPQPQQPYLQLQPFSQPQLPYSQPQPFRPQQPYPQPQPQYSQPQQPISQQQQQQQQQQQQQQQQQQEQQILQQILQQQLIPCMDVVLQQHNIARGRSQVLQQSTYQLLQELCCQHLWQIPDKLQCQAIHNVAHAIILH

SEQ ID NO: 178530 - protein, 214 aa, Triticum aestivum
  Clone ID: PAT_TA_72948.pep
HHLSQASCGRDKSIVKTFLILVLLAIVATTVTTGFRYAVPQLQPQNPSQQQPQEQVPLVQQQQFLGQQQPFPPQQPYPQPQPFPSQLPYLQLQPFPQPQLPYSQPQPFRPQQPYPQPQPQYSQPQQPISQQQQQQQQQQQQQQQQQQILQQILQQQLIPCMDVVLQQHNIAHGRSQVLQQSTYQLLQELCCQHLWQIPEQSQCQAIHNVVHAII

SEQ ID NO: 178531 - protein, 120 aa, Triticum aestivum
  Clone ID: PAT_TA_72949.pep
MLVYQDKLSGDELLSDSFPYRELENGVLWEVDGHWVVQGAVDVDIGANPSAEGGGDDEGVYDHTEKVVDIVDTFRLEEQPAFDKNQFISHMNRYIKNLSAKLEGDDLDVVKNNVESATKY

SEQ ID NO: 178532 - protein, 109 aa, Triticum aestivum
  unsure (1)..(109): unsure at all Xaa locations
  Clone ID: PAT_TA_72950.pep
LHALASGDDARHSLVDEMTKRTKKAGIVGKYGTRYGASLRKQIKKMEVSQHSKYFCEFCGKFAVKRKAVGIWGCKDCGKXKAGGAYTMNTASAVTVRSTIRRLREQTEA

SEQ ID NO: 178533 - protein, 74 aa, Triticum aestivum
  Clone ID: PAT_TA_72951.pep
TKARWRKKMTITFVTFLFRFNQVQQAFSCMEWLHRCYPRRNVKMSLNEMIPSTNLVLCSITTSRRTPDDKTLVP

SEQ ID NO: 178534 - protein, 154 aa, Triticum aestivum
  Clone ID: PAT_TA_72952.pep
MADVDVEAEVAAAGQPKKRTFRKYSYRGVDLDALLDMSTDDLVQLFPARARRRFQRGLKRKPMALIKRLRTAKKEAPAGEKPEPVRTHLRNMIIVPEMIGSVIGVYNGKTFNQVEIKPEMIGHYLAEFSISYKPVKHGRPGIGATHSSRFIPLK

SEQ ID NO: 178535 - protein, 75 aa, Triticum aestivum
  Clone ID: PAT_TA_72953.pep
HISLHRCYIPGKMFVLSVHLYENLLSGSHMVESQYVKYSLIKYSLISMTSHVSGMNIYEVDYLPGRQLESMFAIS

SEQ ID NO: 178536 - protein, 109 aa, Triticum aestivum
  Clone ID: PAT_TA_72954.pep
ADASYLVSEKEDSMTMNTRQRDASNSAPQEMSTLMKNVLETESKDLPICRWASTVIPKPAAPPVATSTAHTTSAQMRSTVPASPPPIIFLPPATLIATNKAATRFRRTR

SEQ ID NO: 178537 - protein, 123 aa, Triticum aestivum
  unsure (1)..(123): unsure at all Xaa locations
  Clone ID: PAT_TA_72955.pep
ARGDLQGARLSSSPRYFPKEPDGFSSSSPFSPFPSLPPQLGVRASSPDSLFSLPISQRELNLPTTVDAHLLPVRRVPDEADWIPRRHHRVAADTCSENLNASTGXQVIGXVFWGVRKRNRWND

SEQ ID NO: 178538 - protein, 167 aa, Triticum aestivum
  unsure (1)..(167): unsure at all Xaa locations
  Clone ID: PAT_TA_72956.pep
MAEMTRVGSGGEPPEVGVSMESDPLVGGDAPSRPRWEASRWASVEAALNRMSKWLVSGSFAFAAIWKHDAEXMWVLLGXVGNSLLSLVLKKMLNHERPAPALRSDPXMPSSHAQSIFYATTILALSLYYWLGTNYLTMILGPATLLVAAYLSWLRVSQRLHTLNQVT

SEQ ID NO: 178539 - protein, 183 aa, Triticum aestivum
  unsure (1)..(183): unsure at all Xaa locations
  Clone ID: PAT_TA_72957.pep
GQALLELGAADVNHPAGPAGKTPLHVAAEMVCPDMVAVLLDHHADPNVRTVDGVTPLDILRTLTSDFLFKGAVPGLTHIEPNKLRLCLELVQSAAMVMSREDAAGNAPVPMYSDHHPGAGGXGGVYSSSGGASTSMNLSLDTRMVYXNLGMDVMNHGDGGGDDGGSRSGQGGPSSLFSPHGFP

SEQ ID NO: 178540 - protein, 79 aa, Triticum aestivum
  Clone ID: PAT_TA_72958.pep
MHFSRDELIGSTFIAFGITLFACFFYVAIASKLLPPYENQFLAAIQDDWYYCLLVPLTLPVIIVAVYLHWLSMKMFKHA

SEQ ID NO: 178541 - protein, 70 aa, Triticum aestivum
  Clone ID: PAT_TA_72959.pep
RHEAGSKSWMPKFIVKPKSASADPHKKQKIESMAVQDNGKGLDDEQKGESAKQTNVLQSLCQNYDSDDSE

SEQ ID NO: 178542 - protein, 89 aa, Triticum aestivum
  unsure (1)..(89): unsure at all Xaa locations
  Clone ID: PAT_TA_72960.pep
TSTPTHSTSAGPPTSRRATTPESTEEPPSCTPPRRPNTDEPEPARSGIPPSQHHQESPKESTPSTRXEDAPTXAGXGAAPPPPLLAGEE

SEQ ID NO: 178543 - protein, 189 aa, Triticum aestivum
  Clone ID: PAT_TA_72961.pep
MAAMLAPAALPPRGLQSKAVGNAESQLLLHGKGCIVADAIIFAAKSNERRRKSQSISQGPTFISEEASSSGSGENPTTSLEVNANDVTTDEKFTVAPRNAVLQACTLTSSLLLAGGLVLREASHFASLNGWPVADPMNLSFNFETWHLELIAGLVIIISSSRYILLQTWPDFRYSSETANRQILTSLET

SEQ ID NO: 178544 - protein, 199 aa, Triticum aestivum
  unsure (1)..(199): unsure at all Xaa locations
  Clone ID: PAT_TA_72962.pep
MAARVLGALLAAALALALALAAPARASNDEGDALYALRQRLSDPNGVLQSWDPTLVNPCTWFHVTCDQASRVVRLDLGNSNVSGSIGPELGRLVNLKYLELYRNNLXGEIPKELGNLKNLISXLDLYANKLTGGIPKSLSKLNSLRFMRLNNXKLTGSIPKEFAKLSNLKVIDLSNNDLCGTIPXVDGPFSTFPLRSFE

SEQ ID NO: 178545 - protein, 187 aa, Triticum aestivum
  unsure (1)..(187): unsure at all Xaa locations
  Clone ID: PAT_TA_72963.pep
RQLSLEEYQLVRDCLCGQMYDSSPVDFVSDLGTRFLLHPSVLKMSQPPRILSWMTRGIASGLDTLFIGKFEAQRAEYWDTLYSSVHVGPILIFCSEDDELAPCSIVQKFGRRLXSLVGDVNLVKWQNSPHVGHYKHHPEEYRAAVTELLTKASMLYMSRRQLNSYDLGTSEHSDMLASDVHKAGTNS

SEQ ID NO: 178546 - protein, 110 aa, Triticum aestivum
  Clone ID: PAT_TA_72964.pep
FGTRGVRLLAVVAGGGVDQASAGDAPPPHHRQPRRAQPARGRQLASTRGGHSTRRQACSGSEDSSVRLHRSASCRPYPYLYVGYLGMDECVAARNRRRGMSRVILFCRHG

SEQ ID NO: 178547 - protein, 73 aa, Triticum aestivum
  Clone ID: PAT_TA_72965.pep
QEETGEGGTTATPNFLQYTTDNCPETPIITPSASSSEKISSASTGQIKEFTTPKGCNAPSRRQHQCSKQGVAG

SEQ ID NO: 178548 - protein, 162 aa, Triticum aestivum
  unsure (1)..(162): unsure at all Xaa locations
  Clone ID: PAT_TA_72966.pep
RHEGNFRFENMMFYEGAATTRITPXSSSSGPPASPFPAPTTNKNLQXMKPWVIAVSAAPPLAVVALCFIFYCRWRSRRYIKGRPRLRRKPWDNKLRGGDEPDWEMEADLSEFSVFDFHQILEATGNFSEEINLGKGGGFGPVYKGSICNTESYWELHLAFFH

SEQ ID NO: 178549 - protein, 63 aa, Triticum aestivum
  Clone ID: PAT_TA_72967.pep
HKNICIRSWYKCNVTRQTSSVQCPGTPPPCPASLRPWRELGGVDPGVVGDGVIEVSSRFLSPS

SEQ ID NO: 178550 - protein, 135 aa, Triticum aestivum
  Clone ID: PAT_TA_72968.pep
GTRDRERAARMLPQLKRVNDWLGEIGTRGEAPPPPPPAQDGDEEAAAAAASANGCGVPEETIERLRKKIYEFLLTNVDSAAAVLGGAAAPPAPAPAAGRSRGPVRRQRIDGDCEAQLGLVAALDLFGPRRMVLVC

SEQ ID NO: 178551 - protein, 181 aa, Triticum aestivum
  Clone ID: PAT_TA_72969.pep
YVESMKTEYLNAQRRIGNGSDPFLEANRREAAKQEAAARRVHPTLHLPTPAQPMAQIAAPATTTSQPQQSSFPSAATSSSALSTFSTPASAPSSSSLFATPTTPAPSGNLFGASGSAQLTTPFGTASTPTLTSTPAPGFGTSTTSLGGTSLFSTPFGGGATASGSSFGGATKGRSKPRSRR

SEQ ID NO: 178552 - protein, 145 aa, Triticum aestivum
  unsure (1)..(145): unsure at all Xaa locations
  Clone ID: PAT_TA_72970.pep
QKWADVDAPDLMSTLAERWKNSTQXRDGLVVVRVVHRLQVGAVAARRPLGRHGVLAHPAPGHGGEGDLGRPRREGEQAHQHLPEPVHDPGRPPWCRSPAVAVVRLAAVVVVVRRRPRRHFLPVARAPRLLPRHYSFLDAKQLLLL

SEQ ID NO: 178553 - protein, 52 aa, Triticum aestivum
  Clone ID: PAT_TA_72971.pep
VVIRCPVFRILTELMCFHDHLYCWLIVNLRTAWMCALYCIMLCSFCKKKKKK

SEQ ID NO: 178554 - protein, 172 aa, Triticum aestivum
  unsure (1)..(172): unsure at all Xaa locations
  Clone ID: PAT_TA_72972.pep
RHEAISGRTGKSTLTGTEIGVDVDSAQKVWLALQALGNIAFAYSYSMILIEIQDTVKSPPAENKTMKKATLMGVTTTTAFYMLAGCLGYSAFGNAAPGNILTGFGFYEPYWLIDFANVCIVVHLVGAYQVFSQPIFAXLETAAAKLWPNAKFVTREHPLVAGRFNVNMLRLT

SEQ ID NO: 178555 - protein, 116 aa, Triticum aestivum
  Clone ID: PAT_TA_72973.pep
MGGMPMRDAAASQPVPIGALATALANAAPDQQRMMLGENLYPLVDQLEHEQAAKVTGMLLEMDQTEVLHLLESPEALKAKVAEAMEVLRTAQQIQTNATPEQQLASLSLNDGVVSS

SEQ ID NO: 178556 - protein, 44 aa, Triticum aestivum
  Clone ID: PAT_TA_72974.pep
SARGMTSASSWHLIYFCHTLQLTKDISQQAQKSIVKECSSHLLV

SEQ ID NO: 178557 - protein, 39 aa, Triticum aestivum
  Clone ID: PAT_TA_72975.pep
IRPRREREREREREREREREREREREREREREREASCSC

SEQ ID NO: 178558 - protein, 159 aa, Triticum aestivum
  Clone ID: PAT_TA_72976.pep
RHEVTFKVMTTFMAPPPAATFLAFHPQDNNIIAIGMEDSTIQIYNVRIDDVKSKLKGHQKKITGLAFSQSMNVLVSSGADAQLCVGVLMGWEKKKSRYIQPPANRPGTLVGDTRVQFHNDQTHLLVVHESQLAIYDGNLECLRSWSPRDALPAPISSAI

SEQ ID NO: 178559 - protein, 87 aa, Triticum aestivum
  Clone ID: PAT_TA_72977.pep
IRTRPPPAPELAASVHPPVGPLPSSSSLPCCCCLTCFNHHLFIMFFFLDTDYGERLLDWSLNVWILCCVSPAPVWDWLLDRGAARAR

SEQ ID NO: 178560 - protein, 92 aa, Triticum aestivum
  Clone ID: PAT_TA_72978.pep
QLHELHYCMALRININPTNSLMLQEMGSIKEYNQWTFSGIQESPHVKVAFISSSKCIKFEKSQIQTKLISRSAHKKFKNENRKIRIKPEDFF

SEQ ID NO: 178561 - protein, 50 aa, Triticum aestivum
  Clone ID: PAT_TA_72979.pep
DSDEARMLTVKREREIEQGINKRLSRKLDRKWKQSIVVRPPPSLRENKEA

SEQ ID NO: 178562 - protein, 173 aa, Triticum aestivum
  Clone ID: PAT_TA_72980.pep
AKCSPKKKNKKQSAKREKRVSDKPIHTSEIPPEDIVPQNNSHVHEGNFEKPAGGTSNGLSPSKDSKQKRVQNEESKKQPLKRMKRGAEEASNPLGIPPENCDTETQPSMQDTNIEQQTVDTRVPRSPNKGKLQKEGQRRKKRKEVNRRKSLTAFESCVAIWRETQHKNTVQAI

SEQ ID NO: 178563 - protein, 151 aa, Triticum aestivum
  Clone ID: PAT_TA_72981.pep
MARKCSSCGNNGHNSRTCTGQRRLQESGGGGAGGVRLFGVQLHVGGAPLKKCFSMECLSSPSPSPSPAYYAAVAAAASNSSPTVSSSSSLVSVEEAGEKMANGYLSDGLMARAQERKKGVPWTEEEHRKFLVGLEKLGKGDWRGISRHFVT

SEQ ID NO: 178564 - protein, 123 aa, Triticum aestivum
  Clone ID: PAT_TA_72982.pep
SYRRKGPSRFTAGEGGGGEKGPREADLRQEVGMKRRGRRERGRRNTLLPSNGSWANGTSLLVPLLLLDMFLEARGEVCTYTGTACSGGSQSIRFGTLRWTSPQPPSRRRARGAGLNTTQPRAE

SEQ ID NO: 178565 - protein, 74 aa, Triticum aestivum
  Clone ID: PAT_TA_72983.pep
RHEGDLSRGQYVEEILRRTPQRRVGEPEEISSLVAFLCMPCASYITGQTIAVDGGMTVNGLYPSSSPSGLSYSN

SEQ ID NO: 178566 - protein, 46 aa, Triticum aestivum
  Clone ID: PAT_TA_72984.pep
PLLKMQREHIRLTHHHTKIWQINSVLTSTPYNNVSSEFITPKLGEL

SEQ ID NO: 178567 - protein, 172 aa, Triticum aestivum
  Clone ID: PAT_TA_72985.pep
SARGEDEPGDANAEVSPEMLRRIKRAKRVSQISEKVATGILSGVVKVTGYFTSSLANSKAGKKFFNMLPGEIVLASLDGFGKICDAVEVAGKNVLSTSSTVTTGLVSHKYGDKAAAATNEGLDAAGHAIGTAWAVFKIRQALNPKSVLKPTTLAKSTIKANVAELRTKHGSK

SEQ ID NO: 178568 - protein, 53 aa, Triticum aestivum
  Clone ID: PAT_TA_72986.pep
SSRTVQAIYKTISSYRYNQSSQASLTTTHLTNQVIRHGVLAHGATTYKGASCR

SEQ ID NO: 178569 - protein, 50 aa, Triticum aestivum
  Clone ID: PAT_TA_72987.pep
LYTVELYYFLNQIYVKWLPKVSYRMLLLLHYVFMNAYKLFNCNLPVFQQH

SEQ ID NO: 178570 - protein, 171 aa, Triticum aestivum
  Clone ID: PAT_TA_72988.pep
RHEARLKDMRRFEEEKKILPTFMAEGYDPSPSTWCLHEAWADQGGLLRTVPTLPIHVMREGSRDCEEAEEESNRNLLEQARLLEEEDEDLCDTEEAKIAFRAFKVKFAALYRSLAGTKPVFIYDPPSDTIEEHLTAKEMERQADISGWPVCSQAQHFATLAFGVVQLYQEN

SEQ ID NO: 178571 - protein, 119 aa, Triticum aestivum
  Clone ID: PAT_TA_72989.pep
IRTRERERERERERERERERERERERPDKNTTDTSVVQPDGDKSYHLTFQQKLKFLMSPKKPWIYLISGLVGFILIAFIIFGFSRFFVDSEEQEEYNMSANVEKGRDNSKNSDTAVRFL

SEQ ID NO: 178572 - protein, 180 aa, Triticum aestivum
  unsure (1)..(180): unsure at all Xaa locations
  Clone ID: PAT_TA_72990.pep
RHEDLQKVSLARRFALVPLGPPLLTYKSNCKAMLTAVGDSVRLVVDRPYKAGEPIIVWCGPQPNSRLLLNYGFIDEDNPYDRIVIEASLNIEDPQFQEKRMVAQRNGKLAIQNFHVXXGKEKETIAEMLPYLRLGYISDPDEMQSILSSEGDTCPVSPCTERAVLDQLVEYLESRLADYP

SEQ ID NO: 178573 - protein, 169 aa, Triticum aestivum
  unsure (1)..(169): unsure at all Xaa locations
  Clone ID: PAT_TA_72991.pep
SSSRRPPTAVFNGAPTAALPDGAAANATRSGAEAVPAPAPAAVERPRTERIAFRTKSEIEILGDGYKWRKYGKKSVKNSPNPSDIGXRKVLVFRAHASQTTKRNYYRCSTEGCNVKKRVERDKDDPSYVVTTYEGTHNHVSPSTVYYASQDAASGRFFVAGTQPPGSLN

SEQ ID NO: 178574 - protein, 189 aa, Triticum aestivum
  unsure (1)..(189): unsure at all Xaa locations
  Clone ID: PAT_TA_72992.pep
FGTRVTYKVTLALWGHVHRYERFCPMKNFQCVNMSSSFVYPGAPVHLVIGMGGQDYQPFWQPRKDHPDVPVYPQPERSMYRGWGXFGYTKLVATKEKLTLTYIGNHDGQVHDMVEIFSGQVSNNNGVPEVIDDTKLSTGVSTKLKIPLFSLEIVGSVMFALXVLGFSLGFLIRRKKEAAQWTPVKNEET

SEQ ID NO: 178575 - protein, 125 aa, Triticum aestivum
  Clone ID: PAT_TA_72993.pep
SDEGGLNQYNAGLSYTTSDFVAAATLNHKGDNIAASYYHLVSPTTAVGGELSHSFSTNGNTITFGTQHALDPLTTVKARFNNYGMASALIQHEWRPKSLVTISAEVDTKAIEKSSKVGLSLVLKP

SEQ ID NO: 178576 - protein, 176 aa, Triticum aestivum
  Clone ID: PAT_TA_72994.pep
RHEGLPVSLSDDCGGRSHSDAIRAICFSVSGALFASAGDDKLVKVWKTDSWRCIQTITSEKRVSAVAISNDDLYVTFADKFGVVWLVTLREDSAEQVSVDNKPVSILGHYCSIITSMKFSPDGRFIATADRDFKIRVTLFPKNPLKGAHEIQSFCLGHTDFVSCITFTSISETQSF

SEQ ID NO: 178577 - protein, 130 aa, Triticum aestivum
  Clone ID: PAT_TA_72995.pep
IRHEADAASSAKIFAVLAGVQSLVACSLRKLRGKDDGINAGVAGCCTGLALSFPGAPQTLIQSCLTFGTFSYIIEKLNKQQPALALQPATGVTGLKAGQSVLPPFTLLLPDAMDEFSKFQNFLSSKFRGN

SEQ ID NO: 178578 - protein, 106 aa, Triticum aestivum
  unsure (1)..(106): unsure at all Xaa locations
  Clone ID: PAT_TA_72996.pep
MAEIVSSVVVHEAVNQIIHGLVNWNERKSSTEENMERLEMAHXQKKLKRAAQECDDTLRKCRQRILEQEEAEQEVRNSSIPRRIAHATKSLVSSLFYAISMAHVDL

SEQ ID NO: 178579 - protein, 90 aa, Triticum aestivum
  Clone ID: PAT_TA_72997.pep
PDEANATQPKEEHEVNIDSVGEECELQPSQSPHKKQKKNHTHVKLEPDGVLADSGSLQVEAQTHDIQQKNDQDWHGYRRRGSEGRWCWQF

SEQ ID NO: 178580 - protein, 65 aa, Triticum aestivum
  Clone ID: PAT_TA_72998.pep
EKKTSRLHAVKIPACVYLYFPGFFSLLMVVPTIRTLNCSTVTQIICLTKITRRHNFCWSSILLIH

SEQ ID NO: 178581 - protein, 103 aa, Triticum aestivum
  Clone ID: PAT_TA_72999.pep
RAPPDYQACHLDTVPVIGMSSGDTHNGGCVTSALENTQSVMDGYPMDQIWKEIEAPQAPALLGIAEGKEKTCSSIPCHLPSSAMWDYKYPEVFWKMEDQEIMM

SEQ ID NO: 178582 - protein, 51 aa, Triticum aestivum
  Clone ID: PAT_TA_73000.pep
GGEEIIYWIKLLDYSSGYYMRNIIQICCIISIFSSQRSETLTERIHQHPYN

SEQ ID NO: 178583 - protein, 204 aa, Triticum aestivum
  Clone ID: PAT_TA_73001.pep
RIQEHLSEFNSILKGFEGNHPFHNYTARAKYRKVLAGRHPRAKGASLTLKSMSSEMGMAESSSLESTSSDDDEDLNISSIDSGASENIFVNDILKFSESRVQIQARWLHEPDESDRLNASHFRDIITCSCGELQTSSGIQFVELTICGVSFMLHQIRKMVGTAVAVKRGLLPKDIIELSLAKFSRIVLPIAPSEVLILKDNSFC

SEQ ID NO: 178584 - protein, 180 aa, Triticum aestivum
  unsure (1)..(180): unsure at all Xaa locations
  Clone ID: PAT_TA_73002.pep
EAMQYRLHTFSSAGDWGWSTRSGRVNHNLCVPLSQQNAVVCGGAARWFFCNKSGLHSFDVGTKTGDVSMAKLLKVIPRDPLSPKAYDEPYLSLDAEGRLTLFSLQLDGNQVDIWTWHHDGRCIPTLLKLDPPSRKKNKNKKAGXSGGVRVLXGRRTVRCSSRTINSASTLSVQDRGDAGG

SEQ ID NO: 178585 - protein, 176 aa, Triticum aestivum
  unsure (1)..(176): unsure at all Xaa locations
  Clone ID: PAT_TA_73003.pep
MEVSKLAIALAMVAAMALPSQAQNSPQDYVRLHNAARAAVGVGPVTWDTSVQAFAENYASQRSGDCSLIHSSNRNNLGENXFWGSAGGDWTAASAVXSWVGEKSDYDYASNSCRRGKVCGHYTQXVWRASTSIGCARVVCSNGRGVFITCNYKPAGNFVGRGLTKLFIHTGDVLAS

SEQ ID NO: 178586 - protein, 108 aa, Triticum aestivum
  Clone ID: PAT_TA_73004.pep
QDDDICALEVQNRSGEWIYATPIPGTFVCNIGDMLKVWTNGIYQPTLHRVVNNSPRYRVSVAFFYESNFDAAIEPVEFCREKTGGAAKYEKVVYGEHLVQKVLTNFVM

SEQ ID NO: 178587 - protein, 96 aa, Triticum aestivum
  unsure (1)..(96): unsure at all Xaa locations
  Clone ID: PAT_TA_73005.pep
HILQRMKGLPLRVYLDLEASRKPTGFEDIFIGYHANDDLQVTYAGKSFHTSRSYHVSTEKTTDALIYWSSXSRCLPHRDKLAEDFLSLVPHHSFGK

SEQ ID NO: 178588 - protein, 87 aa, Triticum aestivum
  Clone ID: PAT_TA_73006.pep
IHCTGKTYTRWRWKQRCIIIMIQKNSSTHSPDCRMNLDAPSPCIPDGNSVSEAHVEHAAAAERGQASFQEAVVAALGVLLLLLPSCR

SEQ ID NO: 178589 - protein, 127 aa, Triticum aestivum
  Clone ID: PAT_TA_73007.pep
AKEMSKINMLRSCKGSVYWMAPEVINPKKMYGPSADIWSLGCTVLEMLTRQIPFPNVEWTNAFFMIGRGEQPTIPNYLSKEAQDFIGQCVRVDPESRPSASQLLEHPFVNRPLRASFESASPPAIRL

SEQ ID NO: 178590 - protein, 128 aa, Triticum aestivum
  Clone ID: PAT_TA_73008.pep
IRTRACEDPGLFDVLVMPNLYGDIISDLCAGLIGGLGLTPSCNIGEGGICLAEAVHGSAPDIAGKNLANPTALMLSAVMMLRHLQFNDKADRIHNAILQTIAEGKYRTADLGGKASTSEFTNAVCEHI

SEQ ID NO: 178591 - protein, 184 aa, Triticum aestivum
  Clone ID: PAT_TA_73009.pep
IRTRLTTAEPSPKETLAQPPITAAHSMASPARPTAASVSGAFGLSPDPKRCSFDQALRQKDFQENRLLMSFVNFHEQEKISKEIVTDAIESCMKKQADNLLNSLEVISGRLSQLELYCYKLERSIGELRSDVMDYHNEANLNFQCLEKQVKEVYLFYTLKYQITLLILFELCCKMHYCWFQFFM

SEQ ID NO: 178592 - protein, 161 aa, Triticum aestivum
  Clone ID: PAT_TA_73010.pep
DDKLELEQWEQNEQRVMVWLLGSMEPSVREQVENLQTTAEVWKEIGQQLSGKTNKMQVTRVLHEMRNLKQGERSITDYAGELKRLYRDLEFFRPFKSNDPKDLALLREWFQPILVQTFLEGLNQEFDLRRQMIYSAPDGPPLDEAVSSVLEEETRLSNQVV

SEQ ID NO: 178593 - protein, 165 aa, Triticum aestivum
  unsure (1)..(165): unsure at all Xaa locations
  Clone ID: PAT_TA_73011.pep
GARRVRGVGGLHHGRRLLARLPDLRRRVPARPLHQGVRHHRRRVRGDRHGEVPPLRHHRPRHRQHLLQAGPQHHPPRPHGLLRHHPLRQDPHQGVIGPDERGSVVAVLRVDERFHVHHGDRXRGDHDVSGGLAFGRPRRTLAHAQPLVPEIXHLDVEGADQAGVD

SEQ ID NO: 178594 - protein, 75 aa, Triticum aestivum
  Clone ID: PAT_TA_73012.pep
APSLVLHNSQSFRRKEFGKNREVCTLTPYLQLSTWENCPSNLLVSFSAAASTLWLSFPVRFTTKGPPLDIRCHPM

SEQ ID NO: 178595 - protein, 145 aa, Triticum aestivum
  Clone ID: PAT_TA_73013.pep
FGRGGALISAGSSGQFEYVQKLASGGCDNTVKVWKLNNGSWRMDCFPALQMHKDWVRDVAWAPNLGLPKSTIASASQDGTVVIWTAAKEGEQWEGQVLYDFRTPVWRLSWSLTGNILAVSDGNNNVTLWKEAVDGEWQQVTTVEP

SEQ ID NO: 178596 - protein, 67 aa, Triticum aestivum
  unsure (1)..(67): unsure at all Xaa locations
  Clone ID: PAT_TA_73014.pep
YLPTMLNMAEPAGCTRYMLTRDNGPHMYXPRQRCRYGSSLSCTYEHMFAPDCLGPLMAIADTVIFKD

SEQ ID NO: 178597 - protein, 51 aa, Triticum aestivum
  Clone ID: PAT_TA_73015.pep
LDVDFKDVATGGPDALSTRDKKVAACKTAKARLEERFKTGKNRWFFTKLRF

SEQ ID NO: 178598 - protein, 50 aa, Triticum aestivum
  Clone ID: PAT_TA_73016.pep
GTRVQSGERKKLVDAGYVIVGNIGDQWTDLLGEPEGDRTFKLPDPMYYVG

SEQ ID NO: 178599 - protein, 59 aa, Triticum aestivum
  Clone ID: PAT_TA_73017.pep
DEVVRLACPVSFLVSSPTRKLLHVARSLNDYVLVILYSWFRRWEYYQTIRWFQLQLPGQ

SEQ ID NO: 178600 - protein, 82 aa, Triticum aestivum
  Clone ID: PAT_TA_73018.pep
FGRGHCGNMIWAEVPGRRCVMETSSAPAASYQGHTVLSTTLSVVASLFTGSVDTSGPATIILILVASVFWSDQLMAIHLSKI

SEQ ID NO: 178601 - protein, 67 aa, Triticum aestivum
  Clone ID: PAT_TA_73019.pep
QLSLFAVFADTVHTDLYFLAVNRCILAINPKLQETKNHFFTLIHYTITVLFKVLSLNGDSWISYYFM

SEQ ID NO: 178602 - protein, 172 aa, Triticum aestivum
  unsure (1)..(172): unsure at all Xaa locations
  Clone ID: PAT_TA_73020.pep
FGTRVAASVAGSAAVFRHVGTAARGAQLLEHLLGPAEFDAALGLTALATREKAEAALEKGNADEAEALLTEVIGFNACGGLHLVYRSRSKARLAMGDISGALEDAEEAIRIAPRFPQAHLLRGDALFAMGEYSVAEDAYAHXLDIDPSIRRSKSFXARVERLREKLVGANNP

SEQ ID NO: 178603 - protein, 87 aa, Triticum aestivum
  Clone ID: PAT_TA_73021.pep
HSSSEGMNYLFLFFIVLEQYDRREQLKKSGLMTKNNMQCKFDASSYFFLAGDKDQYAASTIIASHVELPVLASCRFVVQWLIASCNM

SEQ ID NO: 178604 - protein, 108 aa, Triticum aestivum
  unsure (1)..(108): unsure at all Xaa locations
  Clone ID: PAT_TA_73022.pep
QLELVAADGQQPPLSTHPRXISSCALAQAGLVSATACRKADCKITNCKPNQFKSDQTLDDYLMMPNILLFQGIKQSALPNVRIKTSRCSIVFSSGGAQCLFEIRFYPG

SEQ ID NO: 178605 - protein, 140 aa, Triticum aestivum
  unsure (1)..(140): unsure at all Xaa locations
  Clone ID: PAT_TA_73023.pep
MTLTDMTSPERSSGGCASSWPPLQEAGSSPYMSSLCSPSGIPAVKRYGDRFIPNRSAMDMDMTHYLLTEPRKDKGXAATPSPAREAYXRRLLPKKLFNNHTRILAFQNRLPEPANNFLAELRADAASIQDKPAKQRRYIP

SEQ ID NO: 178606 - protein, 173 aa, Triticum aestivum
  Clone ID: PAT_TA_73024.pep
RVDAVTLAVASVIQPPAAVEVPTEARVAVAGDELFLVVKSKWMYLFGDDVDFSKAFHVNHRGVNPVWQELTGIGDRALFVDKLHGFAVPTPGFGNLEGNTIYSVSSKDVNNNRRHTPTTVNYSVSAFSLESRISKKLVCLLNAGRWRSVVRRHRGSYRAWMKADSAELGHHHY

SEQ ID NO: 178607 - protein, 144 aa, Triticum aestivum
  Clone ID: PAT_TA_73025.pep
MAELSTSSDGLVAEEARQQEPGQGSSGGSHGLQDTKEQEIRKGKAALVSTELLREDLVQSAVTFLKHPKVVASSDGQRRSFLENKGLTMDEIDEAFRRLQSPSSNSVSSDMCTSQGVSDHSCRITEQESRADKNCMDDSGEVVT

SEQ ID NO: 178608 - protein, 117 aa, Triticum aestivum
  Clone ID: PAT_TA_73026.pep
IRHEAQAVEPPAPAKEDESVCSDEEYAMLCREGFSREDVAAVTIQAYFRAHLARRAFKALRSLVRLQAVARGAYVRRQAEVAVHCMQAMARLQARVRSRQALAKPKDNDDKLLLLQN

SEQ ID NO: 178609 - protein, 134 aa, Triticum aestivum
  Clone ID: PAT_TA_73027.pep
GTRLIMQGRNVKLNEKVKEHIEEKAGRAVAKHSQLVKEVDVRLSARGGELSRGPKICRCEITLFTKRHGVIRAEEDAESTYASIDLASSIIKRKLRKIKEKETDVRHLKGTKPPVSDWPPSSLDNNDDDAQASS

SEQ ID NO: 178610 - protein, 66 aa, Triticum aestivum
  Clone ID: PAT_TA_73028.pep
FFIRIECWSVGRWRKFETGRAVVTIGEAAKWTNNTPFTQAEQVFFHERVKYWTRSSHFDVYMRLRR

SEQ ID NO: 178611 - protein, 116 aa, Triticum aestivum
  Clone ID: PAT_TA_73029.pep
RKRMEQHHVFFRENQLLMYRCTSAGKLEGQKKEEELTFPWRQPSKRWTTDGGCEACGQNWNQLQHDHEIIPARRNGREKEDGWKGPRSWPSWSAERGRLAKELGLLSPEATSLVRI

SEQ ID NO: 178612 - protein, 91 aa, Triticum aestivum
  Clone ID: PAT_TA_73030.pep
SSGTRAIPCVRRRTYHDRPPAACMVQSVKEPLAHLHLVLHREKIWSSCRYIDGTDRTAMVAPFRWGSFRWFYAAINSLELQSVFIASFFFG

SEQ ID NO: 178613 - protein, 179 aa, Triticum aestivum
  unsure (1)..(179): unsure at all Xaa locations
  Clone ID: PAT_TA_73031.pep
LCLGWRDLKESEYKEWSKNFQEASCSLDNREFKMSEVCHSLERDLHILGVTAIEDRLQDGVPETIKLLRNAGINVWMLTGDKQNTAVQIGLLCNLITSEPNSQLLSISGKTEEDILRSLERALLIMKNTSETKDLALXXDGWALEIILKHSKESFXDLAMLSKTAIXCCRMTPLQKAQS

SEQ ID NO: 178614 - protein, 182 aa, Triticum aestivum
  Clone ID: PAT_TA_73032.pep
SLNESPPVPPPAAALLSIQRVVEIRSVTGHFISAITMSLACLVCHGMNSPSNSFRSYSVSSSEGENRCGAVVACLSRKVMPSGAANGVGTSKVTPFPLMATGQGTEGAPRLQRSHAVSRDLVRNWNFDEIVFGTRVGCSPFGLDWTTIIWQDKPSLDEFTSIHLCIHVMYQQFSTRSINKQI

SEQ ID NO: 178615 - protein, 86 aa, Triticum aestivum
  Clone ID: PAT_TA_73033.pep
PPPPTRGPSCDLSVGSAVRLLRPRPSPPSITTALMRAGDHLINHGSRRARRDAVFFLVSKKTLFGAQDDRLPPHLLLVGQECSIIN

SEQ ID NO: 178616 - protein, 96 aa, Triticum aestivum
  Clone ID: PAT_TA_73034.pep
ARPPAPPSLGLPNSPPRPPVNSPAAAPSCPRWRPPGEPWLRTLHSTRLHRALPPSSAPPPWHSCAAPPLPADATDKIKAPASALSPATPGKAPPPP

SEQ ID NO: 178617 - protein, 74 aa, Triticum aestivum
  Clone ID: PAT_TA_73035.pep
QYLSPITSEYYEADNYHNILATTCRWQVKDKFQQAPMSSIFYTVLCLCKLFCSTTSLLLEFPVKLTKPMVIMHR

SEQ ID NO: 178618 - protein, 55 aa, Triticum aestivum
  Clone ID: PAT_TA_73036.pep
AMDRVRQRQGKVPPSSSLRRMQSMAEFSQNLVVAELEHINHHTHIIFSLISHMNG

SEQ ID NO: 178619 - protein, 85 aa, Triticum aestivum
  Clone ID: PAT_TA_73037.pep
FFFFFFTKANSTYEQHYSKARDRKRPFIYTLLSTPEAKIATYYLQAQKLCFRERMQLQLSQCTRTTPWRNLHIYKNNSSGHLIFV

SEQ ID NO: 178620 - protein, 152 aa, Triticum aestivum
  Clone ID: PAT_TA_73038.pep
FGRGEEDVSTSNHSNEKLFEEFSQLLDVLPEHLFDENFNDKEVPKRGKGRGRGGRGRGRGNHQYNNNQHHQNNQQHYNHHGNNHLGGNRGSPHPVGTPPHNLITKPEQYPQLPIGANKLPPGPRMPDGTRGFTMGRGKPQAVLPGLCAVGES

SEQ ID NO: 178621 - protein, 94 aa, Triticum aestivum
  Clone ID: PAT_TA_73039.pep
MQTSSSMLGSGFLEFKLNYAQIHHLGIGDVVSSESFSAGGFLWRINCYPRGDKVDGDNEHLSIYLQLLTKSKNVRAIFDASVVCRDGTLSSSDA

SEQ ID NO: 178622 - protein, 97 aa, Triticum aestivum
  unsure (1)..(97): unsure at all Xaa locations
  Clone ID: PAT_TA_73040.pep
IEKKMPGFPACQIRTHHQDTPGSFFARALLNPLMTRWVCTTTATLLHVYGFAPKKNDDSEGEKGEAARGHRSCGAAXPLSGPTGSEERRRRGWRRDG

SEQ ID NO: 178623 - protein, 204 aa, Triticum aestivum
  unsure (1)..(204): unsure at all Xaa locations
  Clone ID: PAT_TA_73041.pep
MEMVDAVDGYKFADESTSDVRVCFRRTGGRGEQPERFPCHSSVLSNRSKYFADLLGQQSDARSGGSNNCIEVQCPRAEYDHYVKLLKFMYLSRDSIEDAITSVKSALGVLRAATSLKXEFVAETCIGYLESASWEEREEEXILQFAQTLAPEAAAXLLARLQAPSANAVKTVFISAVRFAASMETSAAPLFDDIKTAAQEQIDF

SEQ ID NO: 178624 - protein, 163 aa, Triticum aestivum
  Clone ID: PAT_TA_73042.pep
GSTSSARTLNFSRDQVGNIAWSYAVIGQMDRPFFSHMWKTLSQFQEQRVSDQYREDMMFASQVYLANQSLKLEYRDLGLCLRSDLEEKVTRAGKSKRFNQKTTSSFQKEVGRLLYSTGHEWVREYAIDGYTVDAVLVDEKLAFEIDGPTHFSRNLGTPLGHTA

SEQ ID NO: 178625 - protein, 123 aa, Triticum aestivum
  Clone ID: PAT_TA_73043.pep
SPCLQATRFMKFLQQVWVAPQLTISVSRVSSGSWTLVQEGELVGQQAQVAQALPQLYASDDCCQVNLWFLLCPHYFQLYAPKIILDLLQLNLSDLPSLDENPAHQVHQVLLGQLKRNLWFYLQ

SEQ ID NO: 178626 - protein, 55 aa, Triticum aestivum
  Clone ID: PAT_TA_73044.pep
AFSFRLSAHKFTSERCCSKQCICVVTERDEAQRLAGTGNGGSFAQRLAGTGASCR

SEQ ID NO: 178627 - protein, 136 aa, Triticum aestivum
  Clone ID: PAT_TA_73045.pep
MARIKPKQLLIQSKTKKAPSRISYSTIITWNLIVILIVLSLYATYSHWHQRSAQDFEMELHEAELAVRPVDPKMISRPRYAVMNTAKGPITIEIYKDASAGVVDRFIDLCKSNHFKGMPFRHIIKNFVIQGGDFDF

SEQ ID NO: 178628 - protein, 75 aa, Triticum aestivum
  Clone ID: PAT_TA_73046.pep
PSLPRQRRRPQRDGCRRAGAVENGGVEARRLRRGGGRRRRRRGGERRRGGSGAVEGGGGAGVVESWRRRPEDAEC

SEQ ID NO: 178629 - protein, 113 aa, Triticum aestivum
  Clone ID: PAT_TA_73047.pep
LIPPSTNLIITMKRATLCSFGILVILVLAMSPGSDGGRRKILMAKKLAALLLLNKKRYIFVAPFPLPVPLPVITKVKHIIHKEKVPVPVPVPVHHQVTKYVAVPVPTPEKSWP

SEQ ID NO: 178630 - protein, 156 aa, Triticum aestivum
  Clone ID: PAT_TA_73048.pep
REREREREREREREREREREREREREDMWYCPCCKKHQQAMKKLDLWRLPEVLVIHLKRFSYTQFTRNKLETFVDFPTTDLDLSSYIADKSKQPSSHYRLYAISNHYGNMGGGHYTASIYHEEGKGWYKFDDDYVTPMSEDSIKTSAAYVLFYRRE

SEQ ID NO: 178631 - protein, 132 aa, Triticum aestivum
  unsure (1)..(132): unsure at all Xaa locations
  Clone ID: PAT_TA_73049.pep
MAPPVKVFGSAVFANAARVMACLEEVGVEYEVVEVDYTAMEHKGPQHLSKNPFGQIPAFQDGDMMLFESRAIAKYVLRKYSKSAQIDLLREGNLQEAALVDAWXREVEAHTYLPAIGPIFYECVVYPARLGT

SEQ ID NO: 178632 - protein, 152 aa, Triticum aestivum
  Clone ID: PAT_TA_73050.pep
MESSSHKRAREVVDLTAAGPGEAAALPEADAKRLRPQDLLDMLDDDTDAAAAGDLASVMRSLEEEIASFDEAVGAAEAAPTQQQQQPELGFLLEASDDELGLPPAGASASSSSEAGGGGGGLAGAPPESAELDGGQIWGFEDEIDGGAGFGG

SEQ ID NO: 178633 - protein, 106 aa, Triticum aestivum
  Clone ID: PAT_TA_73051.pep
IPILSYSSSLVFCSEWSIAVHDAPAEDLVHVRHCLFPSAHLPRLDAERDLARHAREGGREGGRIDREESPRPEIRPFEATRLLSLVSASPVPLFLEAFTQGTKPRP

SEQ ID NO: 178634 - protein, 110 aa, Triticum aestivum
  Clone ID: PAT_TA_73052.pep
MMIDCCHLVKHGPLAIGINAAYMQTYIGGVSCPYICGRHLDHGVLLVGYGASGFAPIRLKDKAYWIIKNSWGENWGEHGYYKICRGSNVRNKCGVDSMVSTVSAIHTSKE

SEQ ID NO: 178635 - protein, 99 aa, Triticum aestivum
  Clone ID: PAT_TA_73053.pep
QWTTMARFFWCSFYFYLLFSGFRKRRVGSGAYQTASIAAGKMCAARASPALAHQQRALASQQCVDMMVNIATPSGRRTLLQLKLPSFNFTSLLFISSDV

SEQ ID NO: 178636 - protein, 56 aa, Triticum aestivum
  Clone ID: PAT_TA_73054.pep
ATYRVSHLQGGELASEGGDKGLSYCLDTIFTAYSLFQGKGARSLTSMFSSQYPLGS

SEQ ID NO: 178637 - protein, 87 aa, Triticum aestivum
  Clone ID: PAT_TA_73055.pep
PLDKCCQYSQNLQRILISKNNCFVESFPERRLQPSIYCLKKSREIRQCCSANDCISSWTDKGKMQPLIINQNTNRAASSHQPAWQST

SEQ ID NO: 178638 - protein, 199 aa, Triticum aestivum
  Clone ID: PAT_TA_73056.pep
DSDEGHCYFGRFKLHTLPMLESLAVIDTSVSYNLSSFPCLKYLNITRCYGVFKRRRVPCIPGWNLNMFLGGNPGITDLVVRFTGYDRWFKTWSSALLLPKLRRLLIADVPSSWDVSWPRLLIEAAPCLESLHIHISRWEEDPCDDIVWQSPKFCHNQLKELVITGFEGTERQIYFVSFVMKVATKLQSVSLLKNGLVQG

SEQ ID NO: 178639 - protein, 97 aa, Triticum aestivum
  Clone ID: PAT_TA_73057.pep
GSIKAFDFCCNISIFSHYVYVSNSHCYSWSTMYTDLFFVFHCNVMISDAIQFLLTQPLELFLFQVFKYRWLMHHMRRCSMHDGFKKGGLDWYLRPSS

SEQ ID NO: 178640 - protein, 120 aa, Triticum aestivum
  Clone ID: PAT_TA_73058.pep
IYQALEKVNGIAENLSREVFRDTLIEQAEQGVDYFTIHAGVLLRYIPLTAKRMTGIVSRGGSIHAKWCLTYHKENFAYEHWDEILDICNQYDVALSIGDGLRPGSIYDANDSAQFAELLT

SEQ ID NO: 178641 - protein, 104 aa, Triticum aestivum
  Clone ID: PAT_TA_73059.pep
MQDGGKEQELQQLQIVSPPSSSKLQFLHTDEAMGLLVVPICSFLSSSLTHLHLDGISQEMERFTKEQEDALHLLTFLQHLQFYGFIKLQSLPSVLHKLTNLKLL

SEQ ID NO: 178642 - protein, 50 aa, Triticum aestivum
  Clone ID: PAT_TA_73060.pep
DNNVTKKTIRVAGNNNLHHLYRATSTSLLNMYYGSDHDETGSRAMSERAW

SEQ ID NO: 178643 - protein, 158 aa, Triticum aestivum
  unsure (1)..(158): unsure at all Xaa locations
  Clone ID: PAT_TA_73061.pep
SDEGEWESVALTLAGTAGNNIGKVLQKKGTLILPPLSLKLKVVKAYASNQLWISGFLMDMCGAALMLTALSQAPVSVVQPIAGCGLAILCVFSHFYLKEVMNGLDWIAITLAGLGTIRCGVVXSQEQKVDQIPLLNIPWLVLSIVILFVXAQHMASYV

SEQ ID NO: 178644 - protein, 86 aa, Triticum aestivum
  Clone ID: PAT_TA_73062.pep
RIAVYINKHVVNLMSRDPSSTPCEKVIPEPHIQASIFCCNRSGYKSERLLSWTRLLIDNLPCRGAPHFPTHLITLAGHTFLGHARP

SEQ ID NO: 178645 - protein, 157 aa, Triticum aestivum
  unsure (1)..(157): unsure at all Xaa locations
  Clone ID: PAT_TA_73063.pep
ARRQFGCQRLDDALVARVARLTARPPHRFLRRGLFFAHRDLNEILDLYEKGEKFYLYTGRGPSSEALHLGHLIPFMFTKYLQDAFKVPLVIQLTDDEKFLWKNLTVEETKRLARENAKDIIACGFDVERTFIFSDFNYXVGGAFYENMVKVARCVTY

SEQ ID NO: 178646 - protein, 62 aa, Triticum aestivum
  Clone ID: PAT_TA_73064.pep
KEESSASHLHRVLTTRESKRTAAADLGPRQRAVARTHDGAGASRNASGGGKNTTHLAAARPN

SEQ ID NO: 178647 - protein, 102 aa, Triticum aestivum
  Clone ID: PAT_TA_73065.pep
VKDSPLLRFLATGVLCCTTGSTRDDLSLASEVWCLTIEQVFFFPANGCRLEFGNYHSYTGWQRQSTCSAITVQTQEVRLNCSVRGCNLCSAITKINPAAPAE

SEQ ID NO: 178648 - protein, 68 aa, Triticum aestivum
  Clone ID: PAT_TA_73066.pep
FFFFFFGNDYIFSFAFAIGSWQTTINAKLKLSNHWRWRIYLSRIDRASDHNHDLVLVLVQNKHPKSKH

SEQ ID NO: 178649 - protein, 94 aa, Triticum aestivum
  Clone ID: PAT_TA_73067.pep
GAHDCFSVMKYRETYSQPIYPIPDRSHWNNSSPGLQGVVSKADVILSPPNIRRPPGRPKMKILKIESMKRPKRIIQCGRCHLLGHSQKKCSLRI

SEQ ID NO: 178650 - protein, 49 aa, Triticum aestivum
  Clone ID: PAT_TA_73068.pep
FGTRAGRGGPGGRSNYKTKLCENFVKGTCTFGDRCHFAHGENEQRKGAA

SEQ ID NO: 178651 - protein, 127 aa, Triticum aestivum
  Clone ID: PAT_TA_73069.pep
SRGSMNRERRRSSIHDITSVNNGDASTAQGPITGQTNGQAANPGKPSKQSPQPANTPPGVDAYGTTIGQPVGGPLVSAVGTPVTLPVSAPPHLAYGMHAPVPGAVAPGAPVNIAPMPYPMPPPSSHG

SEQ ID NO: 178652 - protein, 165 aa, Triticum aestivum
  Clone ID: PAT_TA_73070.pep
EAPSRPVDKALRLPLQDVYKIGGIGTVPVGRVETGTIKPGMIVTFAPVNLTTEVKSVEMHHESLTEAVPGDNVGFNVKNVSVKELRRGYVAGDSKNNPPQATEEFAAQVIVLNHPGQISNGYTPVLDCHTAHIACKFKDIKEKIDRRSGKKLEDNPKSIKSGDAA

SEQ ID NO: 178653 - protein, 54 aa, Triticum aestivum
  Clone ID: PAT_TA_73071.pep
LTRCLRVSLMSFILERCRLLVFFLNHVPPVFSLLGVYRVLPGGLCNQRVILVHV

SEQ ID NO: 178654 - protein, 159 aa, Triticum aestivum
  Clone ID: PAT_TA_73072.pep
GGGFGESSADPWVDEFQEHMSSFKQSSGTSRGVYVFSENNPYVGHPNPMQEGQELFRKGLLSEAVLALEAEVLKNPDNAEGWRLLGVTHAENDDDQQAIAAMMRALEANPTNLEILLALGVSHTNELEQGEALRYLSRWLQNHPKYGGLVPPQSTGFTL

SEQ ID NO: 178655 - protein, 79 aa, Triticum aestivum
  Clone ID: PAT_TA_73073.pep
FSYQYHHLKKLLLASTFHRIHKILDTRHAIQRGCTATGSSSFLPPTKTGKPNSNNGSSPRRYSHVTMPSILLNWGAFVI

SEQ ID NO: 178656 - protein, 124 aa, Triticum aestivum
  Clone ID: PAT_TA_73074.pep
PTQYHEVCFVHCSCRFAIEHSSSSMHMLHTDSPENVKIKMLRAVVLGAIDDANVMCVSHDSSVGQNTQGLAVLDDIVVDLIQGVVLELEPFPGQLRRQNAGPRLLQELILIVGVQIPFYASSES

SEQ ID NO: 178657 - protein, 117 aa, Triticum aestivum
  unsure (1)..(117): unsure at all Xaa locations
  Clone ID: PAT_TA_73075.pep
MKLTIKRVPTVVSNYQEDAWRAATRRVGGRNCLGHCCLPVSELPVYAFKANPTKLPLQEDAVPTDFFINLLLGQWEDRMTQGLFRYDVTACETKVIPGXXGFVAQLNEGRHLKKRPT

SEQ ID NO: 178658 - protein, 91 aa, Triticum aestivum
  Clone ID: PAT_TA_73076.pep
ILQHCVKKKLANNCSNSSAFTEYMVRQEQEQILKFQPFKLQQNLTDYRVTQKLVYLYVTFHLCLHKRRQPDSPMGARRKLYEPTSFCSQGQ

SEQ ID NO: 178659 - protein, 78 aa, Triticum aestivum
  Clone ID: PAT_TA_73077.pep
NKASTCLVSRKHALEQIRNILVLHYYNLLEQNDKLNRQHRAAKSQKFKENCKKRMRTTNHKYIGKDVGGIVPAWKKQF

SEQ ID NO: 178660 - protein, 76 aa, Triticum aestivum
  Clone ID: PAT_TA_73078.pep
AAGGISALVLYFVHTQLPVRPVFASSIGLGIAAALLSVMGSRFKKSGKIFPAGVVSLVSLVMVGGYFHGILRSSHA

SEQ ID NO: 178661 - protein, 158 aa, Triticum aestivum
  Clone ID: PAT_TA_73079.pep
SVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPN

SEQ ID NO: 178662 - protein, 56 aa, Triticum aestivum
  Clone ID: PAT_TA_73080.pep
QGTTHEASKEANKEVAKDNNAGVGTRLQAAGDAIGDKAKEHKYDASAEANKQAATH

SEQ ID NO: 178663 - protein, 111 aa, Triticum aestivum
  Clone ID: PAT_TA_73081.pep
VHTQTEDGPTRKESSNCRGECPIAYIICLANFIWSFCVSLLSVSGLLLGEQEERQGSLLHLWGYWPEVGYCYPCITQAEVVTFDLIPASLLYCLHPIRAKTYSGAIAHLND

SEQ ID NO: 178664 - protein, 68 aa, Triticum aestivum
  Clone ID: PAT_TA_73082.pep
PVLQGIMMKVAEIFPQKEKKKEVTDIVVVTHKKYHFSWEMLIKNDDFRCDDGGNTIERLFQPDRNIYS

SEQ ID NO: 178665 - protein, 75 aa, Triticum aestivum
  Clone ID: PAT_TA_73083.pep
GNTTIAMHLTTCLYLFTLIFSYCLPVLSPLPAPYLCGLALACCMRREISSCAVLGPVSALTLFALICTPFICMEH

SEQ ID NO: 178666 - protein, 165 aa, Triticum aestivum
  Clone ID: PAT_TA_73084.pep
YGDQSAFFFQLFTFFINSLNALWLLENSEKHACSSSATSSIAARRHSSSFVSCLSRTCSLFLLKLIILLKNVFLAFGNPACSWRAQQRNSILRLRRFSPRPAHRRAEQGGVMARRLRSRPPSPRSSISQLCGFRPRPAHQRAEESEAVATRHLSRPALPHSSAPQ

SEQ ID NO: 178667 - protein, 82 aa, Triticum aestivum
  Clone ID: PAT_TA_73085.pep
MSSSRRSSSPDSNNNTDVSGGGGGGFAADERKRKRMLSNRESARRSRAKKQQRLEDWCAEVARLQAENAAAQSRIAAFEREF

SEQ ID NO: 178668 - protein, 64 aa, Triticum aestivum
  Clone ID: PAT_TA_73086.pep
LHAFVAFSVHDTEYFTKDQNRLISNKEYNLLVIDQDVLGLLTSILSLAIEWCNSCSHMHLHLSS

SEQ ID NO: 178669 - protein, 74 aa, Triticum aestivum
  Clone ID: PAT_TA_73087.pep
VHMDERPLNCEWKGCKKTFKWPWARTEHMRVHTGVRPYECMVPGCGQTFRFVSDFSRHKRKTGHSSGKKNKEST

SEQ ID NO: 178670 - protein, 72 aa, Triticum aestivum
  Clone ID: PAT_TA_73088.pep
LQESDRVYMLLKILKSFYALEFNCILLPATAANSGYFLFGRYNQIMLFNLFQCLLLTYLQFSTLFIVLYTKT

SEQ ID NO: 178671 - protein, 159 aa, Triticum aestivum
  Clone ID: PAT_TA_73089.pep
GFIEDSVAANHSVNGSARNAIKILILDVDSSDLSSGLSCPPENFVEDPFLLKAKEFLSEGGLFIINLVSRSSSVREMVVSRLKAVFEHLYSLQLEEDINEVLFASPSERYLEINNLDAGASKLQELLKIPVGCRIRYTEVAKAPVTVSPDTEHHPFAST

SEQ ID NO: 178672 - protein, 106 aa, Triticum aestivum
  Clone ID: PAT_TA_73090.pep
HSYIYVSYMYINSATHKLSEYTCYIVHRRYIYIDTYMAHGLGTRKLKKLLAGMGVAVYVYVASSMISSIGTSCLLSSDDSCPPLRRRNTRLLPLEQHLLPQSRSRT

SEQ ID NO: 178673 - protein, 105 aa, Triticum aestivum
  Clone ID: PAT_TA_73091.pep
SCSACHKSYISGMVVKCDNRSYICWLVGRMHQSHYAVPFPAYLSVIFSSYCFVCNLLLTYTYLSCMLFVNDPIKLNMTKLGFQTLELVAFLQGPAREIAAITVAA

SEQ ID NO: 178674 - protein, 126 aa, Triticum aestivum
  Clone ID: PAT_TA_73092.pep
DEEKRKERLFSEEKGVEWESSASDFHHENLVTLVIFGFQSEEYMVSYIRRVMEAATNLEEVFLYHRLACRKCLDNSRKQPFKFPWTKRQRLSVKKRITDGIDSFAIIHFPTTAGLRSDHVAKKNYP

SEQ ID NO: 178675 - protein, 36 aa, Triticum aestivum
  Clone ID: PAT_TA_73093.pep
GGSRAVLFRTPISGGVHSATAVHDLPPPALAVRNLM

SEQ ID NO: 178676 - protein, 95 aa, Triticum aestivum
  Clone ID: PAT_TA_73094.pep
IRTRKALVRFQEVTTRYTPEREAVDDMLRERDNIHCSFTTERTLVNPVGAGSSSSRYTVEQSIPESPENGSVDGKDKSGKKKWFNLNLNRSDKKA

SEQ ID NO: 178677 - protein, 180 aa, Triticum aestivum
  Clone ID: PAT_TA_73095.pep
DSDEDLLPPAGAAADVPEDRTVRVKFVLRKQCAFGQHFLVGGDEAALGLWDPAKATALEWSEGHVWTATTDLPANRSIEFKFLLRDASGHVRWQHGTNRTLQITETPNTMVVHEDWDHGNKQKVSEEEELSIGAEDVEFSEVLEGTNGAMPVDNNPQKHENLETDRSACGGCRCSSAVGN

SEQ ID NO: 178678 - protein, 111 aa, Triticum aestivum
  Clone ID: PAT_TA_73096.pep
MAAKCALSAPCLSAHRPLCRNRLAPCLPSPRPARAVALRVSAAKLPPGVEVPRVQPKLSEPFLGFTQTAEIWNSRACMIGLIGTFIVELVLNKGILQMIGVEVGKGLDLPL

SEQ ID NO: 178679 - protein, 86 aa, Triticum aestivum
  Clone ID: PAT_TA_73097.pep
IFRRSRRRTRSRERRSSGTRSSNRSSQESFTLEVPTRSVDMREIRFDEIDDEYIVTGAMARAAVSRRMAAHYRDPRFGRRIPRIIN

SEQ ID NO: 178680 - protein, 176 aa, Triticum aestivum
  unsure (1)..(176): unsure at all Xaa locations
  Clone ID: PAT_TA_73098.pep
GFSSASFLQCLVQENIPTFLEAEMGAAESSSKLASSVHGFSVKDARGNDVELSXYKGKVLLIVNVASQCGLTNSNYTELGSLHKKYGEKGFEILAFPCNQFVGQEPGTNEQIAEFACTRFKADFPVFGKVDVNXGGKAAPLYKFLKSERGGLFGXNHQMDFTKFLVDXDGHVVSRY

SEQ ID NO: 178681 - protein, 160 aa, Triticum aestivum
  Clone ID: PAT_TA_73099.pep
SGYGDLTGFGNTGNLPIAIIGSVCHTNDHPFGPGCDTMGIAYVSFAQWVAVILVYTLVYHMMEPPMQFYEIVGEGNEIQQEPEQISSNYSRSLLHEAEWPGMVDKVTEHSKTPFIARVFMSISGSSQNTFPEIDFTEEGTSGAGPSSPKSLRCLAEPRVV

SEQ ID NO: 178682 - protein, 79 aa, Triticum aestivum
  Clone ID: PAT_TA_73100.pep
DLVFAISSMSECASIEALAPKCTTSCGSLTLSNFRHIDQTGRICSCLETCSGVRTRKIPRKKFDNQKMELCVPNFCSFI

SEQ ID NO: 178683 - protein, 154 aa, Triticum aestivum
  Clone ID: PAT_TA_73101.pep
TLVEYSNRMDEYDKKNEETNRKFSTLLQELNKCKTEIQYLQSASSSSTLSVCSSCSTTASDLSLAMGPPALNSTTNAVRTRLHSQGDQIPENTNKDSMEQSEPVVFDEVKSSDEQEPSTSTGVKRKLELAIPKAAKRVRAVAKKYAALITLTRQ

SEQ ID NO: 178684 - protein, 174 aa, Triticum aestivum
  Clone ID: PAT_TA_73102.pep
EGEAKGLLLASIRDPNPVVFFEPKWLYRLAVEEVPEEDYMLPLSEAEVIRKGSDITLIGWGAQLAVLKEACEDAAKDGVSCELIDLKTLIPWDKETLEASVKKTGKLLVSHEAPITGGFGAEIAASITERCFQRLEAPVARVCGLDTPFPLVYEPFYMPTKNKVLDAIKSTVNY

SEQ ID NO: 178685 - protein, 79 aa, Triticum aestivum
  Clone ID: PAT_TA_73103.pep
MKVYLIALLVLAVLGAAFLPSVDAQYGRGGYGRGYGGYGRGYGGGYGRGYGGYRGGYRGGYGGGYGRGYGGGYGRGYYG

SEQ ID NO: 178686 - protein, 130 aa, Triticum aestivum
  Clone ID: PAT_TA_73104.pep
FGRGEADKAIEMFNRYDISGRLLNVNRASPRGTRMERPPRQFAPAFRAYVGNLPWQVDDSRLVQLFSEHGEVVNATVVYDRESGRSRGFGFVTMVSKEELDDAISALDGQELDGRPLRVNVAAERPQRGF

SEQ ID NO: 178687 - protein, 71 aa, Triticum aestivum
  Clone ID: PAT_TA_73105.pep
EVAPGEGGEEGRGEGLQEGSGRGGEEEQAAAAPWLRCLFPSSSLLCWVLGGEQRIYERKGPLSEKGIVPTV

SEQ ID NO: 178688 - protein, 84 aa, Triticum aestivum
  Clone ID: PAT_TA_73106.pep
KSSCSERLSSPAAPCCCLELLAVSLSSVITREVDFIINFLLNNVLVDFSPYFLTASAAKSSQSGRLTKLIACRTNDNDLIGRSR

SEQ ID NO: 178689 - protein, 163 aa, Triticum aestivum
  Clone ID: PAT_TA_73107.pep
DSDEADLSDIDSGWVILKNSDIVSADLAAAAVSGGQRLGSSTIPSWARWVLGGVVYTVVPFYNRVRHLEDETVGFVENAVEVVEHIAEVTEKLAANVAKQLPEDGSLQKAAEDVEHIAEVVDDDAEKFEAVAEKIDKVCDEIDAAVEPVIEELEKELDQSTTS

SEQ ID NO: 178690 - protein, 154 aa, Triticum aestivum
  unsure (1)..(154): unsure at all Xaa locations
  Clone ID: PAT_TA_73108.pep
RHETAQLAAEIAKLLGCTTWTGAGPGLMDAAIQGALEAGKPVGGFKIGKEAGEWTASNFHPYLPSETYLTCRFFSARKHGLVDAVVRNSSADKTAIVALPGGIGTLDELFEIMALXQLERIGSALPVPFLLMNYDSYYSKLLEFLNDCEDWGTV

SEQ ID NO: 178691 - protein, 78 aa, Triticum aestivum
  Clone ID: PAT_TA_73109.pep
SALLRLKFIYLHTVITRSCNICQLACLHLDISGLCSVAHRDNMSKFLAISLLLTLLSHCAYSYSRATASAWRDQDFFG

SEQ ID NO: 178692 - protein, 178 aa, Triticum aestivum
  unsure (1)..(178): unsure at all Xaa locations
  Clone ID: PAT_TA_73110.pep
APAPAPAVAAETSDDAIQEESPATAPSSDGKPGSGAAPELEVQLFRRGRPVAVFRSQLGGYTQDQLEVGDILEQHGLKSVFAFDPAARKRGVAIRFNPRNGRSLLTYAPGSTIFLDGEPKDSLLKPITKMVIXGVAAMTVVAAVLLKEAKMPEWLQSSKLGTVSFPPWVLACMVIVFL

SEQ ID NO: 178693 - protein, 116 aa, Triticum aestivum
  Clone ID: PAT_TA_73111.pep
IHELQQGYTVSNMDLPPAPMNQQLTNLKPTNDGEQAIQIGAASRGPGQAITKGEGLRRWLRRCREGDVAARSMHDGNSAARETGCRGSEPLGEVATAAERDHRIGRGSGRHRSLVR

SEQ ID NO: 178694 - protein, 150 aa, Triticum aestivum
  unsure (1)..(150): unsure at all Xaa locations
  Clone ID: PAT_TA_73112.pep
RHEGLILTLAILFLWSNATTFINKSPPNIPEVKIPEDLAVNVARSLRYEINRGFATLREIGQGHDLKKFLIVIAGLWILSVLGSCCNFLTLSYIVFMVLYTVPVLYEKHEDKVDAFGEKAMVELKKYYAIFDEKCLSKIPKGPLXDKKQH

SEQ ID NO: 178695 - protein, 67 aa, Triticum aestivum
  Clone ID: PAT_TA_73113.pep
YTCTELWLHLLANLIFLTLKHPTGNSTATNDGGHHLAGPGFCDERTEAGSLRLPWHSWSLSLTPRPN

SEQ ID NO: 178696 - protein, 191 aa, Triticum aestivum
  Clone ID: PAT_TA_73114.pep
DSDEVFTSLAAQSQTSGRSISRSVFLEYYGVRGPLGDRLFQLVAKESGGSDGVTFEDLIISKATYGRGTRDEVDEFIYQLCDVTGDGALTRSDLESVLASVHETVFAVKKEVVEGSNNRPFEAFLNSAVLSEDAEAVSEKSMSLSDFRNLCILLPSLRKFLGNLLMPPDSGRPGFEVPLLHYPENISTDLL

SEQ ID NO: 178697 - protein, 58 aa, Triticum aestivum
  Clone ID: PAT_TA_73115.pep
RHEADVERTIKELRSTPELLYIGDYGHIDFIMSVKAKDDVYVDLMRFLRAQQGMHSSY

SEQ ID NO: 178698 - protein, 103 aa, Triticum aestivum
  Clone ID: PAT_TA_73116.pep
GTRCVKRGGVRFKINGHDYFNLVLVSNVAAAGSIKSMDVKSSDSDDWMPMARNWGANWHSLVNLTGKMLSFRLTNTDGHTIVFNDVVPKGWTFGQSFVSKLQF

SEQ ID NO: 178699 - protein, 32 aa, Triticum aestivum
  Clone ID: PAT_TA_73117.pep
YIYINIYLYMYKVIKITFNNSRVSYYLYITSK

SEQ ID NO: 178700 - protein, 178 aa, Triticum aestivum
  unsure (1)..(178): unsure at all Xaa locations
  Clone ID: PAT_TA_73118.pep
GTRQTFNSMISVFGKGGKLDKAVEMFAAAQELGLPIDEKMYTNMLTLYGKAGRHQEASLMFKRMKEDGIRPGKISFNSMINAYATSGLYSEAKSTFHEMQDCGHTPDSFSYLALIRAYTEAKLYMEAEEAIRMMLNSSTTPSCPHFSHLIXSPFLKEGQIGEAQRIYNQMKDASVAPD

SEQ ID NO: 178701 - protein, 87 aa, Triticum aestivum
  unsure (1)..(87): unsure at all Xaa locations
  Clone ID: PAT_TA_73119.pep
EEARRSVSSGNVAYAKADVVVKLGGWDPEYTRAVXQGCLVALKQLTLADKKLAGKKSLYMRLGCRGDWPNIEPPGWDPDSDAPPTNI

SEQ ID NO: 178702 - protein, 109 aa, Triticum aestivum
  Clone ID: PAT_TA_73120.pep
MSSVQLSGAGVAAVAFTKNGASSFDGLRLAPPSVRVCSSRRPSRSLVVKAATVVTPKYTSLKPLGDRVLVKLGAAEEKTVGGILLPSTAQSKPQGGEVVAVGEGRTIGD

SEQ ID NO: 178703 - protein, 89 aa, Triticum aestivum
  Clone ID: PAT_TA_73121.pep
VAEAQMDSHARAGTKGQLGALDPNIKTDTSRYKSTASVGASNHSLISSAMVVWDLHNKFSFLPKGQMSYIPDPRGTNVEHRVRSENTQR

SEQ ID NO: 178704 - protein, 116 aa, Triticum aestivum
  Clone ID: PAT_TA_73122.pep
SAHRGVKPDQFKAMNDEGMPIYQRPFMKGKLYIHFTVEFPDSLAPEQCKALEAVLPPRSSSKLTDMEIDECEETTMHDVNNIEEEMRRKQAHAAQEAYEEDDEMPGGAQRVQCAQQ

SEQ ID NO: 178705 - protein, 103 aa, Triticum aestivum
  Clone ID: PAT_TA_73123.pep
IGAIAMNQASVDQQQNYLSFCTRLLSALAQTTQHRLTQEINKSTSYAYVVQLCAFHVCESQISYIDQLSLPIDVLSRCDITDPSVNLYPPFLLQEIKTCLVRI

SEQ ID NO: 178706 - protein, 128 aa, Triticum aestivum
  Clone ID: PAT_TA_73124.pep
RARRDCHARHLVNQFDPRIKITPLKKGDALHFSAHKRRASNISPVLKVDAGAWKHIPYNNCPWPWDRWLLPWKSYEPWSSHVRVFDCLLLVQVQCFMAQNSDSRPSSINLHNNQITESAIYLMVVFQY

SEQ ID NO: 178707 - protein, 51 aa, Triticum aestivum
  Clone ID: PAT_TA_73125.pep
MMSLPSFFPEGMDDEDDQSATLDQVLNDTTRVGYFKGYLNSVAQAIKDGAD

SEQ ID NO: 178708 - protein, 161 aa, Triticum aestivum
  Clone ID: PAT_TA_73126.pep
FFFFFFFFAQQLGAHPHHCNIAHTKLFLLGERCPCRYLHRGRCGIRPDEKKKKVVEKEGKKKKDQELRTVYTFHLLPAATYSSQASVYTARSWKYQEERKNRMNAHQSVNPVSVRRNSPAGLVLANGSPTGSAATNGRTENQKILAVRLGCQPYTPAARMV

SEQ ID NO: 178709 - protein, 146 aa, Triticum aestivum
  Clone ID: PAT_TA_73127.pep
MGLLDQLWDDTVAGPRPDSGLGKLRKYASFSPSSSSSTMAASPSPISAAAAAADAPAVTRSITILRPPALSVTSPRGSESGPSTPSSPASVPDSPFGSAPTPKGSEGWKKLRRGGARMADGVDASAGGQPRSPTVYDWVVISSLDR

SEQ ID NO: 178710 - protein, 106 aa, Triticum aestivum
  Clone ID: PAT_TA_73128.pep
ARVFAWRVLELKEQGVSEDDAMAVADMEYRTQKKAKKKAFKELKEIARSEGKKPPPNPYPSAIKEIQAEEKKYVMDRLFNPKVIEIANKMKEERDKLRQERAAGQW

SEQ ID NO: 178711 - protein, 99 aa, Triticum aestivum
  unsure (1)..(99): unsure at all Xaa locations
  Clone ID: PAT_TA_73129.pep
PAHGRVTARVGSDTNCSASATSIGSWPLRLARSRLAPQTNICLFYALCPHSCTPGSNFTVSHPSXQIAPSQACLTLEFFLNXAPEKKEFLVDMSSLSFL

SEQ ID NO: 178712 - protein, 98 aa, Triticum aestivum
  Clone ID: PAT_TA_73130.pep
MSSALGDKIEQMADPLHAMLLDMLPLLGKKGTEDASRAPLPKAEKDPPAGGSSTSNSEILAPDAGTSGVPAPDPNAAPPPKKKKVSYKDAASELLKDW

SEQ ID NO: 178713 - protein, 92 aa, Triticum aestivum
  Clone ID: PAT_TA_73131.pep
ARAFVGRADRLRAVVKAMCAAAKQCMKENNMHLGPWRKHKYMQSKWLGTSEREAPPALDAVAAGSLSSPEKQPKYRASMLSFDFGRAPVVVA

SEQ ID NO: 178714 - protein, 146 aa, Triticum aestivum
  Clone ID: PAT_TA_73132.pep
RWAAQAAGYGDLGRALLDLQAAADQVFDTVSKRTAEEREKLSAISMRIKAAKATDKFPKTKDGTYLENLLQTANHPALGNHLASDTKSDELPPPPPSLLPKHLARTQFVNIDSLPSPVLQFFMSCSCMNAGILNTTAYWEDKIAMS

SEQ ID NO: 178715 - protein, 106 aa, Triticum aestivum
  Clone ID: PAT_TA_73133.pep
LGVGQRRAAPQLRPHPWHGRDFGRSRRRHIYSMGDEGERLAHCNVKRTKWRGGNVLPWQQPRVGGNFYRIWRGPGQPDPGRDGGIKEHTEGRAPPGSVEPCGGSCR

SEQ ID NO: 178716 - protein, 252 aa, Triticum aestivum
  Clone ID: PAT_TA_73134.pep
GTRGKRVTIVGYLKSALDIAAECAEVNGTEIPCTMVVRTKHWIIPDYFAWGVHISKLYLNRFSELLIHKPGEGLLLSILATLLTPLTWIFSKFAESYYSIPMKKYDMVPDHSLFEALITCLVAITPKDHYKRLEEGSIVLKKSKTFSFCKEGVLVEGQSSPIKSDIVIFGTGFRGDQKIKEMFTSEYFQSIAVGSASTTVPLYREIIHPKIPQLAVIGYSESLANLYTSELRAKWLAHFMDGGFRLPSISVM

SEQ ID NO: 178717 - protein, 176 aa, Triticum aestivum
  Clone ID: PAT_TA_73135.pep
MEEFFAGKKFIVTGANAGIGETITKRLVKLGAHVFAVGRDAKKLPPAGPNLTPVCADVGDWNSYDIIKKLGPVHGLVNNAGVAFIESFFDMTQEGWDKTLDINARGIVRISQAVAKNMLDAGIKGSIVNVSSTISERAIPDHTSYCASKGAVNQVTRVMSIELGKLGIRTNNVNPT

SEQ ID NO: 178718 - protein, 102 aa, Triticum aestivum
  Clone ID: PAT_TA_73136.pep
MWVSLYRLFLMLQRFPVESKGRRKKLNEVGYVTAICFGCFLTRCIMMCLSAFNKDADLDVLNHPILNFFYYLLVEIVPLSLVLFILRKLPPKRGIAQYHPIH

SEQ ID NO: 178719 - protein, 143 aa, Triticum aestivum
  Clone ID: PAT_TA_73137.pep
SWWCVDCITHNRYPKENTKCGFYLHPAEGSPAPNITQGKLSAPRILRIHKVANYVVEKLVLDKPDGGSDSAFVMGLSSAQSQLSALDSSSRLGLKSWQKTKPCIEILCNNQVLSPEMSLATVRTYIWKKPEDLILHYRVVQSR

SEQ ID NO: 178720 - protein, 108 aa, Triticum aestivum
  Clone ID: PAT_TA_73138.pep
IAQKFYRNSTPSLALSRCVPISSAKLSPRWLQSLFPLSPQSIPVHNGADYGLAGPTHTPGHRRSAAAVAGSDSTPSQIPNKLSCFLYSDRELHIYFTGATKKELRIFS

SEQ ID NO: 178721 - protein, 160 aa, Triticum aestivum
  Clone ID: PAT_TA_73139.pep
PASSGGVSVSDVLWPSAGAFLAMAVLGKMDQMVAFKGVSLTIAPLGAVCCVLFSAPGSPAAKKYNMFVAQIGCAAFGVLALSLFGPGWLARGAALSASIAFMTITGASHPPAASLPLLFIDGPKFHNLQLWYALFPGAAGCIVLCLIQEVVLYLKKNFKF

SEQ ID NO: 178722 - protein, 52 aa, Triticum aestivum
  Clone ID: PAT_TA_73140.pep
IRHEAEAAAVRSKMVYASSCDGFRKELDGVQVDLQATEPSELTLDVLNDHAS

SEQ ID NO: 178723 - protein, 101 aa, Triticum aestivum
  Clone ID: PAT_TA_73141.pep
SARGQVEVVVLAPLFCFMLMRYKSASSADEDLSVAMLMRMQDPPPPASPSDCRELGRQINYEEVKAELEWGGRQHEGAGDISIFVSHYSGSKLPLSLYHIT

SEQ ID NO: 178724 - protein, 141 aa, Triticum aestivum
  Clone ID: PAT_TA_73142.pep
FFFFFTLEHKYSLWQFKAIIKAQCPGSWATSGLAEHTTGSSGTPRTPICGNVTHTHGSLGGAGLGRARRRPGVGRLVGDGDELRPVPLLRHVLVPVLIHAASAYAAARRPDDGRPDLRHRLGDGDEGLPRGFHLRELCCSG

SEQ ID NO: 178725 - protein, 144 aa, Triticum aestivum
  Clone ID: PAT_TA_73143.pep
GTSSHARTHHQHRTAPPFPQTHPQPQQHISSVRHAAATVATAPRHRPQPLHQPCTLPAGRPSGETGGSNDGEPQQCNNVHVGGVHVLEPPRVPGRRRGMPLRRRFLRAHAAAGQHAAHVQIHRAARGRTPIVALVTVTFGHIPF

SEQ ID NO: 178726 - protein, 170 aa, Triticum aestivum
  Clone ID: PAT_TA_73144.pep
GTRGVRGTMGHIAPEYIKTGRPSVKTDIYGYGVMLLEIVTGERAIAFHPDRMEEAGEIMLIDQVKLWMEEGRLLDLVDRNLGGVYNLEELEKVTQIALLCTHMEPSQRPTMSEVVQMLEGEIVPAERWEEWQLAELQRRQQHEMRQQGKLFNFSEESLNIQEAIELSTGR

SEQ ID NO: 178727 - protein, 103 aa, Triticum aestivum
  Clone ID: PAT_TA_73145.pep
REVEPPSLPASSAVVEVQQRRRRQVLDPVGSGAGRRPRRLVFFLSNPPPPSFCSCYVSFSLPAAGAVIAAPSPPHAVLPRASPATTSSSVGSQWEGGPRPNPA

SEQ ID NO: 178728 - protein, 56 aa, Triticum aestivum
  Clone ID: PAT_TA_73146.pep
DFTFVSLQLGLWSGGFTCVSLFLGLLDWNPCPVKLYIPYVWSVVNQLFMPCRIHTR

SEQ ID NO: 178729 - protein, 33 aa, Triticum aestivum
  Clone ID: PAT_TA_73147.pep
IRHEERERGRSSALGSLDADGGGLQRNKRRRIN

SEQ ID NO: 178730 - protein, 49 aa, Triticum aestivum
  Clone ID: PAT_TA_73148.pep
MMSLCYVNYFFHHEFCVGRSIIGGFTLYMLLTRQKHFSVEPPLWIYDTL

SEQ ID NO: 178731 - protein, 68 aa, Triticum aestivum
  Clone ID: PAT_TA_73149.pep
FFLISITHNTFQCILDHCLSKRMKREQSICNSDSKQKTKKKNFPIVSRKAETLTLPVDDVFLDKENTE

SEQ ID NO: 178732 - protein, 91 aa, Triticum aestivum
  Clone ID: PAT_TA_73150.pep
SNTLLTYIKTPNFMYALSPIPNHKFFSVCLDLGQTKSNKQGPQIRYEICSSHHSCSSRVVSSASTTKDAVTVTEQDQERAGLDLGPAHPRA

SEQ ID NO: 178733 - protein, 60 aa, Triticum aestivum
  Clone ID: PAT_TA_73151.pep
CRNCRVQDLPNAMNAAEITDKLGLHFLRQGHWYIQSTCATSGEGLYEGLDWLSNNIANKA

SEQ ID NO: 178734 - protein, 128 aa, Triticum aestivum
  Clone ID: PAT_TA_73152.pep
LLALHGWISGICLQLDRYYAPGRQRQMLQRAIDRWMDRYRYTSVVWAARAGERPHQAPPQRPQRRGAPPPRPHRHRRSRRRRPCRPLLPPPRRQRHQRRHDAGPLPSRVILWTTMICARPAAVELDQL

SEQ ID NO: 178735 - protein, 234 aa, Triticum aestivum
  unsure (1)..(234): unsure at all Xaa locations
  Clone ID: PAT_TA_73153.pep
SGQVILPLAHTFDPEXFLEVIKLGNASNYQDALLHRDLFLLQMYNGVDENMVGTCSELIFAPIDASFSDDSPLLPSGFRIIPIDAPLDTSSPKCTLDLASTLEVGTPRSRINGSGPGNAASAGSKAVMTIVFQFAFESHLQDSAAAMARQYMRSIIASVQRIALALSSSRLVPHGSSISHTPASPEATTLARWICQSYRFHFGAELIKSGDGSGCEGVLKTLWHHASAILCCSL

SEQ ID NO: 178736 - protein, 104 aa, Triticum aestivum
  Clone ID: PAT_TA_73154.pep
RHEALILLILGVSLDLFGMHMNKSLYSLSYTCVTTGSAGLFFAGIYLLVDVYFYKKPFFPMEWVGKHALMFFVLVACNIAPILIHGFYWREPQNNLLKFIGIGG

SEQ ID NO: 178737 - protein, 129 aa, Triticum aestivum
  Clone ID: PAT_TA_73155.pep
GTRLPPQPRCSLPLLRSILEHRLSQLTLSSLVGLGHEPVSRHRAPPWPPWEPAHVARRPQTFSGQAADTSASARASGCSPTLSLAANKRPPAGNQVFSDILCSGIATRDFARQFEVLQGSNCTDCDSGE

SEQ ID NO: 178738 - protein, 260 aa, Triticum aestivum
  Clone ID: PAT_TA_73156.pep
SARGADIWSCGVILFVLLAGYLPFHDKNLMDMYKKIGKAEFKCPCWFSTDARRLLLRILDPNPSTRISMEKIMENPWFRKGLDAKLLRYNLQSKNAPQVDKNADSDSLSINITAESKQQEEKKPTNMNAFDIISLSTGLDLSGLFEESDNKREYKFTSTNTSSTIVSKIEDVAKNLRLKLTKKDGGLLKMEASKPGRKGVMGIDAEIFEVSPNFHLVEIKKTNGDTLEYQKVLNREMRPALKDIVWAWQGEQSKQQQTMI

SEQ ID NO: 178739 - protein, 89 aa, Triticum aestivum
  Clone ID: PAT_TA_73157.pep
CHRLQTSSPKNVKSKKKHSFMGLISVYQQNNQWFCWMASQAPIIRFEKRCIMQLEKNNHQHMHTPWCITSTRTHHGAPYGVLYICLVPN

SEQ ID NO: 178740 - protein, 252 aa, Triticum aestivum
  Clone ID: PAT_TA_73158.pep
MLRPRDPMQMLRPGQNSEEHRQMMMPEFQLQVSQGNNHAVHFNGPPYSNTGASSPVQSFPVQQSQPHQMPQQSHMYGNTHLPHTQGTNQSNPQQQQAYAMRLAKERHIQQMMPQQQRPLSGASAVPAVQNGSQMQQQSQGSATGVIPATQPQHKQQHPAQNAQGNPMLPHQPSATTSHKQKKQQGQQQPRQNQQQRNQGSQQAKLMKSLGRGNMVHQSPVDVTQASGISTSCKNQVSDKNVMQQGPGHFVGG

SEQ ID NO: 178741 - protein, 113 aa, Triticum aestivum
  Clone ID: PAT_TA_73159.pep
SELLCSSSYIDTLLPKSSLGASFSPSSLTGAAVTTSVSIGPASEVAAVTTSVSIGPEASEVKASTGAGGKSCSSILLASIVPSLTSAGVKSEFTSIASLTMTASLVSMSEVFS

SEQ ID NO: 178742 - protein, 101 aa, Triticum aestivum
  Clone ID: PAT_TA_73160.pep
RLVLQNFLHFQSRCRLRAPQPAQRLGEKDGNQFPMSQHDQVDMQPTEAFAWSGEEKENCCVTHELHHELLLCFVSRMHYFLHALLKKPSKEITLQKCSNLL

SEQ ID NO: 178743 - protein, 232 aa, Triticum aestivum
  Clone ID: PAT_TA_73161.pep
ARASGTVGHSSIIWEAYENPDVKLNFPCRAWVRVMRPFHPTEFVQSMVKQFHTAVGVGVLLEGERKEQDLAQAFNGYVNENRYLIVLTGLSTIEEWHQIKTCFPENKLGSRIIVSTEHVEVASLCPGRESTVSELKQLSAEQTIYAFYRQSSHAVTYPSKPTSRSKLSNIPENEIQEDQSNADVDGNMIAQKKLTRAYTMAGVLEEFQFIGRKQEKEDIIELIVKQDSTHQV

SEQ ID NO: 178744 - protein, 209 aa, Triticum aestivum
  Clone ID: PAT_TA_73162.pep
MSLPQIMKVTELPKLKAWPKSWEKASVPSAESIGLFFFSQNTRSNKEFDDLVKHVIDYDIVLETDVSFAKLLVFPSVVLPAEYRVFQGKHYLWGVFKRSKDMAERDALVEQNCTTCLADEDVPEQNALDIVPCKALDQEMALVVSDIHHDNQPSLTTSQVVESEASSDKGPSHPVINSPERPMYLILDTSCKVLKKWSCERMDTKLSML

SEQ ID NO: 178745 - protein, 61 aa, Triticum aestivum
  Clone ID: PAT_TA_73163.pep
ARGYKATKNELNLGRILHDPKRSGFNQLAMDESDNEAELINGDIHSESEVEEFNVSSVRKI

SEQ ID NO: 178746 - protein, 77 aa, Triticum aestivum
  Clone ID: PAT_TA_73164.pep
SCGGLDVRGNVSYAFNQLFQSASQQKGSCGFNNLSVVTTTDPSQGTCRFKIMIDTGRHDLTHQDDSGAAKAAAVVAL

SEQ ID NO: 178747 - protein, 148 aa, Triticum aestivum
  Clone ID: PAT_TA_73165.pep
LQTANATVDPRALAIFEHASKLVGIDEPKAEIIKLLREEDVRASEQQQQLKIVSIVGSGGMGKTTLANQVYQELKGQYECWAFVSVSRNPDMTNILRTILSEVAKKDYATTEAGNIQQLVSKIVDFLADKRYLLSFIFFHFYLSSLNV

SEQ ID NO: 178748 - protein, 68 aa, Triticum aestivum
  Clone ID: PAT_TA_73166.pep
HAAPVLIARGLRKQVIFKRTKFGPCMHARYAIPMYDYLYQYILIQRCLQRGGGVSSSPPSKDMPGRTG

SEQ ID NO: 178749 - protein, 199 aa, Triticum aestivum
  unsure (1)..(199): unsure at all Xaa locations
  Clone ID: PAT_TA_73167.pep
EHFLAMDQANGGCSPCIDDMMASPSMIPITAVAKLLDGYLAEVAPDVNLKPPKFQALASALPEYARPLDDGLYRAIDVYLKAHSWLSEAEREQLCRLMDCQKLSLEACTHAAQNERLPLRVVVQVLFFEQLQLRTSIAGCLLVSDNLEGSSRPLRSGCVAMSGEAXGWSAAVRENQVLKVGMDNMRMRLAELEKECSDM

SEQ ID NO: 178750 - protein, 120 aa, Triticum aestivum
  Clone ID: PAT_TA_73168.pep
ARGPRPAQANAHGREETCPSLVADETAAVHFLLWGTECDAFEPGDIVRLTSGIFSYHRGNNLFLRAGKRGRVEKVGEFTMMFVETPNMSEVRWGPDPGDPRKMVQEAVVSPYSQVFKPLH

SEQ ID NO: 178751 - protein, 105 aa, Triticum aestivum
  Clone ID: PAT_TA_73169.pep
SSRDDDDSEMYRKEEKEHQHKEHLGEMGALAAGAFALYERHEAKKDPEHAQRHKIEEGVAAVAALGSGGFAFHEHHDKKEAKDAAEDAEEESGRGEGKKKHHFFG

SEQ ID NO: 178752 - protein, 166 aa, Triticum aestivum
  Clone ID: PAT_TA_73170.pep
KLHPGTNLSELSKTADGIKVVTDKGEELIADVVLFATGRTPNSQRLNLQAAGVEVDQIGAIKKTVFGGQEVKPDYGDVPCAVFSRQEKTVMKLVVDAETDRVLGASMCGPDAPEIIQGIAIALKCGATKANFDSTVGIHPSAAEEFVTMRTVTRRVSPTSKPKTNL

SEQ ID NO: 178753 - protein, 78 aa, Triticum aestivum
  Clone ID: PAT_TA_73171.pep
GAFVMDPWWNPAVEEPAVMRIHRIGQTKTVSIRRFIVKGTVEERMEAVQARKQRMISGALTDQEVRTARIEELKMLFS

SEQ ID NO: 178754 - protein, 207 aa, Triticum aestivum
  Clone ID: PAT_TA_73172.pep
GTRVHCRAGFLTPVRNLLGLVRGPKYDGVFLHDKIKSLTHDVKVADTVTNIIVPAFDVKYLQPIIFSTYEAKADTLKNAHLSDICISTSAAPTYFPAHFFKTEATDGRSREFHLVDGGVAANNPTMVAMSMLTKEVLRRNPDFNAGRPTEYTNYLIISVGTGSAKQAEKYTAPQCAKWGLIQWLYNGGFTPIIDIFSHASSDMVDIH

SEQ ID NO: 178755 - protein, 223 aa, Triticum aestivum
  Clone ID: PAT_TA_73173.pep
IRTRLANDTQGTVEAAKWLHKVVDRPNVYIKIPATAECVPSIKEVIANGISVNVTLIFSIARYEAVIDAYIDGLEASGLSDLSRVTSVASFFVSRVDTLIDKMLEKIGTPEALALRGKAAVAQAKLANQLYQKKFSGPRWEALVKKGAKKQRLLWASTSVKNPAYPDTLYVDPLIGPDTVSTMPDQALLAFIDHGTVSRTIDANVSDAEGVYSALEKLGIDWD

SEQ ID NO: 178756 - protein, 116 aa, Triticum aestivum
  Clone ID: PAT_TA_73174.pep
LPTFKVRKEKLGDRITALQQLVSPFGKTDTASVLHETIEYIKFLHEQVGSLSAPYLKNRQQVPHHKVLRDGGEAAAANGELTGRGLCLVPISSTFAVASETPLDFWTPFGGPAAFR

SEQ ID NO: 178757 - protein, 164 aa, Triticum aestivum
  Clone ID: PAT_TA_73175.pep
GVLRGAGLGAFAGAVLSIEVLEASRAYWCSDRLGSHGTSSMADFIEQLLQARFVQEQIVPSGYATHRWQVSISDFGHDDLYDIFGDCSSKGLSRESLNKLPHYVVTDQTRNSFGEDLSCTICLQDIVTGETARRLPNCSHTFHQPCVDKWLVGHGSCPVCRQCV

SEQ ID NO: 178758 - protein, 64 aa, Triticum aestivum
  Clone ID: PAT_TA_73176.pep
YLLPRLCAQLYTPNCQLSVWKYVMLVKYYYDVSSIRLENSLSNLSEISSCSCPEFTALVRLNIN

SEQ ID NO: 178759 - protein, 165 aa, Triticum aestivum
  Clone ID: PAT_TA_73177.pep
AKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIVQVQAKKKSSLNYYA

SEQ ID NO: 178760 - protein, 219 aa, Triticum aestivum
  Clone ID: PAT_TA_73178.pep
DPESHVLLVDSFLKKNEPADAKTALDSMMQHGHLPSPALFKSVMEALFNDGRIQTASRVMKSMIEKGVTENMDMAHKILEALFTRGHVEEAIGRVNLMVENGCMPDLDKLLVGLCDNDRVMEAQKLADFALDRDFDVSFSTYDRVLEALYAEEKTLPAYSMLCKIKNKGGVVDQKGCDALMESLKSEGYSKQADILSRILAENSQSMSKRGGKKVAMGA

SEQ ID NO: 178761 - protein, 107 aa, Triticum aestivum
  Clone ID: PAT_TA_73179.pep
YHLHVIDSGHPGSCLVESDNTFLFKKEEFGCGEPADLENWKVVMASRRHTMDVLQKTHAKMSSMWLCAQENAVSPYNPISLLCRLQVPLDSPFLHPIEDKERHVFQF

SEQ ID NO: 178762 - protein, 107 aa, Triticum aestivum
  unsure (1)..(107): unsure at all Xaa locations
  Clone ID: PAT_TA_73180.pep
GTRQPPMLLELARFYRAEVAARGXQSHFSVWLSPGGLPAEWVKHLGRSFRSLLRRTRDMRLRLQLATLATGFIDVLDICNRVLDKVPDNAGPLILRKGHGGAYLPLM

SEQ ID NO: 178763 - protein, 161 aa, Triticum aestivum
  Clone ID: PAT_TA_73181.pep
ARVTMKILKEFKAHGSAVTSFALHPTQPFVLSASRDQLIKLWNLEKGWVCIRTFTGHSATVNQVKFNPHDNNTFASASGDGTVKTWGIFSPTHFTSLNCQEGQRSVDYYPTGGDQQQQHYMVTGSEWQLRPDNATARIWDLRTQTCIREIKGLESYCEVGV

SEQ ID NO: 178764 - protein, 189 aa, Triticum aestivum
  Clone ID: PAT_TA_73182.pep
MARHSLFFFPALFLYVTPEGRSLSEIASLFNGSTSPTQPIKRLSGSEDLLIRVPCVRDAINVTMSGLFHDTEYKVNLNDTADNINSNFSGLAWNIIVTANKTITVHLLCGCSSTGPEGVLSYTVQPDCVEGGLTMPEESVAEPAEPVGEEPEHAASKHRRRVIFCSVRSSTEEVDVEAPGNEEPEAARA

SEQ ID NO: 178765 - protein, 77 aa, Triticum aestivum
  unsure (1)..(77): unsure at all Xaa locations
  Clone ID: PAT_TA_73183.pep
EVGFFATXLFLKDPHTLFKRVNHAETQRKRIVHQRLSLNDVKFVKNAMKCVRAFVFSFSLRCSMQYSEWHVEMFSIL

SEQ ID NO: 178766 - protein, 224 aa, Triticum aestivum
  Clone ID: PAT_TA_73184.pep
LYILHQHRLLKLYINYRTLLLPAALILHHLIIIIIIIIIRDLILILSISEIFLLSDKGIPVLTILGLEKPPSSVDFAELWGTPGKLLVREVCADREGTCGHVIDVLLRQLDLDNLLPLIPHPGCLRVLLLRLRGLPASQEPVIPRRLRLLLQPQDPTLLRSYRLLLHLETSVTSPHRSRPHIETSPHRSSLNHEIADTIPNRSSLNLEISVTARHRSSRDRLVP

SEQ ID NO: 178767 - protein, 84 aa, Triticum aestivum
  Clone ID: PAT_TA_73185.pep
DQLGCIPEGVNLLVQLEIDLYLVSVFAFGFAGCSSFVCSSILAALLACFSSLTQVLRSLVLLRPDLLLCFISVLSSRLACFLSS

SEQ ID NO: 178768 - protein, 167 aa, Triticum aestivum
  unsure (1)..(167): unsure at all Xaa locations
  Clone ID: PAT_TA_73186.pep
MKFLSPAVLLLLLLLQGNGQRAIETFSATDLRDCPVARLQPWLGISVTEFKRKVAEYRASTKPVVPGADATDTGTPADDTPAAVVAADDEPSGEQQEEEEEPAALVTCSPESTLGEAIEAVASRHVHXLWVVDEEGLLHGVVSLTDILRAVRDAALGEDRELHSIVS

SEQ ID NO: 178769 - protein, 177 aa, Triticum aestivum
  Clone ID: PAT_TA_73187.pep
TTIIFPEDHIMPRLFTPSLAKKYEELYQQNGVKFIKGALIDKLEAGSDGRVSSAVLKDGSVVEADTVIVGIGAKPVVSPFEAVGVSAEVGGIEVDSLFRTSVPGIFAIGDVAAFPLKMYDRVARVEHVDHARKSAHHCVETLLTSQTKAYDYLPYFYSRVFEYEGSARKIWWQFYGD

SEQ ID NO: 178770 - protein, 72 aa, Triticum aestivum
  Clone ID: PAT_TA_73188.pep
LDAKQSKYWHVASANFTANIGPSLDDRNSDKLKNTFCRFNLLKELQLHTKFDVKVGQIARSSISTVAPLHHL

SEQ ID NO: 178771 - protein, 81 aa, Triticum aestivum
  Clone ID: PAT_TA_73189.pep
LQDGRWMPARIRRLRPWHPQGGAATTLDPSVGAADSAWTDMLPLPCRLHAMVSSLLPASYSSWPETIVGLEINFFSLICKI

SEQ ID NO: 178772 - protein, 259 aa, Triticum aestivum
  Clone ID: PAT_TA_73190.pep
RHEGIQIRLDSGHKTCPKTQQLLSHTSLTPNFVLKSLIAQWCEANGIELPKNKANSRDKKAAKSSDYDHAGLVSLMNRLRSGSQDEQRAAAGEIRLLAKRNVNNRICIAEAGAIPLLVNLLSSSDPRTQEHAVTALLNLSIHENNKANIVSSHAIPKIVEVLKTGSMEARENAAATLFSLSVVDENKVTIGGAGAIPPLINLLCDGSPRGKKDAATAIFNLCIYQGNKIRAVKAGIVIHLMNFLVDPTGGMIDEALTLL

SEQ ID NO: 178773 - protein, 182 aa, Triticum aestivum
  Clone ID: PAT_TA_73191.pep
VGLDQNVDESDLDKLPFLKCVIKETLRLHPPIPLLNHENAEDCVVGGYSVPRGSRVMINVFAIGRDASTWKDADAFRPSRFMEGEGEAAGVDFKGGCFEFLPFGSGRRSCPGMALGLYSLELIVAQLAHGFNLALPDGMAPSELDMRDVFGLTVPRATRLCVVPTPRLTCSLVADDDAAHQA

SEQ ID NO: 178774 - protein, 88 aa, Triticum aestivum
  Clone ID: PAT_TA_73192.pep
RCQPWDLTYERIRLIDRPAARTMVVLTSFPAHRRWPNVPGPLLRRMSWVLSPYVKKVTSTAIPSSRTHSAFTSGRTTEVHGKIVSIIL

SEQ ID NO: 178775 - protein, 51 aa, Triticum aestivum
  Clone ID: PAT_TA_73193.pep
PIKHTDLKCRDEREREAHDLHHDLSWATLAIVSPHTICPMDKTPKEKLAKK

SEQ ID NO: 178776 - protein, 203 aa, Triticum aestivum
  unsure (1)..(203): unsure at all Xaa locations
  Clone ID: PAT_TA_73194.pep
MATAYAPMASQVMKSSLQLHSKPRGLSGAALTTTRRPRFTVKAIQPEKATYQVVQPINGDPFIGSLETPVTSSPLVAWYLSNLPAYRTAVSPLLXGIXVGLAHGYLLVGPFALTGPLRNTPVHGQAGAPXAAGLVAILSVCLTMYGVASFNEGEPSTAPTLTLTGRKKEADKLQTADGWSKFTGGFFFGGISGVLWAYFLLYV

SEQ ID NO: 178777 - protein, 99 aa, Triticum aestivum
  Clone ID: PAT_TA_73195.pep
GTRFEALVKKMNAEGAALQGSGWVWLALDKEAKKLSVETTANQGPLVTKDASLVPLLGIDVWEHAYYLQYKNVRPDYLNNIWKVMNWKYAGEVYENVLA

SEQ ID NO: 178778 - protein, 201 aa, Triticum aestivum
  Clone ID: PAT_TA_73196.pep
STLLLDILMAADKFEVVSCMRYCSQLLTNLPMTTESALLYLDLPCSISMAAAVQPLTDAAKDFLAVKYKDLTKFQDEVMNIPLAGIEAILSSNDLQVASEDTIYDFLLRWARAQYPKSEERREILSSRLLPLVRFSHMTCRKLRKVLTCTDIDHEQATKCVTEALLYKADAPHRQRALAADTVTCRKFAERAYKYRPLKVV

SEQ ID NO: 178779 - protein, 139 aa, Triticum aestivum
  Clone ID: PAT_TA_73197.pep
DSKQVVKMVKIQPRNGGIFSFEHQWTSVSSQLPVPGFRLRFFLSVRPLPRSAPVSSVGCRLSQLWRPPLFARPASDELGRPRLIRPPVACLMPARDQRQPGAAPPEAPLRCLPATSRIRIRGGSAGVPFLSHSVESVSV

SEQ ID NO: 178780 - protein, 176 aa, Triticum aestivum
  unsure (1)..(176): unsure at all Xaa locations
  Clone ID: PAT_TA_73198.pep
ISAGSTTESLSVKRAFXAILRSDVVALVIXAMACVTEQDYKIAQRIDKEGKACVIVVNKWDTIPNQNHESTTHYEQDVIEKLPILDWAPIVYCSATNGTSVKKIISAAALVENERSIRLGTSILNQVIREAIAFKPPPRTRGGKRGRVYYTTQAAIGPPTFVLFVNDAKLFPDTYR

SEQ ID NO: 178781 - protein, 114 aa, Triticum aestivum
  Clone ID: PAT_TA_73199.pep
RHEALVGPAGALPSQHSRQYAINLAEGSSSSGRDSNRKWESQGLDLNSGPGSIDLEGKDERMPLPVRQNLIPPPHGFAEDQGRIYQMPVVGTKRKEPDGSWDSERSTYKQLSWQ

SEQ ID NO: 178782 - protein, 114 aa, Triticum aestivum
  Clone ID: PAT_TA_73200.pep
MLCTAGHAGQLALHSAAGEAGKQVAEEASFLVATRRRRLVLTTGSRSALFGLCIRSSISLFVLVVGRTADEVASRSLRVAHGWWICGRSGACAAPLPAAKAEAREDDDQDQASC

SEQ ID NO: 178783 - protein, 111 aa, Triticum aestivum
  Clone ID: PAT_TA_73201.pep
MFERKKKKIDPSKSISKSTQNTLLILYFLAKIEKIHLQQLLNPTPNFWQLVKNMSARVKLRARSSRVGYPPLESSSASRAWSLQVHRLTCLDPAASRRRSTLPPRHAQPHR

SEQ ID NO: 178784 - protein, 116 aa, Triticum aestivum
  Clone ID: PAT_TA_73202.pep
GTRAARNTIINEVSGVFKPYGIDVDMRHLSMIADFMTLDGGYRPMNRIGIGQFSTSPFGKMTFETATKFIVEAATHGEADFLECPSASVCLGKPPKVGTGIFGLLQNLELEQPMET

SEQ ID NO: 178785 - protein, 247 aa, Triticum aestivum
  unsure (1)..(247): unsure at all Xaa locations
  Clone ID: PAT_TA_73203.pep
PMWNQLTVPEASLYSWDPNSTYIHEPPYFKDMTMXPPGPHGVKNAYCLLNFGDSITTDHISPAGSIHKDSPAAKYLLERGVDRKDFNSYGSRRGNDEVMARGTFANIRIVNKFLNGEVGPKTVHVPTGEKLYVFDAALKYKSEGHDTIVLAGAEYGSGSSRDWAAKGPMLLGVKAVIAKSFERIHRSNLVGMGIIPLCFKAGEDADSLGLTGHERYTIDLPTNVSEIRPGQDITVTTDNGKSFTCTL

SEQ ID NO: 178786 - protein, 149 aa, Triticum aestivum
  Clone ID: PAT_TA_73204.pep
RHEASSSLTPDFEAPTSKMRAALPKQVAVHQHVRNSSQAAALVAAVLQGDATLIGSAMSSDGIVEPTRAPLIPGMAAVKAAALEAGALGCTISGAGPTAVAVIDGEEKGEEVGRRMVEAFANAGNLKATATVAQLDRVGARVISTSTLE

SEQ ID NO: 178787 - protein, 136 aa, Triticum aestivum
  Clone ID: PAT_TA_73205.pep
CHALRRQSPEWLQLWEPALCSIRWIQLWLKMPIWNGGCAIMPWLVLGASQRWGSRVVQVVVGSHWSGLRESVKSVPVSNRVSPRAASPVVQLGQWSVFKVSGLDHLGSLLPPPPNGGRHGVAGVVGSLGFASSYIA

SEQ ID NO: 178788 - protein, 102 aa, Triticum aestivum
  Clone ID: PAT_TA_73206.pep
QVRGRRIVAILARCYSASRRHPPLRQHSSKLELRPAVEQGYNSVKMVLTGGGLIAQLSRLQLRRVNRRMGHWRAGCRWRKTMSKCHLLDMRGDLKSDRTINN

SEQ ID NO: 178789 - protein, 194 aa, Triticum aestivum
  Clone ID: PAT_TA_73207.pep
MPALAKPASRPAKTAAAPKPKPAAAKPKAAAAGASHPPYFEMIKEAISALKERTGSSSHAIAKYMEDKHGASLPANFKKMLSIQLRGFAAKGKLVKVKASYKLSDAAKKAAPKPKAKLAAAKTAAPKPTKKDAAKPKKTAAAAKPKKAAAGTKRKAPEKKKVVAKPKKSPAAKAKAKPKTVKSPAAKKARKVAA

SEQ ID NO: 178790 - protein, 242 aa, Triticum aestivum
  Clone ID: PAT_TA_73208.pep
NRSASPLRPPAARPAKEVIPQFYFQDGRPPPYEVKKQCISTVDQLFAGHSNGLRAPEFRMVTRELCKLPTFFTTVIFDKIDKESTGFVTRDAFIDFWVNSNLMSMDSATQVFTILKQQNRNYLTKEDFKPILKDLLDNHPGLEFLKSTPEFQERYAETVVYRIFYSLNRIGSGHLTLRELKRGNLLNALRHADDEEDINKVLRYFSYEHFYVIYCKFWELDTDHDFFIDKENLIKYGNHALT

SEQ ID NO: 178791 - protein, 107 aa, Triticum aestivum
  Clone ID: PAT_TA_73209.pep
NQGTPLKPNVPVDVYVFALFNEDMKPGPASERNYGLFYPNGSPVYALNSAGSGGGSSPGGSLNPYYTSMFSSSSRSAVSATFLTERVILLLLLQAIVILRQSYSLYC

SEQ ID NO: 178792 - protein, 109 aa, Triticum aestivum
  Clone ID: PAT_TA_73210.pep
PNTSFTASFMPSSLFCADSSLVFVTLALPFFNCVLQFPHFGLPSGASYLLWIKTKKVCCSVFLPKENLSEQTCLAERLLPPDYASLCARLGDAMQASLYFGMEKKKKKK

SEQ ID NO: 178793 - protein, 134 aa, Triticum aestivum
  Clone ID: PAT_TA_73211.pep
RGGSPNSPANRHGMRPPLPSSLPAPRLLQPCSPATTAVQSAPVAVQLGQVRKRIEVPCSCACCSMNTTALQLLDGGLRKVRGSSDVLRWPSPSLCVARCLIPDTGGAKRGGEGGNLPLRLCLSSRVCLKFTVSC

SEQ ID NO: 178794 - protein, 125 aa, Triticum aestivum
  unsure (1)..(125): unsure at all Xaa locations
  Clone ID: PAT_TA_73212.pep
GTRVVPIFXGECGACAYCESDKTNLCGTYRVNPFKSTMSSDGGTRFSVVDRNSGLRQPVYHFLNTSTFAEYTVLDAACAVKINPKAPLHKMCLLSCGISTGTRVSVYIPPLVIKIEGLVYIRPKT

SEQ ID NO: 178795 - protein, 89 aa, Triticum aestivum
  Clone ID: PAT_TA_73213.pep
WAPSADDAAFMSTSSSISSSVASTRGTDRSSWGAGRSRTERAAVKASLVVQETAAKGAVESPVSVQDRWFSERSSPSSNSLLGNNCSLH

SEQ ID NO: 178796 - protein, 61 aa, Triticum aestivum
  Clone ID: PAT_TA_73214.pep
FYQLINKMGACIILMQRPGDNLLFEKKTQRILPLKRTCSFAPFLLLRDYTEHLFSFLLLAL

SEQ ID NO: 178797 - protein, 206 aa, Triticum aestivum
  Clone ID: PAT_TA_73215.pep
SARGLITEFLRGGDLHQYLKEKGALNPLTAVSFALDIARGMAYLHNEPNVVIHRDLKPRNILLVNSAANHLKVGDFGLSKIIRAQHANDVYKMTGETGSYRYMAPEVFKHRKYDKKVDIFSFAMILYEMMEGDPPFSSYEPYEAAKYVADGHRPIFRKSHTNELKDLVELCWSGDISLRPSFLEILKRLEKLKEHYSHENHWHLFQ

SEQ ID NO: 178798 - protein, 69 aa, Triticum aestivum
  Clone ID: PAT_TA_73216.pep
DPAEADKLMKIQRDLDETKIILHKTIESVLARGERLDSLVEKSSDLSAASQVILSLLRRINYFLLAVKA

SEQ ID NO: 178799 - protein, 114 aa, Triticum aestivum
  Clone ID: PAT_TA_73217.pep
GTREMSYQKVPPEEPYPPPGYPRPPPPDVYPPPPWGHGHPPPPPPPQGPYYPPPQHPPPGYQGYFNDPPPHGEYQQQHHHNHGNQGSSSSSGFLKGCLAALCCCCVLEECCGCF

SEQ ID NO: 178800 - protein, 182 aa, Triticum aestivum
  unsure (1)..(182): unsure at all Xaa locations
  Clone ID: PAT_TA_73218.pep
GTRKRMVKHVSFIVGCIILSLSATLIVPTNSLPIEESGQKETNFSGSRSKRQVAQASSSANSAAKATASTQTVSNPLLLSALLPLLTKGSQIPPPMATGGSAGPPGLAGLAGLPGLLLGLNPVLGGLSGVLGNLGGTVNNLVDKVETAAPVVSPITDLLQQIIAALLGGXWRNGHATHACYD

SEQ ID NO: 178801 - protein, 191 aa, Triticum aestivum
  Clone ID: PAT_TA_73219.pep
YGAQCSQFVKRRLCENLLRDSRFRTDAVQALHSAFLATNSQLHADSLDDSMSGTTAITILVRGKTLYIANTGDSRALIAEKRGEYIIAVDLSIDQTPYRTDEVERVKECGARVLTLDQIEGLKNPDVQCWGNEESDDGDPPRLWVENGMYPGTAFTRSIGDSVAESIGVVANPEIFILELSASHPFFVIAS

SEQ ID NO: 178802 - protein, 198 aa, Triticum aestivum
  Clone ID: PAT_TA_73220.pep
MAPSAAAAAAATASPLSRLLLSLPNPSVKPPVSSPSRNAGAAVAAKNSTPVVALRRREAVAAVLSAAILSRVLPAAAEASGGECPLEVAPNGLAFCDRVVGTGAAAEQGQLIKAHYTGRLEDGTVFDSSYKRGKPLTFRVGVGEVIKGWDQGIVGGEGIPPMLAGGKRSLRLPPELAYGARGAGCRGWEPTSCVIPPN

SEQ ID NO: 178803 - protein, 114 aa, Triticum aestivum
  Clone ID: PAT_TA_73221.pep
SASATPAENSGVAKLDLDRAGTGDCTVARRDFGPSCFAGEPFFVPDDVEGNGNEDDGYLVCYVHNERTGENLFVVMDARSPQLDIVAEVELPTRVPYGFHGIFVTKAELQAQQQ

SEQ ID NO: 178804 - protein, 112 aa, Triticum aestivum
  Clone ID: PAT_TA_73222.pep
STSYFLPNAGHCPLSSLISGMENPLLRLSASPQPLAGAAGHIQHLPSMPLQLPASTSIAFSRSSGHLHGCTPTVRSIDPTDTRYFSFFCSFGVPSSTNVKVLVQMLLMFCTF

SEQ ID NO: 178805 - protein, 224 aa, Triticum aestivum
  unsure (1)..(224): unsure at all Xaa locations
  Clone ID: PAT_TA_73223.pep
MATLTVPAAVPPVAEDCEQLRKAFKGWGTNEKLIISILAHRDAAQRRAIRRAYAEAYGEELLRALNDEIHGKFERAVIQWTLDPAERDAVLANEEARKWHPGGRALVEIACTRTPSQLFAAKQAYHERFKRSLXEDVAAHITGDYRKLLVPLVTVYRYDGPEVNTSLAHSEAKILHGKIHDKAYSDDEIIRILTTRSKAQLLATFNSYNDQFGHPITKDLKADP

SEQ ID NO: 178806 - protein, 96 aa, Triticum aestivum
  Clone ID: PAT_TA_73224.pep
MTWQVCNLAWSKNVNELVSTHGYSQNQIIVWRYPTMSKLATLTGHTYRVLYLAISPDGQTIVTGAGDETLRFWNVFPSPKSQSSDSLSCIGGTSFV

SEQ ID NO: 178807 - protein, 199 aa, Triticum aestivum
  Clone ID: PAT_TA_73225.pep
RHEGRHLKLPLTQIFSAQDNGPVRGKDLLQDPEDLGLFASLIGEREKHKESVEYKRAAEEEWASRQRQLQIQAEEAKKLRKRKKAEAQRLLDMEKRQKQRLQEVRESQRKNEEAIQLKEQYRGVVRKELEDLERRHWDMTSILHALGISVEGGEVKAFKQALLKFHPDRVSRNDIYQQVKAEETFKFISRLKEKLPRLS

SEQ ID NO: 178808 - protein, 129 aa, Triticum aestivum
  Clone ID: PAT_TA_73226.pep
GTRDVWQLQQSVAPRTADPQGLWSKCRTNHAFCNSNQLQFLQGFRNQMLDAVKGFSASRRNGLFINSCFAHCQSERQDTWYANNSPRLGNKKIADAVGDWFFERGDAKYTDCPYPCDGTCHHLVFRGDH

SEQ ID NO: 178809 - protein, 106 aa, Triticum aestivum
  Clone ID: PAT_TA_73227.pep
GTRRTPRGPNLLAVCCHILAASPVSQRNLDAIPPSRRHEQLHRKLRTRHICLRRFACRAPVRSVDPRGQSCCVRIEAACDLSHWWKRGAKGRMFSAVVAPFLFASD

SEQ ID NO: 178810 - protein, 111 aa, Triticum aestivum
  Clone ID: PAT_TA_73228.pep
FFFFFFFFCIQVKKKLTVSSYIPIHPCAEELHLYTVLITAEVKQGPHHLHNHACRRRREEDRMHRSIGAIYIYIWIFINQLLLEVVGEVEHVEEEVSPEHAGDAAEEASCR

SEQ ID NO: 178811 - protein, 123 aa, Triticum aestivum
  Clone ID: PAT_TA_73229.pep
SYGRKSSRSDDADPILPSFCLRRPPAPPAKSFSLHRRCHPSPPAKILCPVMATAQRSVSTSGKIDYPSWLPSPHTNNNELAVTFLVLRARLALSSSLSTTNISFSPLFDASVSTDEVAPDPRT

SEQ ID NO: 178812 - protein, 66 aa, Triticum aestivum
  Clone ID: PAT_TA_73230.pep
RVHVCISTNNKIKRQARLCSQERNANLFLFTKFFCWIIPLLSQICTHLFMPRHKMITFSQIDPLFL

SEQ ID NO: 178813 - protein, 107 aa, Triticum aestivum
  Clone ID: PAT_TA_73231.pep
RHEAVASNLVPGLMRNLMYEGENALLNEKLLPLMKWLFCQPNPIALNTALAQLGVARPVFRLPYVPLLLEKRIEFVRIVEAIGRGNFVGQKEARVLNDDDFVLISRY

SEQ ID NO: 178814 - protein, 89 aa, Triticum aestivum
  Clone ID: PAT_TA_73232.pep
FCFRLPLVEEIITNYTLKSQESETKYIPDCLHWLHRRIKECSATTHNQVIQLLQASSNLSSMGSPPIMRWRWRPLEEIRHGYLKVLNCV

SEQ ID NO: 178815 - protein, 64 aa, Triticum aestivum
  Clone ID: PAT_TA_73233.pep
LHDVSNKIETTSLQLYIQIGLSTAYIYPTGQLKRQVRTVRYKEIKSDKYGRLCKEYIFFAQTLR

SEQ ID NO: 178816 - protein, 81 aa, Triticum aestivum
  Clone ID: PAT_TA_73234.pep
DPRKKKEESNNYEQETSDGKRRVRAARMILPGRRKNSLRAIRPTSLRPHGDDGACVDWGISGWRGVFVEEEEEGIVCASCR

SEQ ID NO: 178817 - protein, 209 aa, Triticum aestivum
  Clone ID: PAT_TA_73235.pep
RSARISEKVKAFDSPEGEKIPKRSRNSSGRKGKQEKKEATENEEAKDAEADKEAPSEDAPKETDVETKPAEEAKEAPSEDAPKDTDVEMKTAEDASKTADADTPAPAPAGTEKEDAKPAESEAAPPAPSEGGEKKEDAKPAEPEAAAAPPSNPTEPSAPKAAAAAPVENSADKGPHQDSQPPSAAAPAKESSPVNNGQLPAGASAVKCT

SEQ ID NO: 178818 - protein, 94 aa, Triticum aestivum
  Clone ID: PAT_TA_73236.pep
HYLINCGSGIEDPLVACCGGRGPYGVSASVRCGYGEYKVCDDPAKYASWDGFHPSEAAYKGIAIGLLQGSYTQPPIVSITNSCPQIIGLGSSVE

SEQ ID NO: 178819 - protein, 93 aa, Triticum aestivum
  Clone ID: PAT_TA_73237.pep
PSGQKEKKGGSSVLARVDNGIAEPRHGVWTEQKPLPRKRRRGIHHLAPEEELQPISLYQDHFLVAFATTRVLVRLTLYGKSMVLLSRVACRGL

SEQ ID NO: 178820 - protein, 63 aa, Triticum aestivum
  Clone ID: PAT_TA_73238.pep
STVLRTNINTYLHPALPLSQKKGMAPIFWFKMGSDCGMCHCSSTMYVCLIVYLLLEQIFYDPR

SEQ ID NO: 178821 - protein, 99 aa, Triticum aestivum
  Clone ID: PAT_TA_73239.pep
YTRAWLLGCSFTVFGSLHSLLGLALGMQPRHWSLAPKKRIWNPFSHGLARGRRWRSHANQTNNGCTPVAWSAGARCSAGTLRREPNRPYTCFLGGFTLT

SEQ ID NO: 178822 - protein, 259 aa, Triticum aestivum
  Clone ID: PAT_TA_73240.pep
EGPVLPLQAWPARHRHLRSVRCALSPPPPSLDLPLLPFQPAEVLIPSESKTLHLYEARYIALLEEALYKRKNTFVHFVLDPVVDSTTKASFAVRYGCLVHIESIQKLEIGALISIRGVCRVNISNLLDMEPYFRGTVSPMMDEPYEAIELGTRISKLKESMCNLHSLQMKLKVPEDEPLQTNIRASLLWSEKEIFEEYNESFIPGHPERLSFAAYQTVSGMSDEELLTLQNYKIQAMDSIDTLERLNNGIKFVEHNIGM

SEQ ID NO: 178823 - protein, 73 aa, Triticum aestivum
  Clone ID: PAT_TA_73241.pep
MSSTATAADCGGAKTSWPEVVGKSVEEAKKVILKDKPDADIVVLPVGTIVTADFVPNRVRIFVDTVAQTPHIG

SEQ ID NO: 178824 - protein, 187 aa, Triticum aestivum
  Clone ID: PAT_TA_73242.pep
ARAQPGILDVYPSAKWWLDAADLLRSSHLDFTRVFLGWYSDYFAMPHVKSNMKPFNYALDFKNKKAVLPGDGNSAVSFIHSTDLAKYIVATLDDEKKWPELSPFASDAMTWKKAVELAEKVTGTKWDITYDTIEKLEKGQATVLQQPEGSYEFPPEFIQPLVVEFSMLAVRVNMDVSKDGLRNHEFP

SEQ ID NO: 178825 - protein, 160 aa, Triticum aestivum
  Clone ID: PAT_TA_73243.pep
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAEGQDAEATTEEAKKSNHVVRKLEKR

SEQ ID NO: 178826 - protein, 79 aa, Triticum aestivum
  Clone ID: PAT_TA_73244.pep
ARGVVGECGDTDYEGLLGGVHKTIILKGSFNTAPNQVHANRSYSFQDVVSLEKQGIASIEGYGPDNLKSALRQFGISKD

SEQ ID NO: 178827 - protein, 75 aa, Triticum aestivum
  Clone ID: PAT_TA_73245.pep
VLAFSILVLSWINMLARDDSLQVTVHLKKHLASHYLCLSFAGDAQLLNSSGMPSVLRTVGRNSNLKFIEKLTTRL

SEQ ID NO: 178828 - protein, 219 aa, Triticum aestivum
  Clone ID: PAT_TA_73246.pep
MLNQDALSGGILSNAFRGSLYTTMHYMESEGILVAGMGNGSIRFIDISRNQKLHLWKSDTAEISFSSLVSAICSCGSNKGSPMASSWIAAGLSSGYCRLLDKRSGNIIAVWQAHDGHITKLAAPDDHLIVSSSLDKTLRVWDLRRNLGTQSNIFKSHSDGISNFSVWGQDVVSISRNKIALTSLSRPASEIGHQQLALQNLYSADRGVKHKNLSVLSTI

SEQ ID NO: 178829 - protein, 171 aa, Triticum aestivum
  Clone ID: PAT_TA_73247.pep
IGTRLSLSLSLSLSLSLSLSLSPVSSVQPRPPPPPPPPQQPHPSQTLQQLGAIQLPHQDQQLPYPQSAILPQVPLQFPNQLPIPQLQLYHQSQQESGQTLRQVGEQSQLQNQGMQADSFSQQQQDSGINLNQFFSSPEAIQSLLSDREKLCQLLEQNPKLMQMLQDRIGQL

SEQ ID NO: 178830 - protein, 99 aa, Triticum aestivum
  Clone ID: PAT_TA_73248.pep
RIHYNRTVTRSSEKRSLCSDPRCSSLAVDGLLVAVGVLILGRLALGPAASAVQRTDHHPVVDGGAPRRAGGVAAVGHPAFPAQLLPALSLGRSRCGLVP

SEQ ID NO: 178831 - protein, 120 aa, Triticum aestivum
  Clone ID: PAT_TA_73249.pep
FFFFFFFFSHITNLNGDTTKHPENTPGCNIGAKGVLKFMDLWLSKMRLEHTNPSYGSVSYCSLQLQITHTRHDQQQLRTVGKILLSASEKPKNVSINFCRTGHITCQVFPDHEEALHWAA

SEQ ID NO: 178832 - protein, 185 aa, Triticum aestivum
  Clone ID: PAT_TA_73250.pep
MDDGDLDFSNPDTFLCPAVGGADPDGSCSMDSYFDDILKDTEHHACTHTHTCNPPVHDLSHTHTCVHVHTKIVSAPSDTPSDAAETAESPTENNASKKRPSGNRAAVRKYREKKKAHTASLEEEVVHLRALNQQLMKKLQNHATLEAEVSRLRCLLVDIRGRIEGEIGAFPYQRPVKNIDLVSSV

SEQ ID NO: 178833 - protein, 53 aa, Triticum aestivum
  Clone ID: PAT_TA_73251.pep
MHSSTWANKILGPSLVALYNPLQPAFSTVLSTIFLGAPVYAGRFDSTHCPNVQ

SEQ ID NO: 178834 - protein, 225 aa, Triticum aestivum
  Clone ID: PAT_TA_73252.pep
MASGTGTGSRQLQPPAAAADADPGAGGDKLVFEAPPQPVRDDYVENAVKFLSHPKVRGSPVVYRRSFLEKKGLTTEEIDEAFRRVPDPQPSTTATTSPQQQVNSQNHSAGVQTYTPAQPVHPATAGPVALRTQPRFSWYQAFLAAGLLLGFGASAAVFIKKLFLPRLKSWIRNVVAEGDGTEGNQLKARIDEETAEAVKASASAVSAIAKTNQHLLASRMKKRRY

SEQ ID NO: 178835 - protein, 169 aa, Triticum aestivum
  Clone ID: PAT_TA_73253.pep
LSSFFFLVFSLLLLLCACACVGVLIYAGLRRTGKSCRLRWVNYLHPGLRRGRITADEERLILQLHEQWGSRWSRIARSLPGRTDNEIKNFWRTRARKQKAAAQQQQGSRSSKTASAFSGSSSSSSVTATTSRSSCSGSPSPSPSSGGCGGTATTSSSAVTESALRQSSG

SEQ ID NO: 178836 - protein, 230 aa, Triticum aestivum
  Clone ID: PAT_TA_73254.pep
AAPYPAPAYQPTAAAAPAPQAAKPRQLDRRYSRIADDYHSVDQVTDALAQAGLESSNLIVGIDFTKSNEWTGKFSFHGRSLHHISNTPNPYEQAISIIGRTLSKFDEDNLIPCFGFGDASTHDQDVFCFSPDERPCNGFEEALDRYRELVPHLRLAGPTSFAPIIEMAMTIVEQSGGQYHVLLIIADGQVTRSVDTASGQLSSQEQKTVDAIVKASELPLSIVLVGVGDG

SEQ ID NO: 178837 - protein, 64 aa, Triticum aestivum
  Clone ID: PAT_TA_73255.pep
IPVQNAPHFAKGIDALLGPQALLCLVVNTGQGREESTTVYLAAYQFCAHLASTARSTIRILPRA

SEQ ID NO: 178838 - protein, 129 aa, Triticum aestivum
  Clone ID: PAT_TA_73256.pep
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRAKKKIKN

SEQ ID NO: 178839 - protein, 94 aa, Triticum aestivum
  Clone ID: PAT_TA_73257.pep
MDLLQGHYMTSVSRDMAVPTKAGLLDSYASFRLAFALVMGALMFMMMSLRQARNDVRHLLLSLLWAGLCIGITQFVKANGRTFTNRPRFHKSRH

SEQ ID NO: 178840 - protein, 87 aa, Triticum aestivum
  Clone ID: PAT_TA_73258.pep
ELLVTMTTTAASRSAKSTKNRTGGIHHYIYINHTPATPATSKTSKIHLYTGEQRNTEPDLAKIEQKKQGGEHRGKAYLQNQPQMDGG

SEQ ID NO: 178841 - protein, 134 aa, Triticum aestivum
  Clone ID: PAT_TA_73259.pep
TSQKTVAMCLCILCPVWRNSPSTCRFSDGRVQRMGKLETNLPCCLHGRPSLAPLFDLPPSLSCSCAWRSAASLAPVQTVYFLWLSRCKANAPNGWLCLVSFFFEFAVNLGVQRRKQKAEDEEEKGQRDKASWCG

SEQ ID NO: 178842 - protein, 51 aa, Triticum aestivum
  Clone ID: PAT_TA_73260.pep
LVSNIDYIILYSYIIAFKELISQNLLLAVILVNQFLFIYGKYILIKYILII

SEQ ID NO: 178843 - protein, 73 aa, Triticum aestivum
  Clone ID: PAT_TA_73261.pep
QCCVALGCPALSYPSVLLWRRCAAGAMGWPVPPQPTAATLSSVLPGVSVTLSVVYIDLRRGLEDIVLSPTVVT

SEQ ID NO: 178844 - protein, 254 aa, Triticum aestivum
  Clone ID: PAT_TA_73262.pep
GTRAGGAAGEDRVQAVCSEKNGWLICGIYDGFNGRDAADFLAVTLYDNIVYYLYLLECRIKQENGLYGSPEGSLNGVKSELTLAMRFAENEDVKFSETFRAGVLKCLTTAVEQAENDFLCMVEQEMDDRPDLVSVGSCVLVVLLHGTDLCILNLGDSRAVLASVPSSGMDKLKAVQLTEIHSLENPLEYQKLLADHPNEPSVVMGNKIKGKLKVTRAFGVGYLKQKKLNDALMGILRVRNLCSPPYVYTNPHTV

SEQ ID NO: 178845 - protein, 240 aa, Triticum aestivum
  Clone ID: PAT_TA_73263.pep
MLAKASPRPCSTGAVAGGVPSGGAGLARGGARWPARPRAAASVRLVAARPGRRRRTRVVAAAAGERTASGPGPEPMMVEAANGSSSAVAGISTLLTSTVGKSTNILWHDCPIGQNERQNLLNQKGCVVWITGLSGSGKSTLACALSRELHIRGHLTYVLDGDNLRHGLNRDLSFKAEDRAENIRRVGEVAKLFADAGLICIASLISPYRSDRSACRSLLPKSSFIEVFLNAPLEVCEARD

SEQ ID NO: 178846 - protein, 147 aa, Triticum aestivum
  Clone ID: PAT_TA_73264.pep
VTIQHYKQESARLRQQITNLQNSNRALIGDITTMSPKDLKHLETRLDKALGKIRARKNEVLCSELEYMQRREMELQNDNLYLRSRVDENERAQQTVNMMGAPSTSDYQQQGFIPYDPIRSFLQFNIMQQPQFYSQQEDRKDFNLGGR

SEQ ID NO: 178847 - protein, 48 aa, Triticum aestivum
  Clone ID: PAT_TA_73265.pep
NGRHRSINVSNRLTASTLQKQLRSRFDLQKSKIERAYSYQLERNNADT

SEQ ID NO: 178848 - protein, 87 aa, Triticum aestivum
  Clone ID: PAT_TA_73266.pep
RHEGNPIVKTWMLSISTVCLVLTGAAYTGPSMNPANAFGWAYVNNRHNTWEQFYVYWICPFVGAVLAAWVFRAVFPPPAPKPKAKKA

SEQ ID NO: 178849 - protein, 103 aa, Triticum aestivum
  Clone ID: PAT_TA_73267.pep
PCEHSVRTCPLLGKKRRYTDNHWCSILSSSFKKKGYKIVVRSIVEVETNFQRCLIYSTILGRRHYSNFDFGQRSAGRKLLIAGDERGDEPKGSCHPWSDLLGR

SEQ ID NO: 178850 - protein, 71 aa, Triticum aestivum
  Clone ID: PAT_TA_73268.pep
GHENHKNRCKEKDGELRSRVVGSLQVLEAYILKPATHVTPVLANAKLVLSFNHHHRTTITFQFGRKKKKKK

SEQ ID NO: 178851 - protein, 55 aa, Triticum aestivum
  Clone ID: PAT_TA_73269.pep
SARDCVVFILHGFCASRDMFLATCLIQLGTSAAPRLREVPCLGEAGTYFLGLGVL

SEQ ID NO: 178852 - protein, 100 aa, Triticum aestivum
  Clone ID: PAT_TA_73270.pep
STNNSFNIKQSSVLHLRAPKHTISMPYYDHGGLHLASAVHTTPYICTSSFSKEERRKTIVQTLYTMRSTPNMMLINSLCQLLSQTLYSDQVPFQAPPSCR

SEQ ID NO: 178853 - protein, 109 aa, Triticum aestivum
  Clone ID: PAT_TA_73271.pep
ARKYIFFTCVSAQFLWSCFREIVGGSWDHNNFPALFAELQANPPTLRHIRWLTIGVLAWMLWTVRNKLVIQRIPFRRATDALFKWSGYLQLWRPLSRPRERDAITSIIT

SEQ ID NO: 178854 - protein, 258 aa, Triticum aestivum
  Clone ID: PAT_TA_73272.pep
GTRESSVRKSMSLDDLQEKAVFSAIIVDPQMKDTKESPEQSGSNSTVQKMISAFQSSSPQDLTRIKSESSLKGLSASSENFTQSSSDKSSSSLATQDVSGHTEAGLVAGTSGKMQLPPGDKSFSNKRSNATEQQAVLSTTSEGRIRRLFREKKDLDNSEMVITVQNRSKKRSMPKRRRAAIGPYSLEHMHPHVCITTASRQLRELVELEPPLDSFVFVGQVDIKRPNVRGGASMQDQGTSDSKTKNEMVSARGDDHGF

SEQ ID NO: 178855 - protein, 60 aa, Triticum aestivum
  Clone ID: PAT_TA_73273.pep
TPWTSRPVTPPSSTTYSSGSSLRSGSDSTRTFVYSCYKNKCTYMRYLRKTFLVIRVVSRT

SEQ ID NO: 178856 - protein, 222 aa, Triticum aestivum
  unsure (1)..(222): unsure at all Xaa locations
  Clone ID: PAT_TA_73274.pep
GRGPPPGTGRCFNCGIDGHWARDCKXXGDWKNKCYRCGERGHIERNCQNSPRSVRRERSYSRSPSPRRGRGRSPSYSRSRSRSRSRSYSRSRSLSGSPRGGRRDRDDRRSRSLSYSRSPMRSASPPPKEKERSPTPDGSRSPRSRSPQDQVMSPPPKDNGEGNGSDRGESPRGRETSRSRSRSRSPSGDNRSPAANGRSPSPRGDRSPSPRADRSPSPKADR

SEQ ID NO: 178857 - protein, 145 aa, Triticum aestivum
  Clone ID: PAT_TA_73275.pep
MTLVKIGPWGGNGGSAQDISVPPKKLLGVTIYSSDAIRSIAFNYIGVDGQEYAIGPWGGGEGTSTEIKLGSSEQIKEISGTHGPVYDLADIVTYLKIVTSANNTYEAGVPNGKDFSIPLQDSGHVVGFFGRSGTLIDAIGIYVHP

SEQ ID NO: 178858 - protein, 161 aa, Triticum aestivum
  Clone ID: PAT_TA_73276.pep
SARGTPVPGARNSPIDVEAIDDEVQAVSPSRVPPPRRNRRTRREPITVVDLEVESSREGNKRQRVVPVGHHLSSDSGAGSSLQSNAVQTGKEPAKEVPKETFFTCPICWNKMEEPSTTTCGHVFCDTCIKQAIKIQKKCPTCRKGLKMNSAHRIYLPKASS

SEQ ID NO: 178859 - protein, 249 aa, Triticum aestivum
  Clone ID: PAT_TA_73277.pep
RHEPHPHWRKETTVAADSDRAPVPRRPRHWRSSHGGGAAAMSGEHQVYLLSPVPGNSARAPVVPTTGDRASSSTARQDAVPTAEDHKRPKRKRSSDRKPWIRCLPDDLVEKMLVHHTMQTDLNNVMASSFFFLRVALLPCPCHNLGRQPRLVAALVQTKRGLLKVAARDGPRLRWLEPAANMLNKFLHLVYHSRGWVRPVDCREGTVAVIRDRQGRVVELLRPFQGQKITTLPEAPCHNADELLTGGLV

SEQ ID NO: 178860 - protein, 189 aa, Triticum aestivum
  unsure (1)..(189): unsure at all Xaa locations
  Clone ID: PAT_TA_73278.pep
RHEGVLGEGGFGSVFKGWIDEKTLAPTRPGTGMVIAVKKLNQEGYQGHKEWLTEVNYLGTLSHPYLVKLVGYCLEDEQRLLVYEFMPRGSLENHLFRRSSYFQPLSWNLRMKIALGAAKGLAYLHSDEAKVIYRDFKTSNVLLDANFNAKLSDFGLAKDGPTGDKSHVSTXVMGTHGYAAPEYLATGHL

SEQ ID NO: 178861 - protein, 147 aa, Triticum aestivum
  Clone ID: PAT_TA_73279.pep
NLFNALDTTTIYIVCKLLHKLHFTGILCIQTLEHCISEICIKLLQLAMLLDSSCAAASHLLDGIRAPGKLLDEVEMSPPGQQPRLSTRALVSDVRLPVAGTVLRAAGARAGAAATALLGQLRLHRRRGGGVACGCWRTRLEDDRHRA

SEQ ID NO: 178862 - protein, 64 aa, Triticum aestivum
  Clone ID: PAT_TA_73280.pep
CLDSQVFLFICRFINHCRVDFRYPLSSPDTQLLQVATRKEEEQRQMPQTERPRHPVLHHARLVP

SEQ ID NO: 178863 - protein, 158 aa, Triticum aestivum
  Clone ID: PAT_TA_73281.pep
RTFGRMMNNWCRCRHNANCCSSVRAVFWPLMSMGSDVNCGDIADRPRGGPWRSAAALQCACYRRPLIRPAPHRAQPYGCSRSRLRLARPPHRRLLTRRTTRHLAPCMPRRRLGSLGDDDGHTGTLAAGPARLGRGMRIANEAYYHQYLSSQRRCRRLW

SEQ ID NO: 178864 - protein, 70 aa, Triticum aestivum
  Clone ID: PAT_TA_73282.pep
PDIFYNSICPMEPAKLTHLNSKCVMHHGQGRRPYPTDLLKRSIQCNYFNFYHRPMSGLQQYKLARKLTRN

SEQ ID NO: 178865 - protein, 53 aa, Triticum aestivum
  Clone ID: PAT_TA_73283.pep
GTSCLPIYTLSLRTTPVCIEDGASTRWLAAEVAVSPPDFKSRLGRVVLAEFLL

SEQ ID NO: 178866 - protein, 181 aa, Triticum aestivum
  Clone ID: PAT_TA_73284.pep
IRHEAAPSGESLRQVQFRMMEFLNRTVLRLPEKVAMGDTLSQQNELKGFSRQSSSNSVQDGPPWDLLYRLNRHSLQRKKSGKSRLQFVTSGDNEAEDDFSPKEVNQRHLLHEGSLGGSAASIAIFSHVTPIRCLIAGLLDCNPIMSKRICIDDSSVTVLEHSLKTGWQIKRLNDTAHLRLL

SEQ ID NO: 178867 - protein, 190 aa, Triticum aestivum
  Clone ID: PAT_TA_73285.pep
RHEAPFNSLTTENLQFLSSKQALFDLAVFRQYYQETLNAKYNRSGADSSWFVFGGSYAGALSAWFRLKFPHLTCGSLASSGVVLAVYNFTDFDKQIGISAGPECKAALQEITGLVDGQLQSGRNSVKELFGAPKLENDGDFLYLLADAAAIAFQYGNPDVLCSPLAEAKKNGTDLVETFASYVKDYYIGK

SEQ ID NO: 178868 - protein, 137 aa, Triticum aestivum
  Clone ID: PAT_TA_73286.pep
VECVIQLAYRTARRDNWIDVEVKVDNIRCDVDSLVSETLMAERGYGSEEKHFPSRVMLQITPMQQSDVLSVSVGKSNDNPTHEFGIEKGFEGSFDPPNSFGLKASVTESLTLAMKPWKFEQSVHGNTATLNWFLHDG

SEQ ID NO: 178869 - protein, 183 aa, Triticum aestivum
  Clone ID: PAT_TA_73287.pep
VESGESELESEDEAKPFAAPRTRSALPRDGLNTSAVVVDGPAANSVKRKRKNQFRGIRRRPWGKWAAEIRDPRKGVRVWLGTFNSPEEAARAYDAEARRIRGKKAKVNFPDEVSTIPQKHRAGPTPLKVPEMDFEEKPIIKPAVNNMTNSNAYHYPVVDHNIPEPFMHTQNMSFAPFVNSAAP

SEQ ID NO: 178870 - protein, 115 aa, Triticum aestivum
  Clone ID: PAT_TA_73288.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHGF

SEQ ID NO: 178871 - protein, 227 aa, Triticum aestivum
  unsure (1)..(227): unsure at all Xaa locations
  Clone ID: PAT_TA_73289.pep
SARGDAPSVDVKKNVIVAITSDKGLCGGINSTSVKVSRALHKLTSGPEKESKFVILGEKGKVQLVRDSRNSIEMTVTELQKNPINYTQXSRKRAVXELKINHPLCKTIAVLADDILKNVEYDALRVIFNKFHSVISFKPTMVTILSPEVAEKESEAGGKMGDLDSYEIEGGETKSEILQNLAEFQFSCVLYNGALENACSELGARMSAMDSSSRNAGDMLDRLTLTY

SEQ ID NO: 178872 - protein, 138 aa, Triticum aestivum
  Clone ID: PAT_TA_73290.pep
LRLSIFFPVVSNHGPHKSIFFILVGPQSKCNVQSICTKCLSLSCYLFSKSTSKIKGQESSPYDSTKRISITDPSISICPLPLLPSHLPQLTDTKCHKNRPQKTPTGHAHRKGQKKKIYRQCTVHRTNGRKDLPLNSIH

SEQ ID NO: 178873 - protein, 94 aa, Triticum aestivum
  Clone ID: PAT_TA_73291.pep
RHEVVKGFMDKAKPVASICHGQQILSAAGVLQGRKCTAYPAVKLNVVLGGATWLEPNPIDRCFTDGNLVTGAAWPGHPEFISQLMALLGIKVSF

SEQ ID NO: 178874 - protein, 187 aa, Triticum aestivum
  Clone ID: PAT_TA_73292.pep
GWFRMFSVAAYKPYFDVDTSDVVERIWESVFPFRGTFTEKTSENPDLYGPFWTCTTLIFVAASIATFVTYLSHKWHKKEWNYDINLVTWSAGLFYGYVTFVPLLLYVILKYFSAPAGLVQLWCLYGYSLFIFIPASLLSIVPIEIFRWVIAGVAGFMSATFVAVNLRAHIVNSGERWFLIVAGIFLL

SEQ ID NO: 178875 - protein, 60 aa, Triticum aestivum
  Clone ID: PAT_TA_73293.pep
QVTKHIQNNDRTKYIGSSMYTIPKQSLSYGSQLRCVERFHLYHTRFDFLLIPSNPSEDLL

SEQ ID NO: 178876 - protein, 144 aa, Triticum aestivum
  Clone ID: PAT_TA_73294.pep
MASKAGGDGKEAINEQVIANTYANMRTEMNQLYTKITELEMEVSEHSLVIGAIEPLDPSRRCYRMIGGVLVERTIREVLPAVKRNKEGLEEVIARMHEALERKKKEITEFELKYKIRIRKADNDAEDESGKKEGTAQGVLVGPA

SEQ ID NO: 178877 - protein, 64 aa, Triticum aestivum
  Clone ID: PAT_TA_73295.pep
IRHEDYYEDLTPKRVVEIVEMLRRGETPPRGTQHPERKNCGPAGGNTTLLGEPKPPPCRDLDAC

SEQ ID NO: 178878 - protein, 100 aa, Triticum aestivum
  Clone ID: PAT_TA_73296.pep
MKSSTLLVILAVQAALIMGIFAAVAKENAVGESKAIDINPGQLKCCSNCNFSFSGLYTCDDIVKKCDPVCKKCAVVKTYPVKMFKCTDTFLGMCGPPCKH

SEQ ID NO: 178879 - protein, 123 aa, Triticum aestivum
  Clone ID: PAT_TA_73297.pep
TATKAELNSTMSEVSCPSCLKMLIHDTILSRIIYNKNLSLVYHSVDEFCEVGIVLNLLINLGFLQHFFGGSQKNMSAVHFIAANRARGQRPELGERVGHRGHEAPEPAQLRRRLLPPSLQQPP

SEQ ID NO: 178880 - protein, 111 aa, Triticum aestivum
  Clone ID: PAT_TA_73298.pep
GSEGRKAVWAQLHRRRPGDVPPVRDASHQLRPRRQTRITKHWKWSPYYEVLWCLPDPTCLPIILHDVNFAYFLDFVSLIILNICNLIYFICLTHGAINKNRRVFFSLKKKK

SEQ ID NO: 178881 - protein, 90 aa, Triticum aestivum
  Clone ID: PAT_TA_73299.pep
MDKILAFSILSSSPADISAAGFFSTRLSWRTSAAGKPQTPQVDPAPQNQKAAEQQRGSPRVPAAEREREARPRFAPEFDGLNCFESIVSF

SEQ ID NO: 178882 - protein, 95 aa, Triticum aestivum
  Clone ID: PAT_TA_73300.pep
FFFFFFFFYGAVWMTCIHLKLNKGHGRFTKRPPVLEMLCKPSDDVHKCHVLWRTFVRYAHHFLRLRPWICYMCVFWKQRVQLFLLQGAGPTESWP

SEQ ID NO: 178883 - protein, 67 aa, Triticum aestivum
  Clone ID: PAT_TA_73301.pep
FGTRIRALHARRPYGATVLNYQKLSLECTFVCVAVPYFMLLDWSVWWCEICICIAMVWWCVFHFSLI

SEQ ID NO: 178884 - protein, 38 aa, Triticum aestivum
  Clone ID: PAT_TA_73302.pep
FFFFFFKLLHRFLSQKKIFTSSSLVFISHLLPSLTPSS

SEQ ID NO: 178885 - protein, 121 aa, Triticum aestivum
  Clone ID: PAT_TA_73303.pep
MDTNMEDVKMPEPMQLSSAPTTEPTTIPTLDGWIESLMSCKQLAESDVQRLCDKAREVLQDESNVQPVKCPVTVCGDIHGQFHDLMELFKIGGPNPDTNYLFMGDYVDRGYFSVETVTLLV

SEQ ID NO: 178886 - protein, 141 aa, Triticum aestivum
  Clone ID: PAT_TA_73304.pep
FVGVNNNFQSIILAGVLVCDETEESFECVFSDFLQMMRGVAPKTILIDKNRTMNCIKEQHVWTWVMSREQPRKSARCKNCGVEGHRRNTCTKAMEMRLANVGCWSVVLGPTDCFLLVVNMLCCVVDYFRFCVALVGRLNCS

SEQ ID NO: 178887 - protein, 179 aa, Triticum aestivum
  Clone ID: PAT_TA_73305.pep
GTRAHVTGDFRKLLVPLVSAYRYDGPEVNTSLSHSEAKILHEKIHKKAYSDEEIIRILTTRSKAQLLATFNNYKDQFGHAINKDLKADPKDEFLSTLRAIIRCFTCPDRYFEKVIRLALGGVGTDEDALTRVITTRAEVDLKLIGEAYQKRNSVPLDRAVAKDTTRDYEDILLALLGAE

SEQ ID NO: 178888 - protein, 110 aa, Triticum aestivum
  Clone ID: PAT_TA_73306.pep
GQNLRHVCSRCCFCCSIDLDQVHILSAATTVQVQISESVGLVNDNMGDLHFVTRTYQAQHLNPAYTATVQVAVYLKLILSIDSLQPQVSGRVQYKCITQVHQPKNKVHGS

SEQ ID NO: 178889 - protein, 76 aa, Triticum aestivum
  Clone ID: PAT_TA_73307.pep
LQNYSSAMSPKNNLNCSTKVAYLYSHGRNGTSWTGFSFSSRKDSPNLQFHVRKPFCIVHFAQIFDIATTNALRTSL

SEQ ID NO: 178890 - protein, 234 aa, Triticum aestivum
  unsure (1)..(234): unsure at all Xaa locations
  Clone ID: PAT_TA_73308.pep
GGNRTCPQTQQVXXNTILIPNHLVRSMIAQWCTENGIALSPLENQEEDLVTNNERKSFSELFDRISSSSNISEKRQAIKDLRLLTKRNSSFRAVIGENPDSISQMISAVSNPELESNSEVLEDTVTTILNLSIHESNKKIIGDDTKAITFLISALQSGTMEARSNAAAAIFSLSALDSNKAKIGESGAMRPLVDLLEHGSMTAKKDAASAIFSLCKLHENKSRATKSGVIDVVL

SEQ ID NO: 178891 - protein, 86 aa, Triticum aestivum
  Clone ID: PAT_TA_73309.pep
CLKPFQCASRQLKFPRQARSQQGNGQYAQQVPVVRFSWCKNDSWLLPTWRDQQDHTDFFLFPDLNMVPMFHCSEHILDRKHTDSLS

SEQ ID NO: 178892 - protein, 159 aa, Triticum aestivum
  Clone ID: PAT_TA_73310.pep
RLALLLCLLACGAAGAAATARPCASPYSGSSAYPFCDASLSIPARARALVSLLTLDEKIAQLSNTAGGVPRLGIPPYQWWSESLHGLADNGPGVNFSSGPVRAATTFPQVILSTAAFNRSLWRAVAEAVATEALGMHNAGQAGLTYWAPNINIFRDPRW

SEQ ID NO: 178893 - protein, 115 aa, Triticum aestivum
  Clone ID: PAT_TA_73311.pep
KTLSTVCGYCGCLASNLENQSLRYQILATLTRFTNHFMQFMLIFCSQTLIASKTTWIIMTQKYDTDQRHQTASYFLRHYTKLTMSDCQHDTLLQLHLIVGTNPASRSQVPITTII

SEQ ID NO: 178894 - protein, 181 aa, Triticum aestivum
  Clone ID: PAT_TA_73312.pep
LFKTTAYTGPINFTNGGDIAVSSVVQVVGLVLCLHAAAKISHRAQNIASLASRWHALVTCSSDSTYVSTPNSSGNLVPFPAHMFLRDFSESDLESLESGSVQGNSHGTAQLASYMSSYHKRESLVLYLLGNPGGITIFGWIVDRTFLNTILMLELTLVLFVLSKTVVVPAKTLVLDYIRFP

SEQ ID NO: 178895 - protein, 203 aa, Triticum aestivum
  unsure (1)..(203): unsure at all Xaa locations
  Clone ID: PAT_TA_73313.pep
MAETKAPKDPYGFLKDFMAGGISAAVSKTAVAPIERVKLILQVQAASTQIAADKQYKGIVDCLVRIPKEQGFASFWRGNFANVIRYFPTQALNFAFKDVYKQLFMDGVDKKTQFWRYFAGNLASGGAAGATSLCFVYPLDYARTRLXADVGKGPAERQFKGLGDCIAKTVKSDGPIGLYRGFIVSVQSIIIYRAAYFGFFDTA

SEQ ID NO: 178896 - protein, 112 aa, Triticum aestivum
  Clone ID: PAT_TA_73314.pep
DLLPLEPTPMTHAMHELPKDSTSPTSDMDYVPCFFTSSYPYIHMYLVHVHVNLQDKLRFFYGSVPCRSDQDTATQAAMLLQTQISVCVLCVTPGSQEHDSPYGVLSGRAAAV

SEQ ID NO: 178897 - protein, 58 aa, Triticum aestivum
  Clone ID: PAT_TA_73315.pep
MLDKLWDDVVAGPHPETGLEKLRKAATARPILIDKDADAGAAGSYKRTQSMPSTPTTP

SEQ ID NO: 178898 - protein, 129 aa, Triticum aestivum
  Clone ID: PAT_TA_73316.pep
FGTRAASSHMAVLSDPVVGAAPRHDLQCPHGGIASRAPVRPRLPRQRASGHGGALLGRVGAGPSVQCRPYPWSFALPTQQQDPAKWSLASYSDPAKWSTVAHVRLRRSAPPAPIHWRAQSRICIDFVSK

SEQ ID NO: 178899 - protein, 124 aa, Triticum aestivum
  Clone ID: PAT_TA_73317.pep
SARGTTLAHHHGHARVHGLGGGGGGGGAPVDIVETPGEYTFVLDVPGLSKSDIQVTLEEDRVLVMKGGSGKRKREEEEEGEGEGCRYIRLERGATPRSFVRKFRLPEDADTGCVAARCENGVLT

SEQ ID NO: 178900 - protein, 48 aa, Triticum aestivum
  Clone ID: PAT_TA_73318.pep
APLFCSSYDISLSFCFNDCCLRFVTCHQNKTVECYWVVVPWHVNFDSA

SEQ ID NO: 178901 - protein, 65 aa, Triticum aestivum
  Clone ID: PAT_TA_73319.pep
CCPSMLRPNLAHMPCEVFTKLCFGHPKQKKSRLAITFEPCIISILLFKWIVTLMHSANQQGKKGL

SEQ ID NO: 178902 - protein, 69 aa, Triticum aestivum
  Clone ID: PAT_TA_73320.pep
NAGPGAPAVFNCVVEIPRGSKVKYELDKATGLIKVDRVLYSSVVYPHNYGFIPRTLCEDNDPMDVLVLM

SEQ ID NO: 178903 - protein, 84 aa, Triticum aestivum
  Clone ID: PAT_TA_73321.pep
NEYTYTIGSPHLLEEGDNKNESSTLLPFQKETRTGTKTLLLSPFTTKQANQLQSQQPGQVASSAPQCKCKCYLCLHSRSRIEIT

SEQ ID NO: 178904 - protein, 125 aa, Triticum aestivum
  unsure (1)..(125): unsure at all Xaa locations
  Clone ID: PAT_TA_73322.pep
VINDDGHFHGELASAGQXVVVDFTATWCGPCQRIAPVFEQLSTKYPNAIFLKVDVDKCGDTAAGQNVSSMPTFIFYRNRTKLGLCQGANPQNLEAKIIEYYGGGECDDSTEGPVAGHMDLTTFIM

SEQ ID NO: 178905 - protein, 112 aa, Triticum aestivum
  Clone ID: PAT_TA_73323.pep
EIPNGCRAADSSKCVVLDIEGTTTPISFVTDVMFPYARDNVREHLTSTFDSEETKDDIKLLRIQIEDDLRNGISGAVPVPPDEAGKEEVINSLVANVESMIKADRKITPLKQ

SEQ ID NO: 178906 - protein, 65 aa, Triticum aestivum
  unsure (1)..(65): unsure at all Xaa locations
  Clone ID: PAT_TA_73324.pep
PGRQKXIRSRKWGFTKFTRAEYLKYKSEGRIAPDGVNAKLLGVHGPLSKRAPGKAFLAENIQASA

SEQ ID NO: 178907 - protein, 115 aa, Triticum aestivum
  Clone ID: PAT_TA_73325.pep
FRVAALRGFRRVFAHAAPIFFERGIAIEATKEFSSLSVEPCDGELIIVTVFEIKEEEVPAFIEREHEFRFLAVVPEGLDGVPFTNRAVVCARYSDEEYFQGRCQGSKEIFYQRYG

SEQ ID NO: 178908 - protein, 59 aa, Triticum aestivum
  Clone ID: PAT_TA_73326.pep
VALRAALVGGVAAFAKIGAAMKAAGGAKVGAAAAAMTAAATAAVSSKDTNKDNPKTETK

SEQ ID NO: 178909 - protein, 110 aa, Triticum aestivum
  Clone ID: PAT_TA_73327.pep
HVNAWSAGPSLNPLTSGPYGLIFASYIPFFFDIPITTKFRIFGLRLSDKSFIYLSGLQLLFSSGWRSIIPGLSGILAGLLYRLNIFGIRRLKLPDSMTSLLSRFSCPFLN

SEQ ID NO: 178910 - protein, 52 aa, Triticum aestivum
  Clone ID: PAT_TA_73328.pep
FLLSVKGDSSVHCTRYSFAVDFLFVSHVAMYGVGKWVYLCRVLYNSVVACLC

SEQ ID NO: 178911 - protein, 54 aa, Triticum aestivum
  Clone ID: PAT_TA_73329.pep
PSTEIYAIQLFTTFSIPPLMVPPRSRCPRGEMLGPARAKLDKSHHRQQRYPQRL

SEQ ID NO: 178912 - protein, 126 aa, Triticum aestivum
  Clone ID: PAT_TA_73330.pep
IVRPPAVYANATTNGDSFPFVTDAAGTGYPERYQEDAGVGTSGLGLLNNNTGDFEINNWQMHSYPQPEQGFQFFGTDTDVGNPFVGPHNSFNIAPEDYSLDCNVGIEDPSAAHDVSICRNSNDVHG

SEQ ID NO: 178913 - protein, 84 aa, Triticum aestivum
  Clone ID: PAT_TA_73331.pep
IRVQIRSNPYMYKGNLALQTGRELLSVGLDTEKNLHEVSLPFLVLHGTDDVVADPCGSKLLHERASSRDKTLKLYPGMWHVLMG

SEQ ID NO: 178914 - protein, 123 aa, Triticum aestivum
  Clone ID: PAT_TA_73332.pep
LPPRSRHQEANYSSGIWNVAVLCASAAVDDACDHLDCHSGPFLVVFLARGRSGMCTQVYSSEAAAWSHRIYAPRLSEHIQWVPSALAGNSMYFLCSKSVLKFDLTTREMSLIDLPQETFSSAM

SEQ ID NO: 178915 - protein, 77 aa, Triticum aestivum
  Clone ID: PAT_TA_73333.pep
NNDIYNIVDHSTTCTNPGQKRKMDKKGCISSMSYTMMIYIISALRREQFDYIMSTKTKLIHSQRTRSTQGGFQQLTM

SEQ ID NO: 178916 - protein, 71 aa, Triticum aestivum
  Clone ID: PAT_TA_73334.pep
FPALITSFLKAFHVMDRDLKLHKNIDCFFSGTTSVAAIKQGRNLIIGNLGDSRAVLGTRDENNELVAVQLT

SEQ ID NO: 178917 - protein, 115 aa, Triticum aestivum
  Clone ID: PAT_TA_73335.pep
FMTHYVLLLCSFKEQLQQHVRVHAMEAVMACWELEQTLQSLTGASPGEGSGATMSDDEDNQVDSESNMFDGNDGSDGMGFGPLMLTEGERSLVERVRQELKHELKQGYREKLVDI

SEQ ID NO: 178918 - protein, 106 aa, Triticum aestivum
  unsure (1)..(106): unsure at all Xaa locations
  Clone ID: PAT_TA_73336.pep
MVAHRFHQYQVVGRALPTPTDEHPKIYRMKLWATNEVRAKSKFWYFLXKLKKVKKSNGQMLAINEIFERNPTTIKNYGIWLRYQSRTGYHNMYKEYRDTTLNGAVE

SEQ ID NO: 178919 - protein, 89 aa, Triticum aestivum
  Clone ID: PAT_TA_73337.pep
DLISYRVHSEYRHKTCSSLWPGPSPDSVTPLARKRADKCWNTSHTDTVTDSLTKTPLHSEVRDASLSHPVSFIWGSPQPAELLLGRSSS

SEQ ID NO: 178920 - protein, 57 aa, Triticum aestivum
  Clone ID: PAT_TA_73338.pep
RNSITSSNRITNSMLLFSSSCGPCSSAQIALLPDGHVAHPHRTHCFLTGGASSACWI

SEQ ID NO: 178921 - protein, 67 aa, Triticum aestivum
  Clone ID: PAT_TA_73339.pep
LKDKALKRAGLTEENLQEQIEQRNVARKNKQFEVSDGIRKNLATKGIALMDEPSGTVWRPCEPERSE

SEQ ID NO: 178922 - protein, 113 aa, Triticum aestivum
  Clone ID: PAT_TA_73340.pep
TLLPPPPPTPPPHVTQSFAPNSSYPPPPPSSQYIAGYPPAPPSNFYPPPPAGYPAPSFPSPTSTYPPPPAPESASSQYPPPLPRSAPCCDRSVDRALPSYMSTRPPPSGAPCY

SEQ ID NO: 178923 - protein, 110 aa, Triticum aestivum
  Clone ID: PAT_TA_73341.pep
TEMLACRWALATCQHFIAASSNHQSIKRQLSKLKTLIIWSYSHSLILVILPLPIFALYMIEQAYQNSRIAPLNGIKEIKNPNSYVYTYSIFTSKDWSYCFSHKRKSTQKR

SEQ ID NO: 178924 - protein, 85 aa, Triticum aestivum
  Clone ID: PAT_TA_73342.pep
RTFAGVAPCSPTSSLDLELFPNAVPGLHLSSPPRTCAAASFNSSRRHLVRRIRCLSAPSPPGASSPAPAPISGHPRRQTPRPCSP

SEQ ID NO: 178925 - protein, 74 aa, Triticum aestivum
  Clone ID: PAT_TA_73343.pep
MGSEGPSVVTVHVTGFKKFHGVAENPTEKIVTNLNSFLEKRGLPKNLVLGSCTVLETAGQGALPTLYKVLESAI

SEQ ID NO: 178926 - protein, 53 aa, Triticum aestivum
  Clone ID: PAT_TA_73344.pep
LSPFFSLFTGNSIPLVQRITCWYIGSSIRFPSLERTTFTLPYMIIFMPPYILD

SEQ ID NO: 178927 - protein, 63 aa, Triticum aestivum
  Clone ID: PAT_TA_73345.pep
MNSHMWKFFTWFAMVLFLKFVPKCMHIFINCLSHSVQSCKNGRERCRSQKQFECSCSCPRHVA

SEQ ID NO: 178928 - protein, 120 aa, Triticum aestivum
  Clone ID: PAT_TA_73346.pep
FGRGHLAVAPLPISGSQSSLLLLPRRASHAPVSLSLPLRSRLIAAVATKEEPELGGGGSGGDDGAGGSGGGGGSDPKEGGQEGEGEEEKMEQGLSLSQKLTLAYAALVGAGGVMGYMKSG

SEQ ID NO: 178929 - protein, 111 aa, Triticum aestivum
  unsure (1)..(111): unsure at all Xaa locations
  Clone ID: PAT_TA_73347.pep
MPPATVVAAIRWVEEEDGAPRQVSLDARALVVDGTRRLLFAGXMHYTRSTPEVRHAVAYVFWNVHEPVQGQYNFEGRYDLVRFIKEIQAQGLYVSLRIGPFIESEWKYGYE

SEQ ID NO: 178930 - protein, 148 aa, Triticum aestivum
  Clone ID: PAT_TA_73348.pep
TGPSFTEAAMGRLAQGTKVLAEGGYEKIFKQTFEVLPDEQLKICYACYLSTSAGPVMGVLYISTAKIAFCSDNPLSYKAGNKTEWSYYKVVIPLHQLRAANPSVSKVNSAEKYIQVVSVEGHEFWFMGFLMYDKAAASLQEALATARE

SEQ ID NO: 178931 - protein, 98 aa, Triticum aestivum
  Clone ID: PAT_TA_73349.pep
MEKAIDRQRVLLAHLLPSASASASSAQPQLAASACAAGDSAAYQRTSSFGDDVVVVAAYRTPICKAKRGGFQDTYPEDLLTVVLKAVLDNTRINPPDI

SEQ ID NO: 178932 - protein, 198 aa, Triticum aestivum
  Clone ID: PAT_TA_73350.pep
KPAIKTVLEAYLPQIVLIVFLALLPTLLMFLSKQEGIPSQSHAVRAASGKYFYFIVFNVFLGYTLGSTLFKSLTTIIDHPAGIVTMLANSLPGSATFFLTFVALKFFVGYGLELSRLVPLIIFHLKRKYLCKTEEDVKAAWAPGDLGYNTRVPNDMLIATVVLCYSVIAPLIIPFGVAYFALGWLIAKNQILRVYVPS

SEQ ID NO: 178933 - protein, 89 aa, Triticum aestivum
  Clone ID: PAT_TA_73351.pep
TDVELLRKYTLLHSLPLDKSLKIVRDFLISATAKDCSLMISFRPRENGSTDSEYDSVFLESVKRTYEYKAYFADLDAKPLVKMEHYFKL

SEQ ID NO: 178934 - protein, 78 aa, Triticum aestivum
  Clone ID: PAT_TA_73352.pep
SARGYNDMSLKDMDKKGVTFACMNSIGESPSSLATFALKFKDTATREEFKDAVEFHKTSKAPDVLLKTPENSPNAAEV

SEQ ID NO: 178935 - protein, 97 aa, Triticum aestivum
  unsure (1)..(97): unsure at all Xaa locations
  Clone ID: PAT_TA_73353.pep
FGRGGYGGWLLYXVAAAGDAGFVRELLGRQPLLVFGEGEYGVTDVLYAAARSRRXQVFRMLLNAVLSPAREDGAGDLGGAPSGATRGGYMFRREMMN

SEQ ID NO: 178936 - protein, 71 aa, Triticum aestivum
  Clone ID: PAT_TA_73354.pep
VPEALIQEMFRHNPEVSREGLGLYICQKLVKTMSGTVQYLREADTSSFIILIEFPVAQLSSKRSKPSTSKF

SEQ ID NO: 178937 - protein, 107 aa, Triticum aestivum
  Clone ID: PAT_TA_73355.pep
RRKNGTLLAFGIHFTPQISLNEFQKPALSTHANLYLLGKRNKRKKERKKRKVENKTYKYNFLPHTPLLLLRREETRIGSYNCCVMQPRDVAHQTYALGGYLSTLVRI

SEQ ID NO: 178938 - protein, 124 aa, Triticum aestivum
  Clone ID: PAT_TA_73356.pep
GRGWRGYGSGSSRDWAAKGPMLLGVKAVIAKSFERIHRSNLVGMGVLPLCFKPGEDADSLGLTGHERYTIRLPTNVSEIQPGQDVQAVTDTGKSFTCKLRIDTLVELAYFDHGGILHYVLRNLV

SEQ ID NO: 178939 - protein, 143 aa, Triticum aestivum
  unsure (1)..(143): unsure at all Xaa locations
  Clone ID: PAT_TA_73357.pep
FLEIKAKWFPFFXLMFLIIMAFIVPDSINFLPTLVSFMYVSWLYLRYFQRNPLTGLKGDPSDDFSFPSLFPAAMRPVTDPVANLFDRMLCARSRPSEVALPISDPAKASRRRERGERVLEERLAADNAGDTEATPHGHGTAED

SEQ ID NO: 178940 - protein, 127 aa, Triticum aestivum
  Clone ID: PAT_TA_73358.pep
VDENLEISLDNDLNIEKTEKPASSLTATEMDSSVHVVPSTDEVDEAIQPPDDDMGISSAAWVEVEHQELEVTDSGENVVAEDVTSPGIAPLPSSSPRVRHSLSQMLQADSNEPEIIEWGNAENPPPQ

SEQ ID NO: 178941 - protein, 35 aa, Triticum aestivum
  Clone ID: PAT_TA_73359.pep
GISGLNAGNAASIPSKCGVSVPYTISTSTDCSRVN

SEQ ID NO: 178942 - protein, 111 aa, Triticum aestivum
  Clone ID: PAT_TA_73360.pep
PSHTTLVSPLYQIEPRHGQGQPDLATPILGWFEMVSAARNRSSINGCQERPPAATAASTGLSKPGLRTATAAPSALSCDLSWLDLTGPMKCHYIMPFNGWVMEVILSGRFD

SEQ ID NO: 178943 - protein, 69 aa, Triticum aestivum
  Clone ID: PAT_TA_73361.pep
KIQDSWNAPHPMSTYTEETKAIRFIKRCSMTAPFWHCQCTLYREVMRDESSWSLLCPLPRAPHRHVALS

SEQ ID NO: 178944 - protein, 75 aa, Triticum aestivum
  Clone ID: PAT_TA_73362.pep
KGSAPSSHSEISNYSNYDINWIGCNWKRTVARESIFLCTHFARQVLNKPILPLFLELDQVDTCSSYKSSCKPSHL

SEQ ID NO: 178945 - protein, 109 aa, Triticum aestivum
  Clone ID: PAT_TA_73363.pep
MPSRQIPSNGMRDAHAKKKQPMKRRFNDLSEDEEDPLAMIRSMFRYDPSKYAGRDDDDSDMEADFATIEMEEQRSARIAKEEDDEQLRLIEEGERREQERKRRKMARGR

SEQ ID NO: 178946 - protein, 154 aa, Triticum aestivum
  Clone ID: PAT_TA_73364.pep
SSGMLYDGSSGDNAPFDINDFPQLTGRPNSAGGGQGQYGSLRKHGVSVNAIVQQNQEFSIQNEDFPALPGNKGSSSDYPMDIHHKDHLHENVNIMQAQHYPMARPSGFNLGSSYPPRQHQQSANSVQNAGLETIGLRPSNSPSPSTNAGVYEQF

SEQ ID NO: 178947 - protein, 65 aa, Triticum aestivum
  Clone ID: PAT_TA_73365.pep
MILVAVVAELLEEYTALVARVLEQLLTDAPFPRRMRFLSLRSLPFVPPPLPPPPPPHALHVTTRG

SEQ ID NO: 178948 - protein, 72 aa, Triticum aestivum
  Clone ID: PAT_TA_73366.pep
GSGSNREPEPDQHPSTLPSAFWRCRPLGNTADVPSCRDSVRVPTLVSWAHVTCHVPSSSAPPYLTLPQSDHR

SEQ ID NO: 178949 - protein, 150 aa, Triticum aestivum
  Clone ID: PAT_TA_73367.pep
RHEAQMIKEAIAALKDRTGSSSVAIAKYIEEKHGKALPANFKKMLSVQLRASAAKGKLVKVKASYKLSDAAKKDAPKAKATAKPAKDAAKAKKTVAAKPKKTAAAGTKRKAPEQKKLVAKAKKSPAAKAKAKPKTVRSPAVKKARKVAAA

SEQ ID NO: 178950 - protein, 59 aa, Triticum aestivum
  Clone ID: PAT_TA_73368.pep
ARLQNKNAAAIKACPYAAVRPSMVSITRYKISYELHHQPSDHSTKSANRMRNTTPPRQG

SEQ ID NO: 178951 - protein, 149 aa, Triticum aestivum
  Clone ID: PAT_TA_73369.pep
MGSLMAGWDSPVLADDDKKVNARRNRSLTKEEVEAFWKQRRSRRSSEEGGGELASPLSSPPATATWQESPFGSSEKPAAAAVRVDGFLPGGGSGDDDDAAADSPSRSRDWWTRSSWAFLNEPPQEEPSARAQQRYTPQFHVARIATGNA

SEQ ID NO: 178952 - protein, 100 aa, Triticum aestivum
  unsure (1)..(100): unsure at all Xaa locations
  Clone ID: PAT_TA_73370.pep
FGTRAKAKLLLYEQKSIESIQILRSRDVLSXSTRSKEERGQNRRVISMQLETLLSHESRLAQENLTYASENRFLRETVHFYQFTTQDNALLDDEGTDVGI

SEQ ID NO: 178953 - protein, 149 aa, Triticum aestivum
  Clone ID: PAT_TA_73371.pep
MEHAKSGPSSWPELADVVPVPQDDGPSPVVPIAYRDDFREVMDYFRALYFTGERSPRALRLTAEAIELNPGNYTVWHFRRLILEALDFDLLEEMKFVGKIAECNPKNYQIWHHKRWLAEKLGPDIANKEHEFTKKILAIDAKNYHAWSH

SEQ ID NO: 178954 - protein, 68 aa, Triticum aestivum
  Clone ID: PAT_TA_73372.pep
LIRHMAPTCQRGRGVSLGSHTICRNPDAPLMPCYFVGISVRYIAERRLTTIPLIHSLNKLELLTTPVS

SEQ ID NO: 178955 - protein, 141 aa, Triticum aestivum
  unsure (1)..(141): unsure at all Xaa locations
  Clone ID: PAT_TA_73373.pep
DSDEVEEALEQLDNVGHNFYCFRDEATGQVNILYRRKEGGYGLIIPKEDGNFDNKDTVGXRNHHHPPLRSRPWPCTPPPTTTDDPFLFFFACLLAATVKQTPPRTRRHLISISCMHWHIAVSVSVSVSLCHTHYSHSIAQV

SEQ ID NO: 178956 - protein, 98 aa, Triticum aestivum
  Clone ID: PAT_TA_73374.pep
HPCATVFPLGYVYIFLSEPNPCSNYIMHYLFPFAGSVRPSPVTSKHKPSSETPTSTEPPKGSCSVSKTAKAFTFRELAEATKNFRSDCLLEKGVPRPN

SEQ ID NO: 178957 - protein, 126 aa, Triticum aestivum
  Clone ID: PAT_TA_73375.pep
MDAAGGEQLSLAAVRDALVRLEDSVVFALIERARHPRNAPAYAPAAGGGGGYSLVEFFVREAEALNAKAGHYQKPEDVPFFPQDLPSPLFPTKPSPKALHPFALLVTVNDAIWKMYFDELLPLFTV

SEQ ID NO: 178958 - protein, 35 aa, Triticum aestivum
  Clone ID: PAT_TA_73376.pep
LGPFEGFPFGSGGSNSLFPSFPRTSSETAAFAGAR

SEQ ID NO: 178959 - protein, 54 aa, Triticum aestivum
  Clone ID: PAT_TA_73377.pep
FLNLISAPEGIQCICKRFPSLKIVTSEIDYGLNEEFRVIPGLGEYGDRYFGTDN

SEQ ID NO: 178960 - protein, 58 aa, Triticum aestivum
  Clone ID: PAT_TA_73378.pep
VPIDFATAEHKSPEHLARNPFGQVPAFQDGDLHLWESRAICKYVARKNNAAELLREGN

SEQ ID NO: 178961 - protein, 103 aa, Triticum aestivum
  Clone ID: PAT_TA_73379.pep
SARGKTASGSAPSPPTPSTPPAPCSTPSSVATPATRCCRTSSCTGASRSRRRRRRDRRSSIKGGNLFKKKRRRCGWLVDLSWAAQCNATQPLGVGLTQASRHC

SEQ ID NO: 178962 - protein, 177 aa, Triticum aestivum
  Clone ID: PAT_TA_73380.pep
MAPKKYNSRSNSSYSAPTAPLPERGPVEALVYWRDPVSSGIVFGATLVVLLSFAYMSLISVVAYLAMFIQSGCILLRLYKTALQTVNKTNESHPFQEYLDLDIRLPQEKAEELCKLAVVHINAVLVELRRLLLAEDLVDSAKFFGILWVLTYVGALFNGLTLIIIGFIALFTLPKVY

SEQ ID NO: 178963 - protein, 106 aa, Triticum aestivum
  Clone ID: PAT_TA_73381.pep
GTRNQSKIAATHRVCLCCLASSPPCRLQLARSAARGMSTTTTNAVSQQKDAADKKPAQETVTKTVQTVEVRSSAGQPDEEGVLKPVKVVHEIPAKEAKDNSGVKQD

SEQ ID NO: 178964 - protein, 118 aa, Triticum aestivum
  Clone ID: PAT_TA_73382.pep
SQLDRRNQIRSHARGRSRSRRVVVYCMSAAASRVTSAEDATASGDALPGAAPAIGDGAGEEAGALNSCADAITRSDEATAISSTATRGAIVNPTKKKKKNVARSTTRARGDSNHTSCR

SEQ ID NO: 178965 - protein, 99 aa, Triticum aestivum
  Clone ID: PAT_TA_73383.pep
IRTRELQKKLDEMAKGWPQKLKHELHDEHELVLLRRGTYGCDGCEEMGSTWSYRCDECDFDLHPKCALAEEKKGEEEEGKSTEEAPAGYVCEEGVCRKV

SEQ ID NO: 178966 - protein, 53 aa, Triticum aestivum
  Clone ID: PAT_TA_73384.pep
FFFFFFGKSTGSCLHENVQRTFFFTAKIASSPLLPSVIHIMNQWRTNKPSSES

SEQ ID NO: 178967 - protein, 177 aa, Triticum aestivum
  unsure (1)..(177): unsure at all Xaa locations
  Clone ID: PAT_TA_73385.pep
DSDEAGLGSAYANGMLYVVLYEGDQIAVMDVEGNTRKIIPVPFQEGGEFQPCSLASPNSQGHLHLIYHADLGHGEILPEQQSNELFIWVLEDYDILIXEEWVLKDTVSFLKLVGKMTGQTINGFKVVAIHPDHSLVFLIQHFNRDLISYNMDKKCLVSALAISPSLHMFHFKRVVNI

SEQ ID NO: 178968 - protein, 95 aa, Triticum aestivum
  Clone ID: PAT_TA_73386.pep
RRRSVATSKGGLIVFKMGKDKEATKLKEEEKHKKRENKDKDKKDKKDKEKDGSEPKGSSDEKQEKGKDKKKKDKKSEEMEQKEDHLENKNDKAAQ

SEQ ID NO: 178969 - protein, 189 aa, Triticum aestivum
  Clone ID: PAT_TA_73387.pep
IRTRVTSSSSLEPDRLSVVVKRAGRWTEKLYETISSLPPSQPGHLDVSVEGPYSQATPASFLQYDSLVMISGGGGITPFISVIRELVHRSGTAAEAATPSLLLIAVFKTSADLAMLDLIVPASGGFSDISRLELRIEAFVTRESVPSAGDVVAIAHKVPAEEVLFKPSPSHAPIAPVLGHNGWLWLAAV

SEQ ID NO: 178970 - protein, 85 aa, Triticum aestivum
  Clone ID: PAT_TA_73388.pep
DSDEGPWSGSKITVPAKFILSKNDVGLQSFGTEEYVKSGGLKENVPDLEVSIIEGHHFVQQEEAESVNSEILSFLNKFATEGGSA

SEQ ID NO: 178971 - protein, 67 aa, Triticum aestivum
  Clone ID: PAT_TA_73389.pep
CNNLVPPLHFLPHCILYQQLNKTTNGPLGLDSVWCIVSLQSQTKKNLELALTRRRRGHSAFGRLFPL

SEQ ID NO: 178972 - protein, 155 aa, Triticum aestivum
  Clone ID: PAT_TA_73390.pep
MQLLVRNPASSGGCAFLPAAAATLRPPSSATLSWRRPGCSWRSKRCLSLPPRANTDGSGSGAAAAEASTVGDTLEREEGGGVDAGASAESSSNRKQPRPVDPKIEKELKKAVQKTAATFAPRASTKTKNPAVPGTALYSIFEVQGYVSMLLGGAL

SEQ ID NO: 178973 - protein, 152 aa, Triticum aestivum
  Clone ID: PAT_TA_73391.pep
MVGADIDPQKLLQFFSKYGEIEEGPLGLDKVTGKPKGFALFVYKTLDSAKKALQEPHKQFEGVVLHCQKAIDGPKPNKGGGLGGLYGAGTSGGRKGAGGYGAHSHSLPGAAVGGHVMPSPVSSLTSLPGVAGGPGVNPALGQALTAILASQG

SEQ ID NO: 178974 - protein, 86 aa, Triticum aestivum
  Clone ID: PAT_TA_73392.pep
PSHPLADTESLLSLSAPRFSPPPAPSFSSPPTYVNNPPTIDTTNPIMSSLCPFAKLASAGATCPVKSSSDNKTTINHADDDDDDNE

SEQ ID NO: 178975 - protein, 153 aa, Triticum aestivum
  Clone ID: PAT_TA_73393.pep
ADLIFTYFLGKYLVVPIFDEVTRSGPSLNTTGPQLRRLEESLLLTIQGKGNVFISNIHLLIWCIDRSLSRCACVHGDGGQLYAAIMASATGSAGGVAWIGLKGNTHTNWTKICNIYGNFCRHIGSSVFLGLVASVILVLLTILNAYCLYRRSR

SEQ ID NO: 178976 - protein, 99 aa, Triticum aestivum
  Clone ID: PAT_TA_73394.pep
IRTRQRSFFDSLVKYITSGPVLAMVLERPDAIAQWRALIGPTDARKAKTSHPNSIRAMCGLDSEKNCVHGSDSPESAAREISFFFGEEADSVTVEHDEL

SEQ ID NO: 178977 - protein, 42 aa, Triticum aestivum
  Clone ID: PAT_TA_73395.pep
ILLTSCYCWLLMLFYISYNYNKQRLNRSNMCYTGGEINEYTN

SEQ ID NO: 178978 - protein, 161 aa, Triticum aestivum
  Clone ID: PAT_TA_73396.pep
IVFERGDLVFVFNFHPKKTYDGYKVGCDLPGKYRVALDSDAFVFGGHGRVGHDVDHFTSPEGIPGVPETNFNNRPNSFKVLSPPRTCVAYYRVDEEAERLQAKAETTGSRKTSPDIIDVDATPVKTSTATKEDKEATSGGKEDASKKGWKFARQSSNKNTK

SEQ ID NO: 178979 - protein, 86 aa, Triticum aestivum
  Clone ID: PAT_TA_73397.pep
SARGDDLISLEEICQYSGGLAGAAAMYPCPVLAWQLGSWLGCMRVRLRTLLYVSLGLSWQWRREGGAEGGLAPPNLPITPLIHLID

SEQ ID NO: 178980 - protein, 125 aa, Triticum aestivum
  Clone ID: PAT_TA_73398.pep
MDFTSSYFHAFGNPDFAAVFSGGGSAQAIRPGTTTSSSGGAKAVNVGRGGAARQGAPSVFCVQDAEVEEAHHFLDECTLCRKGLAGDIFMYRGDTPFCSEECRREQIEMDRNRHRRKKQQYSPTA

SEQ ID NO: 178981 - protein, 72 aa, Triticum aestivum
  Clone ID: PAT_TA_73399.pep
SRNWYPPAPASVWDPIRSVGRGANLACTRVLIRRLQPGRKESRRSPAGDGLAADLEQRRTRRERGKLPSSES

SEQ ID NO: 178982 - protein, 211 aa, Triticum aestivum
  Clone ID: PAT_TA_73400.pep
FGRGYIDSVLNQDRAHPDKYIDSVLNRATHQDSYLALNRKYDLMFTDIDDISRMKGSSIEEVTKPYTTAPTSDPYSLRSRDGSFYRHPSSEDLNINTDVPMQGYSARYGQIGGDSYPQARMVPLATDSETHQRMHGGTSADDYPSTRYSLGSSGARFSQPATTVPSFGLPGVSSQRGSGSVMDKYSYGLLGPTVPQSSVIDRYTASLDGTS

SEQ ID NO: 178983 - protein, 98 aa, Triticum aestivum
  Clone ID: PAT_TA_73401.pep
MKKAIDEERFEDAAKYRDELMILAPHSLLKCSSDATTLGIRVQVRSVYIESRSQPLKGQFFFAYRIRITNNSQRPVQLLRRHWIVTDGNGRTENIWGV

SEQ ID NO: 178984 - protein, 80 aa, Triticum aestivum
  Clone ID: PAT_TA_73402.pep
SNNGLEVWAGPLSNNRKAVVLWNRQGYQATITAQWSSIGLASSTAVTARDLWAHSSFSAQGQLSASVAPHDCKMYVLTPN

SEQ ID NO: 178985 - protein, 155 aa, Triticum aestivum
  Clone ID: PAT_TA_73403.pep
FGTRIQLNVQQEADGMIRRSEAGYMETSIPSTCTVTIRAHDGGCGSLMFEHNSDKLISGGQDQTLKIWSASTGALTSTLHGCLGSVNDLAVTNDNKFVVAACSSNKLFVWEVNGGRPRHTLTGHTKNVSSVDASWVKSFVVASSSNDRTIKTWDL

SEQ ID NO: 178986 - protein, 79 aa, Triticum aestivum
  Clone ID: PAT_TA_73404.pep
FGRVPFRPPGVPPAPFPGAPQQFMRGPPPMGPPQVRPGMPGPPPPGMRPGMAPPPFGQPRPGMQPPPPGPQQPGQNPPQ

SEQ ID NO: 178987 - protein, 184 aa, Triticum aestivum
  Clone ID: PAT_TA_73405.pep
FGRGSIVVQCVIQLAKLYGLHTINIIRDRPGSQEAKDKLKQLGADHVFTESQLDIKNIKSLLGALPEPALGLNCVGGNAASVILKFLRQGGTMVTYGGMSKKPVTVSTSSFIFKDLSLRGFWLQKWMSSDKAEESRTMIDYLLDLVHEGKLKYEMELTPFSDFHLALDKALGKHGSQPKQVLKF

SEQ ID NO: 178988 - protein, 60 aa, Triticum aestivum
  Clone ID: PAT_TA_73406.pep
IRPRERESARERERERERERERERERERERERERERERERERERERPAREATRIPPKIPR

SEQ ID NO: 178989 - protein, 199 aa, Triticum aestivum
  Clone ID: PAT_TA_73407.pep
MAANFWTSSHCKQLLDPEDVDLVPAADRERGITPEEFRLIKIHMSFHIWRLAQQVKVRQRVIATAVTYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASV

SEQ ID NO: 178990 - protein, 156 aa, Triticum aestivum
  Clone ID: PAT_TA_73408.pep
FGRGLADFDRVMAINARGVVAGVKHAARVMAPRRRGSIICTASIAGVLGSITPHPYSVSKAAVVGLVRAVAGELARSGVRVNAVSPNYIATPLVMRILQEWYPERTADEHRLIVEKSINEMEGVVLQPEDVARAALYLASDESKYVNGHNLVVDGG

SEQ ID NO: 178991 - protein, 104 aa, Triticum aestivum
  Clone ID: PAT_TA_73409.pep
VRPRSRPRPRPRAPRPQPPPCRGRREAGRWRRGEWCAGLDQGPHESVLELYVSIVRAIRSVVHSRSYGCCSLLITIPHLAVCYSVFLLSTVWSIVLRMHLYDST

SEQ ID NO: 178992 - protein, 45 aa, Triticum aestivum
  Clone ID: PAT_TA_73410.pep
HPDAVVLHVVIVLVGARVGLHAAAAVPAGVVAVVVHAGRAAVVVV

SEQ ID NO: 178993 - protein, 52 aa, Triticum aestivum
  Clone ID: PAT_TA_73411.pep
HISLCFWLTTDHPSHLIRSKLDKSRTRVWCSSLAAFLLMLASKSAPQLRRHK

SEQ ID NO: 178994 - protein, 120 aa, Triticum aestivum
  Clone ID: PAT_TA_73412.pep
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRDRGSRYDRGRDYGSGRAPAR

SEQ ID NO: 178995 - protein, 109 aa, Triticum aestivum
  Clone ID: PAT_TA_73413.pep
MGRRPARCYRYCKNKPYPKSRFCRGVPDPKIRIFDLGKKKAKVDDFPLCVHLVSDEYEQLSSEALEAGRICANKYMVKHCGKDQFHIRMRLHPFHVIRINKMLSCAGAD

SEQ ID NO: 178996 - protein, 141 aa, Triticum aestivum
  Clone ID: PAT_TA_73414.pep
IRTRDVAEAPAADDDDDDDVDLFGEETEEEKKAAEERAAAAKASGKKKESGKSSVLLDVKPWDDETDMAKLEEAVRSVQMEGLLWGASKLIPVGYGIKKLQIMMTIVDDLVSVDTLIEDHLCAEPVSEYVQSCDIVAFNKI

SEQ ID NO: 178997 - protein, 76 aa, Triticum aestivum
  Clone ID: PAT_TA_73415.pep
VLFLYHILAQLLVCLFRLLIGTASSVPIGSFVPSVEELSTRCLSLITRHFPACKHSSKISAIRIIVNGSSGKPGWL

SEQ ID NO: 178998 - protein, 41 aa, Triticum aestivum
  Clone ID: PAT_TA_73416.pep
APGISPSLKNFLLSIVSGGVVLVAIVGAVVAVSNFDPVKRG

SEQ ID NO: 178999 - protein, 69 aa, Triticum aestivum
  Clone ID: PAT_TA_73417.pep
MADWGPVVVGVVLFVLLSPGLLCELPGTHRHVDFGGFHTNGKAIFVHTLIFFAAFTILTLALHVHIYTG

SEQ ID NO: 179000 - protein, 112 aa, Triticum aestivum
  unsure (1)..(112): unsure at all Xaa locations
  Clone ID: PAT_TA_73418.pep
VATWDXRAPQPSQIESAVRWAVRKRSQNKPVYVHCAYGHGRSVCVMCALLVALGLAEDWKAAEQMIREKRPYISMNTLHRKSLEEWSKHLLSSKRSGESDVSSVIHSDYNQK

SEQ ID NO: 179001 - protein, 56 aa, Triticum aestivum
  Clone ID: PAT_TA_73419.pep
MEACSSDRPYYVFVRTISRISLSGAGMPVKCSNCPLACRINISRPLPPVAPHSAAS

SEQ ID NO: 179002 - protein, 67 aa, Triticum aestivum
  Clone ID: PAT_TA_73420.pep
IKFSSYISYLHDCSLRSKTFLLVLAADMHFSKYIVVSFSRILMLYLSYQFHAIILELNKTKPEKLID

SEQ ID NO: 179003 - protein, 122 aa, Triticum aestivum
  Clone ID: PAT_TA_73421.pep
LLVGGMTRVPKVQAVVSEIFGKSPSKGVNPDEAVAMGAAIQGGILRGDVKELLLLDVTPLSLGIETLGGIFTRLINRNTTIPTKKSQVSCHTSILSQNAVSSCLIIPYLTRMGVFFLDMTHI

SEQ ID NO: 179004 - protein, 92 aa, Triticum aestivum
  Clone ID: PAT_TA_73422.pep
NSVLSTHSLIEHTDVVVLLDNEAIYDICKRSLDIERPTYTNLNRLISQVISSLTTSLRFDGAINVDITEFQTNLVPYPRIHFMLSSYAPIIS

SEQ ID NO: 179005 - protein, 92 aa, Triticum aestivum
  Clone ID: PAT_TA_73423.pep
IRTRVNGKVAPASSSPGGAASSLLAAASAMTTSSPALALVDERMSTEGTGLSLGLSNNLLGWILLGVFGLIWSLYTVYTSTLDEDEDSGLSL

SEQ ID NO: 179006 - protein, 77 aa, Triticum aestivum
  Clone ID: PAT_TA_73424.pep
RRWSGVDSAAPHAVPASRGPRRHPPLPAPRRLPRAPHEDYLANWSSWDGNSLRSQRDPTPSLRGSTREVIAAKIETK

SEQ ID NO: 179007 - protein, 32 aa, Triticum aestivum
  Clone ID: PAT_TA_73425.pep
PRCSKFAYSMKPKHRSHLAIYTRSLHTSSSLV

SEQ ID NO: 179008 - protein, 89 aa, Triticum aestivum
  Clone ID: PAT_TA_73426.pep
IRTRERTSLEFFFFFFFFFFNTKSKHNTLYLSIFEAAYIRAFIPYLGIYLSNRTTRPAENASLFYPSTARSNISGLTGLATIISLFKGI

SEQ ID NO: 179009 - protein, 83 aa, Triticum aestivum
  Clone ID: PAT_TA_73427.pep
MCSITRLAFVLALAIASSTEVAESRDFNILAQGSLPDAAKGPGLTAASGKLCQLCEQYSTEALFYLTQNETQTEILSILHHEC

SEQ ID NO: 179010 - protein, 78 aa, Triticum aestivum
  Clone ID: PAT_TA_73428.pep
LPSHSFHSTSILSSLNYSTKNLSPLPSYSRNPCAAAQSSSTTSRRRGAGCHPPPTSGLDPTPTPRTLTPLSPLTLRER

SEQ ID NO: 179011 - protein, 123 aa, Triticum aestivum
  Clone ID: PAT_TA_73429.pep
MARSMQFAVAMIAVVVAAVLLAAATTTSEAAVTCGQVNSAISPCLAYARGTGTAPSAACCSGVRSLNSAASSTADKRTACNCLKSAAGRVSGLNAGNAASIPSKCGVNIPYTISASIDCSRVN

SEQ ID NO: 179012 - protein, 194 aa, Triticum aestivum
  unsure (1)..(194): unsure at all Xaa locations
  Clone ID: PAT_TA_73430.pep
PTLRRAPPLPRPSSLSDPPRRSLEVSAGRPRSALPTRIPWLSSKKTRRRLQIPPLVTSPLGDVLHHVDKVSHGQFAFTTVESGNYLACFWTETLEKGMVVNLNXTGIAAKDWDSIAKKEKLDVPVEEASFVHSEPPQDGSAPPVVSSDMEVLHDKVKKQVIKEGHGRKPIKFATCFACIGGGIQPCRRVARIAR

SEQ ID NO: 179013 - protein, 135 aa, Triticum aestivum
  Clone ID: PAT_TA_73431.pep
FPALYQQGPKNLFFDWYRILGWMGNGLYSSLAIFFLNLCIFYDQAIRAGGQTADMAAVGTAMFTCIIWAVNMQIALTMSHFTWIQHLFVWGSITTWYIFILAYGMTLRSRDNYQILLEVLGPAPIYWAATLLVTA

SEQ ID NO: 179014 - protein, 138 aa, Triticum aestivum
  Clone ID: PAT_TA_73432.pep
GTRQRGLLNKESEESDEEENYFSIELTPSLFTSAVDNAYQSIHDFSKPLINMMKAAGWDLDGAANAIEPGVVYTRRAHKKFAFESYICQRMFSGFQEESFAIKDSNISVSNEAFFHQFLAVRAMDPLDVLSQNPDSVF

SEQ ID NO: 179015 - protein, 177 aa, Triticum aestivum
  unsure (1)..(177): unsure at all Xaa locations
  Clone ID: PAT_TA_73433.pep
IRQRVMVVKRRGGKEWDKDMPHSEWINTVQSEPDVISMSFLPITSLLNGVPGCGFLNHAINLYLRYKPPIEELHQFLEFQLPRQWAPVYSDHPLGPQRRKQSSASLALSFMGPRLYVCTNMVDVGERPVTGIRLYLEGKKSNMLGIHLQHLCSLPXILQLQDDPYNHRTPEPYDRKY

SEQ ID NO: 179016 - protein, 111 aa, Triticum aestivum
  Clone ID: PAT_TA_73434.pep
GWNEELKLSVPQHYGPLKLQVFDHDMVSKDDLMGQAEIDLQTMINAAAAFGDPELLGDIQIGRWLKSEDNALVRDSAVVVSGGKVKQGVALKLQHTESGELELEMEWMPLV

SEQ ID NO: 179017 - protein, 84 aa, Triticum aestivum
  Clone ID: PAT_TA_73435.pep
LSCAMLIYSFSHDAASWVMFLLRVSCRVGVDGGVGRHGVVLLIGRVRDRLHRLVVATAAVACMTAAALATPALFACISLFASCR

SEQ ID NO: 179018 - protein, 80 aa, Triticum aestivum
  Clone ID: PAT_TA_73436.pep
FIYSKVKKQNQVKMKFASVLCIIFFISFAALFGDSSCYRMKSEMRSKRQVDNAETGKTTTAKPVNIEDMVMGATTSKTYT

SEQ ID NO: 179019 - protein, 54 aa, Triticum aestivum
  Clone ID: PAT_TA_73437.pep
SLFHDRMISTLQVHQLAAATLIFKTNNFVRRMTNISNESKKFEALGNTLLCLKA

SEQ ID NO: 179020 - protein, 72 aa, Triticum aestivum
  Clone ID: PAT_TA_73438.pep
GGSAISYGVYFYNATRGSLTTLSSLTFLTPMFASIFGFLYLGETFSPVQLGGALLTLVAIYMVNYKSIVGEK

SEQ ID NO: 179021 - protein, 103 aa, Triticum aestivum
  Clone ID: PAT_TA_73439.pep
FGRGPIISLSPSVAVEMSKMAAQTVGNSVSEFLSGFSDTKTDSAARVSFKYGCTRGVYGAPFFFVNGFLQPGGGSPIDYSTWIGILDPLVSQNGERIEMFTSM

SEQ ID NO: 179022 - protein, 98 aa, Triticum aestivum
  Clone ID: PAT_TA_73440.pep
MISVRLQEASRSPGIASYLQEAGRVVTAMAQPQPRRGDEGLQAQGGNGKAPAAQQDPIKYGDAFPVKGELAGQPIAPRDAAAMRSAEDSVPGVQVPQE

SEQ ID NO: 179023 - protein, 107 aa, Triticum aestivum
  unsure (1)..(107): unsure at all Xaa locations
  Clone ID: PAT_TA_73441.pep
STGAFIGASRYASATMIPPSIISRGVGWQVRIQILYCGLSDLSLYHGXVTLLNVKHPCQGIGLLLDSFFGTATGTSVSVENIGLLALTRIGSRRVVQISAGFMIFFS

SEQ ID NO: 179024 - protein, 100 aa, Triticum aestivum
  Clone ID: PAT_TA_73442.pep
IRPRRERDRERERERERERERERERDNCGKSAQGSTEFCKAHGGGKRCTWSTGCEKFSRGKSGFCAAHGTLMARQREQEVVKNVGSMIGPGLFSGIVVSS

SEQ ID NO: 179025 - protein, 33 aa, Triticum aestivum
  Clone ID: PAT_TA_73443.pep
SDEERFQNVVVEVRIDLIWFVVLHDYQFRMLDK

SEQ ID NO: 179026 - protein, 115 aa, Triticum aestivum; identical to SEQ ID NO: 178870
  Clone ID: PAT_TA_73444.pep

SEQ ID NO: 179027 - protein, 108 aa, Triticum aestivum
  Clone ID: PAT_TA_73445.pep
MAPKKDKAPPPSSKPAKSGGGKQKKKKWSKGKQKEKVNNAVLFDQATYDKLLSEVPKYKQITPSVLSERLRINGSLARRAIKDLMARGLIRMVAVHSSQQIYTRATNT

SEQ ID NO: 179028 - protein, 128 aa, Triticum aestivum
  Clone ID: PAT_TA_73446.pep
CNFISLSFVWFIKQGDKIAFVEAYDESLAHLIYAGSDIILCSSFEDPSLQTAMKAIKYGSVPVQLNFPSDESRELEGHDCPNTAMSQYIISTYGDLSLSQTLDDFNNDPSHWDRQIKDGMGRGSSWDM

SEQ ID NO: 179029 - protein, 147 aa, Triticum aestivum
  Clone ID: PAT_TA_73447.pep
MNIADDADHHVHEHRHIDGGHDHFDSRNIGFLFLEDALTPGSKVAPYIDPASSRGAPLLPRDVADSIPMSTKSFTDILRMFSPVSRAMAESIWYSLELCEHPRPIKGEKRGCVTSIESMVDFAASMLGTSDLRAFSSPSVPVEGRNA

SEQ ID NO: 179030 - protein, 101 aa, Triticum aestivum
  Clone ID: PAT_TA_73448.pep
RTDYQHVKTTFSNTPPSKREVCRLLPCSNGDQKGFRDFISYLKQRECAGVIKIPSVKPLWSRLLFILPPTPEACGMLELPPHPTECLIALILPKETTAEAT

SEQ ID NO: 179031 - protein, 140 aa, Triticum aestivum
  unsure (1)..(140): unsure at all Xaa locations
  Clone ID: PAT_TA_73449.pep
IHDAERSWNRTCSVAVSAAACIXQIPEKAVQLHRQHDRVYCSSTASPEIPVTPPWPSSNKEGMHNIHQHKRWKNRKKLPFTSGTQTWKDMRASAAARSANGGSHPRKKQSSPQPLQRPLPTSQLDSTTLQNKEISMLVTF

SEQ ID NO: 179032 - protein, 58 aa, Triticum aestivum
  Clone ID: PAT_TA_73450.pep
VISQLRIMSMKNKYVVIPFLRVHTRYHLQGRSLGICQGHPPPSQQKSSHSQTSYVLFF

SEQ ID NO: 179033 - protein, 70 aa, Triticum aestivum
  Clone ID: PAT_TA_73451.pep
SLSPRIAHSPTRHQLNSALLCVGLGSKQAKRLHGFDDGVQPGRGVVRRAGVGAAGDVASGGRPRRRGPAA

SEQ ID NO: 179034 - protein, 126 aa, Triticum aestivum
  Clone ID: PAT_TA_73452.pep
EYHVYEFFKIWNCSRERANFLVHEFFTTQYFQDGIHPIPGARDALQTLSSFCSLSVVTSRQDVIKNHTLEWIEKYYPGLFEQIHFGNHFALEGRSRPKSEICRSFGAQVLIDDNPRYALECANDGM

SEQ ID NO: 179035 - protein, 137 aa, Triticum aestivum
  Clone ID: PAT_TA_73453.pep
IPLDEDMKGKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKQSQEPESTTSEKSGQQSQ

SEQ ID NO: 179036 - protein, 70 aa, Triticum aestivum
  Clone ID: PAT_TA_73454.pep
DFLLVLPKITLWVYPCSELKKNHLILLLHQNVQNICYLHQSHPKNLKRNSITCSAYPNSLSTNRERASSE

SEQ ID NO: 179037 - protein, 61 aa, Triticum aestivum
  Clone ID: PAT_TA_73455.pep
STSSLVLLPALLPPPSPAQCSDQPAPMGVLSAADPPPVSAIGFEGYEKRLEITFSEAPVFA

SEQ ID NO: 179038 - protein, 139 aa, Triticum aestivum
  Clone ID: PAT_TA_73456.pep
RHEVKSDGKITALHIDLGINAGISPDVSPMMPLAIIGSLKKYNWGNLAFDTKVCKTNVSSKSAMRGPGDVQGSFIAEAIIEHVASALSVDTNTIRRKNLHDFESLVVFYGDTAGEASTYSLVTMFDKLASSPEYQRRAE

SEQ ID NO: 179039 - protein, 146 aa, Triticum aestivum
  Clone ID: PAT_TA_73457.pep
IRTRAARSVFRPEFMNRVDEYIVFKPLEREQINSIVKLQLARVQKRIADRKIKLEVSPGAIEFLGSLGYDPNYGARPVKRVIQQYVENELAKGILRGDFKDEDSIFVDTQVTVPSNGQLPQQKLVFRKVGEQSKAAAEDEKFLPAV

SEQ ID NO: 179040 - protein, 189 aa, Triticum aestivum
  unsure (1)..(189): unsure at all Xaa locations
  Clone ID: PAT_TA_73458.pep
ADADTERFLDDSIEQSDRLLMQVWQSLVSSVLNVFMTKTSINGLLRRGSMFVFSTDQIRRLLNLTFFDSGTTLVDLGAGDGATTEKYAPLIREVYTTEKSGPMIRILTQKGFRLLDVDTWWTREEKFDVVSCLNLLDRCSDPAKLLDXIKSAVKPNGRIVVALVLPYRPFDEFRSAIPEQKLPITGVTF

SEQ ID NO: 179041 - protein, 66 aa, Triticum aestivum
  Clone ID: PAT_TA_73459.pep
MAEENKSGSGDLMASGKVVAEATMSVFQQKSVEGVDKKEVAGAAADLLHSASTYGKLDDKPVGQYI

SEQ ID NO: 179042 - protein, 90 aa, Triticum aestivum
  Clone ID: PAT_TA_73460.pep
GGRSSRRPRGAPRKRTIRVTAATRTAAGAAAAAAAVRRAISAAAARARYPNSRRSFYCKFGEGSAVGYYCKIAVRACVRAVQMVCIGRKW

SEQ ID NO: 179043 - protein, 180 aa, Triticum aestivum
  Clone ID: PAT_TA_73461.pep
LAVTGINKKNCQEFCLCLAHLSSLESLSVRSWEKEGLRGCLDSLSMPPKDLQSLKLFGTLGKLPEWVTGLQNLVKLKLERTKLTELDVTMQVLGKLPNLAILRLLNYSFRASEPYHLTCCREAFPSLTALELQYAGIKSVLFEAGTAPKLELLLCQHGITFSGLSSLPKLKEVMIDNKYS

SEQ ID NO: 179044 - protein, 57 aa, Triticum aestivum
  Clone ID: PAT_TA_73462.pep
SDEGHMHTHFVLYHDPVCLFRSPVCMHVFSVMIFVLRIWCCKFNSPLLWFLGHEECL

SEQ ID NO: 179045 - protein, 76 aa, Triticum aestivum
  Clone ID: PAT_TA_73463.pep
AAAGDAAPPKPAEEAPKEKEPVPAPAPKEEGGKSSSEGFGLGDVVKGAEQLVEKQGGAGEESAAGGLFKMAQGFLK

SEQ ID NO: 179046 - protein, 86 aa, Triticum aestivum
  Clone ID: PAT_TA_73464.pep
RPPPPTWRPALQPPRPPPTPTTSRRPHFRLRPRCPSLKLTLKLKRSMKLSMSPPFLACSLVRKRRTEGVRDVAAMERRGEGRGCDD

SEQ ID NO: 179047 - protein, 88 aa, Triticum aestivum
  Clone ID: PAT_TA_73465.pep
SARGLRRPWRRRLARGDQPRRPADARGRRLLWQHAVADGRQDGAGRRLPLLLRSSATPRTDSAQLCIVQISSGFRENKQKTNSANIWL

SEQ ID NO: 179048 - protein, 169 aa, Triticum aestivum
  Clone ID: PAT_TA_73466.pep
SSVKPGSPLLVSVSLLSHLPSPVVVDQLEVQFNQSDCNFVIHSAQEDSPPLDSNLHDQIVQDTSSLTLFTNRWMRLTHELKSGQSGKLECLSVKATINKHLVICCHAESPASMEDFPLWKFENQVETLPTKDTALAFSGQKLIQVEEPDAQVDLVLNSAGPALVGELFT

SEQ ID NO: 179049 - protein, 114 aa, Triticum aestivum
  Clone ID: PAT_TA_73467.pep
KAATVYSCFLGTSANLRYQVIAGLIEHRLREDLMTYYNQPLLASLVSFVSRTVNSYWGTQQWIDLARATSVQSTKKELPSPEVSSATEMPLLECGTTEVQNVDDSSNNQSNDLT

SEQ ID NO: 179050 - protein, 99 aa, Triticum aestivum
  Clone ID: PAT_TA_73468.pep
NEGTILFIIIDKLCTYKRLKGASLCTDKTKPTNKVHNSDRGYTRRAEVIRDQTFLSISEYNSAWRGVCFHVVLVISSIHTITKFTAHRSIDLMCGDQLG

SEQ ID NO: 179051 - protein, 127 aa, Triticum aestivum
  Clone ID: PAT_TA_73469.pep
FGTRHGGLTKPDYATCVLISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILI

SEQ ID NO: 179052 - protein, 55 aa, Triticum aestivum
  Clone ID: PAT_TA_73470.pep
ANPKLLQPPCTLSKYNCSHSGVADSLFLQAVVTPYFIIMVNYVHEIRSTCQFGTR

SEQ ID NO: 179053 - protein, 149 aa, Triticum aestivum
  Clone ID: PAT_TA_73471.pep
MEIFVKTLTGKTITLEVESSDTIDNDKAKIHDKEGIPPDQQRLIFAGKQVEDGRTLTDYNIQKESTLHLVLRLRGGVQIFCKTLTGKTITLEVESSDTIDNVKAKIQDKEGIPPDQQRLIFAGKQREDGRTLADYNIQKEYTLHLVLRL

SEQ ID NO: 179054 - protein, 138 aa, Triticum aestivum
  Clone ID: PAT_TA_73472.pep
RHEGRKRPAPKGATYGKPKSHGVNELKPKRCLQSIAEERVGRRCGGLRVLNSYWVGQDSTFKFYEVITVDTAHPAIRRDAKINWICNAVHKHRELRGKTSAGRKSRGLGKGHGFSQTTGGSRKACWKRKNTLQLHRKR

SEQ ID NO: 179055 - protein, 182 aa, Triticum aestivum
  Clone ID: PAT_TA_73473.pep
DSDEACGPCIGQWDRQDTKKGEKNTIVSSYNRNFTGRNDANPATHSFVASPELTTALAIAGRLDFNPLTDSIKDGSGKEFKLAEPTGEELPARGFDPGENTYSAPPSDGSSIRVDVDPKSDRLQLLTPFDRWDGKDMVEMPILIKIKGKCTTDHISAAGPWLNYRGHLDNISNNLFIAAINS

SEQ ID NO: 179056 - protein, 120 aa, Triticum aestivum
  Clone ID: PAT_TA_73474.pep
IRTRPAPLNPSLKTKPSISLLSLSFFQETGDKGDRYTTILRSAGGGHILDFCHRRSSCLGDTRSCYIFFQLNRIDACISFAQSDRRFSQLAGKKGQERLRAAEEEDDDDRGRQSQQKEPQ

SEQ ID NO: 179057 - protein, 140 aa, Triticum aestivum
  Clone ID: PAT_TA_73475.pep
PELRWAFVRKIYVILAVQLAMTAAVSGFVVKVPAVSNFFVSSNAGIALYIFLIILPFIVLCPLHYYHQKHPVNLLLLGLFTVAISFAVGMTCAFTSGKIILEAAILTAVVVISLTAYTFWAAKRGHDFNFLGPFLFAAIM

SEQ ID NO: 179058 - protein, 86 aa, Triticum aestivum
  Clone ID: PAT_TA_73476.pep
IRTRLSLSLSLSLSMLTVGACCPMLTELDISNCYDVSYKSLEVIGQSCQNLRVLKRNIFNWIDPSEHVGIVPEDYLRECPELPKKK

SEQ ID NO: 179059 - protein, 85 aa, Triticum aestivum
  Clone ID: PAT_TA_73477.pep
FTTFLIGCTPNTPKCSITNFLDDGIPLHFICWWCTELPLFQNSCIVTNKTHICITGAPLDVTTPKSLKTALKAMNAIPMLCTTKS

SEQ ID NO: 179060 - protein, 151 aa, Triticum aestivum
  unsure (1)..(151): unsure at all Xaa locations
  Clone ID: PAT_TA_73478.pep
LLRKRXIPEEKYTNAFLGFGPEDTNFAVELTYNYGVDKYDIGTGFGHFAIANEDVYKLAENIKSKGGKITREPGPVKGGSTVIAFAQDPDGYMFELIQRAETPEPLCQVMLRVGDLERSIKFYEKALGLKLLRKKDVPDYKYTIAMLGYAD

SEQ ID NO: 179061 - protein, 139 aa, Triticum aestivum
  Clone ID: PAT_TA_73479.pep
IRTRLKLDLHDNKDKQKVLKAVSTLHGIDSISVDMKDSKLTVVGLVDPVDVVAKLRKVGAAAIVSVGPAKEEKKDGDKKDGDKKDGDKKDGDKKTPPPVILYPHHQWYPYAAAQYHPHPYPPQYVVHSAEEDPNSCVIC

SEQ ID NO: 179062 - protein, 125 aa, Triticum aestivum
  unsure (1)..(125): unsure at all Xaa locations
  Clone ID: PAT_TA_73480.pep
SFCVPFSLVPLLIFSSSCVVKAPYKNSNSIVKVAWILSVVIMGINIYFFCNSFISCLVHSELPRLXNAIISILVFPFMAAYIAALIYLAFRKVNAAGLFPSVPVSNGTEVEAWRQERIADDIGVH

SEQ ID NO: 179063 - protein, 120 aa, Triticum aestivum
  unsure (1)..(120): unsure at all Xaa locations
  Clone ID: PAT_TA_73481.pep
GIAHVKKQMLENAXQKIVTVEQKLTRGWGGENAYHVSGYRYLLVDPERRISRASPPVKVTTLAKDSLLALNMLRQEVDLEKSRYKRGDPCHDKDFEACIRTKNNAWVIAKISRGRELYMA

SEQ ID NO: 179064 - protein, 79 aa, Triticum aestivum
  Clone ID: PAT_TA_73482.pep
VGKFSVIWNFQQVKDSNHECYRDQQGLKSCYCYKVVLKDESIVDSRFMHEKFASSDSPEAPLVVATPMKVSSFSIANRR

SEQ ID NO: 179065 - protein, 49 aa, Triticum aestivum
  Clone ID: PAT_TA_73483.pep
AAAHVGQFIKFDEMSETSSSHGGHTSAGSVPVQELPRLHEKVRSSMFFC

SEQ ID NO: 179066 - protein, 58 aa, Triticum aestivum
  Clone ID: PAT_TA_73484.pep
CNQHIYQCKKIRCGIQSTPAEQIQIQATSRNIAVHIYTHGKQLPVNMEISDMYIATVN

SEQ ID NO: 179067 - protein, 144 aa, Triticum aestivum
  unsure (1)..(144): unsure at all Xaa locations
  Clone ID: PAT_TA_73485.pep
PNHVAIKIALELKKLLVDNSLLDVSQSDLEANLFKLMEKRGYGEDYINRYKMMTRFHHQRVPLVILVCGTACTGKSTIATQLAQRLNLPNVLQTDMVYELLRTSTDAPLTSVPVWARDXNSPEELITEFCRECRVVRKGLAGDL

SEQ ID NO: 179068 - protein, 66 aa, Triticum aestivum
  Clone ID: PAT_TA_73486.pep
LQYICPVSVSASHDGIHTYFAYIHTSHDRRIMQRSLISAKIRNDEVVLVVLRHLHPWLLALARYSV

SEQ ID NO: 179069 - protein, 138 aa, Triticum aestivum
  Clone ID: PAT_TA_73487.pep
TIHQTTTTLIADAASKDEIQARVAQLKKELAETDSVYDTEKLAERIAKLAGGVAVIKVGAATETELEDRQLRIEDAKNATFAAIEEGIVPGGGTAYVHLSTVVPSIKEKIEDPDERLGADIIQKALVAPASLIAHNAG

SEQ ID NO: 179070 - protein, 47 aa, Triticum aestivum
  Clone ID: PAT_TA_73488.pep
FLPSVYQGNTTLFARRFWHVMLRNPERPNFPRIMFVTERTVLFEHGL

SEQ ID NO: 179071 - protein, 44 aa, Triticum aestivum
  Clone ID: PAT_TA_73489.pep
FIQVFGNDKRYWFIPAYSEEDLRRMPVLQGLDYPVRTDLDGQEL

SEQ ID NO: 179072 - protein, 82 aa, Triticum aestivum
  unsure (1)..(82): unsure at all Xaa locations
  Clone ID: PAT_TA_73490.pep
XVLCIDSYIAAVLLFLIRRLCVAKYGQMNSTGATKISSLSKKSELREKGVVYHRTNEPTQLCLCLSHRSRASAADVTQRNRN

SEQ ID NO: 179073 - protein, 42 aa, Triticum aestivum
  Clone ID: PAT_TA_73491.pep
MAALIESCWANEPWRRPSFANIMDSLRSLIKVPLPQLIRSDS

SEQ ID NO: 179074 - protein, 124 aa, Triticum aestivum
  Clone ID: PAT_TA_73492.pep
EISYLLFYQLNCSPESGSGQSRVAARRRGIRIQAMAGLERRRRLARATVADRQSTVLSSGEQPSRGLRKSDGPGLCQGDKREGARQSLGLDGAWGKSPAARRWRGEHEGRRLSRSLRSDSRACV

SEQ ID NO: 179075 - protein, 176 aa, Triticum aestivum
  Clone ID: PAT_TA_73493.pep
MGGASNSNLLPPGFHFFPSDEELVVHFLRRKASLLPCQPDIVPTVCMNHYDPWELNGKALGAGNQWYFFSHAKHSRVTPNGYWSSVCADETVSSGGCSVGLKKTLVFSTGEPSESEGTETNWIMHEYHLLDGRKGISSSTTSTNSSSKKLHHPNTESNNWVICRVFDSTTGGSQAS

SEQ ID NO: 179076 - protein, 51 aa, Triticum aestivum
  Clone ID: PAT_TA_73494.pep
TLFCKYLTHALATHHHQLIIFNFISCVTRRLCAIHRIRVRWKMETSARWRR

SEQ ID NO: 179077 - protein, 63 aa, Triticum aestivum
  Clone ID: PAT_TA_73495.pep
TPSPRPCSAGDTTGPPSSTSSTMMRSFSLKVEFCCLRSNCRAEASRILSSEINDSHVFDYEVH

SEQ ID NO: 179078 - protein, 129 aa, Triticum aestivum
  Clone ID: PAT_TA_73496.pep
SQSAGYPELKIAMAGSVGSDPLGSFYRAKLRRANVHFLSKPVKDGTTGTVIVLTTPDAQRTMLAYQGTSSTLSYDSDLASLVSKSNVLIVESYLFELPHTIEAIKQACEDAHKNGALIAVTASDVSCIK

SEQ ID NO: 179079 - protein, 106 aa, Triticum aestivum
  Clone ID: PAT_TA_73497.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVK

SEQ ID NO: 179080 - protein, 67 aa, Triticum aestivum
  Clone ID: PAT_TA_73498.pep
HSACRSSAGSQSTCLLYIALQILQVPNLKRLTRLCSARFSFYMCRDSSAVIHQFTSGEEPASDVGDS

SEQ ID NO: 179081 - protein, 57 aa, Triticum aestivum
  unsure (1)..(57): unsure at all Xaa locations
  Clone ID: PAT_TA_73499.pep
QVPGPQXSFVFVKDSIYKKPDTALLPFPTYFTQEGEPEDLEPLIADLGDVDPFMAAD

SEQ ID NO: 179082 - protein, 105 aa, Triticum aestivum
  Clone ID: PAT_TA_73500.pep
QRGLVGTMEITQQSLLLPRKIHVHDFRRSHTKRLREKWCFHAHLNSRGRKRERWEHLGHIYLHNGGDGDDDAWTMVHLQKNILPTFFLSFFFLRKVTTMHYLPAW

SEQ ID NO: 179083 - protein, 61 aa, Triticum aestivum
  Clone ID: PAT_TA_73501.pep
LCINSSYDVVDPHLSTPFDDGRSVEGKIWLYEDGTFGFGFVGSNSIIDLRHVSSAGCILDT

SEQ ID NO: 179084 - protein, 185 aa, Triticum aestivum
  Clone ID: PAT_TA_73502.pep
ILPRRTYCRDVVKKLLLSLNIYILLSIVDGNNGNNKIIFLEPMVKTNETLSVNENGTKNEIRPMSLMFTDKIVNETRPMSSMFTDKIINETRPMSFIFSNKISNETKPMSAMFLNKTINETKPMKINTTMNESLNMNETETMNNETVHPHIQNNSTSNNAEGEVLSLGLFDATLNIDRSIDSLRS

SEQ ID NO: 179085 - protein, 87 aa, Triticum aestivum
  Clone ID: PAT_TA_73503.pep
NVVQLLCTFEDIRNAPFGKEMMQAYSDHLKLRDVDHEVFFPGLFLKMPGRFYYQFGKPIPTRGRQDVLTDKQAAQDLYMHVKSEVER

SEQ ID NO: 179086 - protein, 54 aa, Triticum aestivum
  Clone ID: PAT_TA_73504.pep
MFENPTALMNFTTGNEHVVEIYKWQIAKSEQPTLIGLSCLGFLLSCSSIFDWAT

SEQ ID NO: 179087 - protein, 73 aa, Triticum aestivum
  Clone ID: PAT_TA_73505.pep
KLYMEDWIGLKTLDDEGRVKFVSVPGGHLGISKTDMMKYIVPYLKGKDNGKAWIAATWRAITNTIGGEAFVLN

SEQ ID NO: 179088 - protein, 131 aa, Triticum aestivum
  unsure (1)..(131): unsure at all Xaa locations
  Clone ID: PAT_TA_73506.pep
GDGDCGTTMYRGATAILEDMKKRYPMDDAAGTINEIGATIXKVMGGTSGILYDILCKAAYASLKQSSTVTANEWADALEASVAAVSKYGGASAGYRTMLDALIPASAVLKQRLEAGDDPVTAFVASSEAAS

SEQ ID NO: 179089 - protein, 44 aa, Triticum aestivum
  Clone ID: PAT_TA_73507.pep
MATPLIAGLAVAAAALAGRYSIQAWNAYKARPVVPRMRKFYEGG

SEQ ID NO: 179090 - protein, 83 aa, Triticum aestivum
  Clone ID: PAT_TA_73508.pep
MARSPCDLRLLLLAAAAAFIYIQVRLFVTQSHYADRLAEAERSENQCTSQLKSLIDQVSMQQEKIVALEEIKVRQDEERAHLK

SEQ ID NO: 179091 - protein, 142 aa, Triticum aestivum
  unsure (1)..(142): unsure at all Xaa locations
  Clone ID: PAT_TA_73509.pep
FINNHTTVWGSWWKXHQWGYKCCKQTIKNSYCTGLAGIEAAEASADLMKANMARKEAAEDEPVQHEEKRLATWGTDVPQDLVLDPKKLAESLKKEKGRRNEERDEKKXKYNVHXDDQVTVEDMEAYRMTKIHHDDPMRAFLK

SEQ ID NO: 179092 - protein, 97 aa, Triticum aestivum
  Clone ID: PAT_TA_73510.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSN

SEQ ID NO: 179093 - protein, 145 aa, Triticum aestivum
  unsure (1)..(145): unsure at all Xaa locations
  Clone ID: PAT_TA_73511.pep
HAQVQANRHAADSRIPFEYCYDLSSSEARFPIPDIILRTVSGSLFPVIDPGQVISIQEHEYVYCLAIVKSRKLNIIGQNFMTGLRVVFDRERKILGWKKFNCFSSSTTENYSPXETRNPGVSQLRPLNNSSPAALYDSLLMMLIL

SEQ ID NO: 179094 - protein, 167 aa, Triticum aestivum
  Clone ID: PAT_TA_73512.pep
HPILVFACSDSRVCPSVTLGLHPGEAFAVRNIASMVPPYDKTKYAGVGSAIEYAVCALKVEVIVVIGHSRCGGIKALLSLEDGAPDKFHFVEEWVRIGGPAKTKVKTDHASVPFEDQCSILEKEAVNVSLENLKTYPFVKEGVEKGTLKLVGGHYDFVNGKFETWEP

SEQ ID NO: 179095 - protein, 117 aa, Triticum aestivum
  Clone ID: PAT_TA_73513.pep
PSSDGAQNYPPGVAPPSSGTPTHPVATSVYASSGAPNAPSMYPPPPYSYSPYYPPPFQPPPPPPPVSVDPSQSIATAPWATHSAVPPPPPPLSSSTDQPTASYGADAEYDKFMSEMK

SEQ ID NO: 179096 - protein, 95 aa, Triticum aestivum
  unsure (1)..(95): unsure at all Xaa locations
  Clone ID: PAT_TA_73514.pep
IWSKLTKKVAANMSRIVVSLASFNGEERIFACTXIFASNQSDTKILTSASLVRISDDENKINDNLKIVVHLPNKQQTVRTLQHYHLHYNVAIVSI

SEQ ID NO: 179097 - protein, 106 aa, Triticum aestivum
  Clone ID: PAT_TA_73515.pep
AQHEHRRPSPLIHVPQELQAFPRPPPLHQPSAQIQARDAPWPHHSSPLKPPPPVHQPQALAPRIPRPPTHPSPLVPVPPQRAPPPLPHPPCPHVPAQRFPAETRPP

SEQ ID NO: 179098 - protein, 120 aa, Triticum aestivum
  unsure (1)..(120): unsure at all Xaa locations
  Clone ID: PAT_TA_73516.pep
GANWYLQPKILXNEGVISVTSLKLSVLTNTITLRRLIRKGVPPVLRPKVWLSVSGAAKKRSTVPETYYDELIRATEGKTTPATRQIDHDLPRTFPCHPWLNSDKGQASLRRVLVGYSFRD

SEQ ID NO: 179099 - protein, 126 aa, Triticum aestivum
  Clone ID: PAT_TA_73517.pep
DYKDEFVIKHGVKLGLMSCFVKAAVTALQNQPIVNAVIDGDDIIYRDYVDISVAVGTSNGLVVPVIRDADNMNFADIEKGINALAKKATEGALSIDEMAGGTFTISNGGVYGSLISRPIINPPQSA

SEQ ID NO: 179100 - protein, 82 aa, Triticum aestivum
  Clone ID: PAT_TA_73518.pep
TTALARRRFAAVNCDRRPTMSYQAGYPPPAGQQQAYGGAPPPPAYVAPPPAYPPTQDGGAYYGQQQQQTTTSRGGDGFWKGW

SEQ ID NO: 179101 - protein, 82 aa, Triticum aestivum
  Clone ID: PAT_TA_73519.pep
FFFFFFEQIPLIFAASKAVMALGDMLPNSKGHFDGAPNLKTNCPAAPRAHPPLAQSGPSSLIPLRAGAPCTYVTHTSLEPMY

SEQ ID NO: 179102 - protein, 65 aa, Triticum aestivum
  Clone ID: PAT_TA_73520.pep
QRANSNTWPRGICGANWNITIHVPGISKVSNMHPRTWRSRDEFRSLPCTITNKRQGTLMVSLIIK

SEQ ID NO: 179103 - protein, 131 aa, Triticum aestivum
  Clone ID: PAT_TA_73521.pep
MMAPGTATSRFSKWADKLRGGAPGENEAQDKRKLVSKWKPTTKGTLKRTYRVRSVEEGRRILKEIALVLSEDDHFVDASSHKGCQIRRESAHGESVCCYNVRALFDELPTPHLVLEITAFPAGPLTDNDYR

SEQ ID NO: 179104 - protein, 66 aa, Triticum aestivum
  Clone ID: PAT_TA_73522.pep
SCTCWKMYAAAAVGPLCHTNIQLSQLTTVYMPAKLVCSLHSHIHSTNGGERVACRLLILRMDRTAN

SEQ ID NO: 179105 - protein, 128 aa, Triticum aestivum
  Clone ID: PAT_TA_73523.pep
TTMPRDTRLIVVVDFSRQLHEMTNMSLPSIFFPNALVCSRRRKKGQRCGRNAASQLAGDAQMVAAAPTAVRQRQRLLPAGGVRRRKYWGPSMVATSADGDNGVLPWRWRASLTGARRRPSMTVARCQW

SEQ ID NO: 179106 - protein, 172 aa, Triticum aestivum
  Clone ID: PAT_TA_73524.pep
IDELNIVQTHLVSNASVPSSAVSKSQNGTIEVHQYQEALNWLNQGELFVKRSSRSDLKSLWSGCFDQSSEYHPTLSWGSFATCGRRETMEDTHFLLPHMSEEKDVFAFGIFDGHRGSAAAEFSVRAVPGFLKQFGQGASPTDALSEAFVSTDLAFREELILHRKSKRIIQKD

SEQ ID NO: 179107 - protein, 84 aa, Triticum aestivum
  Clone ID: PAT_TA_73525.pep
THTNHTRSNPPSKNLSKPSDPSIHPPRGPKQMPPLHKTITTANDTLLLPLLLDCRTPTTTVPLDLKTRAHADGGGEPTTTTTSP

SEQ ID NO: 179108 - protein, 103 aa, Triticum aestivum
  Clone ID: PAT_TA_73526.pep
MDDLAAAAGFDAAPAGGFYWTTPAPPQAALQPPPPPQQPVAPATAAPNACAEINGSVDCEHGKEQPTNKRPRSESGTRPSSKACREKVRRDKLNERFLELGAV

SEQ ID NO: 179109 - protein, 102 aa, Triticum aestivum
  Clone ID: PAT_TA_73527.pep
PVVYTEMDGGFNSGGAGAPRRISWGSRQTASTDRGTVRRFLRNVFACFGGRGSAASRSHAMPELDDDDASDHSAAFSRGGSRSRSTSWRLEDGHAADAMVQR

SEQ ID NO: 179110 - protein, 124 aa, Triticum aestivum
  Clone ID: PAT_TA_73528.pep
TAQQPGYGAGRGGGPAWTTEPPAAGGGLSHLLVIAAPALMRTASIALAMTTPAPPGWCPNHDVSRTGSGGSIYTTSNDNLHITVDSSSPSPDLAAPVPRRHVRILDDAVVDFYFMIDSDVYYRN

SEQ ID NO: 179111 - protein, 117 aa, Triticum aestivum
  unsure (1)..(117): unsure at all Xaa locations
  Clone ID: PAT_TA_73529.pep
SRSTLLWRAAKLPIYSVALVPLTVGSASAYHHAGLFFTKRYFVLLTAAVLVITWLNLXGADKNKKESVVSITGSRTMTQNAANISLFLGFAGLFWAFAEARDIRFILXVMSAIFCGY

SEQ ID NO: 179112 - protein, 109 aa, Triticum aestivum
  unsure (1)..(109): unsure at all Xaa locations
  Clone ID: PAT_TA_73530.pep
CEDEEPGIVVTSKXVNEAPEESTAEKDMPSDGDDAEPTGITILRRRHAPTASSFSDGDDAESTGITILRQHQAPNASLLSDGDDAESTGITILRRRQAPTASSASSFTQ

SEQ ID NO: 179113 - protein, 98 aa, Triticum aestivum
  Clone ID: PAT_TA_73531.pep
LIYTSTHSIIIHTCKPAHSLLYTTTATTATRGYISLFSLISPLGWSIGCSLDKFLLLSLVSLSRWWSAESVKRGRQRRRRSRRGGAGTRQVVVGEPDL

SEQ ID NO: 179114 - protein, 111 aa, Triticum aestivum
  Clone ID: PAT_TA_73532.pep
MARSVSYVSAAKLVSMARGNPRLAIIDVRDEERSYQAHIAGSHHFASGSFEARMPELVRAASGKDTLVFHCALSQVRGPTCARMFSDYLSETKEDSGIKNIMVLELGFNGW

SEQ ID NO: 179115 - protein, 33 aa, Triticum aestivum
  Clone ID: PAT_TA_73533.pep
GLWFFRFQRLAQHKHNNVEVTSHILVRFDGTQV

SEQ ID NO: 179116 - protein, 128 aa, Triticum aestivum
  Clone ID: PAT_TA_73534.pep
MASLAQHVAGLASPPLSGAPRRRPAAPTRPSALVCGTYALTKEERERERMCQLFDEAFERWGTAPMEGVSFSPEDLECAVESTDIDTDIGSLIKGTVFMTTSNGAYVDIQSKSTAFLPLDEACLLDVN

SEQ ID NO: 179117 - protein, 125 aa, Triticum aestivum
  Clone ID: PAT_TA_73535.pep
RGYVEAVLSSLAANVPKAIVLCQVEKAKEDMLNQLYSSISGQSNVKIEELLQEDHNAKRRREKYQKQSSLLSKLTRQLSIHDNRASVSSYSNDTTEAESPRTPSRSGEDWRSAFDSASNGPVAAS

SEQ ID NO: 179118 - protein, 97 aa, Triticum aestivum
  Clone ID: PAT_TA_73536.pep
GFRYPLQMPYRSLHKMPNRLDAKFQVPVFMVMGEKDYCFKFPGFETAMRSGIMNNFMPDLKITYIPEGSHFVQEQLPEQVNELLLDFLKAKGHPVAS

SEQ ID NO: 179119 - protein, 126 aa, Triticum aestivum
  Clone ID: PAT_TA_73537.pep
YELACTRHISSLIYLQFERLFQFNRKVEELTYTIAAEEIPFQLGLSKTDLRRVLKSSLSGIDKSIGAMYRRLQKTLTSDELFPSLWDKCKKEFLDKYESFVQMVTRIYGNEPIMSVNEMKEVLASF

SEQ ID NO: 179120 - protein, 105 aa, Triticum aestivum
  Clone ID: PAT_TA_73538.pep
MAATAYSVALLGGARLPAAPRSALLPRRSVCQLRLQDAPRLSLLRAKAASEDTSASGDELIEDLKAKWDAIEDKPTVLLYGGGAIVALWLTSVVVGAINAVPLLP

SEQ ID NO: 179121 - protein, 54 aa, Triticum aestivum
  Clone ID: PAT_TA_73539.pep
DTPRILIWRGEGDEHDRVVLTPEFILRPAASCLANSNASVRWNWKHHHHASALR

SEQ ID NO: 179122 - protein, 59 aa, Triticum aestivum
  Clone ID: PAT_TA_73540.pep
GYCWQQELAPQPETRKMNIVTFVCDHMEPTAAVLLKQLTIDIGAGFPDYMLQQLHIRRI

SEQ ID NO: 179123 - protein, 50 aa, Triticum aestivum
  Clone ID: PAT_TA_73541.pep
GAPCRPGGGTRRPRPGRPWRGVASPARLEALERSAAAAERSGGVRRQAKR

SEQ ID NO: 179124 - protein, 139 aa, Triticum aestivum
  unsure (1)..(139): unsure at all Xaa locations
  Clone ID: PAT_TA_73542.pep
MAALVNKINRSSILSXWPPIYSSALKQIVKSMLRKNPEHRPTAGELLRHPHLQPYLAESCSCSPIYLPVKPNKSNLVDKQSKKPSSGRKRTVKANGSNETLDTAAEHTVEARDSSTNFSDVSTIGTQEALILQMPVDLD

SEQ ID NO: 179125 - protein, 82 aa, Triticum aestivum
  Clone ID: PAT_TA_73543.pep
ALVAPDYGAVAEYTAPGTDNWGADWGTGEAAAAPAGIPAAGADWAAAPAPPADGVWDAAAAPPAATGWEQGTAPAAAPTGWE

SEQ ID NO: 179126 - protein, 44 aa, Triticum aestivum
  Clone ID: PAT_TA_73544.pep
INKADAHHRLIATSSDAIYLNVVPTFTILLYSICNTRAQCGQQK

SEQ ID NO: 179127 - protein, 43 aa, Triticum aestivum
  Clone ID: PAT_TA_73545.pep
FQVIVVTDGERILGLGDLGCQGMGIPVGKLALYTALGGVRPSA

SEQ ID NO: 179128 - protein, 92 aa, Triticum aestivum
  unsure (1)..(92): unsure at all Xaa locations
  Clone ID: PAT_TA_73546.pep
EEHRITFPEQLLPLHHQQSRGLSSRGASRESRGGGGEPGVSEVSHLXRSSFEPRPCSPVSPPLSTPPSPQKLLDLLGFHPHLFLVDLGVTGM

SEQ ID NO: 179129 - protein, 57 aa, Triticum aestivum
  Clone ID: PAT_TA_73547.pep
IPGVAPFALCLFFSKLVAYTFLYWLPFYISHTRIGGQDLSDAMAGSLSTIFDVGGVL

SEQ ID NO: 179130 - protein, 34 aa, Triticum aestivum
  Clone ID: PAT_TA_73548.pep
LLIDRNMTEFHALVNIQITKRIYTPPGQRHDYED

SEQ ID NO: 179131 - protein, 118 aa, Triticum aestivum
  Clone ID: PAT_TA_73549.pep
FALVLESGGSDLPIIISCASLALADAGIMMYDLVTSVSVSCFGKNIIIDPTSDEEAWQDGSLVVAFMPARKEITQLTLTGEWSDGRITNAVELCMDACSKLGDILRDHLKDTATLTSE

SEQ ID NO: 179132 - protein, 47 aa, Triticum aestivum
  Clone ID: PAT_TA_73550.pep
MSANVDESTSGGSSSDAAGGSFECNICFELPQEPIVTLCGHLFCWPC

SEQ ID NO: 179133 - protein, 101 aa, Triticum aestivum
  Clone ID: PAT_TA_73551.pep
LTPFAKSFLIELEPKIHLEVFQEAELLINIKEHVLVPEHQVLTNEEKKTLLERYTLKETQLPRIQISDPIARYYGLRRGQVVKIIRPSETAGRYVTYRYVV

SEQ ID NO: 179134 - protein, 90 aa, Triticum aestivum
  Clone ID: PAT_TA_73552.pep
AAWRSHCQYKKQNSPRRKVTSNPTQPLTCLCTSVQFLLQKARITFIGMLTAPAVTGKENHYGVSEHFKMLERFMAYRKFLMSNFLTSGIS

SEQ ID NO: 179135 - protein, 110 aa, Triticum aestivum
  Clone ID: PAT_TA_73553.pep
MQVLVIRRQEKFFLEQTDKTTTSVSAEQSSLGTTGSSHHVHTGTDGPKDPSSAGAVEHKSLAETYLLQEPDNSKDMGAKESKHDGVISTGTSDDGKIVLDIIEAIDAAER

SEQ ID NO: 179136 - protein, 112 aa, Triticum aestivum
  Clone ID: PAT_TA_73554.pep
RVRPMVDMQLGLFGTRRFSREIELISVNFLQNSYEIPAFQTSPQWRRVHLTSNDHNFTCIRLTEHSGKTNGQSNFRITFMKTLLADVNDKSRRVTTDYGNRSISQSDNTCAE

SEQ ID NO: 179137 - protein, 91 aa, Triticum aestivum
  Clone ID: PAT_TA_73555.pep
TSHQPRPEPPRCYLARIYMHIIIIYIYQCGGGGEDGGGAGGEGAQLAAVVAVVGVRWPTAARVVVSVHPPAAVHVLAGVVAVVGVGPAGVE

SEQ ID NO: 179138 - protein, 65 aa, Triticum aestivum
  Clone ID: PAT_TA_73556.pep
MFGRMPRKSSNNTKYYEVLGVSFTASQDELKKAYRKAAIKNHPDKGGDPEKFKELSQAYDVLSDP

SEQ ID NO: 179139 - protein, 63 aa, Triticum aestivum
  Clone ID: PAT_TA_73557.pep
WLGMPIHDSDFGWGRPGFVAPAQMFGSGTAYVTQGYDKDDPINVLFALEPEYLQTFEKAFYGE

SEQ ID NO: 179140 - protein, 65 aa, Triticum aestivum
  Clone ID: PAT_TA_73558.pep
YSGGELESADSMTPFDVAVRILDNQLRSLMWIDEKVNEFSGRIQRLPSNSASAERDSGIPRFWLS

SEQ ID NO: 179141 - protein, 105 aa, Triticum aestivum
  Clone ID: PAT_TA_73559.pep
EVEESAARESRTIGNMIEDSCADNDIPLPNVNARILAKVIVYCRKHASARGGTEAGDAEPTAATNKASEDELKTFDAEFVKVDQATLFDLILAANYLDIKGLLDL

SEQ ID NO: 179142 - protein, 40 aa, Triticum aestivum
  Clone ID: PAT_TA_73560.pep
CIVRAVPAGPEGGIRISSTLPNRLGKMLAPLHWHDYKKQY

SEQ ID NO: 179143 - protein, 130 aa, Triticum aestivum
  Clone ID: PAT_TA_73561.pep
GSWGRLVLRVGQTFFAAACIGVMGSSLGFASYTAFCYLIASMGLQMLWSFALACLDGYAITTNKDLTSPILVSLFVVGDWVTAILSFAAASSSAGVVILFQKDVFFCRRYTQLPCGKYELATAFAFLSWA

SEQ ID NO: 179144 - protein, 98 aa, Triticum aestivum
  Clone ID: PAT_TA_73562.pep
NMVEDDAGKRPLPGWSVGIAKFSSEAHVPSAGSEPLEGCDSVRRTARAGVHIRFLCHYFVEALFGCSEIRINPHVLSWVRVELELNSTSIHSNTCGLR

SEQ ID NO: 179145 - protein, 36 aa, Triticum aestivum
  Clone ID: PAT_TA_73563.pep
SCYSQVATYFPQRARDKRAHSKHQLSCVIIILVVIC

SEQ ID NO: 179146 - protein, 100 aa, Triticum aestivum
  unsure (1)..(100): unsure at all Xaa locations
  Clone ID: PAT_TA_73564.pep
AAPPSSSSSFSYGGYPPPPAAAYPPPPAQAAASGFGSGYGYGSGLVPVAFPPGTHPDVXRAFRSADRDCSGAIDERELQGALSSAYHRFSIRTVRLLMFL

SEQ ID NO: 179147 - protein, 79 aa, Triticum aestivum
  Clone ID: PAT_TA_73565.pep
TSNGDLLGLLVESNMRESNGKAELGMTTDEIIEECKLFYFAGMETTSVLLTWTLIVLSMHPEWQERAREEVLHHFGRTT

SEQ ID NO: 179148 - protein, 67 aa, Triticum aestivum
  Clone ID: PAT_TA_73566.pep
CVDSQELRSCLAFPSPASPPPSSQISPGSGRNKSAIWQFTTLLFGRSCMMSPNSVKQDSSILPGQEE

SEQ ID NO: 179149 - protein, 120 aa, Triticum aestivum
  Clone ID: PAT_TA_73567.pep
LPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLG

SEQ ID NO: 179150 - protein, 107 aa, Triticum aestivum
  Clone ID: PAT_TA_73568.pep
DDGVPLEGVIQIEKPGDAGVESKLVSYAKLGLLAGGDVFCLLLFSAIGRFIHGLPVLDAETFKTADPFIAGWLLSAYLLGGFGDDAKGRNGVGNAVIAAAKSWAVGI

SEQ ID NO: 179151 - protein, 109 aa, Triticum aestivum
  Clone ID: PAT_TA_73569.pep
IFGGNGAEEPYPIRGRYSQFTLLTMTYDARFWNLKMFVEHYSKCASVREIVVVWNKGRAPVQGELNSMVPVRIRVENKNTLNNRFKIDKEIKTGAVMELDDDIMMTCDD

SEQ ID NO: 179152 - protein, 91 aa, Triticum aestivum
  Clone ID: PAT_TA_73570.pep
KPEDWIFPGHPLAAAEFITGRSGQSCTVPIIAANCIVLLACNNLRFFFLFVAPLNDDGDIVVGVCGFCWLRACQRVCCLGRRQVEEEADRR

SEQ ID NO: 179153 - protein, 51 aa, Triticum aestivum
  Clone ID: PAT_TA_73571.pep
ETSPAMTPPSSSIHLRLRVQVDFFCSCTQLVIGPSCKFQRTRSIDLACSLY

SEQ ID NO: 179154 - protein, 51 aa, Triticum aestivum
  Clone ID: PAT_TA_73572.pep
SRLVCAALHFTSYRIPMNAGDFYDQCVCFFFSLSFGAMAYHSTGKIVTNNL

SEQ ID NO: 179155 - protein, 54 aa, Triticum aestivum
  Clone ID: PAT_TA_73573.pep
FFFFFLETFTTNYIILIQLNLNKQYKTRGTVQNTSSLHIVKLHVISKVTEHYRI

SEQ ID NO: 179156 - protein, 123 aa, Triticum aestivum
  Clone ID: PAT_TA_73574.pep
GLLSRRVLRLRGSIPRETKWSVVVDLYFYRDPEEVEKEEEIKEIAAPPAKEYVGEMVDQGWGNEAEVVAPAAENWADDSAPVAPVVPAPVVPSEDWSAPATQAAPTAPAQNWGGSTAENGIKS

SEQ ID NO: 179157 - protein, 82 aa, Triticum aestivum
  unsure (1)..(82): unsure at all Xaa locations
  Clone ID: PAT_TA_73575.pep
LNCIQNVPLMDVVFVHGLRGGPFNSWRIADDKSSTTKAGLVESIDEDAGKEGTCWPXRWLAADFPQARFFTVKYKTNLTQWT

SEQ ID NO: 179158 - protein, 146 aa, Triticum aestivum
  unsure (1)..(146): unsure at all Xaa locations
  Clone ID: PAT_TA_73576.pep
REVVELPMLHPEXFVKLGIDPPKXVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARRNIKVLMATNRPDTLDPALLR

SEQ ID NO: 179159 - protein, 76 aa, Triticum aestivum
  unsure (1)..(76): unsure at all Xaa locations
  Clone ID: PAT_TA_73577.pep
KLEIGTKLAEFCSRALLALDVLVHPRALSLERTVPSQGNTVFGAGTYXISRFGDQPQAMEVEDMYDDWLTSNNDEP

SEQ ID NO: 179160 - protein, 111 aa, Triticum aestivum
  unsure (1)..(111): unsure at all Xaa locations
  Clone ID: PAT_TA_73578.pep
VDHYPYLVWGPPTKFNLAQWKPKQENSELELIDDARTADRLLKWXINKXNGXAEGDLDDKKYENESMLXQGASDPEQIVRAIYDVEEATAHALQIILEHKMIKPDTRDSLI

SEQ ID NO: 179161 - protein, 65 aa, Triticum aestivum
  Clone ID: PAT_TA_73579.pep
MSDLDVQIPTAFDPFAEANAGDSGAASGSKDYVHVRIQQRNGRKSLTTVQGLKKEFSYSKILKDL

SEQ ID NO: 179162 - protein, 38 aa, Triticum aestivum
  unsure (1)..(38): unsure at all Xaa locations
  Clone ID: PAT_TA_73580.pep
VEEGPHDFLLXKGGRYAELWYQQNSSDASDSAAVSLEV

SEQ ID NO: 179163 - protein, 66 aa, Triticum aestivum
  unsure (1)..(66): unsure at all Xaa locations
  Clone ID: PAT_TA_73581.pep
AWGLGTYVVNKQTPNRQIWLSSPVSGPLXFDWDVATNGWIYKRTGANLVQLLEKEIGELCHTPVEL

SEQ ID NO: 179164 - protein, 45 aa, Triticum aestivum
  Clone ID: PAT_TA_73582.pep
QLQLFFTRTVSDITKYTHRLARNGKFSTTNGFTIFIQIRNGKSGS

SEQ ID NO: 179165 - protein, 73 aa, Triticum aestivum
  Clone ID: PAT_TA_73583.pep
GKQGADRNSSDFLDSSRPQYALHRETSRAMGGLQSDSNIHSLAEVQNNDSSAHTYASLLGSSLSRSASPDPEL

SEQ ID NO: 179166 - protein, 129 aa, Triticum aestivum
  Clone ID: PAT_TA_73584.pep
FLDRSQNFARSVGMKEMQKICECLRATVSDLSKFSKGKIAAPKLKALLFKPLNQVNPVTNPCQKTVKRKRANPNKTSTNPIQKNAKKKKALEQDKLAISPGQKDGTKPLDQEKSVSSPIQKDDKKIKPL

SEQ ID NO: 179167 - protein, 59 aa, Triticum aestivum
  Clone ID: PAT_TA_73585.pep
CYCASYALNRKPCPSVYIASRVGPRMCPQRRAATISSVFSTSSVSMLKLKTKPLITLED

SEQ ID NO: 179168 - protein, 56 aa, Triticum aestivum
  Clone ID: PAT_TA_73586.pep
SWCRAVSIRCYVRRVAHGQGCVWALPQLSVLLAVSCVFPLLLCHNGWCVEDGVMHV

SEQ ID NO: 179169 - protein, 120 aa, Triticum aestivum
  Clone ID: PAT_TA_73587.pep
EAYPLADAQLTMGIPRLIQQAANYKQLKKGANEATKTLNRGISEFVVMAADTEPLEILLHLPLLAEDKNVPYVFVPSKQALGRTCGVTRPVIACSVTSNEGSQLKQQIQGLKDSIEKLLI

SEQ ID NO: 179170 - protein, 115 aa, Triticum aestivum; identical to SEQ ID NO: 178870
  Clone ID: PAT_TA_73588.pep

SEQ ID NO: 179171 - protein, 84 aa, Triticum aestivum
  Clone ID: PAT_TA_73589.pep
KHAATSRAVLNAITSLRRPSPHAPPLLVRCSVLLATRPDHGHSFDGPDAGDQPYQQVASTVYYLVRQSVGKMDLASPISHLDSG

SEQ ID NO: 179172 - protein, 119 aa, Triticum aestivum
  unsure (1)..(119): unsure at all Xaa locations
  Clone ID: PAT_TA_73590.pep
YDPKRLLGVTTLDVARANTFVAEVLGVDPRDVSVPVVGGHAGVTILPLLSQVTPPSSFTQDEIKYLTDRIQNGGTEVVEAKAGSGSATLSMAFAAAKFGDACLRAMRXDAGIVECSYVA

SEQ ID NO: 179173 - protein, 129 aa, Triticum aestivum
  Clone ID: PAT_TA_73591.pep
MGRRILNDALRTMVNAERRGKATALLQPISGVMVSFLNIMKHRGYIKKFEVIDPHRVGKINVELHGRIKDCKALTYRQDIRAKEIEQYRVRMLPTRQWGYVVITTPNGVLDHEEAIKQNVGGQVLGYFH

SEQ ID NO: 179174 - protein, 53 aa, Triticum aestivum
  Clone ID: PAT_TA_73592.pep
FFLIRNEAQLLSQFSQSESHTRIHQTIVTAGRRLLSSYLVFSSIKKKGHNIPN

SEQ ID NO: 179175 - protein, 118 aa, Triticum aestivum
  Clone ID: PAT_TA_73593.pep
PDGSGWGDHIQLLQIFESWDQSGYDPRWCSDHDLHVRSMKLSKDVRNQLCQIIKKIAKGSTDVHARKSRKSDPDYRKLRRALCVGYGNQLAERMLHHNGYHTVGYRSQLVQVHPSSVL

SEQ ID NO: 179176 - protein, 46 aa, Triticum aestivum
  Clone ID: PAT_TA_73594.pep
PRRPHSSPPSTTPSLLPPCPSFSCSSSVLGGYRVRLVRWMLAESPM

SEQ ID NO: 179177 - protein, 71 aa, Triticum aestivum
  Clone ID: PAT_TA_73595.pep
LTASGFLYTVMLQAPLLIGCDVRNMTSETMEILSNKEVIQVNQGIILILLWERTCYPGLASQATNICLHSN

SEQ ID NO: 179178 - protein, 99 aa, Triticum aestivum
  unsure (1)..(99): unsure at all Xaa locations
  Clone ID: PAT_TA_73596.pep
LLGNSSRSSSTNASSTVTDSLLSSLVLNLSSLEVEDTSKSSAPSVVENNWFKRSLPSKTWKLSAVDSSLSHEERERXRRRAVVRSAFVQHLLVTTLFED

SEQ ID NO: 179179 - protein, 102 aa, Triticum aestivum
  unsure (1)..(102): unsure at all Xaa locations
  Clone ID: PAT_TA_73597.pep
PGLGMRLDRSNLNLHYAARYXKEIPVLMRALLDAXSERRLFIRSDELDAAWSLFTPLLKELEEKRIAPELYPYGSRGPVGAHYLAAKYNVRWGDLSAEHYKA

SEQ ID NO: 179180 - protein, 61 aa, Triticum aestivum
  Clone ID: PAT_TA_73598.pep
NYQHGINGRTIDSAFKFVEFIIRAVSKLDYVLKKLSDTNSTLNSFALPRCRSKQIFVNGIL

SEQ ID NO: 179181 - protein, 34 aa, Triticum aestivum
  unsure (1)..(34): unsure at all Xaa locations
  Clone ID: PAT_TA_73599.pep
LLESMVWEKGSSLYNSLIVARPSIASXIKHLGLL

SEQ ID NO: 179182 - protein, 112 aa, Triticum aestivum
  unsure (1)..(112): unsure at all Xaa locations
  Clone ID: PAT_TA_73600.pep
PFPRLHFFXVGFAPLTSRGSQQYRALTVPELTQQMWDAKNMMCAADPRHGRYLTASAMFRGKMSTKEVDEQMLNVQNKNSSYFVEWIPNNVKSSVCDIPPTGLKMASTFIGN

SEQ ID NO: 179183 - protein, 113 aa, Triticum aestivum
  Clone ID: PAT_TA_73601.pep
MEPDEAVSQHHQRPSSCERGDQRWENIDVPCGLIVGSSITLIGTPGVLSGNFWIDLVGTALPGESEKPIALHYNVRLNGDKVTKDPVIVQNTFTANNGWGVEDRCPSTNYSNA

SEQ ID NO: 179184 - protein, 119 aa, Triticum aestivum
  Clone ID: PAT_TA_73602.pep
MESFAQNQKHVIGIPLASYAYASEEGKPSCSALIHKKNKKTSFIYRMNKLNLKTDSYMQGFKQHLTLGPKISETIKGKLSFGAKVLQAGSIEKIFRQYFVVEKDEKLLKAFQCYLSTTA

SEQ ID NO: 179185 - protein, 38 aa, Triticum aestivum
  Clone ID: PAT_TA_73603.pep
IFSVSSLIIPFAIVIKIASKSVLDSNQVLMGFFRVNNS

SEQ ID NO: 179186 - protein, 85 aa, Triticum aestivum
  Clone ID: PAT_TA_73604.pep
RSAGCRTLAEAKIHIEQKRKKEYELNAQKAKESSLIANNKSVQKMNRPMKIESDGNLEPKKGGAGLDSPKTTGLTSVKQWDDWDI

SEQ ID NO: 179187 - protein, 153 aa, Triticum aestivum
  unsure (1)..(153): unsure at all Xaa locations
  Clone ID: PAT_TA_73605.pep
NDAFGTAHRAHASTEGVTKFLKPAVAGFLMQKELDYLVGAVANPKKPFAAIXGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLD

SEQ ID NO: 179188 - protein, 63 aa, Triticum aestivum
  unsure (1)..(63): unsure at all Xaa locations
  Clone ID: PAT_TA_73606.pep
TGTGINPARXIGAAVIFNNEKAWHNHWIFWVGPFVGAAIAAFYHQYILRAGAIKALGSFRSNA

SEQ ID NO: 179189 - protein, 76 aa, Triticum aestivum
  Clone ID: PAT_TA_73607.pep
YSASCNWLVLDIQRSSEAAYYRPAPNRSWDAATAFALLLSVVAICLSIFVGYRFSRNRSTAQFTPLEQIQFAEERH

SEQ ID NO: 179190 - protein, 106 aa, Triticum aestivum; identical to SEQ ID NO: 179079
  Clone ID: PAT_TA_73608.pep

SEQ ID NO: 179191 - protein, 113 aa, Triticum aestivum
  Clone ID: PAT_TA_73609.pep
VAEYTLKLLHRRIPPSVPGIMFLSGGQSEVEATQNLNAMNQGTNPWHVSFSYARALQNTCLKTWGGQPEKVTAAQDALLLRAKANSLAQLGKYTSDGEAAEAKEGMFVKNYSY

SEQ ID NO: 179192 - protein, 47 aa, Triticum aestivum
  Clone ID: PAT_TA_73610.pep
SVVYLDKQQLFCSASLTLAVWDKHALSQVVVLYKCKFQSDVCQSKLA

SEQ ID NO: 179193 - protein, 117 aa, Triticum aestivum
  unsure (1)..(117): unsure at all Xaa locations
  Clone ID: PAT_TA_73611.pep
SKAARSVRVFFDWKDYLRFYEMGTYWPYTPSIQLLYGLRTALDLIFEEGLDNVVKRHNRLGTATRFAVEAWGLKNCCQKEECFSDTVTXVVVPPYIDSAEIVKHAWKRYNLSLGLGL

SEQ ID NO: 179194 - protein, 103 aa, Triticum aestivum
  Clone ID: PAT_TA_73612.pep
HHLHNTTQFGLMAVSLGYYETLMSCSGSSTSSEMPPEDRARAGISPGLVRMSVGYNGTMEQRWAQFERALALMHPPTHHLSLKGAAAAADRDGSDAGNNHRKH

SEQ ID NO: 179195 - protein, 43 aa, Triticum aestivum
  Clone ID: PAT_TA_73613.pep
QIHTTTGRPRVLHFIRKSSSLMFNSTRLLVQYVTIICSTEHFI

SEQ ID NO: 179196 - protein, 58 aa, Triticum aestivum
  Clone ID: PAT_TA_73614.pep
RTACHNNKMETFFPPQNIYDLLEVMYPKNKAKCLYPIATSMSSSLNCNARKKQNLTNT

SEQ ID NO: 179197 - protein, 142 aa, Triticum aestivum
  Clone ID: PAT_TA_73615.pep
KYITLDDGRKLCLECLNTSIMDTDECQPLYIDIQEFYEGLNMKVEQQIPLLLVERQALNEAMEAEKTGHHLAETRGLCLSEEQIVRTILRRPVIGPGNKIVDMITGPYKLVRRCEVTAILILYGLPRLLTGSILAHEMMHAY

SEQ ID NO: 179198 - protein, 69 aa, Triticum aestivum
  Clone ID: PAT_TA_73616.pep
TQLSRMLQLCLPIGAFHQRVVSCMRRVQVQHEYGSGEVQDYKELLPLSKDKREADELTMCLRDAARMYG

SEQ ID NO: 179199 - protein, 46 aa, Triticum aestivum
  Clone ID: PAT_TA_73617.pep
TNTWDRFAFRIHKRVIDLISSPDVVKQITSITIEPGVEVEVTIADV

SEQ ID NO: 179200 - protein, 47 aa, Triticum aestivum
  Clone ID: PAT_TA_73618.pep
LFMSFQSPIEIPAISNFDFLLMAFNARREKSGLPTLGPLEFYSVVSP

SEQ ID NO: 179201 - protein, 40 aa, Triticum aestivum
  Clone ID: PAT_TA_73619.pep
SPLSSLPPSSSPPHTSSSTSSPTFSSAFPYVLLVRLSITR

SEQ ID NO: 179202 - protein, 171 aa, Triticum aestivum
  unsure (1)..(171): unsure at all Xaa locations
  Clone ID: PAT_TA_73620.pep
MASEAAKVVVPESVLRKRKREEVWAAASKEKAVAEKKKSIESRKLIFSRAKQYAEEYEAQEKELVQLKREARMKGGFYVSPEEKLLFVVRIRGINAMHPKTRKILQLLRLRQIFNGVFLKVNKATINMLRRVEPYVAYGYPNLKSVRELIYKRGYGKLTXQRIPLTNNKVI

SEQ ID NO: 179203 - protein, 94 aa, Triticum aestivum
  Clone ID: PAT_TA_73621.pep
MPMHMIHECNGFFFVVLSFLIRMFLFLEIPLVIGPRRPGDAEILFSSAAKAEREFKWKAKYGIEEMCRDQWNWASKNPFGYASPDSTKQNGHSH

SEQ ID NO: 179204 - protein, 190 aa, Triticum aestivum
  Clone ID: PAT_TA_73622.pep
IRTRERLILWSECPGARLDDDFRTRLNIGYVQELKVLGYLDLRIHVLEISNTIIEAGTKPSPRTIVPSVNILALKVRFGVRKEARMLPSYLRCFPNVVTLHIMSDEADEPTGKLNFKFWQEAGPISCLQSQIKRVVFKNFRGNRSELAFLRFIWERAQLLHKMVIVLADGDDPASLDQMVAKLKPLACAK

SEQ ID NO: 179205 - protein, 64 aa, Triticum aestivum
  Clone ID: PAT_TA_73623.pep
IRTRTQQAFVTVDKKAPINQDLISNFMSDPVHGAIEVCAQLRPTVDISVTADADFVRPELRQSS

SEQ ID NO: 179206 - protein, 63 aa, Triticum aestivum
  Clone ID: PAT_TA_73624.pep
DYVAQATIAVGVTSSLVLLWAPSIFGLAGVWAGLTTLMGLRMAAGILRLLWKSGPWSFLHEEP

SEQ ID NO: 179207 - protein, 142 aa, Triticum aestivum
  Clone ID: PAT_TA_73625.pep
KLRSLVFYTDFRPSTLQLSSPYKYLNSLEKLTVVRSLKVPIGFTGQYFFRVLDIRVCKLEEDDLKILQELPRLQSLILRLEVLPTTMVRISCEGFAELESLYVDCGMPRMTFEEGAMPNLEDLGLQLYAGSASEEHMGIKHL

SEQ ID NO: 179208 - protein, 144 aa, Triticum aestivum
  unsure (1)..(144): unsure at all Xaa locations
  Clone ID: PAT_TA_73626.pep
RDCLFSDPGRDGSSLLKIWNLNKCGGVVGVFNCQGAGWCRVTKRTRVHDAAPGTLTGAVRADDVYAITRVAGDGGNEWRQRQQXEWDGEAVVYAHRARELXVRLPRGAALPVTLAPLQYEVFHVCPLRAAAPGVAFAPVGLLDM

SEQ ID NO: 179209 - protein, 178 aa, Triticum aestivum
  Clone ID: PAT_TA_73627.pep
IRTRVHIWFDRKLKNTYDHLLFSRSSLLSVYADMSVTCKEYYDPNRSMLELVFAPADEWIGRSDTEIIDATMEELAKLFPDEIAADQSKAKILKYHIVKTPRSVYKTVPNCEPCRPLQRSPIEGFYLAGDYTKQKYLASMEGAVLSGKLCAQSIVQDYSRLALRSQKSLQSEEVPVPS

SEQ ID NO: 179210 - protein, 104 aa, Triticum aestivum
  Clone ID: PAT_TA_73628.pep
MAKAQAMAALMLTVLVVLAASAEMAHGVCNLSSAGIRACQPAAAIRNPTEQPSAECCAALAGADLACLCRYKNAAGVWVRFYRIDINRAMGLPGKCGLAMPANC

SEQ ID NO: 179211 - protein, 41 aa, Triticum aestivum
  Clone ID: PAT_TA_73629.pep
ALPYSFWLSMSGRMMIPAFETASSASAVPEEIASAASISAQ

SEQ ID NO: 179212 - protein, 91 aa, Triticum aestivum
  Clone ID: PAT_TA_73630.pep
SAPVLAYAGAVFADACLKGLNGVPDVVECSFVQSTVTELPFFASKVRLGKNGVEEVLGLGELNDFEKKGLENLKGELMSSIEKGVKFAHSN

SEQ ID NO: 179213 - protein, 39 aa, Triticum aestivum
  Clone ID: PAT_TA_73631.pep
SGFRKDMSHVAEWSRSRWLPVAPPSAGENSATTPPRAES

SEQ ID NO: 179214 - protein, 144 aa, Triticum aestivum
  Clone ID: PAT_TA_73632.pep
MTTGSTPGSPPSQGSQRKRGSTKDSVALYAVQCYKCYKWSTVPKEEFETLRENFTKDPWFCSRRPDCSCADDADIEYDSSRIWVLDKPNIPKPPPGTERLVILRSDYSKMDTYYVMPNGKRARCAGDVDKFLEANPEYKNSISV

SEQ ID NO: 179215 - protein, 67 aa, Triticum aestivum
  Clone ID: PAT_TA_73633.pep
RAAAQQQQQQLARRGDGEMEMVPLLLLPSTTFLFFENGFPHHHIIILASSTVLALLLVVLVLSSSPF

SEQ ID NO: 179216 - protein, 121 aa, Triticum aestivum
  Clone ID: PAT_TA_73634.pep
FGTRLTFLSGIRALAPLSAVLHNLALSDVGLLDQIATADDLRSVERADGAGPGVLRVRGGGRRRAQPHLRDVRAEQAVCALRHRAQRRVEPRRGHAPTPARVLQDHPARRPAAGHRDLALI

SEQ ID NO: 179217 - protein, 130 aa, Triticum aestivum
  Clone ID: PAT_TA_73635.pep
MWWEWEGGGGEAPREETPVDFDFISLLSKPKDYYKILEVDYNASEETIRSSYIRLALKWHPDKKQGEESSTSKFQEINEAYQVLSNPAKRQEYDKKGILYVQDQNVVDYLNRHKGLILTCNGLGIRYSVW

SEQ ID NO: 179218 - protein, 85 aa, Triticum aestivum
  Clone ID: PAT_TA_73636.pep
DTQPTVVVSHYKIGPLCDSESLASSVVVMSFISDLFCFLTEPTGSKPGGRQEPFHWCKLPSHCHNRHRGQGSSWVGWSMAWECRR

SEQ ID NO: 179219 - protein, 216 aa, Triticum aestivum
  Clone ID: PAT_TA_73637.pep
MATAARALVAARPARPLLPSRRLPSSSSIRPPRQRGGGVGSVRCMARRPDSSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 179220 - protein, 116 aa, Triticum aestivum
  unsure (1)..(116): unsure at all Xaa locations
  Clone ID: PAT_TA_73638.pep
EGQSVNVGXKWGLVRGVASALASLPDSLKEKLVPDVQHRGKLQDLHNSVHEISADDALQMFHESLCQSNRPSEGSGSHVTSTSNGATESNRMESLSKDLVLLLHECSDIKVSEELA

SEQ ID NO: 179221 - protein, 205 aa, Triticum aestivum
  Clone ID: PAT_TA_73639.pep
LLSQKESPLHDSLRSIPASIWESHIRVGITAILQNRVVSSEKLHTLLLAECMMSILGENWLSEDFHVPDNQNVLPVDKFMLLVLESARVEVAVLLNELAYLKYESSKTSQTDEAICQKQRNLAILFSLIEKIIKMISNASSGEGAPIQTIHESTIMQAITGLNETISLVLDFLQDAKDHGQQKGDDLLAAARIVGSYLAEAPYAC

SEQ ID NO: 179222 - protein, 63 aa, Triticum aestivum
  Clone ID: PAT_TA_73640.pep
RSGFKGPKFRCAHFFFQMNWYILRISAFHSSQFLQCIQVDHERRHDPERSEHTTENENVYIVA

SEQ ID NO: 179223 - protein, 108 aa, Triticum aestivum
  Clone ID: PAT_TA_73641.pep
VICEDVSVLKQRVDERLSLSKVERSCMSSLSSSLHSSRHKSWTSSDRTTEAMESPDKRTLVEPASPVCKDLDGDDDQCTVEVSYGNDAGKGILKRVNSKEDGDGWELC

SEQ ID NO: 179224 - protein, 101 aa, Triticum aestivum
  Clone ID: PAT_TA_73642.pep
VQTEKKETPQERLKRIMSKQLNKQIRKDTAAEIAKKREQERQRQEKLAEVEGDIIAEAVVGVEVQGGTIHDPSLIPVRLLALQGTEAGQGTEYQLHQSPMK

SEQ ID NO: 179225 - protein, 35 aa, Triticum aestivum
  Clone ID: PAT_TA_73643.pep
MSDLDSQIPSAFDPFAEANAGDSGAAAGSKDYVHV

SEQ ID NO: 179226 - protein, 151 aa, Triticum aestivum
  Clone ID: PAT_TA_73644.pep
FNNICSQGLFDLFNTKWLFKILKWASYLIGLSENHCCLLCQINCSSSTNMISPSIGNASMNNQRGHVSKKWWYMGCELCKKRLHNEGGSYYCQPCDCRSAIPMYKFSLIAADETAEARFFCHDIVAHHLICRNYNSLLKLLAIHQAYLHKC

SEQ ID NO: 179227 - protein, 59 aa, Triticum aestivum
  Clone ID: PAT_TA_73645.pep
FGRGFGCTDATQVLKELEEAKKAYPDAFVRIIGFDNVRQVQLISFIAYKPPGCEESGGN

SEQ ID NO: 179228 - protein, 120 aa, Triticum aestivum
  Clone ID: PAT_TA_73646.pep
QRSTVYCTPFEPLFWYPFEKHLKAKGTGRRRGTLQWNSRKQKSQGNASMNCTATRVPAHCKPRAAGLQGEEGYTPTALNVGVAVHCTGKVALLQWRMRRLAARLDPELCRRQLGASRFAC

SEQ ID NO: 179229 - protein, 74 aa, Triticum aestivum
  Clone ID: PAT_TA_73647.pep
WWSGSSRTPRHEQNPFGPSPHVTCFSKLPAVKKGGEGLPWFFPPFCATIPFHSCSLANCRPASWHAKWACVIPL

SEQ ID NO: 179230 - protein, 158 aa, Triticum aestivum
  unsure (1)..(158): unsure at all Xaa locations
  Clone ID: PAT_TA_73648.pep
FGTRKHPEQPXVVTLEMCMTGLDKKKASVFFKTSADGHTTCAKEMTKLSGISDIIPEMEVCDFDFEPCGYSMNAIHGPAFSTIHVTPEDGFSYASYEVMGFNPASLAYGDLVKRVLRCFGPSEFSVAVTIFGGRNHAGTXAKGLDVGAYSCSNMVEQE

SEQ ID NO: 179231 - protein, 133 aa, Triticum aestivum
  Clone ID: PAT_TA_73649.pep
MPAMVKPASRAAKPASAPKKQKAKPSAAAGGSSHPPYFEMIKEAITVLKERTGSSAHAIAKYMEEKHGASLPANYKKMLSIQLRGFASKGKLVKVKASYKLSDAAKDSPKAKPAAPAPKAAAPKPAKDAAKPK

SEQ ID NO: 179232 - protein, 49 aa, Triticum aestivum
  Clone ID: PAT_TA_73650.pep
FGRGELKALWDSQVNDEEQWALNYKLLKAAGLFAGSIFLMRNFGDLMAI

SEQ ID NO: 179233 - protein, 70 aa, Triticum aestivum
  Clone ID: PAT_TA_73651.pep
PDRCRLCTTSCFSVAADSVHFCALKFHAVLRPLLLAKEQVHYAVEHLPPLHSAATHSLLVWHEPLPLHRL

SEQ ID NO: 179234 - protein, 55 aa, Triticum aestivum
  Clone ID: PAT_TA_73652.pep
EVDFESESVPSYLQPDQESELNLPAAPTGHAAVPANQQQEDELGLPTVPQASIRT

SEQ ID NO: 179235 - protein, 177 aa, Triticum aestivum
  Clone ID: PAT_TA_73653.pep
EADEGRLVYKALENAADRKIKIRIVQHSGFAPDFDKESADLAAGRPNVENATVLFEDWWGSGVVHAKVWISDKKDVYIGSANNDWKSLTQVKELGIYFANCPQIAKTVEVYFQNLWTLSTLNSTSYTKQAWDKEWQVSRKVPCWSHFLQPKERCRSPIPLSVDIPYVDGYPALAILK

SEQ ID NO: 179236 - protein, 177 aa, Triticum aestivum
  Clone ID: PAT_TA_73654.pep
FGRGWNRAYKRCMTMLRSVYATLRFLPAYRVFRLLCANQSYNYEMVHRVGSFAVPLSRDEEAAMRSYQFVPVETQHGRLVVSVQYLPSLAAFNLEISSLSPSMLIADYVGSPAAEPMRAFPASLTGATGSAFPQALSNQPQRPHSWATPALWPQAPRQQARFSPPHLLNASPTPSPP

SEQ ID NO: 179237 - protein, 53 aa, Triticum aestivum
  Clone ID: PAT_TA_73655.pep
PTHPYHTDSQVQLQILSCPCPDFPYSTATIQTGVGNGKRTHKPGSPRTQTFIT

SEQ ID NO: 179238 - protein, 95 aa, Triticum aestivum
  Clone ID: PAT_TA_73656.pep
MAGLSLQHPWAFAFGLLGNVISFMTFLAPIPTFYRIYKTKSTEGFQSVPYVVALFSAMLWIFYALIKSNETFLITINAAGCVIETIYIIMYFVYA

SEQ ID NO: 179239 - protein, 126 aa, Triticum aestivum
  Clone ID: PAT_TA_73657.pep
STKGLVGWDMLHPSQVNPYNPRNKPVWLSVKGWPNGCVQKWMLCISCWPTRHPQAKSLYPPIQVTKHLHMVIACTDAGLLHLPKQPTKHYFQVTACTQHAYTQPEYSHRKATEHTPIDWHNFQRPL

SEQ ID NO: 179240 - protein, 99 aa, Triticum aestivum
  Clone ID: PAT_TA_73658.pep
IRTRENDELPKDDDKSATKPKEAISKGKDSKDEGKSTEGKARSGRKPRNAGTPLKSDADKEKRKEKEVKAAEIEQEASGNASTGKSGNASTGKKRRRKA

SEQ ID NO: 179241 - protein, 116 aa, Triticum aestivum
  Clone ID: PAT_TA_73659.pep
MGGDWQELAQSAVIGLIFAFLVAKLISVVLAFKEDNLRITRSAPDPAPSSSPDAAAPALDGGDGDGDSDSDGDWEGVESTELDEDFSAASAFVAASAAGVPEEAQLRLYGLYKIAT

SEQ ID NO: 179242 - protein, 64 aa, Triticum aestivum
  Clone ID: PAT_TA_73660.pep
SDEEKGLDPLSFKFVEHHKTPAFTFISSHDESIWNLDGEMFQASEVSVQACRGLVNLFASGPEV

SEQ ID NO: 179243 - protein, 164 aa, Triticum aestivum
  Clone ID: PAT_TA_73661.pep
MPTAKVALVENVNEGNRDEPNVSLCGELNWLSSSGSCEEDIFRRYLAFTTADVENGWYGGTLIYDRDENSGAYKHYSELCQGAVMDPFEHDPEKERHYAEALIVDLDVSNDARVEAEMQAALDDYQIIGSDLSIIPSCGALAEDPSQLTRWIIGDEKLLVGAAQ

SEQ ID NO: 179244 - protein, 114 aa, Triticum aestivum
  Clone ID: PAT_TA_73662.pep
MDASHPKGEAAAGWVTIEEWSGSSASALSRTAVLTASASASSLTAHRFGSRWGQIGSRMLGAFVPEGFPGSVTPDYVPFQMWDTLQGLSTYIRAMLSTQALLGAIGVGEQSATV

SEQ ID NO: 179245 - protein, 70 aa, Triticum aestivum
  Clone ID: PAT_TA_73663.pep
TMDIDLLSNGCQEPFSKSSHTCYHAWRCAVRTTETHALSFALILEALICQALICSFACDVSYIVGTKDRH

SEQ ID NO: 179246 - protein, 77 aa, Triticum aestivum
  Clone ID: PAT_TA_73664.pep
GTRKKGGFLQKIRTSLVYLCPAEHIPPKIEVDLTNLDVGDRVLMHDIPVHPSLKLLSKNETMPICKILASKPIEPVE

SEQ ID NO: 179247 - protein, 137 aa, Triticum aestivum
  unsure (1)..(137): unsure at all Xaa locations
  Clone ID: PAT_TA_73665.pep
FGRGGLPGARSGSTSFPSELLVDRFLFDHLLGSWLSLPLSPIKFSCLVSYFQIPTALDPFAXVSAVDSSAAAGXSEDYDHVLVQQRNGHGSLTTIHGLGKEIEYSKILRDLNKEYCCNVTXTMDPELGQGIRLQGDQ

SEQ ID NO: 179248 - protein, 70 aa, Triticum aestivum
  Clone ID: PAT_TA_73666.pep
LSAPLKKIALISRNEHSYQWWPPLGLLQLNHMCAPCYTCGSIASSVIHARCPSWKQREYDVMKIVLHLFP

SEQ ID NO: 179249 - protein, 115 aa, Triticum aestivum
  Clone ID: PAT_TA_73667.pep
MSDLDVQLPSAFDPFAEANAEDSGAGPGAKDYVHVRIQQRNGRKSLTTVQGLKKEYSYNKILKDLKKEFCCNGTVVQDPELGQVIQLQGDQRKNVATFLVQAGIAKKDNIKIHGF

SEQ ID NO: 179250 - protein, 89 aa, Triticum aestivum
  Clone ID: PAT_TA_73668.pep
MLTCQQCENIGIVAKKSIRRVAYSTLGGTFAGLLLFRSPTTRWASVALGAGVGIGAAYTECSYLFNGAPPKWSPKVSTVPSAHSEGEDK

SEQ ID NO: 179251 - protein, 171 aa, Triticum aestivum
  Clone ID: PAT_TA_73669.pep
FGRGRHNLLGKFELSGIPPAPRGVPQITVCFDMDANGILNVSAEDKTTGQKNKITITNDKGRLSKEEIEKMVQEAEKYKAEDEEHKKKVDAKNSLENYAYNMRNTIRDDKIASKLPEADKKKIDDAIEGAINWLDNNQLAEVDEFEDKMKELEGICNPIIAKMYQGAAGPD

SEQ ID NO: 179252 - protein, 143 aa, Triticum aestivum
  unsure (1)..(143): unsure at all Xaa locations
  Clone ID: PAT_TA_73670.pep
RDFSIQNGLIHRQFVRLLSQFPSPGQVHFASFLSWSCSPDSHNSQLHANQNKKKKNHLVSSGTKXMKIEMKFLALLSTDSKKHQTLMWTGRRTDLLLLLLLFLRRAGAVVLPTLCQYSNSALQVHMWCTTARQADFSYANQVQ

SEQ ID NO: 179253 - protein, 49 aa, Triticum aestivum
  Clone ID: PAT_TA_73671.pep
LQSLKKLIRMSTNRNSIREVLYSSMPYHLRQEVLFLIGFLEYPIFDFVF

SEQ ID NO: 179254 - protein, 187 aa, Triticum aestivum
  unsure (1)..(187): unsure at all Xaa locations
  Clone ID: PAT_TA_73672.pep
GTRGLRNLEKTLEEGGELXXGKTVYLFGGTEPQLLDVNGELKIVLVPVVVAVDCPFPPSDKIGINFVQTGKEEIVPMKEMKMAWVPYVPLEDRFVRIESLKTKIFTLCCTQRRSVLKCMKTERANKFYYCTPYYMPLNPPEDEDGTAVTAIYPLDPPILCDFYLELDDYEVLAARIVRDEGLPEDET

SEQ ID NO: 179255 - protein, 86 aa, Triticum aestivum
  Clone ID: PAT_TA_73673.pep
RVTSAVELDARQTELIARKMRRLTGFVNLKVENVVDTSLIAGFVICYGTDDSHVIDLSVKSQLAALKNRVDSIDQTVHAHGHPHHC

SEQ ID NO: 179256 - protein, 67 aa, Triticum aestivum
  Clone ID: PAT_TA_73674.pep
KAKNRANKNVCTGGSLQLLPSVLFHPFVSLHATGPKLISYDGITAPGRWVKMHLKMSRSCQYGSSIR

SEQ ID NO: 179257 - protein, 110 aa, Triticum aestivum
  Clone ID: PAT_TA_73675.pep
MGKKIRSANGTSTPVRSMNQAVSLREETSGRTHVDDVSLLRVKHLQRLAAWAGAEAGVGPIGALLGRRLAASAEAAGVPLDAATFLCQRCETILKPGFNCTVRIRDKRNK

SEQ ID NO: 179258 - protein, 85 aa, Triticum aestivum
  Clone ID: PAT_TA_73676.pep
FFFPQQHHIRAFLMCAVDLGFYTTQGCRLSPMQFESLRAFGFCTSVHGTEFAFGGQHPSVAWVFDDLYSELFVLFLFMKQVLLFV

SEQ ID NO: 179259 - protein, 135 aa, Triticum aestivum
  Clone ID: PAT_TA_73677.pep
LSIPNYKGREAYISGTTNPTALPAETVLKMATINGAKAVLWDNEIGSLEVGKKADLVVVNPFTWSMVPLHDRIANIVYSMRTENIESVMCNGQWIMKDHKIMNLNEEEEISSAVKRANDLLERAGINLPSRMNYV

SEQ ID NO: 179260 - protein, 108 aa, Triticum aestivum
  Clone ID: PAT_TA_73678.pep
MVAPVVIASAGLGMLAGVAMANRSLGGDGLPAASKWDARPRCATCGGSGRVECMCNRWSDGDSGCRTCAGSGRMPCRSCGGSGTGRPLPARLIVQHQKPPPPPPAGHN

SEQ ID NO: 179261 - protein, 114 aa, Triticum aestivum
  Clone ID: PAT_TA_73679.pep
FGRGLCREQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 179262 - protein, 168 aa, Triticum aestivum
  Clone ID: PAT_TA_73680.pep
SDEGKLMGLMLHGISASANLIGNILTKLVLSPELQDQLHVEIVSVCNESSKLEVDDLLRMQVLLATVCESARLLPAGPLLQRCSLKHDLKLGSGITVPAQSILVVPLHLVQMDASVWGDDADQFNPHRFLKKDVDLREIFGAPKGSNRINVFSECAKTESFLPFGSGS

SEQ ID NO: 179263 - protein, 195 aa, Triticum aestivum
  unsure (1)..(195): unsure at all Xaa locations
  Clone ID: PAT_TA_73681.pep
FRFSMSWTRLLPTXGYTNKPSKDGIKFYNNILDELHANNIEPVVTIYHWDHPDSIEKKEGGWLNETMVEIFADYTRFLFNEFGSKIKIWITMNAPSSFCKYGYGTGVAAPGVEMPGIGPYICTHNMLKAHARAYRIYDEEFRNTQNGQVGVVLTCDHYYPVNKNDTKSPDIAFQFDCGWFANPIFSKNGDYPNIM

SEQ ID NO: 179264 - protein, 49 aa, Triticum aestivum
  Clone ID: PAT_TA_73682.pep
LPTGKKHSSPRIGTMYHYRTSQYNCCKMSSRCDTAANCKKHGTQHITGA

SEQ ID NO: 179265 - protein, 211 aa, Triticum aestivum
  Clone ID: PAT_TA_73683.pep
EANGSSVMETTDGTTTAVETSRNPSMGYGDSEGTAPPLRAFRKKRRREFPEASAQPQAKYWSEYDHPEDGSDAGDAYVIYIDPNERSSFDLFFDKIGRFFSRKSKSADDNVLPPSPSIGGDDESSSDEESRLLPRKPKSYGAMPSLHAQSQRRYGSSARTYEQEHDSNALLPQFAAVSLVASLVILVVAYLLAATGKHKLATEATRASSLL

SEQ ID NO: 179266 - protein, 171 aa, Triticum aestivum
  Clone ID: PAT_TA_73684.pep
IRHEAATDEIDIHSMRNSFVNSSTSRNEPNEHCTLDFDIKGSMLEALEKSDSDLENQYNGSTRPCGSLPTAGTSGSIDDFMSLQTNFGSLTSLVRSVEDGPMSRIIQDQCDLQLGFGVQKPQMYPTFEEQLRMASAGAPQFGTMNRHNHVPVPEPTLMLGYAPHIGSCPPV

SEQ ID NO: 179267 - protein, 27 aa, Triticum aestivum
  Clone ID: PAT_TA_73685.pep
YQLARCILLPNLYNLPFNIIRPFLHKG

SEQ ID NO: 179268 - protein, 80 aa, Triticum aestivum
  Clone ID: PAT_TA_73686.pep
SKANNLVLNVDGAIGSLFLDLLSGSGMFTKQEIDEIVEIGYLNGLFVLARSIGLIGHTFDQKRLKQPLYRHPWEDVLYTK

SEQ ID NO: 179269 - protein, 137 aa, Triticum aestivum
  Clone ID: PAT_TA_73687.pep
GTRDAVIDAEARRRKWLEDYPEATNTDEAVVFDTSIIPWWAWMKRFHLPEAEKLNGRAAMVGFFMAYFVDSLTGVGLVDQMGNFFCKTLLFVAVAGVLLIRKNEDIESLKKLIDESTFYDKQWLATWQDDSTGGPKN

SEQ ID NO: 179270 - protein, 110 aa, Triticum aestivum
  Clone ID: PAT_TA_73688.pep
KSILIELWIFITKWSVYKDHKRIGKQEQKTEQNATDLAVSSGRGVMRRCVAVPATANPIKARVSCASTLSSGSVRRSVSQLTMRTLAATPSGLVTDGGILGATAATALVR

SEQ ID NO: 179271 - protein, 79 aa, Triticum aestivum
  Clone ID: PAT_TA_73689.pep
AAPRAVAPAASLHLGPGEIAEVSRNKVLIAATVASAIGQLSKPFTSGKNGSAGAGLDLRTIFRSGGMPSTHSAVKTSDY

SEQ ID NO: 179272 - protein, 78 aa, Triticum aestivum
  Clone ID: PAT_TA_73690.pep
HYVVNWSILAALLPTADRHVSYVYKFASNIMEHARDNSNIRHVYKFALHAIIPGQWDCPFFYLLRPCLVSKNFGKSIL

SEQ ID NO: 179273 - protein, 110 aa, Triticum aestivum
  Clone ID: PAT_TA_73691.pep
PPKGCHLQREGFGTTSRGLDDHFPNRHKDPILGHFAQAHQVSQGPRERVLSEADILSPQFGKKLGNVFDLRERLSPSEHFTRHALVDHVDLNPSLDLTSGSLHPGLSRGK

SEQ ID NO: 179274 - protein, 144 aa, Triticum aestivum
  Clone ID: PAT_TA_73692.pep
RHEDNFKVRAREKGFQIRDFEYSPEAQEGRKQEMEKLLQDQEAMRTSLLQWCYASYSEVFSSWMHFCAVRIFVESILRYGLPPSFLSAVLAPSTKGEKKVRSILEELCGNVHSVYWKAEDDVAVAGLGGESEVHPYVSFTVNFV

SEQ ID NO: 179275 - protein, 68 aa, Triticum aestivum
  Clone ID: PAT_TA_73693.pep
TVRCLMEGTFGCTTQTVLGDLLPLMADALEFYFTYMCNVLIHYVRTIIVLGSSEHHSIQLVLCCPLHE

SEQ ID NO: 179276 - protein, 161 aa, Triticum aestivum
  Clone ID: PAT_TA_73694.pep
DSDEGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAG

SEQ ID NO: 179277 - protein, 43 aa, Triticum aestivum
  Clone ID: PAT_TA_73695.pep
TFNGLSILLGLAFQLQGDQRKNVSNFLVQAGIVNNEHLKIHGF

SEQ ID NO: 179278 - protein, 56 aa, Triticum aestivum
  Clone ID: PAT_TA_73696.pep
GTRGRRYRVPPNFPGRFHPSDAIEFGSDKKAVFRVKVLSTLPYESARGGPQILQAA

SEQ ID NO: 179279 - protein, 94 aa, Triticum aestivum
  Clone ID: PAT_TA_73697.pep
GSDATHTLHTVLNIYVHTYRSETTKIHYAVPRYTHNHRAKLHISTWTLFIAASSRLQAQSIMQDTKGQGAELKAAVCLFITRWRWPTSWPRTVA

SEQ ID NO: 179280 - protein, 135 aa, Triticum aestivum
  unsure (1)..(135): unsure at all Xaa locations
  Clone ID: PAT_TA_73698.pep
NHAYSLLYTRGYAIVQHWHYCSNCYSPQINIRPYHXAARIQTHYSGVGYANLADSKVLSSRMLIMIRYKYKRRSSIRFSLQSPQQSYGKLFQKVTSPKILVRNNHVPFEHCSLQDRDPQESVLFFNHLLDRSLLL

SEQ ID NO: 179281 - protein, 193 aa, Triticum aestivum
  Clone ID: PAT_TA_73699.pep
SHLATASPSASLSHPPSSLSHPPPSHLPSSAATAPPPSPVPPTATTPQRPDLVGGGQPESSRWTWHSMDLACIKVRGSVRRACAEEDSWSSPSPSQHKPRRLVSSMPHTLRSPPPSLLFSSDPDPTSAAPASSPDESSASRSSARRWVWLCVCPLASCRQIHGAATGSSLDSVDLPFWFKVSGLTINGSGEKY

SEQ ID NO: 179282 - protein, 150 aa, Triticum aestivum
  Clone ID: PAT_TA_73700.pep
ILALSNPTSQSECTAEQAYTWSQGRAIFGSGSPFDPVKYNDKLFVPAQANNAYIFPGFGLGVVISGAVRVSDDMVLAAAEGLAEQVTPEHIEKGLIYPPFSIIRKISANIAARVAAKAYDLGMASQLPRPKDLVKYAESCMYSPVYRTYR

SEQ ID NO: 179283 - protein, 61 aa, Triticum aestivum
  Clone ID: PAT_TA_73701.pep
MGANCCIAAKERPQPCVTPIEVSAFRNVRHSPSWSFRWDNRTHIEDIMEMPALFSNHSSGS

SEQ ID NO: 179284 - protein, 78 aa, Triticum aestivum
  Clone ID: PAT_TA_73702.pep
HAHRPISLYAWAWLHYNLSSVQTDESIIATDTDAQAKAATLSLHSHPTILRKLNARNLTRISGCSLRTCRLRRCCCRC

SEQ ID NO: 179285 - protein, 52 aa, Triticum aestivum
  Clone ID: PAT_TA_73703.pep
GVRLIQAIKTTNDEPIFKSNNFRSRLQAMNRWVNLQNHLQQLYGTSIWVHRW

SEQ ID NO: 179286 - protein, 201 aa, Triticum aestivum
  unsure (1)..(201): unsure at all Xaa locations
  Clone ID: PAT_TA_73704.pep
WNFVAECLPKYIQKVQISSKNELELLIAPEGVLPVFHFLKNQTNCQFVNLSDICAVDVPQRSNRFEIVYNLLSLRFNTRIRVKTYTDELTPIDSITSIYEAANWYEREIWDMFGVFFTNHPDLRRILTDYGFEGHPFRXDFPLSGYVEVRYDDEKRRVVVEPLEMSQEFRRFELSTPWEQFPNFKKATTAEEVPSAEKEKK

SEQ ID NO: 179287 - protein, 134 aa, Triticum aestivum
  Clone ID: PAT_TA_73705.pep
LTKILCSLGTSNSQPCCRQLPVPAQRSLCDELPWYIHIPYEDLKTAGSVDICHSLSNTNNRLLPAVVYSGVLTIQTLLMDIYFFLDRKFILLILRESALVGHPHEWSLFVSFSMVIFFLWLIWTLVIVPVPSGR

SEQ ID NO: 179288 - protein, 168 aa, Triticum aestivum
  Clone ID: PAT_TA_73706.pep
FGTRPRLAAVMDAVNERKLPPELRGRGNAVRSETDIVNVVEQRIWHSMEEGHFENLPGKGKPLNLTSNPHADPAEDTLYRILSRNGCAPEWVELNKEIRGMIIGWRLALRKAWANRSEGDDSNWNDDCRVLQEQIRQINDKVFRYNLIVPFGRQMFGLNWDKEVDKLK

SEQ ID NO: 179289 - protein, 161 aa, Triticum aestivum
  Clone ID: PAT_TA_73707.pep
MYRVASGLGALKRHGADAQMMNVAIRCASTSVAQGSSGGFWTWLTGARSNEIPPPDFALPGVTIPPPLPDHVEAGKTIVTTLPNGVKIASETSAGSSCSVGVYVDCGSVYEAPETTGASQLVKTMAFATTANRSELRVVREIDAIGGTAKASASREMMSYT

SEQ ID NO: 179290 - protein, 215 aa, Triticum aestivum
  Clone ID: PAT_TA_73708.pep
RTRGDKSTPTGGDLVLYRRIAEVKEKERRRTLEEILYALVVQKFVEADVSLVPALSHSIDSSGRVDQWTETVEEKLQRLHSPEAYEMIENHLSLILGQRQGDATIAAISKLRVGQVYAASVMYGYFLKRVDQRFQLEKTMKSLPWGSEEEDSALNQVMTTDSMPSARVSSSHPEMGSWTAPDFNAGGPSQSIKPSRLRSYVMSFDSDTLQRYATV

SEQ ID NO: 179291 - protein, 103 aa, Triticum aestivum
  Clone ID: PAT_TA_73709.pep
RAVQTAWRVGNDAVEAGSNLVPGSVPRPIARIGVTFAAMAVALFLVKSVVSTALFVLAMMALIYLGFRAMNPKEASSFRLDEAMGDPSEDPVEEARRIMEKSK

SEQ ID NO: 179292 - protein, 83 aa, Triticum aestivum
  Clone ID: PAT_TA_73710.pep
IHDASWFLFTYQSRLLYIRTTTSQPNKIQNPTYMFLSPFRSCLHILRKPLSIYWWHVQIYLSPTLFCMYACIMYVYSYICNKL

SEQ ID NO: 179293 - protein, 78 aa, Triticum aestivum
  Clone ID: PAT_TA_73711.pep
SARGPIGVSRYEYDQLRAPVGRVYFTGEHTSERYNGYVHGAYLAGIDSANILINHIFKNEEYKVRGKYEPDDQIAKAK

SEQ ID NO: 179294 - protein, 222 aa, Triticum aestivum
  Clone ID: PAT_TA_73712.pep
LRGSGISLALDVGNDKVGELASDSAAAASWVRDNVQAYYPDVDIRYVVVGNEVPGAASVLQAMQNVHAALASAGLAGNVRVSTAVKMDAIENSSPPSSGVFKDPAAMSPIVQFLAGNGAPLLANVYPYFAYEYSDGIDLNYALFQPSSTTVTDPANGLVYTNLFDAMVDAVRAALDKAGGGGGVNVVVSESGWPSADGKGATVDNARTYNQNLINHAGKGTP

SEQ ID NO: 179295 - protein, 62 aa, Triticum aestivum
  Clone ID: PAT_TA_73713.pep
QQFSSSPEERNVVDSFNSSLATLFTSVNKLDAESSKSAFVSSATALEKWIALAGLGGQLKGY

SEQ ID NO: 179296 - protein, 47 aa, Triticum aestivum
  Clone ID: PAT_TA_73714.pep
LGLKDSSSDSQLNCVISSFFYLHLIFHACVQRFDEMDEKFLDGELNR

SEQ ID NO: 179297 - protein, 188 aa, Triticum aestivum
  unsure (1)..(188): unsure at all Xaa locations
  Clone ID: PAT_TA_73715.pep
GCGDDDYQKWRWQPDGCDLPRFDAKLLLEKLRNKRLMFVGDSLNRNQWESMVCLVQSEAPWDKKSLVKNGSLNVFHLQEYNATVEFYWAPFLVESNSDDPDIHSISDRMIKPTSIAKHAANWXGVDYLIFNTYIWWMNTPQMKTLHGGSFSRKHVKYDEIERVEAXXRKVLKTWSRWVEAHIDPKRTT

SEQ ID NO: 179298 - protein, 143 aa, Triticum aestivum
  unsure (1)..(143): unsure at all Xaa locations
  Clone ID: PAT_TA_73716.pep
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETVYRGARKGRXXLVIAPKDYSTKYRY

SEQ ID NO: 179299 - protein, 191 aa, Triticum aestivum
  unsure (1)..(191): unsure at all Xaa locations
  Clone ID: PAT_TA_73717.pep
MATPAPATAGELLRVEPLELXFPFELNKQISCSMQLSNHTNDYFAFKVKTTSPKKYSVRPNTGVVLPRSTCDVVVTMQAQRLAPPDMQCKDKFLVQSIVAPSGITVKDVTGDMFTKESGNKMEEVKLRVTYVAPPQPPSPVPEESEEGSPSRTSESEXGDGPAGGFTRALRERIEPQDNXTEAGALISKLT

SEQ ID NO: 179300 - protein, 85 aa, Triticum aestivum
  unsure (1)..(85): unsure at all Xaa locations
  Clone ID: PAT_TA_73718.pep
AWQSVATNLLATLFVACHTFCGLPHLLKVSCGKLWLATKHPLEHTLRSVVVSDASPAFQIVNYSMNLEVSLTEXKKKKKKKKTKK

SEQ ID NO: 179301 - protein, 148 aa, Triticum aestivum
  Clone ID: PAT_TA_73719.pep
SEMRINGQTSKNHFSRSRPSKKLDGLSKPARNISCSSDIRNGSGSDWSMLSRTLESSPSRHQGCPMPTSAPPSLCGSASIILSISPISKQSSPPSGRFMTPPSGRFVTPPSGSFVMGSSVPKTLSATLGVPAWIQLDPASKASGPRPN

SEQ ID NO: 179302 - protein, 90 aa, Triticum aestivum
  Clone ID: PAT_TA_73720.pep
RGIISRDIAKFVVRGHQELTLQLFKLEDVAMGIWIQQYKNSGQQVNIVTDDRFYNEGCDADYVLAHYQTPRLMMCLWEKLKTEYQAICCE

SEQ ID NO: 179303 - protein, 98 aa, Triticum aestivum
  Clone ID: PAT_TA_73721.pep
FGTRARPNIESVNGTVSHNIAGGGIVSGSGSGNDVYQNRFPQREAALNKFRLKRKDRNFGKKVRYQSRKRLAEQRPRVRGQFVRQSGQEDQAAQGSER

SEQ ID NO: 179304 - protein, 63 aa, Triticum aestivum
  Clone ID: PAT_TA_73722.pep
SIKLGRLATYNSSIYEMNKDVSTPYIRIIQHSNVFLQVFCSDDCGLIELELIMLDVGGACKHV

SEQ ID NO: 179305 - protein, 70 aa, Triticum aestivum
  unsure (1)..(70): unsure at all Xaa locations
  Clone ID: PAT_TA_73723.pep
MGVHAKSMSWYMSPPXSPAAPGSAATEAQHALSXXPGGSSDASFDTNMVIILAALLFALLFALGLNSLAR

SEQ ID NO: 179306 - protein, 122 aa, Triticum aestivum
  unsure (1)..(122): unsure at all Xaa locations
  Clone ID: PAT_TA_73724.pep
LRPWKXSSYVYEPSSVVIGVISYLEEQRNSLIDLQXRHGVKIPCEIDAQFAGMVEAWASGLTWREIMMDSAMDDGDLARLLRRSIDLLAQIPKLPDIDPVLQKNAQIACSVMDRVPISELAG

SEQ ID NO: 179307 - protein, 134 aa, Triticum aestivum
  Clone ID: PAT_TA_73725.pep
ARGIVLSCNATADHAIIWIEREAQKALDLMLEEEDTMAVPSEQQMERNETLQKEHVEEHRAALRRAVTLSVPDARGPSPYGTFDEVEQHHHQPERSESFPPAGPRQRMSWNDLIERVFDKDEDGHIVLRSSVLL

SEQ ID NO: 179308 - protein, 54 aa, Triticum aestivum
  Clone ID: PAT_TA_73726.pep
RTIHGLRIWSECLWASERLLYNDVRLLPHPLLYTMVSMICPVLWHHSIVKTKCH

SEQ ID NO: 179309 - protein, 74 aa, Triticum aestivum
  unsure (1)..(74): unsure at all Xaa locations
  Clone ID: PAT_TA_73727.pep
ISHEFGWRRKVEVEAYLAQITEDEQDLKTSVEAIAHVPPKSTFLRNVGMESKXMKKDAKAAAMNKRVQELMFWM

SEQ ID NO: 179310 - protein, 111 aa, Triticum aestivum
  unsure (1)..(111): unsure at all Xaa locations
  Clone ID: PAT_TA_73728.pep
TGHGVDWCPTEFKCDINYQXPSVVPGGDLAKVQRAMCMINNNTGCAEVFSRIDHKFDLMYAKRAFVHXYVGEGMEEGEFSEAREDLAALEKDYEEVGAEGADDENDDGEDY

SEQ ID NO: 179311 - protein, 197 aa, Triticum aestivum
  unsure (1)..(197): unsure at all Xaa locations
  Clone ID: PAT_TA_73729.pep
MDTSRGPLHLVRSISLVAVSQDHSLHLTCQTDLLTRPASGEGNQGSSGLSSYLEGFTPVKSIGSMPASHSYLLVPSPSMRYLSPATLQLPTCLTSESPPLAHLLHSKGTAIPLAMGYVVSKAVPPVRRDSAQLTKDEQPSVLLVSIIDHYGGSIATVQEKMSXRRWNFTQGTTTRDCEVEMHNVLEAVAAELHSLSW

SEQ ID NO: 179312 - protein, 179 aa, Triticum aestivum
  Clone ID: PAT_TA_73730.pep
RTRVVKQLLGLQINAEKYYFGIRKSLVEFDEVLEVQRKHVYNLRQVILSGDSESCSEQIFQYMQAVADEIVLLNIDPQKPPKAWNLVKLLDEFVRLGGKLLSESFEDIQEENLQSALEEMQGWDPVKADSFALPNMPVPPDSLRGIRKKTSSIMRWFAICVDDTSKKGRYTNTVNLLRK

SEQ ID NO: 179313 - protein, 155 aa, Triticum aestivum
  unsure (1)..(155): unsure at all Xaa locations
  Clone ID: PAT_TA_73731.pep
MRPQESFYIGPIDDGDMHNDVNQWPSEERLPSWKETMKLYIAAILDTGTRILSLIALGLDMDAEFFHKIGALNCPATFLRLLHYPGEVNESDSGNYGASPHSDYGVITLLETDGTPGLQICMEKDRNPHLWEHVHXHIDGALIINIGDLLERWTN

SEQ ID NO: 179314 - protein, 57 aa, Triticum aestivum
  Clone ID: PAT_TA_73732.pep
ESRMTQINTIIRSYIVLNKVLIKRKTLQRQQRLPLDTNEPPQQHIPQGLGSYKTSCR

SEQ ID NO: 179315 - protein, 101 aa, Triticum aestivum
  Clone ID: PAT_TA_73733.pep
MGSKDSQVEATLQDGNKEAEEDDWEAIADRGENDETLTLARSLEQQAKVSPSSSSEKISTPSSGPRGGERGSFLYDKSVLYSDQCGLENDMDEQESNDQSG

SEQ ID NO: 179316 - protein, 101 aa, Triticum aestivum
  Clone ID: PAT_TA_73734.pep
VRSAPPHLQFDARVHVVRLAGAEKVTCTCGLYEHVGLLCRHSLKVLVHLDRTEIPPGNIMYRWTKHAGPEYSPCTRELMMDQVSARVDGTKSHVKRALEFA

SEQ ID NO: 179317 - protein, 67 aa, Triticum aestivum
  Clone ID: PAT_TA_73735.pep
VAAILLVALLVTSNCSCKKEANYRSTTGVFLPLSALRWHLRRRLLFPSLLGYVMQYYAEYRVALPRR

SEQ ID NO: 179318 - protein, 69 aa, Triticum aestivum
  Clone ID: PAT_TA_73736.pep
LGEKKRSHLQQFGKLCFQKPKSPAKHEEKDRCQAGACTHICALDREIFQVRRDEELGCQTVGEDFSSFC

SEQ ID NO: 179319 - protein, 159 aa, Triticum aestivum
  unsure (1)..(159): unsure at all Xaa locations
  Clone ID: PAT_TA_73737.pep
HHHHDHGHRHHNCDDYRRVPPPPADEGYGQPPPTDPYGXRPVDPNPYGRPPCPGRELSRGWRTATSSTSGTSPETGRPDYGGGLDVADVGGGPEYGHEVRPHHHGGSEYGHETRPHHGVGGGGAAPVRHETYRIYCKAGDDQYSLSAHDGKVCLVRTER

SEQ ID NO: 179320 - protein, 61 aa, Triticum aestivum
  Clone ID: PAT_TA_73738.pep
SCTSTSVTQKHILGNCFQIKIFRSPRLLHDLYMILQPEAHIPLIFLSCFCQLKERVMNLPE

SEQ ID NO: 179321 - protein, 88 aa, Triticum aestivum
  unsure (1)..(88): unsure at all Xaa locations
  Clone ID: PAT_TA_73739.pep
FSSKKKKKNWFHKHISQHMHSSFRFRYAEYQVSEIVFWIEKVPDRLFTYSTDAMKPAKNMAMLPAYDFSXVVRELHMPKSSPKYVSNT

SEQ ID NO: 179322 - protein, 176 aa, Triticum aestivum
  Clone ID: PAT_TA_73740.pep
RPQGLYEHRDIDQKKLRKLILEAKLAPCYMGADDAAAAADLEECPICFLYYPSLNRSKCCSKGICTECFLQMKPTHTAQPTQCPFCKTPSYAVEYRGVKTKEERSIEQFEEQKVIEAQMRMRQQALQDEEDKMKRKQNRCSSSRTITPTKEVEYRDICSTSFSVPSYRCAEQETEC

SEQ ID NO: 179323 - protein, 76 aa, Triticum aestivum
  Clone ID: PAT_TA_73741.pep
QDDGCGSRTLPGRQSTVYLQRLNRIWIIFVESPVKVKVSTLHSSCTERYSHIISYNIGDKLQQIIEQILYNCIEVN

SEQ ID NO: 179324 - protein, 175 aa, Triticum aestivum
  Clone ID: PAT_TA_73742.pep
RQIHVDCHAKLLKETTNTCDLGLLRRLIVPPQSVKEVGQGSGISGMLNSIKDGFANSTAGNRRRPRNKKRGNNHPGGKANSIPAKGSVLDSVLEGFARLKGLDGKYALAKPLSQNSLKQTYRSGIPNERVRKYELVDLPQDSRPLLVFINGKSGGRNGPSLRRRLNMLLNPIQVI

SEQ ID NO: 179325 - protein, 77 aa, Triticum aestivum
  Clone ID: PAT_TA_73743.pep
MGGGNGQKSKMARERNLEKNKGSKGSQLETNKKAMSIQCKVCMQTFMCTTTEVKCREHAEAKHPKTDVYQCFPHLKK

SEQ ID NO: 179326 - protein, 124 aa, Triticum aestivum
  Clone ID: PAT_TA_73744.pep
MSSAAGGDGETVRASHILIKHQGSRRKASWKDPDGRIISATTRADAAARLLDLRNQILSGQANFADLAARHSDCSSARRGGDLGTFGRKQMQKPFEDATYALKVGELSEIVDTDSGVHVILRTA

SEQ ID NO: 179327 - protein, 68 aa, Triticum aestivum
  Clone ID: PAT_TA_73745.pep
MKCLLFLQIVKHFIEPMLYDKVKFVYSNNSDSQRILADIFDLDKLEFAFGGRNTASLDITKYSCWSDV

SEQ ID NO: 179328 - protein, 78 aa, Triticum aestivum
  Clone ID: PAT_TA_73746.pep
DEGPLFIFESQSCFFRAIRISMWSFLLLCHKLMLHYNLENICVLSGILLCGLHLTRGAIQGSIDICYEQFSYVILILN

SEQ ID NO: 179329 - protein, 64 aa, Triticum aestivum
  Clone ID: PAT_TA_73747.pep
PTALIVEGILNSVAAGILVYMALVDLLAEDFMNPKVQSRGKLQLAINVSMLVGAGLMSMLAKWA

SEQ ID NO: 179330 - protein, 50 aa, Triticum aestivum
  Clone ID: PAT_TA_73748.pep
DCNAQLICIQIQLQCDRCLLDSLFSEKVCRFPFHLFDYNFSENSVRSAHS

SEQ ID NO: 179331 - protein, 107 aa, Triticum aestivum
  Clone ID: PAT_TA_73749.pep
RENIGPSIHPPHTLSSGNNHGTGVLGEDAAGASPPCGLLPAGKQSGGDPEAKQRQKRGAGEGKMNKGGEQGAAAGGKDKERRKRRDDSKAPPIVVHQFPFHSRPGLL

SEQ ID NO: 179332 - protein, 168 aa, Triticum aestivum
  Clone ID: PAT_TA_73750.pep
GTRVELDAANSRLQDALSEMWELEAASRAAMENGMEEGLGDSTDEPLIDFPQELRMEVDRQPAQPAIHTPAVAGRRREDQMVPSMTSSFIRAETELTADFGNTSEDSRPEVPSNIHLQARAEREETVDGGTGNTVRMNGNHQQQNLQNNMHRVLGIAPSVSEASSSWT

SEQ ID NO: 179333 - protein, 120 aa, Triticum aestivum
  Clone ID: PAT_TA_73751.pep
KMIMATNRPDVLDPALLRPGRLDRKIEIPLPNEQSRMEVLKIHAAGIAKHGEIDYEAVVKLAEGFNGADLRNVCTEAGMAAIRAERDYVVHEDFMKAVRKLNDAKKLESSAHYSADFGKE

SEQ ID NO: 179334 - protein, 179 aa, Triticum aestivum
  Clone ID: PAT_TA_73752.pep
VHFEMEPLGGNPERRAAVARPAKSLLAIPVGIKQKAVVDKLVSKFPGDRFTVMLFHYDGEMDGWRELGWSDRAIHVAAKDQTKWWFGKRFLHPDMVAEYEYIFLWDEDIEVDGFDPIRYLSIVRRERLEISQPALDHRSQIHHRLTLRARKGQVHRRFYKTRGGGRCDDNMTGPPCTGW

SEQ ID NO: 179335 - protein, 33 aa, Triticum aestivum
  Clone ID: PAT_TA_73753.pep
GTRLILIFAEALALYGLIVGIILSSRAGQSRAD

SEQ ID NO: 179336 - protein, 118 aa, Triticum aestivum
  Clone ID: PAT_TA_73754.pep
KKYCTKEVIERCKGEREAYASQGIFFDHKILHISEADVLETKMFGSSPIIILRFQTQQIYCVRDREGQVTEGGQDTIQPVFYSWAMQLMDSDEVPEEESYYPVWRLREMQQAGIKALI

SEQ ID NO: 179337 - protein, 196 aa, Triticum aestivum
  unsure (1)..(196): unsure at all Xaa locations
  Clone ID: PAT_TA_73755.pep
NRNSPLIEQLIFFHDHTIFIIIIIITTITYIIIFIIKNKFINIKISENQIIEFIXTTTPPIILIFIAIPSLHLLYLIDEIKCPILTIKIFGHQXFXSYEYSDFSNIEFESYIINELNKENFRLIEVDNKTIIPFKFNIRLLISSDDVIHSXTIPRLAIKIDAIPGRINQINLFINRPGIYFGQCSEICGINHRFIP

SEQ ID NO: 179338 - protein, 152 aa, Triticum aestivum
  Clone ID: PAT_TA_73756.pep
EAGAQGVPMNQVTPSQGSDEAKPSDATVADAAAATSEGTAAPPAAEGTAAPSSEEPNAAAPGNEEGTAHPVNEEATAAGVPDAAGSPDVPAPAAPAPAPATVAVADTSSSDAPAVTPSEVTVSAPSTEAPELTDKPSSTEASLPPPPTVSGV

SEQ ID NO: 179339 - protein, 80 aa, Triticum aestivum
  Clone ID: PAT_TA_73757.pep
EQLGVKIISSSRMHSCGTNCWYAEDFTHGAVSNLYLQFGVQAGADDGYWGSNLVVTAIFVPETCSARIESCSPAPEILCS

SEQ ID NO: 179340 - protein, 90 aa, Triticum aestivum
  unsure (1)..(90): unsure at all Xaa locations
  Clone ID: PAT_TA_73758.pep
SDEHRPNFARPFQCAAVSAPSAAAASPSASAVPAERLEPRVXAALQREGGYWVPDKLTKLPMEQIDADKLTKQDVDVRLKWLGLFHRRKQ

SEQ ID NO: 179341 - protein, 87 aa, Triticum aestivum
  unsure (1)..(87): unsure at all Xaa locations
  Clone ID: PAT_TA_73759.pep
TMRGAFHDVSPCRTTTTSANRSPSSPPCCGVVGGMAQLGRGGRPATPARECHLTSSPAPAGRTNAVLVKXRHPPPSREVSGLSLVRI

SEQ ID NO: 179342 - protein, 185 aa, Triticum aestivum
  Clone ID: PAT_TA_73760.pep
EAVAARARGSPLLRALSGTRARPPLARSIHEGPDTIDELLDRHLSKKGPTPSAILDDDAAEALARRRLTSSRREALGLYRDILRATRLFEWPDERGVPWRDTLRANARREFEEARGERDPEVVARLLIGGRDAVDQALERVADASRRMVQAEEAKRRGGPVDPHTPTPTRCAPCFLFFFSCCCLY

SEQ ID NO: 179343 - protein, 75 aa, Triticum aestivum
  Clone ID: PAT_TA_73761.pep
MGIINWVQNRLNTKQEKKRSAAAAAAGASSVRNAPVRENSCRGQADDELPGDWSMLSIGTIGTLGNEPTPAPAPD

SEQ ID NO: 179344 - protein, 210 aa, Triticum aestivum
  Clone ID: PAT_TA_73762.pep
MGEGECNEAIASSLRNLEDLISLTVHGGSVLQQGPVCSLPRSIQELFMTQSSHLRRVPKWVSSLVNLQQLHLQVEEFEQEDLCILGSLPGLLILELTMENIDSRLTITREAGFRCLRKFSFGVVRWMMFEAGSMPRLETLELRIWSGEESDVDHTDSHTASVGDFDFGIGNLPCLVTLKYATHGCDDCNAAAKASMERAAGTYPNCPSPL

SEQ ID NO: 179345 - protein, 196 aa, Triticum aestivum
  Clone ID: PAT_TA_73763.pep
RRKRPRETVAPPARLFSLQAPQGSPGHKVIHLAQLHRRPAATGLRLDFDEGGSEHVACTSSTSSLLPGELAAQCGRHNNEIDRLLQEHAERLRLALADTRRRQNRSLLGAAEALAARRVREVEAETFKAARRGVELEERLARLRAEAASWQAKAMSDQSTAAALHAQLQQEAATAQARSGKAAEEAEGAADDAESG

SEQ ID NO: 179346 - protein, 73 aa, Triticum aestivum
  Clone ID: PAT_TA_73764.pep
GLLLRGCSPRIPLTLSSNASFSCSNGHRWEDNRTLISTAKLSVVYTPSTPRLELRRLLNWMPHRDGQSPPFWS

SEQ ID NO: 179347 - protein, 81 aa, Triticum aestivum
  Clone ID: PAT_TA_73765.pep
RPRRERERERERERERERERERESFPVSMYISQRRVPRGSTRWMFLHALSGVCLLVSVVAGAGSVADVAVEFKAHNPLRRG

SEQ ID NO: 179348 - protein, 170 aa, Triticum aestivum
  Clone ID: PAT_TA_73766.pep
MVDVEHRMAGMAPAAHAAGLRRLSTRAAAGPSSASASPRHGLYSFQGVASSVLSHLRASGVAVLPGLSEMELARAEAEMGFTFPPDLRAVLALGLPSGPGFPDWRSRAGLRAAFDLPVAAASLQIARGALWPRCWGKRPADSDRARRLARSAIRRAPLLVPLFDRCYLPC

SEQ ID NO: 179349 - protein, 100 aa, Triticum aestivum
  Clone ID: PAT_TA_73767.pep
HAPRARPAHRGPPVLLVHLLLVLVLLCWRRSRRGRAAADGRGRPGGPTPAGRGEGRHVGRLLHGSGPRSPQMGIEQESCGSSSLTAGLMLGGSYCGSAEP

SEQ ID NO: 179350 - protein, 100 aa, Triticum aestivum
  Clone ID: PAT_TA_73768.pep
SNTAKAMAGADPIWMMLDRFVFRRDPAESSIEDRSYSFSASHIAGSAPFTVAFRVLSPPEISRLYLKWPPLLDPMNGSSCDLVAARDNLLLISLTSSPGT

SEQ ID NO: 179351 - protein, 164 aa, Triticum aestivum
  unsure (1)..(164): unsure at all Xaa locations
  Clone ID: PAT_TA_73769.pep
MLQGSSISNQKTLYEVLSVPEDATYDEIRTAYKCAALNTHPDKAQPTLEPFVPTGEQHDFFGVQKAWETLRYPKCRAEYDKQLQSSRQSLDVIATDIEIEDMIVESSDDGVELLYACRCGDYFSITSCELGXMGILVSEDGEIEAQAPDSLPTSIVLGCGSCSL

SEQ ID NO: 179352 - protein, 73 aa, Triticum aestivum
  Clone ID: PAT_TA_73770.pep
STLTLSIMSKSEACVYQLASYSFGAESQCTPFLLSIDRSTYLVMHVLVPFPTLCVIISSIWCDPKDDLKVISF

SEQ ID NO: 179353 - protein, 85 aa, Triticum aestivum
  Clone ID: PAT_TA_73771.pep
FGTRDVGGGAASYTVSITQPAGVTVIVDPSTVSFDGKSPDEEKHFKVTFQVYDPVKAANYVFGGIEWSDGKHHVWSPIVATTKCG

SEQ ID NO: 179354 - protein, 199 aa, Triticum aestivum
  Clone ID: PAT_TA_73772.pep
RHELDRHISGRPARGVRPWIPRDRSHCADRGFFPDDLQKQKTALANRLGLRPRQVEVWFQNRRARTKLKQTEVDCEYMKRWCEQLAEQNKRLEKEVAELRALKTAPAAHAQQAATLTMCPSCRRVAATAAGPAATQHQHQHQQPQQCSPKPNAHPAGNVLPSHCQFFPSTTTAAAPDRSGRQQGAWNGAAQPLVTRELF

SEQ ID NO: 179355 - protein, 232 aa, Triticum aestivum
  Clone ID: PAT_TA_73773.pep
SARGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSG

SEQ ID NO: 179356 - protein, 117 aa, Triticum aestivum
  Clone ID: PAT_TA_73774.pep
LSYQACTDINFAYPKKIHCILSRGGGGGQIKFFVGGNHNSRKGIGREKICLLTSWSTCCLPVYIVSQFGWLAALFFERSSSALCCCSMCQDQRPKSYSLVHPTVNKSGYSFCMKCQT

SEQ ID NO: 179357 - protein, 184 aa, Triticum aestivum
  Clone ID: PAT_TA_73775.pep
MELLPSIAVFLLLSCSLAAAMVPAGTIERVSKQQILVGIPPGGHAGPPVLFLTSPSGKYAAYFVRTHTAPGAGGLGADFCYVEVMAGGGKAAEGGEGGGAAGGASAWESECRPVSTVNTCTLLFSWHGLEVFDGSEEVWHGETNTDGTNFLQTLELVDDGDMRVRDKDGELAWRASDEPRHAQH

SEQ ID NO: 179358 - protein, 110 aa, Triticum aestivum
  Clone ID: PAT_TA_73776.pep
MSVAAGVALAVADAVWAQIKAAGHATDEHLSILDHLFGKNMLRACKILDEGGVRRVTGAPSGRSLFLVMGESKRKEEYICFPEHLCTCYSFFYDIVGRGEQLCCKHQLAA

SEQ ID NO: 179359 - protein, 198 aa, Triticum aestivum
  Clone ID: PAT_TA_73777.pep
MVKNFRKRSLESDAADNSDDEDTRRVALEEIRYMQKLRERKLPAASVATGAAASATTDGSTARGRGGSGAGAAGEEDLVLQDTFAQETAVTIEDPNMLRYVENELLKKRGKTIEVNDKDDKDEVDELYVVPDHLKARKKNMEESSTQWTTGIAEVQLPIEYKLRNIEETEAAKKLLQERRLAGKTKSDANIPSSYSAD

SEQ ID NO: 179360 - protein, 44 aa, Triticum aestivum
  Clone ID: PAT_TA_73778.pep
TVGPRLLTTHLFMLAEAAKQSFQNRITLLLHVCNSYIKSSHQNS

SEQ ID NO: 179361 - protein, 103 aa, Triticum aestivum
  Clone ID: PAT_TA_73779.pep
RHEHDQEVFEAIKGEFVGGELQIKLVFLDTALFDGFCEYHGEMDRVCTMHANCCLRLATKLHDLRNVVADWKRYSSLTPPEKMSSKLRWTYPAKCAATMKIPA

SEQ ID NO: 179362 - protein, 183 aa, Triticum aestivum
  Clone ID: PAT_TA_73780.pep
MADAGAAKPEPEKKSSSAPIEPAVEAQAKQIEALSLSVPDDDGGGPEGPPLLDDSDDSQIQAVTSGGTVYESATTFEDVKLTPELLKGLHDEMGFSRPSKIQAITLPMILTPPHRDLVAQAHNGSGKTTCFVLGMLSRVDPNRKVPQAICICPTRELAQQNKSVLMRMGKFTGITCACAIPSS

SEQ ID NO: 179363 - protein, 139 aa, Triticum aestivum
  Clone ID: PAT_TA_73781.pep
FGTSSFGPYASAKPVTYYALCPDIDMLTSAATDFFMQLGTIYEVCKLGTHSPQHSGGQIEQSPGKYQPSGLVLVECPDQLKSSGSHSVSISSVTEYFQALSKSWSVKSFLSSLARIIKEIKLNLNISTNQKESSNIPCT

SEQ ID NO: 179364 - protein, 106 aa, Triticum aestivum
  unsure (1)..(106): unsure at all Xaa locations
  Clone ID: PAT_TA_73782.pep
PSFIFFDLRSPVWRILWXLRLPSKVKIFLLDALHGIMPLKSILANRHIGTEGHCPICNLGAEDVKHLLFECTPAVELWKLHVDTIIFDVMHLMLLFQKKKKKKKKK

SEQ ID NO: 179365 - protein, 96 aa, Triticum aestivum
  Clone ID: PAT_TA_73783.pep
RLRRRFSRLRPHSPVCAVEPGLLTSFLMVARRESPLLAVTQPCLVPYKGRRRRMLSPSVPNAAELRHDVHLVVVKSRNLLFLLRQSSSRCSALLNS

SEQ ID NO: 179366 - protein, 214 aa, Triticum aestivum; identical to SEQ ID NO: 158836
  Clone ID: PAT_TA_73784.pep

SEQ ID NO: 179367 - protein, 144 aa, Triticum aestivum
  Clone ID: PAT_TA_73785.pep
SRWRRPRGRPARGGCRAPSASPAPPSGPPSPPRAAARSRSRPPPPPPQPEPGPGPAPVPLPPQPGPPPVSLPLPPGPGPEPELEPEPGAGPVPAAAAAPAHPGREAAEPGGRPDGWPAGAGRRRRARATPKSSALRGRLEELVP

SEQ ID NO: 179368 - protein, 95 aa, Triticum aestivum
  unsure (1)..(95): unsure at all Xaa locations
  Clone ID: PAT_TA_73786.pep
MGLQNELGALYNSAHTVGFAHCGTFTGRIQTAAVDPTMDPGYASQLLAACPXAGVDPNVALEIDPVTPHAFDNQYFINLQKGMGLLTSDQVLYAD

SEQ ID NO: 179369 - protein, 130 aa, Triticum aestivum
  unsure (1)..(130): unsure at all Xaa locations
  Clone ID: PAT_TA_73787.pep
SELLCADGCCMIDLRMGVYGYPIEIQSLFFMALRCALLMLKHDAEGKDXVERIATRLHALSYHMRSYFWLDFQQLNDIYRYKTEEYSHTAVNKFNVIPDSIPDWLFDFMPCEGGFFVGNVSPARILRILV

SEQ ID NO: 179370 - protein, 69 aa, Triticum aestivum
  Clone ID: PAT_TA_73788.pep
ARGKAEGTCCSSNSTSCTCDCNTIAQERCSSLTDNYTDCQACTNSIFNQCNTTCNDDCNNNCKKKGCHA

SEQ ID NO: 179371 - protein, 69 aa, Triticum aestivum
  Clone ID: PAT_TA_73789.pep
SRPGKTHIMMLNKIMRCKRSWSCSDQFNKIMGETKDFYIAGEEFSCSQTEMASYIYIWYANFGRPGLFQ

SEQ ID NO: 179372 - protein, 129 aa, Triticum aestivum
  Clone ID: PAT_TA_73790.pep
ISTYALFKRVKETAPAPAPAPVHHLPTDGSIIPKNCSRPISSLSAGRAHRLSQSEVLGSGAYAAEGSPAGAAGASAGELMHFTGWLSFFLLVKYRLPLRPQTKKTYYEYTGLWHTPFVLERTFSTFLVP

SEQ ID NO: 179373 - protein, 166 aa, Triticum aestivum
  Clone ID: PAT_TA_73791.pep
MDPTAPQRGTKRPLPATAAGDEDDDRSALGDRKVRFPKGKKAKYRDPAAAGSSGEGGAAAEDIDELMNPELAAVKRARRRHRREGDDAQGTANVKGFEMRYKDDANFIDDGIEIEPFNLEQEREEGYFDENGNFVEFARGNDMKDAWLDNVEVDTKFAGKVQKKKD

SEQ ID NO: 179374 - protein, 112 aa, Triticum aestivum
  Clone ID: PAT_TA_73792.pep
GTSIPVMYQRVPCVKKGGVRFKIAGHDYFNLVNVFNVAADGSIKSMDVKSSDSDTWAPMTRNWGANWQSLANLTGKMLSFRLTSTDGRTLVFNNIVPAGWTFGQTFASKLQF

SEQ ID NO: 179375 - protein, 93 aa, Triticum aestivum
  Clone ID: PAT_TA_73793.pep
QKQIRFKGKECQDSFTHITPKRLASLACCVVLLTDRTLTTVMNILPLTTVLLLPLLVSSSFAIASFPMHVYNTHSHTCHIQFCQSPDHERSVR

SEQ ID NO: 179376 - protein, 131 aa, Triticum aestivum
  Clone ID: PAT_TA_73794.pep
IRHEKIRAAKEKEKELKERLKNEMDKSMFLRKGEEIKSLISQIKELNEDKEAAVDDEKLGDLLRTKPVRKDKGVAYWKFDGYYKKTSIMRQEFDTTGNNDKWFVFTEEEEKVIGDHLAPRSQLQCKSHTQA

SEQ ID NO: 179377 - protein, 202 aa, Triticum aestivum
  Clone ID: PAT_TA_73795.pep
GTRLTASSDELTPMTIEPLIAVPVGVDIMENGLPEYGTQYSDDTTQNSMHKVAKLENQSSPQNNNHHTELVLVRPTPKFRGGKAKRGLRKQLNVADICDRLASAAARQEILFCEEVKKQATAEIDALYDEIRPAIEEHERDSQDNVSTSLAEQWIEASCCKYKAEFDLSAAIIKNLASTPLRAKEDVNPREQNGVLYLQNGP

SEQ ID NO: 179378 - protein, 53 aa, Triticum aestivum
  Clone ID: PAT_TA_73796.pep
GGGGSSPPRAEPPASSPLPVTGYHLLLLRHVRAALAPSNCCEILHQAFAALVN

SEQ ID NO: 179379 - protein, 154 aa, Triticum aestivum
  Clone ID: PAT_TA_73797.pep
TSHRDEAADVLEREQGGWQTVSKGRCSPPPAAFGRPSINVRRSPPTWLRDRCFRCLRRGHRAYSCRDPIRCTDCLRSGHIARFCRAKKPVHQASPLQCHAPSAASTGDVSMIDVQIPSISAEHVGLVEETKMLRTELHDCLARAGSVLGRAEAA

SEQ ID NO: 179380 - protein, 60 aa, Triticum aestivum
  Clone ID: PAT_TA_73798.pep
LNVSDPEVESSSLSHPKTPQSGDENALLTTWVVMQTSDLQMPRATLNFVRSFPSPFCSWI

SEQ ID NO: 179381 - protein, 94 aa, Triticum aestivum
  Clone ID: PAT_TA_73799.pep
MSLALVPAPADATHVTETDALEQSGWESLWERVVELVVWKDVAKSALWFGLGSMFFLSFSFSREITFSPISVFCQLGVIILGLAFFKDSVPQRQ

SEQ ID NO: 179382 - protein, 136 aa, Triticum aestivum
  Clone ID: PAT_TA_73800.pep
HASTRRRRWLRTHASQPASTLVATAASLPARGCDGCCARTQGRGTPARGDGGGCGCARKPAGQQAGRGCTHARGDGGQHAAAAAAAHARKAAARQHGRGGSSRRGCAAVSSPDQRRSGATPGRRHGEEDGVHLVPN

SEQ ID NO: 179383 - protein, 115 aa, Triticum aestivum
  Clone ID: PAT_TA_73801.pep
KSHSDASCQEEPCSGIRCQPHEVLWFSSGPVLRLFRDVVFPQVSGCEVISMEVYFSCLSGAQLPSWRPLDRATSDAKQSNPAGRSQAVVHESSCLQTSRTHVGYLTCLGLATLHM

SEQ ID NO: 179384 - protein, 151 aa, Triticum aestivum
  Clone ID: PAT_TA_73802.pep
TSSSSRLHAPYPTTPEEATCHGCSTRRPGGSAPPRPASSSPAPRSSPRPRASPTPTSSPSAPRPPSAARSSRTSSPASAQPWPDPEPEQTPTPSQISPKPSHTSVAPRHHPDRALRAFSNHKRRSSTIGAKGIGLFVCFFAHWNFFSKGDD

SEQ ID NO: 179385 - protein, 82 aa, Triticum aestivum
  Clone ID: PAT_TA_73803.pep
LPRSSDLGQSEAKGKQHLQALPFQKKWSSWSVQPMQEHLVRIRGGESESAPGTEDLLIHGTQGGGWIGCFASSECCCLASCR

SEQ ID NO: 179386 - protein, 49 aa, Triticum aestivum
  Clone ID: PAT_TA_73804.pep
ETLLPTFNVFYCILRCNRFVMENLVKHLAELVMNYLIYIAHVKKKKKKK

SEQ ID NO: 179387 - protein, 84 aa, Triticum aestivum
  Clone ID: PAT_TA_73805.pep
GTRDFEEGPYMTPGSPSGVLVPPMDEDATSPLPGWTIMSHSKVVKYIDAGHFRVPHGSRAVELVAGVEVALVQEVATVPGRSYR

SEQ ID NO: 179388 - protein, 128 aa, Triticum aestivum
  Clone ID: PAT_TA_73806.pep
MEASGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLL

SEQ ID NO: 179389 - protein, 250 aa, Triticum aestivum
  Clone ID: PAT_TA_73807.pep
GTRDSLLLNVCPTHFIEVPPSKTISNIGGLHRMLGLPDHILVAAAGESTECLPSSDATNKFGASFETPAGRKLVKPSDYMELISCLQPNLWASLADEVPAWVNEKRNKTSVERTLRWLDACIALDAASGRNSLGVVVGGSSIEQRKLCATEVSKRNVSGFWIGGFGLGESVEERCSLLNAVTDCLPLGKPRIVSRLGLPEEVLEGVVDGCTCFTCQNHTRAYLNHLINVHEMLAQILLEIHNTHHYLRFF

SEQ ID NO: 179390 - protein, 167 aa, Triticum aestivum
  unsure (1)..(167): unsure at all Xaa locations
  Clone ID: PAT_TA_73808.pep
TGKRSCLPDHPACNQAVGSNLHGEATPSGANAAASFGLGAREDGPQPRRGADSSARPLRPRTQPPRPALVRPAAMCPWPRTPRPALVRPAALRPWPRPLRPPTRAAPRPDPGRCVEPCGPASARPRALLHAPRPPXPCPWPPPSNRRRRRVGCGDRAGVVRASARAE

SEQ ID NO: 179391 - protein, 108 aa, Triticum aestivum
  Clone ID: PAT_TA_73809.pep
GTRFSYFFCQKKNFFTFASSFSSFVSACTTMDLQSSELASFNMKRGEDTKEAEEPVMVIGAAAEQTSTVAPPDPSAMTSVSIFLDQSEIGGNNDARLFLSYCLWHKVA

SEQ ID NO: 179392 - protein, 120 aa, Triticum aestivum
  Clone ID: PAT_TA_73810.pep
RHEHLQPTYPSLFSQPDPLSRRAHRPPAAACPTTTRLLSSSRRTPPPSPTPPSATSLPCGRPAKPPPAPNLLAPGRIAACAQPPDPRPRRHLRPVSWPPAAACVHPPGHRPRCPRPTSWI

SEQ ID NO: 179393 - protein, 175 aa, Triticum aestivum
  Clone ID: PAT_TA_73811.pep
MVSDAPAFRTTVVLAAVLAVLVLAPPSLACEEGAPAPAPALAPAPAPAPVMLCGDCESRCQARSTCEAYVAAAGCGNECDTSYTPECEPCKSRAMQSCTTGCNSYCLTNCQGSQCDNCATSCGGHCTQEAVNACRSRCTYSYYQVKSCKECQSDAARRCIYACNTQCKANCVVSG

SEQ ID NO: 179394 - protein, 82 aa, Triticum aestivum
  Clone ID: PAT_TA_73812.pep
QTCTRPDNTIHIWMTTQRVDPNKNVRPRRRLHMDEVMTHFFSYRSFSILKLVSRNHISGLLNTCNNIKRETLEKEDATIQEL

SEQ ID NO: 179395 - protein, 128 aa, Triticum aestivum
  unsure (1)..(128): unsure at all Xaa locations
  Clone ID: PAT_TA_73813.pep
ESARAHALVVPVLVKKMFRVSDMATEFAVSALWRLCRGADAGAGACCAEALRVGAFQKLLLLLQVGCGGVTKDRASELLKLLNGFRGSVECIETVDFXGALRGHFDRRRCWIFWRLLSPLFRLFWELD

SEQ ID NO: 179396 - protein, 138 aa, Triticum aestivum
  Clone ID: PAT_TA_73814.pep
ARRRRCCARRPPCAGDAAAATGAVTVVTGTCSYRDKLLHSRSRRETKETTTATAAPAAGKGGDRRNTPGRASRSGASLIPGGATGFLTRQRRKGRRSCGSSFADRTVPVQPAQIWAGAPGPISRPHKNRRFHFEGWRG

SEQ ID NO: 179397 - protein, 113 aa, Triticum aestivum
  Clone ID: PAT_TA_73815.pep
PATPQSAGRGRRSSTAREKKLCWQLPRSSILIWIEVGQRQLSGSGHTGPREWSKGWRRSVALHRPVPPRTTRCRPNCKSSPHQTDDLHANTEPHNRQSGRHACRVCTAGDMLQ

SEQ ID NO: 179398 - protein, 61 aa, Triticum aestivum
  Clone ID: PAT_TA_73816.pep
MFNYLNPSEFHCTFAEPWERARERHAQLVELAPAASERRSRAGELSSSSPSGDGDFGRLRR

SEQ ID NO: 179399 - protein, 167 aa, Triticum aestivum
  unsure (1)..(167): unsure at all Xaa locations
  Clone ID: PAT_TA_73817.pep
GRDWELRIRATCLTFPKPVLVTKIGPWGGHGGKEFDIRESVPQHLESVTIRSGVAIDSIVFSYIHQAGKKQTLGPWGGDGELTDTITFAPLEIVKEVSGTSGTFGGDTVVTSLTFVTNVRTYGPFGKPNGTAFSVPLTDTNIVGFXVRAGRLVNAIGVYACPSVQNY

SEQ ID NO: 179400 - protein, 177 aa, Triticum aestivum
  Clone ID: PAT_TA_73818.pep
SMRHCFFPYAQHHMLKIMAVVWLFLGCSVSIMLCQRTRLPWKRLDTSNAWLRLKVRDYNYSNMKRLDEENQSLKHELGVAKYNKQKTKPKTRSIKNKLMMARYKNKKNAMGWFVLTRYMHGLSDHICNVIALNRSSGKEPMDPLMNEPLNNIEKLAERLKRGVLKSEKQLKSIKRGF

SEQ ID NO: 179401 - protein, 107 aa, Triticum aestivum
  Clone ID: PAT_TA_73819.pep
GSPNIVEKGCSIEGICVCPKDSHCAPEKGYFCPPGTMFSEARVCSTRAAFRRRKRRPSRRTLIRSACMHACAGSSGCASKFRLRCLTLMMLVCGVFASSQRLYRLYL

SEQ ID NO: 179402 - protein, 50 aa, Triticum aestivum
  Clone ID: PAT_TA_73820.pep
FINIYICMYVCMYVCMYNVCMYVCMYACMYIRLTLGVGLDITFSVSYVMI

SEQ ID NO: 179403 - protein, 172 aa, Triticum aestivum
  unsure (1)..(172): unsure at all Xaa locations
  Clone ID: PAT_TA_73821.pep
QQFRKDFKLFLELRAKEXVSGGRMXISLVGTRSDVIASEFSLFPGILAQILSVMVAEGVIDKAKFDSFYVPLHGPSIEEVREIIKEEGSFSIKEMRVHDPTAEMNIALSSPSKFVNNLIALFEPIIVQHFGEVMDEFVRAAELHWSLDVDGSLRQERARTSRAMLVVSLAKA

SEQ ID NO: 179404 - protein, 35 aa, Triticum aestivum
  Clone ID: PAT_TA_73822.pep
TGRRAVTGAPSATDDSSSSMTALASSDHGARLDRS

SEQ ID NO: 179405 - protein, 114 aa, Triticum aestivum
  Clone ID: PAT_TA_73823.pep
MEKVAVAAAKTAHPPPSPGKPTTLLDVHEVEWITRELERLLVRETVGAGARADARRRRKRAEAGVSSSPEAHAKKGGFLAELLGKHAASICGDGAVVSGRRRRGRSGFREVDKV

SEQ ID NO: 179406 - protein, 122 aa, Triticum aestivum
  Clone ID: PAT_TA_73824.pep
LITSTLSLFFAWFDQNHSMFLGESRVRKNETSLFLGLVTKGSLNFTKTHFSFLPYTNIALFTLFFFDERPDRVFSNPNTYLCRPLKSYHTVPRRLQISVDKNGIFFFSTEGGLLQAFDSEVQ

SEQ ID NO: 179407 - protein, 121 aa, Triticum aestivum
  Clone ID: PAT_TA_73825.pep
RHEGLHLAASQLTILSVLALLAVAATAQAPGAAPAAAPQAPPPPPATPPPAMAPPTPAPVSPPPTAAPAPAPTVAPTPSATAPAPADSPMSSPPAPTPDMSPSPTAETATPGSGAAGLSPA

SEQ ID NO: 179408 - protein, 175 aa, Triticum aestivum
  Clone ID: PAT_TA_73826.pep
GTRRSSRPLPCTTHRRHLWRPMSPNSGTIRWCPAHPRLPLAMLFIIHRIDLIYPVSCGRRHHFHFLGFWWWGGPHRLSPARPRGGGDSTCEMLLPDKVVAGSPSFHRRIRSSPTRPLPDPLLSDSNAYKSARPRQQQPTSKWPILSPSPPPMRIQDDDYHDFADLRSLLLDAIRA

SEQ ID NO: 179409 - protein, 120 aa, Triticum aestivum
  Clone ID: PAT_TA_73827.pep
RSPWPSPRGTPASSRPSSRSPSRTPSSSSPSPSSASTLSPLPSCSAWTRGRGTPTPATPRTTRSGSAARCSPSSTSRTWPASSPRRSRPSSPPPSRTPASGPSTGPAAPPSSLPWPSWPL

SEQ ID NO: 179410 - protein, 120 aa, Triticum aestivum
  Clone ID: PAT_TA_73828.pep
MATTTSYDNADVRHRALGVHAASRKIGKPAPSSSQAQQQNRKPVIIYMVSPKVIHVEAHEFMSLVQRLTGPEVAGEDGRERASTSSSSPRTATDRGREGGPACARQGPRPQPPAPRCPSR

SEQ ID NO: 179411 - protein, 164 aa, Triticum aestivum
  Clone ID: PAT_TA_73829.pep
MIRVHDALANLLLVLPKNIFPLLVQSFAQIVDELSPKGGASLSARFEKTLHDLRRSIRSGLQVLKDMILDYTSDVVPQGGGIHEITKYLLKYIMSLLDNGTSLKIILVGDEQDGKVAMRTLQDNVATLISHLEIMLEKESHRYQDAGLKTMFMVNNVNFVLHQV

SEQ ID NO: 179412 - protein, 152 aa, Triticum aestivum
  Clone ID: PAT_TA_73830.pep
LDVLLQLFTKKPFQNRSLEISSIDFPTTYGKIRFNIWVSLGEQQPDDLPEQFYSQPHCTIVMLHVTTQMSYKNIPLWHQNNVNADPHTPTVLVANKLYLAAHIIVKMKHITYHRKRNLRFFEVSSIANYNWEKPFLALLQTLVNDNELVLTR

SEQ ID NO: 179413 - protein, 177 aa, Triticum aestivum
  unsure (1)..(177): unsure at all Xaa locations
  Clone ID: PAT_TA_73831.pep
MRLYITAAAADDDATKPKAPQQLQAARRGYRSVVVTGLLAGVLLFRAALLAIETGASLCPSATGCSDWSAGLGRWLYGGGGDATEEFMKEWKRSHRVATLLDPVVVEAAPDSLDXXMVEMDTILASYDRLDMEAVVVKIMAMLLKMDRKLKSSRIRTLFNRHLASLGIPKSMHCLAL

SEQ ID NO: 179414 - protein, 82 aa, Triticum aestivum
  Clone ID: PAT_TA_73832.pep
SHGLAKPHGRASRTARWNYRENLPEPRRRLTSFVPAVVFGNGAEEDGGGGHQGGWWEGARRQWGSRHGHGMRQGAWGGALVP

SEQ ID NO: 179415 - protein, 220 aa, Triticum aestivum
  Clone ID: PAT_TA_73833.pep
FSLIFFLLLSASIAVAVAVAVAVDESTDDMLIRQVVPEEEVPVDQLLNAEHHFTLFKSKFGKKYATAEEHDYRLSVFKSNLRRAKRHQALDPTAEHGVTKFSDLTPKEFRNTYLGLKNPLKYPSDANKAPILPTSDLPEDFDWRDHGAVTAVKDQGSCGSCWSFSTTGALEGSHFLQTGELVALSEQQLVDCDHECDPAEKNSCDAGCNGGLMTNAYEYI

SEQ ID NO: 179416 - protein, 197 aa, Triticum aestivum
  unsure (1)..(197): unsure at all Xaa locations
  Clone ID: PAT_TA_73834.pep
RHEAHLHPLPTSSPSSSSPAPHLLPVSSAFTAPSSSPSSSAPNLRRQPQRLMAGPAAAGGGKGAAGGGIKVGGSGGPAFVGQVFTMLDPSGNGLMAVTKRFDLPHFIADRTPTWFKRILSPLKKSDNDPVFRFFMDLNDSVSYVKRLNVPSGXVGACRLDVAYEHFKEKPHMFQFVPNEKQVKAANKLLKSIPQRGK

SEQ ID NO: 179417 - protein, 201 aa, Triticum aestivum
  Clone ID: PAT_TA_73835.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVS

SEQ ID NO: 179418 - protein, 223 aa, Triticum aestivum
  Clone ID: PAT_TA_73836.pep
EVCCCAKAAGAPAFPPFPWAHAPSPPAPPRCAITEIDESREVESEDNLSPRSVLTPWRRPTPASALSPSPPLVVGGKRAFDPSSEKTSLMICNIPNGFVKRRFMAILDQHCVQENDNPGWRVVGGGKFVRSEYDFLYIPIDFRTKYNKGYAFVNMTTATAARRLHTFLHGHRWALAGSRKVCEVVHADIQGVDALSAHFSCSKFPCGNKEFLPVRFGPPRDGL

SEQ ID NO: 179419 - protein, 72 aa, Triticum aestivum
  Clone ID: PAT_TA_73837.pep
MNIVDDLYAKFMLSGNNYMNMVKPCWKPSVDGDVRKTGDQSGRTDGLLWYKDLGSHVSGEFSMAVIQANNLL

SEQ ID NO: 179420 - protein, 187 aa, Triticum aestivum
  Clone ID: PAT_TA_73838.pep
ARGSYAHVTRQELREIARGVLASGARFLWVMRPGIVSSDDPDPLPEGFAAASAGRGLVVPWCCQVEVLSHAAVGGFLTHCGWNSVLESVWAGVPMLCFPLLTDQITNRRLVVREWRVGVTIGDRGAVCADEVKARIERVMSGKEGEELREAVKNVRTTLEAAAAHGGSSQRSFDEFVDELTRRCGGC

SEQ ID NO: 179421 - protein, 62 aa, Triticum aestivum
  Clone ID: PAT_TA_73839.pep
QNYDARNVLFHCAPSFRQYIQGKVTKTKNTTDIHEMSKIKLVMNLAGTFRRWIYEHSSEQTR

SEQ ID NO: 179422 - protein, 180 aa, Triticum aestivum
  unsure (1)..(180): unsure at all Xaa locations
  Clone ID: PAT_TA_73840.pep
VAWPRAGRRTSSSRGTPAPPPRRPRATSSPPAASSPALAPLPSTTTRRRRTGSRSGRRRRRSRPSPATPRTSRTRTTTSPRRQRSCRIYLSLFRXARRRDPLRPRRRRRRLLALAATKEEPPSAARSPVSPRSHRLVXRRPPRLRSTRTSCPARVGVDRWISGAAQERLLALACRSCVAW

SEQ ID NO: 179423 - protein, 224 aa, Triticum aestivum
  Clone ID: PAT_TA_73841.pep
MDAIKKKMQAMKLEKDNAQDKADTCEGQAKDANLRADKVNEEVRDLGKKLVQVEGDLVNAKNQLETANQDLEEKEKTLTATESEVATLNRKVQQIEEDLEKSEERSGSASQKLLEATQSADENNRMCKVLENRSQQDEERMDQLTNQLKEARLLAEDADGKSDEVSRKLAFVEDELEVAEDRVKSGEAKIMELEEELKVVGNSLKSLEVSERKANQRVEEFKRE

SEQ ID NO: 179424 - protein, 241 aa, Triticum aestivum
  Clone ID: PAT_TA_73842.pep
RHEENQERGEETKQANLGLSPRISCDLAADSPNPMPRASGSVARPAAAATSASSDAGHSEPSCSTPAYQKVFRPVTRSMTRIPPAVAATPDAKKRVDSTSSNRSTPDACFSIQLAAARPTATRARTPQEVTKSAWRPLTQPAVLSEDLKRASTPATNPTAKRSRVTNSQAAKDSASKVNQNVRSGKKNRNEECASQGDQSDGAVIPSPPKKLQSGKGSSNLVSKRKSTIRSKGAKLAAPLL

SEQ ID NO: 179425 - protein, 63 aa, Triticum aestivum
  Clone ID: PAT_TA_73843.pep
FSCKLLGFLDMHKPCSYRCHPVNIYTGSVYFISLFFPIIDNTTMFVKWAAICSITIKSYGATR

SEQ ID NO: 179426 - protein, 80 aa, Triticum aestivum
  Clone ID: PAT_TA_73844.pep
RRLLKIVLVGLCSNEETYALQVPYDITRPQGLVYDLSSFLRVLFSRCKTSLLLFAWNFLLESIICFYTIVFHLDIFSFKS

SEQ ID NO: 179427 - protein, 108 aa, Triticum aestivum
  Clone ID: PAT_TA_73845.pep
RHEAHVNAAELHGPERRHRRNSARAAVLRGGQLHLGSPADATNVAPGSANQVYARTATLPSGLKPHLEKQSSRQSEGPRSGDTGGVNSDTDNPAMSSSSSQTTSAGHP

SEQ ID NO: 179428 - protein, 239 aa, Triticum aestivum
  Clone ID: PAT_TA_73846.pep
RHEGRSGQGTPLEPSRKGLERSLAFKRWARGRCFRCLARGHQVNACREPFRCIRCRRSGHRERFCRASSPVACNRSSVTRAPLQRSRSSSVQPCPSLTRSWAEVVGHTSSCVSVPPRSQYGCCKDSNVNASLVSALESQLALLRTELLQEVELLRAELRDALAKLEVASVVPLLPELQVGSIVEDAEGFFGDFSPCALHVTPLVRGSAVITEVVAPVLQIMPELHELCGESSIVLPLEL

SEQ ID NO: 179429 - protein, 180 aa, Triticum aestivum
  unsure (1)..(180): unsure at all Xaa locations
  Clone ID: PAT_TA_73847.pep
FGTREAVRTEPAAPASEGKADGEEWVTVFGFSLRDTNLVLREFEKCGVIXRHHSGPREGNWIHILYQHSYDARKALQKNGIQLCSGVIIGVKHIDPVHRQQLDDRLAGINQGGFMVSLPSKSLVLKSNTGASNQLGALPRPYDPKSSTNVIRDAGRRTTGSVAAPAKSIVTNVMDLIFGI

SEQ ID NO: 179430 - protein, 141 aa, Triticum aestivum
  Clone ID: PAT_TA_73848.pep
GFCPTQEERRRRLPEDEIKVFPPSPRSGGASSVDGGRVKVCFRRIYLWWICSDLVIWLDPADLRYSSSAAVAVLVGWFYGAFARRLPDCLLQQVVPGSGDGGAMTAACLRLASLIVVVARWSTDLDVMFIISGIRCTVMID

SEQ ID NO: 179431 - protein, 209 aa, Triticum aestivum
  Clone ID: PAT_TA_73849.pep
MNRMRRIAGMGKSKKAPSAVQKDKDESIVFFRELYKHEEDTDVNLLEPIYSVEFDAIQGGHMSKPPSGKRDLLMPIIEKHDYDWPKTPPVAPMFPSLKMEASSSETVVAPKVTHIPITQPVKPSASRFIGKTEATKTSAKTPAGSSSSNSAKSQPCTTDRRPASAYATLPNRQQKPDAKANTGTSSNSGKEHSHTYYANASQDSSSSSA

SEQ ID NO: 179432 - protein, 168 aa, Triticum aestivum
  Clone ID: PAT_TA_73850.pep
MRAKCANCERILQFYCPHKQVCTVAPLYLLETKVLSVTEESELTWILKNTAEEREALCNYKAKEEQQQAEQEEDEQEEDEQEEASSDSSSDSDFLKEEEEENFLENVPSLELPDNFATKDTKEEQKEEEYFLEQQHLSDTESSDDFYPNPDWNIEEKPSRQNKRSRRA

SEQ ID NO: 179433 - protein, 65 aa, Triticum aestivum
  Clone ID: PAT_TA_73851.pep
FFFFFFFFFFLGICSSITQCIRPDRYKGLKPFSRDESYESYIYIFSNVSYILSIIHPPTTNQMIK

SEQ ID NO: 179434 - protein, 117 aa, Triticum aestivum
  Clone ID: PAT_TA_73852.pep
MVSEGVIGKEKFDSFYGLLYEPSSEELREIIQEGASFSIREMRAHDPRTDMNNALSTPGRFAGFLRALFEPVLVQHFGDAMDEFVRTAERRWILEGSLQEERVRCPYAMLVVSLTKA

SEQ ID NO: 179435 - protein, 149 aa, Triticum aestivum
  Clone ID: PAT_TA_73853.pep
MATITCHLPPLLPGPASGHHRHLKPSPPPFNRHLRAPPPTRLLRAARRRHPDAVVVVPDARPWVGDLSGAASYWDGREEDGDEEEDADDDDRSLDLLARFLHSVFRKASRRARRAARSVLPPSVPAELVKFSVNGVLVLTFLWILKGLL

SEQ ID NO: 179436 - protein, 194 aa, Triticum aestivum
  Clone ID: PAT_TA_73854.pep
RHEAQVQPDLSFLDTGQPQGMPWPPLSRMPLVASGDRVPSQRTREYQAIHHHHQASMGVLPASKYLIILTFIWTTLAFLNLWRVNVDPGAGAGGVHGQCPQRKARLGPGQAGLSPRRLPNTVPCTTVNKVCSSGTKGIHISSLHLQCLHSYLSPLLKNLCCCLLACSLLSEVYIFCLSLIRYLKNFMKVILVCV

SEQ ID NO: 179437 - protein, 164 aa, Triticum aestivum
  Clone ID: PAT_TA_73855.pep
MGSKGILKNSGSSRMPPHGPSKPPTAPTSAPQVVFGRRTESGRFISYSRDDLDSEISSVDFQDYHVHIPMTPDNQPMEEDGTKADEQYVSSSLFTGGFNSVTRAHVMDKQGPDSDIGRSGPKGSICMVEGCDSKIMRNGRGEDILPCECDFKICVDCFTDAVKA

SEQ ID NO: 179438 - protein, 61 aa, Triticum aestivum
  Clone ID: PAT_TA_73856.pep
RILSASYFTHRGKTLLRAFLSIKFSRWLQFNWRIKLFTLQRKLYNILFKIMLLTTLVIQIT

SEQ ID NO: 179439 - protein, 195 aa, Triticum aestivum
  Clone ID: PAT_TA_73857.pep
MDTACGSKPPQSKKVCIIGAGMAGLAAARELRREGHDVTVLEQSGDVGGQWLYDPRTDADDALGVAAPVKVHSSIYASLRLISPRQTTGFTDFPFCPKSGRDDRRFPGHREVHLYLKDFCDAFGLMEAVRLNTRVLHAAMTPACKWAVRSMDLGIGECDGADGKELDAYVDEVFDAVVVASGHYSQPRLPSIKGM

SEQ ID NO: 179440 - protein, 132 aa, Triticum aestivum
  Clone ID: PAT_TA_73858.pep
MASPRAGHRQLMGASSSPAPSGDGEATAGRGSSQEAMKIMVSVLVVVIFCTLFYCIYCWRWRKRNAVRRSLLQSLRPMSSSDLPLMDLASIHAATDNFSKANKLGEGGFGPVYRVRGLLNSCNLVVSLLASP

SEQ ID NO: 179441 - protein, 135 aa, Triticum aestivum
  unsure (1)..(135): unsure at all Xaa locations
  Clone ID: PAT_TA_73859.pep
RHEASAEAEYRAVAHAVAEAVWLRQLLGELHQAPTRATVVYCDNVSAMYMSTNPVQHQRTKHVEIDLHFVRERVSLGEXRVLHVPTSSQFADVFTKGLPTSIFLDFRSNLNIREPHVSAAGGCWKSTTRPDGQRP

SEQ ID NO: 179442 - protein, 181 aa, Triticum aestivum
  Clone ID: PAT_TA_73860.pep
MEAAAASALTKEVVLKLVALLSEKHKLSKGLKDDLRFIRTELDMISTARDSHHIISSRRPQAVVSMDEMRDLAHDIEDCIDRFLPCVACEGEAAAASSVLRRVKTAVTSTTRSPRFAAEIRKLRVRLRDAHERRANYERPGRRRALLCPLPPEWPLLPRPPPTATSWASTSRGRSSWSSCW

SEQ ID NO: 179443 - protein, 175 aa, Triticum aestivum
  Clone ID: PAT_TA_73861.pep
MAAKEPMRVLVTGAAGQIGYALVPMIARGVMLGADQPVILHMLDIEFAAEALKGVKMELIDAAFPLLKGVVATTDVVEACTGVNVAVMVGGFPMKEGMERKDVMTKNVSIYKAQASALEAHAAPNCKVLVVANPANTNALILKEFAPSIPEKNISCLTRLDHNRALGQISERLGV

SEQ ID NO: 179444 - protein, 152 aa, Triticum aestivum
  unsure (1)..(152): unsure at all Xaa locations
  Clone ID: PAT_TA_73862.pep
VTNQEETRGVMYQEVARTRLPDVAGVRTTTRAQVREEEGEGVASRTILDRKIRGTSTGSPWLMILGRACNLSLAAYYPSMVPSPGFQSHCAKRRHLIKAGVGISTTAQVREEEXGRGGFQNHSGSQDQRNFYRKSMVDDPWQGLQPIVGNIL

SEQ ID NO: 179445 - protein, 230 aa, Triticum aestivum
  Clone ID: PAT_TA_73863.pep
GTRRRFGRFDREIDIGIPDAIGRLEVLRIHTKNMKLDDDVDLEQIANECHGYVGADLASLCSEAALQQIREKMELIDLEEDTIDAAVLNSLAVTMENFRFAMSKNNPSALRETVVETPNVTWTDIGGLENVKRELQELVQYPVEHPEMYLKFGMQPSRGVLFYGPPGCGKTLLAKAIARECQANFISIKGPELLTMWFGESEANVRDVFDKARAAAPCVLFFDELDSIAK

SEQ ID NO: 179446 - protein, 204 aa, Triticum aestivum
  Clone ID: PAT_TA_73864.pep
SARGIFAAGLALVEPHGFVHTPLSRTSIFRRPNEFPGAQQPFWWDDTGVWCGNVQQNQQYSTCGRCGDAPGNTHAQQGGRYDKGIITGTYTAGQVINAIVEFTANHRGGFMFELCPQVSENNNCFQRLRINSADRGVRDNNWACSGGDHQNGQMRVAIQLPAGVRCTRCTLRWTYRTSYPPAPDACWNPNNAQTFRNCVDIRIN

SEQ ID NO: 179447 - protein, 161 aa, Triticum aestivum
  unsure (1)..(161): unsure at all Xaa locations
  Clone ID: PAT_TA_73865.pep
FIALSXIVPGLKKMDKASVLGDAIKYVKTLQEQVKGMEEVARRRPVESAVLVKKSQLAADEDDGSSCDENFEGADAGLPEIEARMSDRTVLVKIHCENRRGVLVAALSELESIDLAIMNTNVLPFTTSSIDITIMATAGEDFSLSVKDIVRKLHQAFKSSP

SEQ ID NO: 179448 - protein, 36 aa, Triticum aestivum
  Clone ID: PAT_TA_73866.pep
VSCEQSVLIFLYNNIMPHFPFDLVISTSTLSVLVMH

SEQ ID NO: 179449 - protein, 151 aa, Triticum aestivum
  Clone ID: PAT_TA_73867.pep
ARGKAGEVVPAYVWAPEEDGPYYPGRVSRWWLSQSLKHLDASLRRLGATHLFFNHLYDPLSLVRDHRVKQVLGAEGITVQSFNSDLLYEPWEVLDDHGCPFTMFTPFWNKCLCMVDPPAPMLPPKRINSGLCTAFFFFFFFLFSRKRNNNY

SEQ ID NO: 179450 - protein, 120 aa, Triticum aestivum
  Clone ID: PAT_TA_73868.pep
MAVGDALRRLCEDIGWSYAVFWKAIGAADPVHLVWEDGYCGHTPCPAGSEASQARATELGCSAAVDSICSLVRKDMAQQVHVVGEGTIGRVAFTGSHQWIIHGTADDHGLSSEVASEMHY

SEQ ID NO: 179451 - protein, 246 aa, Triticum aestivum
  Clone ID: PAT_TA_73869.pep
FGTRAASTGFQVKNCWCLTFRGWSSPWPSTHPVPELRAMMWPSQRQAKARFGCLCLHPTQLAAVLRFGETMVGFPPSGSGRWRMRQSRCLLGPCSRVQWGGTCSYIMSEARRSGEAVTRAASTHSSLRGCVVLLHCPNRLMHIATFHRRYYRHRQCQVPHPTLTSRERGALCGCLNYKKPTLEAWKCTSSQRPPSSKLLVRRGWCSSRGRARRRGACRYQGVEEDDCGQGQQVLQLEGLLPLVVIA

SEQ ID NO: 179452 - protein, 197 aa, Triticum aestivum
  Clone ID: PAT_TA_73870.pep
TSSHSETTSTKQHLHRITAIMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDN

SEQ ID NO: 179453 - protein, 99 aa, Triticum aestivum
  Clone ID: PAT_TA_73871.pep
MYVWILHLQTLGKWRNMSRESTGEAILETDCEQIKRCLEVGLVCVNPDRSKRPPIAKVISMLQGLESITCSFSNEAASSAGQGVEPQDRPRKRSRTGRH

SEQ ID NO: 179454 - protein, 248 aa, Triticum aestivum
  unsure (1)..(248): unsure at all Xaa locations
  Clone ID: PAT_TA_73872.pep
FGTRGLMGLPNISFLELDQVALHHVPKGIANFQHLYSLRGVFESETGFRLDELRDLHNVRRLWVDKLEKATPRGELVLKNSRNLRELGLQCTSTRYDADELERIQRVYDTLVPSTSLAYLFLVGFPGSAFPEWLLTEPELNMPNLCLMHLNECIPCSVLPPAGQMPELLELKIQGADEVVSIGTELLXGKGVASAAAFFPKLELLLIIRMRNLEKWSLNTRDVCDGNHQQFSLMPCLSRLLLLDCPKL

SEQ ID NO: 179455 - protein, 230 aa, Triticum aestivum
  Clone ID: PAT_TA_73873.pep
MVANEKLELEQQLQAVQALVHEAEGAQASLIGAVEAADHALQARELVNNPHTNVSLGDATSTLSSFVVLIQKKANLLAEQIEEKKRGGLTPEQIAEIHANFAYFDKDNNGFLNKKELRTCLQSLGEESTPQAMQAILDKYDTAKKGTINKHEFEVFIRESLGDTGTSEEIIKSFQYLCYEAPTITCQQMINVVNNRTFTDHHVDYLKQEMKQTSADAYNYSQWTQEAFAR

SEQ ID NO: 179456 - protein, 233 aa, Triticum aestivum
  Clone ID: PAT_TA_73874.pep
LSLLQFKDAISLDPHQAFMSWNNSIHFCNWEGVLCRLKTLPHRVSSLNLTSRGLVGHISPSLGNLSFLHSLALVENTLTGEIPPSLGHLRRLQTLRLRNNMLQGRIPSFVNCSKLRVLDVSHNHLVGQFPTELPPVLQVLRVGTNNLTGTIPASLVNITTLTTISCLNNQIKGNIPSEFADLPSLQYLYAGGNQLAGSFPQAILNLSTLIDLDLGLNGLSGNLPPNLCTALHN

SEQ ID NO: 179457 - protein, 211 aa, Triticum aestivum
  Clone ID: PAT_TA_73875.pep
PFTSEEATRYEELSKAQFADFYRTVAVPNKASSFGQMNNEPSSSRLTNYSTTPSTSLFRQPFGDQEDSQHSSDCQRSEDGYGSNDSGFGSNSDDERNGEEQSNTGDLYYNILEEIPEQAQFENVTLAYQPYTATDNNILPHQQSSSAPLTTLVPAPVAAQADETSPILGHYTENGPEALETTLQLDEEEYLKYVTNQQVLQDISQSATEQS

SEQ ID NO: 179458 - protein, 93 aa, Triticum aestivum
  Clone ID: PAT_TA_73876.pep
AAVIGLPPAHPRRLKRTPTYNEPQASSNGLHDNDHRNCSASQVHQHRRLRGLMLHQITGLMLHQITTNIASHRNRNCLGVDAELGCEMDCARS

SEQ ID NO: 179459 - protein, 191 aa, Triticum aestivum
  Clone ID: PAT_TA_73877.pep
MLNAAPPSGPKILRGSTIMRRGGTSRGGISKRPGARGIRVDKDGDLDMDAPARPTARGGRGGAPGAPGSMSTRGVGRGSTRASGSGALRGGTTRGPPRGQGLIEITVLGWQESKGPNRDSLVDFLERKSAVKIKKSRIQQDALIISVPFLQAGEMTKWDGCNYAGSTLSITASNAPKITSKKDEEMITNAL

SEQ ID NO: 179460 - protein, 122 aa, Triticum aestivum
  Clone ID: PAT_TA_73878.pep
SARGLCLARAILRKNQILLMDEATANVDPKTDALIQQTIREKFADCTVITVAHRLNTIIDSDRVLVMDAGRAAEFDEPHILLQNQTGLFHGMVKALGANEFEKLSLIAGKKLTSDDGNKKEN

SEQ ID NO: 179461 - protein, 226 aa, Triticum aestivum
  Clone ID: PAT_TA_73879.pep
RHEGKLLINGIKILIAQNKTEEEIDKFARNTCVNLQIEQPYVCDRIIEEFGNELYFAIERSYLEPHEFCGAFVKDCGVFENPLDQPWPLVIPGNKPAVKPWPTVTAGKPKMRVLHLADIHIDREYAVGSESACANDEGFVYAFCCRDYPPGKSANSSPKNDSIKTPAPKWGIAANCDIPYWTFEESMKIISEREKYDYIIVTGDLEPHAIWDYTKETTTANIVNIT

SEQ ID NO: 179462 - protein, 95 aa, Triticum aestivum
  Clone ID: PAT_TA_73880.pep
REYGSTSTPLKPKEFVKFKSSRIGIASIAATSATKGTNLESPAIKLPFSSHKIPTVAPDPSSAWNGASTFSFINLASDLYYLCSTGSGFFDKDFI

SEQ ID NO: 179463 - protein, 170 aa, Triticum aestivum
  Clone ID: PAT_TA_73881.pep
NICVGESGDRLTRAAKVLEQLTGQTPVLSKARYTVRSFGIRRNEKIAVHCTVRGPKAEEIIDRGLKVKEYELYRENFSDTGNFGFGIQEHIDLGIKYDPSIGIYGMDFYVVLDRAGRRVAKRRRTKAHVGASHRVGRDEAVKWFQQKYDGVILPPKPKEARKGGGNRRRK

SEQ ID NO: 179464 - protein, 221 aa, Triticum aestivum
  Clone ID: PAT_TA_73882.pep
RHEGQRWSNKIGQDSVLEPRRFSRRSGLFSEKLYGRAGLMRSVEVAPAVKDAVLRSLKSSYGGLDKGSTPAAHRVGLGGKVNSWAWSAIGAGSGTSSTTEHILACHIGTRLFEIKYSHTACPTSAAADMTAACHLSYYCAYLVAAAPRLLPDSPAWTDKRYKEVVKDVKAALGKDDDGASESTTQRYERLLKELSATTRDEVLQRGAELGSRLVEAYAENE

SEQ ID NO: 179465 - protein, 56 aa, Triticum aestivum
  Clone ID: PAT_TA_73883.pep
RHEVKPERFAGSQEQPRVCLSSQKLIREGFEFKHNDLGEIFDDLVKYGRTTGILPY

SEQ ID NO: 179466 - protein, 50 aa, Triticum aestivum
  Clone ID: PAT_TA_73884.pep
MAVGKNKRISKGRKGSKKKTTDNYMLRMFTIGFTKRRPNQVKRTCYAQAS

SEQ ID NO: 179467 - protein, 71 aa, Triticum aestivum
  Clone ID: PAT_TA_73885.pep
ANKMYFGLLHLCIRTYISGTKGRGKKKTSSKSVLYTTKSKGIARRGLRKKSSKIIDCMNSWGKSQKSFTSF

SEQ ID NO: 179468 - protein, 48 aa, Triticum aestivum
  Clone ID: PAT_TA_73886.pep
MCLLQDKPQPPPEGRLPDATKGSDHLRQVFGKQMGLSDQDIVALSGGH

SEQ ID NO: 179469 - protein, 226 aa, Triticum aestivum
  Clone ID: PAT_TA_73887.pep
MSRSTTEDWDEERDVRPNALVVVLGDVGRSPRMCNHALSLTTELNYNVFLLGYNDTTPHPAIALNPNIRIVPVRPPPDLPRFVPDPVALVFKLLWTNFFLFTAMLFRVPFLVHLILLQNPPGLPTMFICWIISHLKRANWIIDWHNYTYKMLQHKWNLEMDLSKKSRTAATEAQQEVAKKRQTREEREAALREKKRAARAEKKPAWNLRKFFVEMVYRYEGFFGRR

SEQ ID NO: 179470 - protein, 226 aa, Triticum aestivum
  Clone ID: PAT_TA_73888.pep
MGVFSQLSESSKQNAFSLPGFKKADCSSGSPSGKKEVEFGSPLFYTYCAIGGAASCGITHTAIVPLDLVKCRIQVNSEKYKSIGTGFRVTVAEEGVRALAKGWAPTLIGYSLQGLGKFGFYEVFKNVYADMIGEENAYLYRTSLYLAASASAEFFADILLAPMEATKVRIQTSPGAPPTLRGCAPMIYRAEGLSGFYKGLPPLWMRQIPYTMMKFACFERTVEMLY

SEQ ID NO: 179471 - protein, 150 aa, Triticum aestivum
  Clone ID: PAT_TA_73889.pep
ARGAGRVVENPSISPVVPPPMPATTATRIQPQDAEIITPEFSQARADTAATLPDSPCCVLSDVLGIFDANATISSGTADVHSALRVVHTAGTPNLPASNSYALVISLSLVLPPFSTTPANLGYVDKAASSTYCKVLSTHLLIIKQPLWPT

SEQ ID NO: 179472 - protein, 203 aa, Triticum aestivum
  unsure (1)..(203): unsure at all Xaa locations
  Clone ID: PAT_TA_73890.pep
SGISPAMSNCFAKPTSRSEGEILHSANIRSFTFKELRTATRNFRRDSILGEGGFGVVYKGWVEESTFAPASSDTGMPVAVKRLSQKGIQGHREWLAEVNYLGRLSHPNLVKLLGYCLEDVQHLLVYEFMPQGSLENHLFGRSLNFHSLSWNVRMNVALGAAKGLAFLHSDXANVIYRDFKTSNVLLDSSYSAKLSDFGLARDG

SEQ ID NO: 179473 - protein, 143 aa, Triticum aestivum
  Clone ID: PAT_TA_73891.pep
MATGSSKWWQGPMDFPPQPQPQQMQQHQPLQHQHQPLQLPAVTMPAPAPAVAASPESKQQQQQGQGQGEGQMGAAAGAIVPLRRPRGRTMGTKNKPKPPIIITRDSPDALHSHILEVAPGADACGCAVHNTRRLGRGVCVLGA

SEQ ID NO: 179474 - protein, 204 aa, Triticum aestivum
  Clone ID: PAT_TA_73892.pep
MGKLVRQCDMEVMKMAMLKHEETFRQQVHELHRLYRIQTQLMGGDLSTRRQPRRRGNKQPRRALNLQLPADEYIVGAADEDDDGCGTGAELELTLAVGGRRTGSGTSRKNNVSKRGHAKHDGAGGFSSPFASDCSGGTSLSSSPPSSAEYSESAFGVALHGGYPGGGRASAAMPESHDVRPRRGGSDEAAPVALAAGAVPVPQP

SEQ ID NO: 179475 - protein, 180 aa, Triticum aestivum
  unsure (1)..(180): unsure at all Xaa locations
  Clone ID: PAT_TA_73893.pep
MASFGFPSVSIPILFLITLSTVLTSSSPGPSKSNDSDTDLAALLAFKGQLSDPLGILARNWTTGTNFCHXFGVACSRRRQRVTTLRLPGSLLHGPITPHLGNLSFLSVLNLTNTSLTGSIPDDLGQLRRLKYLYLGFNGLLGSIPTTIGNLTRLHALSLSHNHLSGSIPVELQNLQSLGY

SEQ ID NO: 179476 - protein, 244 aa, Triticum aestivum
  Clone ID: PAT_TA_73894.pep
MDSMESCVPPGFRFHPTDEELVGYYLRKKVASQKIDLDVIRDIDLYRIEPWDLTEHCGIGYEEQNEWYFFSFKDRKYPTGTRTNRATMAGFWKATGRDKAVHERSRLIGMRKTLVFYKGRAPNGQKTDWIMHEYRLETDENAPPQEEGWVVCRAFKKRTAYPNRGMMERWGSNYSYNEVNAMSGAPFPDPNMASTYAAAAQMGRGASFKEEAEQLDGAAALLRYTSSHLVELPQLESPVAPLPR

SEQ ID NO: 179477 - protein, 199 aa, Triticum aestivum
  Clone ID: PAT_TA_73895.pep
ARGLISSMDSADTTVAGGRVLLLPFPGMQGHANPMLQLGRRLAYHGLRPTLVLTRHVLSATPTTQCPFPVAAISDGFDAGGIASCADTAEYLRRMEAAGSDTLASLLLADDVRVLVYDSHLPWARRVAREAGVAAAAFFTQMCAVDVVYGEVSAGRVPLPLADGRALRGRLSVELGPDDVPPFVAAPAWYPAFTESALS

SEQ ID NO: 179478 - protein, 64 aa, Triticum aestivum
  Clone ID: PAT_TA_73896.pep
EVLFILSSLEDAFNSFELLVVFSLRRKLMQLLLPMSLPLKVLSMKSLAMLLVQAMKVQLNLQEF

SEQ ID NO: 179479 - protein, 223 aa, Triticum aestivum
  Clone ID: PAT_TA_73897.pep
RHEGQGRFLIYEYMERGDLAKILTNNGRAIELDWGRRTHIVLDVGQALAYMHHDCSSPIVHRDITSKNILLDPEFRACISDFGMAKILNIGGQNLTRLAGTKGYIAPELAYTKNVTEKCDVYSFGVLILEIFMGSHPGDLLSSLSLGTKNNDVCLHDLLDSRLVLPDAEAAREIYCMLNVAVQCLDPNPSRRPTARQASDELSDMKACEGHVDYLHVVLTSPA

SEQ ID NO: 179480 - protein, 179 aa, Triticum aestivum
  Clone ID: PAT_TA_73898.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSHPVKLVPFNPEYLDESVMWTESSDVGKGFRCIRMVNNIRLNFDALNGDKDHGGVHDGTTVVLWEWAKGDNQSWKILPWGE

SEQ ID NO: 179481 - protein, 121 aa, Triticum aestivum
  unsure (1)..(121): unsure at all Xaa locations
  Clone ID: PAT_TA_73899.pep
SISLVYGNISSFFFFFRFINSNGSPIFLSRKNQELWLLYRGFFVEVNMFKGNNKMXLNFLKMSTLTLKNIGGALDSISXAKDGLADEDSNLMVKLKFLTYKVFCYSSLLHFGLCSLVHFEI

SEQ ID NO: 179482 - protein, 116 aa, Triticum aestivum
  Clone ID: PAT_TA_73900.pep
KFALIFLICWFGLNFDWVCSLLPGPTRSVLFFLHENLLIYLSNIMIVQRIQEAIEIIFISIDHLATTTNTETSRRRAVVIAPPSMEPQPDLSSAAYAVLTSTNSIPRCKTAPASYI

SEQ ID NO: 179483 - protein, 169 aa, Triticum aestivum
  Clone ID: PAT_TA_73901.pep
RFRHGYCKHNPRKMVKTWAEKEMRNLLRVRAEGIRCPKPLLLRLHVLVMEFIGKGGWAAPRLKDAALSDDKLRETYFEIVTTMRTLYQKCKLVHGDLSEYNILYFEGHLYIIDVSQSVDLDHPSALDFLKEDCLHVNDFFEKRGVAVMTVTELFNFVVDQNIADDDVDD

SEQ ID NO: 179484 - protein, 59 aa, Triticum aestivum
  Clone ID: PAT_TA_73902.pep
LPPNQSCWRPPFQRSERHRRIPSPPPVPLEQAPLLDLISSSFFQARPPDPECRRRIPSP

SEQ ID NO: 179485 - protein, 121 aa, Triticum aestivum
  Clone ID: PAT_TA_73903.pep
ASRLKSLTGHIAPHSLVCPGLRSAQWRLRYVRGRALLTQNAKQIGRKSPNLEANITSILFSQYQMKSINASMRPDACRRKETGRVAACHPWISPSPAEGAPSWATMFSPSSPVVGPVASPD

SEQ ID NO: 179486 - protein, 82 aa, Triticum aestivum
  Clone ID: PAT_TA_73904.pep
IMSLVLHCHLVCLICSQNVPLTVRSWNSGVINMLTIPESSITRRVLVLLHLQVCLISSWKVSLKILAKQSGIPFVFYLFLTQ

SEQ ID NO: 179487 - protein, 171 aa, Triticum aestivum; identical to SEQ ID NO: 141927
  Clone ID: PAT_TA_73905.pep

SEQ ID NO: 179488 - protein, 171 aa, Triticum aestivum
  Clone ID: PAT_TA_73906.pep
MGKAFSLLRPEPQTQGEPGEGMAMELRKRPRPRRLDPDFVSSPPPTPPRKRPRKQDAERKQPRRPAAAKRQPAPSKRARCAQQGIGSPVAGLQPSRCCRIVAPLSRVSFIPRSRVPFNWYEPDIWTEVAKHLHGADLLRLSATCLWFFRLLYEDSIWRYAFLRDLSLHTND

SEQ ID NO: 179489 - protein, 83 aa, Triticum aestivum
  Clone ID: PAT_TA_73907.pep
MSTPSGPGEADGATPAASTYYDVFGPDAKPDVIFKEATSDSTLNLQDVQGLVTWVIGEGMPPSWVFVKNKPLIPKVILLYVPG

SEQ ID NO: 179490 - protein, 172 aa, Triticum aestivum
  Clone ID: PAT_TA_73908.pep
DRGTARSFRCFDVSELKRRVLAGLSKNPNTDTQWRYLVLGEACFHLGLIEDAMVLLQTGRRLASAAFRRESVCWSEDSFSSSTVAAAVASVPSGNASKSGSAFIIPAVESEAMSQLLAHVKLLLRRRTDAMAALDAGLPAEAVRHFSKILEARRGVLPHTFTAACLVGRAAS

SEQ ID NO: 179491 - protein, 231 aa, Triticum aestivum
  Clone ID: PAT_TA_73909.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNPHRLV

SEQ ID NO: 179492 - protein, 108 aa, Triticum aestivum
  Clone ID: PAT_TA_73910.pep
RHEGGYRAGGAGGVQAMSQCVGDLDAKACSDCVSAAAAQLKAGCGYASAGEVYLGKCYARFWSNGGGFVSGASSGNGYGFGPRMNGERLALAVGGFFASLAYFSVLLV

SEQ ID NO: 179493 - protein, 174 aa, Triticum aestivum
  Clone ID: PAT_TA_73911.pep
PPVGRGEHGAWPCRSTTACATKASLHEPRARAWPERSTAARAAGASRPARARLGHSTTTLPLVRWRPGPLAVAPSTSSQPKRVGSRGDRGLGQLGDVGAALRARVHPWRRAWQLVLFDREGNQGGMRRRKRKGRRGELQRLDSGGQVSDVRRPARAASRAGGVQCADKRPFRVC

SEQ ID NO: 179494 - protein, 158 aa, Triticum aestivum
  Clone ID: PAT_TA_73912.pep
GTRVTKVAAQVVAQAQAVLGQLISAVEGVISQVTEVIAQLTTQATTTVNGATSIVGDITVQLTAVISVAVEVVSGLVGQVSGILSGVTGLLSTDVVGQITGTVFSSLDVVFSVTAQVTVVISTVTDVVSGLTGVLGGLSGGIGGSTGGSSGGPCPCSG

SEQ ID NO: 179495 - protein, 138 aa, Triticum aestivum
  Clone ID: PAT_TA_73913.pep
IVAKEAIQEAARNGSDVVLVDTAGRMQDNEPLMRALSKLIYVNSPDLVLFVGEALVGNDAVDQLSKFNQKLADLSPSPSPRLIDGILLTKFDTIDDKVGAALSMVYISGSPVMFVGCGQSYTDLKKLNVKSIVKTLLK

SEQ ID NO: 179496 - protein, 171 aa, Triticum aestivum; identical to SEQ ID NO: 141856
  Clone ID: PAT_TA_73914.pep

SEQ ID NO: 179497 - protein, 84 aa, Triticum aestivum
  Clone ID: PAT_TA_73915.pep
QSCITSGCQDQEEVHLLLRQEKKESAAAVTGCRLCRDNNLDCRHDYLSTRSLWEPEVFATAFHLQAQRDHITESSKEAWRFTDM

SEQ ID NO: 179498 - protein, 49 aa, Triticum aestivum
  Clone ID: PAT_TA_73916.pep
ITFYVIKSQSYSEQFVLYSHEMQHFFLLFTVSHQFVFTFFCRISMFVAD

SEQ ID NO: 179499 - protein, 119 aa, Triticum aestivum
  Clone ID: PAT_TA_73917.pep
SNVKKQPSSLIKIRSLDHWTMMIEQEDNKLLVIEFTASWCRASDTIAPFFAHLANQFPDAIFLEVDIDDMKYIAEAYKVDGAPMFLFMNRLEVKDTLRGAHKDELLEKIQRQMARLVDK

SEQ ID NO: 179500 - protein, 148 aa, Triticum aestivum
  Clone ID: PAT_TA_73918.pep
FGTRALHYALTKIKEQELQIERLQKNTGGVTMAAQSEKEVEQLRKEKSDLQIKLQAMEHAMQQQQKRLQNEIQEQKVEIEQLRKNAEDLAVAAQSEKEVEKLKKEKYDLESKLFIMRQEMQQKERECREAIEEQMRLRAENDVPRLWW

SEQ ID NO: 179501 - protein, 147 aa, Triticum aestivum
  Clone ID: PAT_TA_73919.pep
SARGDWPHTCNVQTPLSLPISSYCDVTSGSESALQDAVAQQPVSVAIEADQSCFQFYSGGVMSDPSCGTQLDHGVLAVGFGVTGGTKYWNVKNSWGTSWGQNGYIWLGRDVAGQPLGVCGIASEPSFPYGGKSLGGQAHATRHHRKH

SEQ ID NO: 179502 - protein, 230 aa, Triticum aestivum
  Clone ID: PAT_TA_73920.pep
DSDEATVLVVAAMAPLYFALGLGYGSVRWWKLFTPDQCDAVNRLVAYFAVPFFAFDFAARMDPYALNYRVLAADALSKLAVALALAAWAAASTRCCRAGAKRGGELASSWCITGFSLATLNNTLVVGVPLLDAMYGGWARDLVVQISVVQIIVYFPLLLLAFEARRACGGGAGKPDAAVAVSASDDDVEDGGAEGRRRREPVWPLVRAVWLKVARNPNVYAGVLGVAWSC

SEQ ID NO: 179503 - protein, 181 aa, Triticum aestivum
  Clone ID: PAT_TA_73921.pep
MPGDKTLGSLLLERLSVDYGKKSKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDV

SEQ ID NO: 179504 - protein, 161 aa, Triticum aestivum
  Clone ID: PAT_TA_73922.pep
MSDTDEHHFESKADSGASKTYPQQAGAIRKGGHIVIKARPCKVVEVSTSKTGKHGHAKWHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 179505 - protein, 115 aa, Triticum aestivum
  Clone ID: PAT_TA_73923.pep
SRGASRSPQTRSQRSGQPLLQFESESRAERNRGRKTRELVDYREAASQRDWWEKRVRIKLHKNPKLREGDAKNDIRMASSRSSSMQQRTSWRLQQVERLQCCSRGVLRTSGNYYC

SEQ ID NO: 179506 - protein, 129 aa, Triticum aestivum
  Clone ID: PAT_TA_73924.pep
GTRAATVLPIPVTARLRLSQRIPRRRVPSRTPGRAVRAAASFRRRPTPSTSLSQSSQAATSLPRHSAPLLLSPQRRASADAQHLSCSVPPTPRLLPRTSKLLANSLSFLIILFPSGRPGMSSPRKTFGF

SEQ ID NO: 179507 - protein, 173 aa, Triticum aestivum
  Clone ID: PAT_TA_73925.pep
RAVDLQVTTSPRCAACFAGSLLCCSSSIESGINRPAFPTESPPSATHKNHQQQSPMTENKTQIAPQNLPLIQNRKAVQSGHPNTTADHQTAEHAPYIRLERTPRADVAERPPRRPTTAPRDRGGRPERRGPLRQEEGATMEIMIWQEIRSIYKPQPDCRTAAAAVSGEVSRLN

SEQ ID NO: 179508 - protein, 148 aa, Triticum aestivum
  Clone ID: PAT_TA_73926.pep
IRVFKEGFFEDGAVVCAPFLSDLTAWKTRSEEDEEQCLEKWKVQLPQSHISSYFPCLGPKDDTTGKALRWPIGFVTTGFIHGSTGKDGAAVAFCDARLLAALRQEQWNEKSMLGQEICVLVRNARSAAYRRALATVVLEQQKEDLEFL

SEQ ID NO: 179509 - protein, 94 aa, Triticum aestivum
  Clone ID: PAT_TA_73927.pep
TFVVMYQLFSSIESTKGWSALSASLSHFDGWSLPRCKMLLKTYYYLDKNGNRVFYEYDVRGLLRLIWNSSKHQSRRDLQFFCSDGHERLSKVTV

SEQ ID NO: 179510 - protein, 122 aa, Triticum aestivum
  Clone ID: PAT_TA_73928.pep
PWRPRDLPMVPPSLHHACAWPGYLQREPSAKSHSPQPAIPRASDAASLARCCPATVAALRRTLLWLLLQQSKCPTCVRPCSFVLELVRAAMHASEDWADASSAIAMTSSHFMHQSISMSLRL

SEQ ID NO: 179511 - protein, 69 aa, Triticum aestivum
  Clone ID: PAT_TA_73929.pep
MCSYRRTPLVQNLDHIGPYHQRTSEPAYQCRMSSVLLLHRCGSSAKRKDGITNIMDTRWQHITLQFYDL

SEQ ID NO: 179512 - protein, 95 aa, Triticum aestivum
  Clone ID: PAT_TA_73930.pep
CHRAAPQWLLMMRCSGRRRSWSCTVVGETAESLAGTHRPWSEPFSCTCGGSEIQGDFSAVFGREGRTAKFPSSVLSYPTVEGGQRANYFWKKSVG

SEQ ID NO: 179513 - protein, 84 aa, Triticum aestivum
  Clone ID: PAT_TA_73931.pep
GLKPTFACKWKSSLDWPTRFAICLGVARGLAYLHEESSICVAHRDIKANLNPKISDFGLAKLYDDLKTCEHEGFWHIVGAFPPC

SEQ ID NO: 179514 - protein, 117 aa, Triticum aestivum
  unsure (1)..(117): unsure at all Xaa locations
  Clone ID: PAT_TA_73932.pep
KIQENRDVGFALLESYSRILESLAFNVMSRIEDVIVADNVAREKAKKDAPPGSXSEAPPQVPDGADSMTLLDFMGWNGDSEGRSDDQSPSAVDPAQDDGRLMKLPNIMTNLFMKTSQ

SEQ ID NO: 179515 - protein, 90 aa, Triticum aestivum
  Clone ID: PAT_TA_73933.pep
WGQDAGEFRPDRFTNGAAAACEPSHMYLPFGHGPRICAGQNLAMVELKVVLVRLLSKFAFSPSPGYRHAPLFRLTIEPGFGMPLVVTKLP

SEQ ID NO: 179516 - protein, 116 aa, Triticum aestivum
  Clone ID: PAT_TA_73934.pep
FGLSRCFRPMQSQTFTVNIRGTLRYSAPECGNGEITHQLDIYSLGIIIMEVLTGENWYQYDVDMLVTQLQGLNPTFPNIFFGIHLVQPAKFIVRFCRKLPGSPRFTHLMVETVREA

SEQ ID NO: 179517 - protein, 64 aa, Triticum aestivum
  Clone ID: PAT_TA_73935.pep
FAAPPLHARISALPEMVTAGSPPRYRSFTWAEYKTAMYSLRLSHSRLDLFHVDDDESGNGSKGK

SEQ ID NO: 179518 - protein, 65 aa, Triticum aestivum
  Clone ID: PAT_TA_73936.pep
RPGKKKGAPDSPEEEEMKGGADEDLDEPAGAAEEEEEEEEEEEEEAAEEEEEEEEEEEEEEEEEE

SEQ ID NO: 179519 - protein, 48 aa, Triticum aestivum
  Clone ID: PAT_TA_73937.pep
LKREVGELKEVIGGKDFLLHSYKEQKVELCSQIRELQEKLSSHVPNIL

SEQ ID NO: 179520 - protein, 64 aa, Triticum aestivum
  Clone ID: PAT_TA_73938.pep
DHTMQIMEPERLQEVGSYLTLDKFDKMTRPFAMPAEDFPPATPSQCLAVRFCEDIELQGARLQH

SEQ ID NO: 179521 - protein, 100 aa, Triticum aestivum
  Clone ID: PAT_TA_73939.pep
GCVRQSSPPSPSPGSGACGATCWPLLKFILYGAPLCRGVTDHFHGRRSKWQCVKSLRLGSAILYSSSFTRERSVQSNLLAAPQIYTVWSSALQGSYGAEG

SEQ ID NO: 179522 - protein, 161 aa, Triticum aestivum
  Clone ID: PAT_TA_73940.pep
RSLRMFCALLGNRQTHLNLSNNMGQTPLDISPYGVPPGFFDEQNSEAKIHFALTVVNARSGGSRRDHFEENYTRQLKYDETEQLEKLKEPTQTLCIGVALVATATFTVTFALPGGYRADEHINGGTPTLAGRYAFDAFIIASTFSFVLSVMAMIGLMYSGY

SEQ ID NO: 179523 - protein, 108 aa, Triticum aestivum
  Clone ID: PAT_TA_73941.pep
LTNASSENTNNMPSKVIALDLNQKMLLDVQEFDRQRPSSYMTTSISSYLMPAAAAVAQVLDCCLHLGANSFICLTQLIDEWGYDFKCSRQSHVCNVDASILYDDNAGF

SEQ ID NO: 179524 - protein, 111 aa, Triticum aestivum
  Clone ID: PAT_TA_73942.pep
AQLIQALKVRNTQTRRTAELCRIWGDMDESELVQNSPRIRLRFEAIKVGAAAGHYMNQRTGGIDEGPGKKRIRRGRITVREKSKIWKSKMDRESKGQQRGDEEEKGILVPN

SEQ ID NO: 179525 - protein, 155 aa, Triticum aestivum
  Clone ID: PAT_TA_73943.pep
SSPAASYPSLPPTGAALQTQTAKGERRGAERGAMGKYMRKCRAEDGAVGGVEVTQAVGVRTRSRAAAANVVVSKRRRPLPPGSPSASSSLARAQGGSCYLKLRSRMLFMAPPAPASGAAAGHGPAPPLPAGLSRCSSTASSVDASAAAQDRSLPS

SEQ ID NO: 179526 - protein, 191 aa, Triticum aestivum
  Clone ID: PAT_TA_73944.pep
PNRNYWLASNVVSRKPGTPTGTAVLSYYGGRSSPRAPPPTAPPAGPAWNDSAYRIGQSLATVAHPEHAHPPPPRADRTILLLNSQNKIDGRIKWAINNVSFTLPHTPYLVALKHGLLGDFDQRPPPETYNHTGYDVYGVQANPNATTSDGLYRLAFGSVVDVVLQNANMLAPNNSETHPWHLHGHDFWTLG

SEQ ID NO: 179527 - protein, 87 aa, Triticum aestivum
  Clone ID: PAT_TA_73945.pep
LLLPEVSSSWMNFSVASTVGMVSISCSFSSGINGLRAAPDDLCSGCSRTPCSGARMRQQHPPIMTTMTASPSPEHDHFCDARTGARR

SEQ ID NO: 179528 - protein, 156 aa, Triticum aestivum
  unsure (1)..(156): unsure at all Xaa locations
  Clone ID: PAT_TA_73946.pep
VRWWLVHRSGGTGLAPAQSSCLRKRRSVLGDAKIQGGTLPFSSPCYRFRAMPQQAGFHGIGIGGAVNTTYRSATNLHQAIASRGEEKGRGRCGXWLVHRSGGTGLAPAQSSCLRKRRSVLGDAKILGGTLPFSSPYYRFRAMPPQVKVNPLLGWQT

SEQ ID NO: 179529 - protein, 155 aa, Triticum aestivum
  Clone ID: PAT_TA_73947.pep
SARALGRYLLRPSTTQPSQISSLPDHNAAATTSDSASSGALSRRCSPDQLPHTALLRPPAMAMSSAPLHAARSNPRCHRSPAPAPPLVRHTTQSPWYISTRAAAGSAVVLLLRLGNLDSDATDGSVSHSSSDPCFLTPLGSLCGRPWQILLCRPS

SEQ ID NO: 179530 - protein, 158 aa, Triticum aestivum
  Clone ID: PAT_TA_73948.pep
MSTDVAADVPAPEVEVAADPVVETTAEAAAGDAKPAKETKAKAAKAKKPSAPRKPRATPAHPTYAEMVSEAITALKERTGSSQYAITKFVEDKHKAHLPANFRKILSVQLKKLVASGKLTKVKASYKLSAAAAKPKPAAKKKPAAKKKAPAKKTATKT

SEQ ID NO: 179531 - protein, 214 aa, Triticum aestivum
  unsure (1)..(214): unsure at all Xaa locations
  Clone ID: PAT_TA_73949.pep
MAASPMTPESPRSSATPSPPPLRPRRSSRPPMVRPWTPSXPDAHDLSTPSPTSMRPKTPPPPSTRSTRTSSATRRYRSSYRCRQRSPSTSAPALPRSFPQRQPPPTPSPWQPNQLRPSARQKLLPTRVSGCSLRSSPSTVSTRHMTPPPNTCTRLPSNIDHGHGLYKCRSITRDISSGQVRGRRSHLCQTQPTRKGHVQVYIVNHMEVPASVLG

SEQ ID NO: 179532 - protein, 184 aa, Triticum aestivum
  Clone ID: PAT_TA_73950.pep
GTSRAAIAAAIAAAAAAAAAAGFALTAKSAGRPLPRPSHSASLWASLSLADSGAPGNVEPRTGAAFPAETAGGRRLLGVGLRKTTILGLKSIDVYAFGVYADDSDLKQLRDKYQKLPISDLKENDELINDALERDIRMTVRLQIVYGRLSIGSVRSAFEKSVGSRLQKFGGSDTKELLQSFVSL

SEQ ID NO: 179533 - protein, 122 aa, Triticum aestivum
  Clone ID: PAT_TA_73951.pep
MARLNSKAVAAAVVLAAVVLMMAGREASAALSCGQVDSKLAPCVAYVTGRASSISKECCSGVQGLNGLARSSPDRKIACRCLKSLATSIKSINMGKVSGVPGKCGVSVPFPISMSTNCNNVN

SEQ ID NO: 179534 - protein, 78 aa, Triticum aestivum
  Clone ID: PAT_TA_73952.pep
MSCCGGSCGCGSACKCGNGCGGCNMYPEVEAAGATLLVAATATHKASSGGMEMAAENGGCGCTQCKCGTSCGCSCCSC

SEQ ID NO: 179535 - protein, 114 aa, Triticum aestivum
  Clone ID: PAT_TA_73953.pep
RYSEWVLEELDELRGSFLLTDPAMPGHPIVYASRGLAALTGYPRRELLGRNARLFQGAATDRAAVSGVREAVRAQRAHQVAILNYRRDGSPHWVLLHLAPVFHAADGRVLHFLA

SEQ ID NO: 179536 - protein, 217 aa, Triticum aestivum
  Clone ID: PAT_TA_73954.pep
MGKVLLNKEYKMKCNACWRELEGQAITTTCGHLLCTEDAKKILSNDGACPICDQVLSKSHMKPTDINPSDEWTDMSMTGVSPQILMKSAYRSVMFYIGQKDLEMQYKMNRIVGQCRQKCEVMQAKFTEKLEEVHAAYQKMAKRCQLMEQEIENLTRDKQELQEKFAEKSRQKRKLDEMYDQLRNEYESVKRSAIQPANNYFPRAQPDLFSGMPNILD

SEQ ID NO: 179537 - protein, 190 aa, Triticum aestivum
  Clone ID: PAT_TA_73955.pep
LGGRARARPAMTMLGQAQAQPAAAFGDTTLTKVFVGGLAWETHKDTLREHFERFGDILEAVIISDKLTGRSKGYGFVTFKEADAAKKACEDGTPVINGRRANCNLASLGAKPRPQPPHLLRPSPPTTPAPHHMPALPSPHHQPAPAIAVGSRGVSPVPWYYHPSTTPPPPPQAAHYGHGAHQQYHGVLPF

SEQ ID NO: 179538 - protein, 162 aa, Triticum aestivum
  Clone ID: PAT_TA_73956.pep
PPSSSSSPRSPSSSSCSSPTPHRRRPRAPAARPGTPAGRATAPRARLRTASTPRSSRCSAPSSPRARRAGCSCSASRRSSSRSRPSTTGRAPPPPSSPTAPRTRPARGACSLGAAPAARRPSTGPRTRTRPGRRGRCCGARGRALCAGGRRGRCASPAAGWR

SEQ ID NO: 179539 - protein, 132 aa, Triticum aestivum
  unsure (1)..(132): unsure at all Xaa locations
  Clone ID: PAT_TA_73957.pep
IRHERSLPRPQDLSPPPSPAPFAARGLPPIAPFAAGQPEPPPVAHCGSRRRLSLVAPFAVGEPEPPPVARRXATAGRRGRAGAAAIVSSRPPILHPYAGAPSFSSSSRRPSPLPRPPRPSGRFTGLRRRPAR

SEQ ID NO: 179540 - protein, 168 aa, Triticum aestivum; identical to SEQ ID NO: 124110
  Clone ID: PAT_TA_73958.pep

SEQ ID NO: 179541 - protein, 215 aa, Triticum aestivum
  Clone ID: PAT_TA_73959.pep
MEAAAADEERPLLHLQPYNQDVGSEYAGDGSVDINNQPALKRNTGNWRACYMILAVEFCECVAFFAIASNLVTYLTTVLHESKVAAARDVSAWVGACFLAPLIGAFLADTYLGRYWTMVVSLPVYTIGMLVLTVSASVPTSYYHGDVHHAVVVYLGLYLAALGTGGIKPCASAFGADQFDSGDPTELEKKGSFFNWYYFLIKSGSLLSSTLLVWL

SEQ ID NO: 179542 - protein, 169 aa, Triticum aestivum
  Clone ID: PAT_TA_73960.pep
MATDAALSQPDRATVTLGEPAHEEAVQQLVQQPDSRLRSLNPGPIPIPGAPSSRSLLEKVSDQTVNLDLTASHQSENGSISTVSSTVSSVESEKAAYEFLAQTPIKSTDKHLVEFSEAMRTVAKALRQVAEGKAAAQAEAAEWKRKYELETARKQQTRIKDCGTCTDDN

SEQ ID NO: 179543 - protein, 111 aa, Triticum aestivum
  Clone ID: PAT_TA_73961.pep
LRVDIFDKFKDQTGNFSTSLCSDLVSLLSLYNAAHLATPGEDALSDVIVFSRYHLEAMRNKLRPPMAEQVSRALDIPLPRTVRRLETMHYIKEYEKDESNNGPLLELSRLD

SEQ ID NO: 179544 - protein, 42 aa, Triticum aestivum
  Clone ID: PAT_TA_73962.pep
FFFFFFLIQRHILLTAGSKQETQICTNYKVFISPIDLHTHAL

SEQ ID NO: 179545 - protein, 106 aa, Triticum aestivum
  Clone ID: PAT_TA_73963.pep
LQQSPMWRLSRYHCAARQHRYGPTFKLVHMVCRVKNWTSIAPNNPQTSARKPMSEEPRNERPERLHGRIRQVVGAVKSNPGATTESVRNARKKERKKKKRGREGRG

SEQ ID NO: 179546 - protein, 223 aa, Triticum aestivum
  unsure (1)..(223): unsure at all Xaa locations
  Clone ID: PAT_TA_73964.pep
GTSLCVCVCVCLINSLLREKVHIKSNKPFIVLEGEGRDHYYRSFNRVSTFKSATFRCDASDFQARNITFKNTYTIDNNTVPAVAAQVSGDRSAFYNCGFVGXQDTLNDQQGRHYYENCYLEGAVDFIFGHARSIFQGCTLWTCKLPSWKYTGFLTAQGRESLSEDNGFVFKECTVDGVTPVYLGRGWRFCSTVIFYRTFLSNIIVPQGWDAWNAKGHETSLTM

SEQ ID NO: 179547 - protein, 170 aa, Triticum aestivum
  Clone ID: PAT_TA_73965.pep
ARDPPPPRAHPRRKQQLRRRRRDSAGDGGRAPGRGRRAGLARRRRLRPRPQRSVMHHRPVVFVVGVHGRLRRAAPAPAGAHGGYRRERARKRHQQRCHARHGALAAAADARRPHDDPRTTAPPTGRVAAAAARRRDVVVGSDLAPRRAVRRRRLPGAGVRRRDHVGRLRR

SEQ ID NO: 179548 - protein, 88 aa, Triticum aestivum
  Clone ID: PAT_TA_73966.pep
FFFFFFFFFFFFFVFFFFAGAGAGASPFLGLHSSFCLKSSSIHTYTHRGQPRTSCRLIASLATSTRREQERHNNRKDFTRANRGNTAD

SEQ ID NO: 179549 - protein, 86 aa, Triticum aestivum
  Clone ID: PAT_TA_73967.pep
MGYLNLRGSLLPLLCLHLLLSLFVSLATADIASEKQALLAFSSAVYHGKKLNWDQNISLCSWHGVTCAEDRSHVFALRVPAAGLIG

SEQ ID NO: 179550 - protein, 170 aa, Triticum aestivum
  Clone ID: PAT_TA_73968.pep
GETLEVDPGLTEFICPDCATPQSLPPELMPPPPSRRKALPLPRAAADVRGARLPCGSCGALLSVPVGLARCACPVCGAELAVDTARLRHYLLSSATAEGAVPVVPLGDPSAPPILQAQQVRQEHPNFGIRAGLLWTDPDNRTNCMGQVQTNQPNQLIPEQADLDNPGSTI

SEQ ID NO: 179551 - protein, 76 aa, Triticum aestivum
  Clone ID: PAT_TA_73969.pep
ITSVLTSSSMSCEFVMPSSPSFSSSHDSIIALFYYCFLVYRAGRGLQFMILMQYLPVSLLGCPYSYFLNSVGESYF

SEQ ID NO: 179552 - protein, 230 aa, Triticum aestivum
  Clone ID: PAT_TA_73970.pep
PAWLDGMLDEDEKFFKANGVPLFSSHMIDLSEESKEENIQTSKKYLQRAAPMKQFLEMEIGITGGEEDGVNNEDVDNNSLYTQPEDIYDIYREFSEVSKYFSIAAGFGNVHGVYSPGNVKLRPELLQKHQQFVKEKTNAKDDKPVFLVFHGGSGSSVDDFRQAISYGVVKVNLDTDMQWAYLSGVRDYVLNKKDYLMSQVGNPEGSGKPNKKFYDPRVWVREGEKTMSQR

SEQ ID NO: 179553 - protein, 98 aa, Triticum aestivum
  Clone ID: PAT_TA_73971.pep
GHDRQAGGHHNQRSGALPLIIHLAHIITWIMLTGEIARGRTSCPKRVHFLHHDGPQPALCHRNTLVLSHIHRFTWRRSSLVLLTLGLDEQLEASGLGH

SEQ ID NO: 179554 - protein, 168 aa, Triticum aestivum; identical to SEQ ID NO: 124110
  Clone ID: PAT_TA_73972.pep

SEQ ID NO: 179555 - protein, 70 aa, Triticum aestivum
  Clone ID: PAT_TA_73973.pep
CSPPRMQYNLYVTICYSDSSIPHVNLTSCLNVLLEMWKPAVAKLDHHDFILFNCPEDRSTNLNTLAYIWP

SEQ ID NO: 179556 - protein, 159 aa, Triticum aestivum
  Clone ID: PAT_TA_73974.pep
MATPTPTPTSPASIRASGGPGAGDRWVVRAQPAAAELVERSVTTIRFLAVDAVEKAKSGHPGLPMGCAPLGHVLFDEFLRFNPANHAWFDRDRFVLSAGHGCMLHYALLHLAGYQGVTIDDLKAFRQWGSRTPGHPENFETEILRSTRRGPTKRCYFQD

SEQ ID NO: 179557 - protein, 205 aa, Triticum aestivum
  Clone ID: PAT_TA_73975.pep
PSPTTAMMEGAAQLLADGFAGSPLLGASPSPCRVEHRLGGPLGLPPVREFRAAVRAGYRAAGPVVRRSMDGLHNADDCFSPRRAIGSHYMSELLQEHQKLILFTQVLPICIKLLGHYESLDSLPRRRPVYHYWPRLELVLADSPWPDCLCFSLVDANLLCLTLFWPQGVSLVTYCYQLREEKGSMRVYITEVEKELAYHACCLVR

SEQ ID NO: 179558 - protein, 73 aa, Triticum aestivum
  Clone ID: PAT_TA_73976.pep
VGEDKDRSRFSHQQMLCFSLLVCLLLLISQSTEVVIVTCNQSVSQSKIHRQSSIGLCVSRSVNQFTAAAGHNC

SEQ ID NO: 179559 - protein, 74 aa, Triticum aestivum
  Clone ID: PAT_TA_73977.pep
IHIDVFLVTPENMVCRWWFRDAKSISSHKHLGMLSCLFLPTCYCSRLCMSYRNYDMPSVQELTGKHAFTLSKAC

SEQ ID NO: 179560 - protein, 132 aa, Triticum aestivum
  unsure (1)..(132): unsure at all Xaa locations
  Clone ID: PAT_TA_73978.pep
PTATNRWPPPATSERPAAPXQPPDAPPPAAPXAPATSATPSALVASSATRHASTVPNPPPGAEPLPEDAPRQTPPRLGEPDPVGPPTPTPKEKITGTPPSEEDDGGLPGGMPDTTPPPDVPLPPASPDGSTV

SEQ ID NO: 179561 - protein, 155 aa, Triticum aestivum
  Clone ID: PAT_TA_73979.pep
MHRAKTIAGLKYTIQAGIDSLEGSRQQLMGRLLEINKTMDNPRDDDIESQRYCPKCYDGTGSLCIQCELDGLSQGYEARLFVVKKSNNDSVIASVDEARDVQRRNYELNHFFRNKKTNEGSEVGGNNDNPRSVRENIQAASLYRSIGILLKPRLL

SEQ ID NO: 179562 - protein, 196 aa, Triticum aestivum
  unsure (1)..(196): unsure at all Xaa locations
  Clone ID: PAT_TA_73980.pep
INDQEEEIQLSAMESFRVNYFLVIVDNAILSLTSRFDQLKKFEKVFGFLFNXKNLKSLDDSKLQECCATFAKAFSDDKSSDVDLHDFVSELKVLQVTLPDGLMSALEILQFVMAVDCYPNVSVAYRILLTVPVTVTSAERSFSKLKLLKNYLRSTMLQDRLNGLAMCCIEKDILDNVDLDCALNDFASRNARRNIF

SEQ ID NO: 179563 - protein, 95 aa, Triticum aestivum
  Clone ID: PAT_TA_73981.pep
HVLLWMLQTGFRQQFQKKGIGVLARSSNQGGYAKKKSMEISIPRTISWHFLSYINYLLREKICKTRVESIECTIVMLWPTLFSKFLLFIQSVFQS

SEQ ID NO: 179564 - protein, 92 aa, Triticum aestivum
  Clone ID: PAT_TA_73982.pep
SGMAVGCGWQAFVAYVNVGCYYVVGVPLGCVLGFYFNLGAAGIWCGMIGGTLMQTVILVWVTIRTNWDNEVAEAMKRLHKWEDKKPLLAVEE

SEQ ID NO: 179565 - protein, 210 aa, Triticum aestivum
  Clone ID: PAT_TA_73983.pep
RMLICDRCDEAFHLLCCHRRIKKIPDNDWYCLDCSRKKPKRQREMLPSTKGSAKHIQRPLQVLGSKGDMLTNAEPYETQVRIGRDFQAEVPEWSGPISGSDDYFVEPAELDATEMTNLSLSLRREDKKTSIGNWIQCQEVLDTGAICGKWRRAPLFVVQSSDWDCSCSVLWDPIHADCAVPQELGTAEVLQQLKYINKLKLRLDSYKQKR

SEQ ID NO: 179566 - protein, 121 aa, Triticum aestivum
  Clone ID: PAT_TA_73984.pep
ASPMAMVFMVLFVHQIYLNHQSLSGSFMYVGHAQALLKRICDTTRHQAEQILYFFFFFLPTITFFSQHGRMDEFKLWLLFWVCNFFTGSAILWDLFGAFLIYIINLKVRRFLWYLQELLLK

SEQ ID NO: 179567 - protein, 64 aa, Triticum aestivum
  Clone ID: PAT_TA_73985.pep
FSSCSSLVHPWYNITCKYTQLLCVKKFIPNLRKNKGYLSTKDCFMILCPIFCDLITCLYSLSNL

SEQ ID NO: 179568 - protein, 116 aa, Triticum aestivum
  Clone ID: PAT_TA_73986.pep
PAFLFWLVLEYDIEGNLQLHISLYFFLQKNDVCPLWHKHEWLQKMWSLQLQSTIPICYAMPPMGLYGWIMSYLLLRLGPGAECHICSMSARLIIDGISWPILNKITCFGGFFCRIF

SEQ ID NO: 179569 - protein, 239 aa, Triticum aestivum
  Clone ID: PAT_TA_73987.pep
SIFMEYLDKFVVVYLDDILIYSKNEEEHAEHLRLVLEKLREHRLYAKFSKCEFWFTEVTYLGHVISGKGIAVNPERVQAVLDWTPPETVKQVRSFLGLASYFHRFVENFSKVAKPLTELLKKDKKFEWSPQCEHSFQELKRRLTSAPILVPPDFTKDFIIYCDASRQGLGCILMQDRHVIAYASRQLHPHEDNYPTHDLELAAVVYALKTWRHYLLGKRCEIYTDHQSLKYIFIQPDLN

SEQ ID NO: 179570 - protein, 205 aa, Triticum aestivum
  Clone ID: PAT_TA_73988.pep
FIETGSELRSNYSEVIAPHDVAVYGALCVLASFDRSELKSKVIDNYNFCNFLELVPEVRELVNDFYASRYGSCLGYLEKLKSNLLLDMHLHGHIETLYKDIRHKAIIQYTFPFISVDLNLMAVAFQTSVSLLEKELAALITDNKIQARIDSHNKILYASHADQRNGTFQRALQTGNEFERDVKSMLLRANLLKHEFSQKAAERKV

SEQ ID NO: 179571 - protein, 148 aa, Triticum aestivum
  Clone ID: PAT_TA_73989.pep
PAHYPPPRPQPTPDLPSHGAASRGQNAGERAASRRASEAAVSRRGGGFFAEPHGGEAGPGVHRLQAGGRREGGRGRLVGHPGLRALRRPRGLQPRVASLVCALVSTLTCLYTVVIKRSTVYFPCCELQNTSFASLSFPPFFQTEKQGC

SEQ ID NO: 179572 - protein, 145 aa, Triticum aestivum
  Clone ID: PAT_TA_73990.pep
MTKMMPRDTTAMVPSGSGNPAIAAAAAGKIPFSQLTRTNYAAWAMRMKYLLRAHSAWGVVDRESPSKEVDESKEELAMTIISQSIEDATLLRVAEKESASDVWAALRSMHVGVERIRESRIQSLRSEFDNLKMADGESVDDFATK

SEQ ID NO: 179573 - protein, 159 aa, Triticum aestivum
  Clone ID: PAT_TA_73991.pep
RRHTFVKENIKRIKRSQCRLPSPLKHQNDTYAHDTKLGLPQDSLPCSRLHPVPISASPNSTSRQAAVRQQPDRYHNTAFSPSPFLPHAASSPSSTLLIPHGRRLMRRQLPTASGFLTAPNDAFKIDMARKDCGEGEDSGPRRSADAREEKGGSGEERSP

SEQ ID NO: 179574 - protein, 191 aa, Triticum aestivum
  Clone ID: PAT_TA_73992.pep
KFLQSQSLIIPMLWSSIATLLLHIPVCWLLVFKTSLGYIGAALAISVSYWLNVFMLVAYIGCSNSCKETFSRPTLDAFSGVGVFMRLALPSALMLCFEWWSFEVIILLSGLLPNPELQTSVLSTCMTTITLMYTIAYGIGAAGSTRVSNELGAGNPEGARLAVRVVMSIAVTEAVLITGALLASQHILGYA

SEQ ID NO: 179575 - protein, 83 aa, Triticum aestivum
  Clone ID: PAT_TA_73993.pep
KRHQMGQYSSLFFILIYFSLIFCLNSILHGIFLFYFIYTPYPRMAVFGKSPYPYPRLSVPVSVLFRSSLCPCTWDSIFYFPAV

SEQ ID NO: 179576 - protein, 150 aa, Triticum aestivum
  Clone ID: PAT_TA_73994.pep
YSRAAGSLPPPATLNHHVTALQLTPPPETHCPNPPSTSDRVVVAHLLLTTLRLGRLATSGSSTSASWRSALHGLLQHPRDVVGNMRALASGGVALHAWLPDPSLSRIQSFLGRSPRRCRQPPQRTGHSFPHLAIAMDGTTVTPGGRSPLR

SEQ ID NO: 179577 - protein, 216 aa, Triticum aestivum
  Clone ID: PAT_TA_73995.pep
KSRPTPTLPPSPSPSSSSMHPVLIFLLSLLVLPSIFWLVIKSSPSYFAITKRRMGVMSMIASSTMTVLSLPYVLEFIQASGNVSLMDERRDRDHGSEGEEATGRKQLGNVICMTFAAYLVADLVVGRKYYRKDLTVVNGYIHHHVYAFIVIGAVATWQTSLFALCALMELPTFFLALANTFPKQRNDWAFASTFLATRIMLHAWICWAYGVWVTEG

SEQ ID NO: 179578 - protein, 70 aa, Triticum aestivum
  Clone ID: PAT_TA_73996.pep
HDPRGPEAAHPRTHRADAAEEREPRPRRPSPAPRASGRPGARLINWRRHRTEDPDYYFGHGDGTNVRIIL

SEQ ID NO: 179579 - protein, 194 aa, Triticum aestivum
  Clone ID: PAT_TA_73997.pep
GTRAGGYAVLMAGQLVAGVACGFGLVVAPVYIAEMAPAASRGFLSSIPEIAGNTGILLSYIADFALAGFPNNVNWRLMIGVGALPPLFLAVATLLAMPETPRWLVLHGHHDEARLVLARTTGDAALADRRLKEIVSSAQESSKQAVPGGSDGTTRSTSVWRDILIRPTRSVRRVLLAILGLQFFQQASGVAALV

SEQ ID NO: 179580 - protein, 39 aa, Triticum aestivum
  Clone ID: PAT_TA_73998.pep
TLISLDTNLNIVEYYQSPSLHIIYQYITKFLYFVLLFMV

SEQ ID NO: 179581 - protein, 33 aa, Triticum aestivum
  Clone ID: PAT_TA_73999.pep
LDVIQLHTVHMFHMLGWVVLILVSRGALLTKAS

SEQ ID NO: 179582 - protein, 168 aa, Triticum aestivum
  Clone ID: PAT_TA_74000.pep
RHEAYAALTRLRGEYQELDTSPFRHIAITSDIGAEGYYTAAYSTVTREPFYHQNLVLHADGLDRANRALRHELYTTRQHLYRALKMLHPFVGSGELPRSAIYPARTVMPQGVGWPEVGGYSPALGPLLPLERQVLHQSTRGPQVADVVYPLPHYQLSGYSYLRSTASD

SEQ ID NO: 179583 - protein, 212 aa, Triticum aestivum; identical to SEQ ID NO: 159807
  Clone ID: PAT_TA_74001.pep

SEQ ID NO: 179584 - protein, 102 aa, Triticum aestivum
  Clone ID: PAT_TA_74002.pep
KLPAEQMVELAVGRNTLKHVKKSALVKTKQKENIGTTRTGLMVWELRELMGGTTGEANLAEICICFSKMMCCSVDDHHHASNVKVLDPYMHSISASSKGSSI

SEQ ID NO: 179585 - protein, 102 aa, Triticum aestivum
  Clone ID: PAT_TA_74003.pep
EAPPACLPIASPERRPLLPPRRWPTSLLLPPRRRPAHWLPVAWPPLAQPPSRRCHGRATASQASVQRHNTKPFDVAARENSQATEGPRTFTVGTIVRSPTQR

SEQ ID NO: 179586 - protein, 46 aa, Triticum aestivum
  Clone ID: PAT_TA_74004.pep
CKLLDSSGKIISIVYFCNYLLAFSCSTIKVEIPTRNGSDWYSLDLN

SEQ ID NO: 179587 - protein, 180 aa, Triticum aestivum
  Clone ID: PAT_TA_74005.pep
ALLRQQGTEPSPAEDAALSSREVTTVESPCHASASTFLPLPGPYVCADLLDSLLHEIIALFNSFQDFLAFIGTCHSWRTAVSTFPSVYTFSFPPLHFKPDGPYVHPHSGDVKPILLSNCRWQLSDPTKKNLSLVCSVPENSPNAMHYLGCSYGYLIFSYEEHCLLVDVYTGTNVKPPKLP

SEQ ID NO: 179588 - protein, 173 aa, Triticum aestivum
  unsure (1)..(173): unsure at all Xaa locations
  Clone ID: PAT_TA_74006.pep
RTGAKTNYLNEQFLSYYAQLLLRXLHQXGKTNLSHDGLNPAHVPYXWVNNPTLTEFCFGMIGRADIEGSKSNVAMNAWLPQASYPCGNFSGTSSLKFRGTKGSXATLSWFVFTLKIKIKGTFTLLFYLRFLFSMSPXLGHLRYLLTDVPPQPNSPPDNVFNPDQPVKDLNTKR

SEQ ID NO: 179589 - protein, 57 aa, Triticum aestivum
  unsure (1)..(57): unsure at all Xaa locations
  Clone ID: PAT_TA_74007.pep
AGFTPLLHYLXDNKEIIPMEYPYGSRGPAVLDDFTSSYGYKFSDAAGYQWPMNEQKL

SEQ ID NO: 179590 - protein, 198 aa, Triticum aestivum
  unsure (1)..(198): unsure at all Xaa locations
  Clone ID: PAT_TA_74008.pep
KKCEAETFYRLPYLFYLDQILEKKFSGVVDGMCPRYKNVIETCGMGCLLNFVRTEVPLRLVKWLASRFDVPSSEFQLKKKFIPITKYDIHNILDLPVDGEPLLCDPESGRDFVLSHFNLSSIPPVSFFTKKLKSSEVELPDDDIFICFMIVAFSSFLCPNSSLSPSPKYLHIFNXVDLFASXDLSQFVYEWLLCSIKK

SEQ ID NO: 179591 - protein, 102 aa, Triticum aestivum
  Clone ID: PAT_TA_74009.pep
LPPPSLPHVSTGECIKLDLPELRDHETLGRTSEGLLFLLHKRTNIRLLNPLTRHLEELPPLITLLPPYRQTASMDVHCLWLDIALFRCPQKFFPPSVLTLST

SEQ ID NO: 179592 - protein, 162 aa, Triticum aestivum
  Clone ID: PAT_TA_74010.pep
QGGGRCRRRGGVLNLPARPRSGRCRGACATPPPRAALRRPVIVPAAQTPPPHRPLRRHSWYPGSTRPLLDSRLTRSPLLLGVPQERSIRLHNWRDASSPLLDSNTGTEPSAEMEDAALYGALAVAWLPSLGERQAYPFSPTGLLSVLLARDLWAIVEHQRTI

SEQ ID NO: 179593 - protein, 139 aa, Triticum aestivum
  Clone ID: PAT_TA_74011.pep
FFFFFHNLHRSRRYATTSSSFTIQIMVLFRSLEEIETKQTALLCVNTKRRRATNVAVILSPDVALMTSLLPASREWHPLDQQLCQHPTPLSHTPEPCHCQPTTSCAVLCCQHRWTSLGPASFHCPLLKYIFFPFSCKRQ

SEQ ID NO: 179594 - protein, 165 aa, Triticum aestivum
  Clone ID: PAT_TA_74012.pep
LRPHSAASSSVATTSLFPISPHTCPSPSIAAACTFAVPPLRGAAARTRICQRLKEKSLHRAASAPPSKIHFQDVVSGYCGLLIGSPIILYEIIAFVLPGLTKDERKFLGPIVLGSSVLFYLGILFSYTVLAPAALNFFVNYAEGAVESIWSIDQYFEFVLVLLFS

SEQ ID NO: 179595 - protein, 81 aa, Triticum aestivum
  Clone ID: PAT_TA_74013.pep
HQAKKLKGAILGKSVYSTCIDHHKTETEINIINQQKTKIFFSESMRTNGVETENNFKSLKDKKELQYYRLTELIFSREDLC

SEQ ID NO: 179596 - protein, 81 aa, Triticum aestivum
  Clone ID: PAT_TA_74014.pep
APAQGMCSSSIQFFFFLFTSSFLSLSLSLCLTKKLCVPDTCLFSLNKTSQSTDRRDFVLQKGYHRSKYGTSKDGRIFFKMG

SEQ ID NO: 179597 - protein, 50 aa, Triticum aestivum
  Clone ID: PAT_TA_74015.pep
MATFADLEACVWLEETLKKFDRILVISHSQDFMNGVCTNIVHMQNRKLKL

SEQ ID NO: 179598 - protein, 239 aa, Triticum aestivum
  Clone ID: PAT_TA_74016.pep
MEALREATAELTVYVHPSNAADVRCAVSRQLSTLLFSYEDRFDGVLLSHEVEFEGDNEDDQDRKVDGDGKKVINAKILDGLVPYFGVPVTANLLLFSPQPEMILEGKVEMLGKESIHAIVLGVFSAAIMSDDIPETFKFKRRGHGGKFISQSDKRHVIKKGSMIRFSVKRVDTEMNCHITGSLMPPHTGCMRWLSVHDTEYASEISSGKRKPRDHTKSEQKVQDCTTANREDSVVNSER

SEQ ID NO: 179599 - protein, 133 aa, Triticum aestivum
  Clone ID: PAT_TA_74017.pep
MQAAITTVASANPHLKPLVSSLRPSPPHRVRVHPPRHRPSTRASAMASSAPQELTITRPDDWHLHLRDGDVMATVLPHSARHFERAIVMPNLKPPVTTTARAIAYRDEILKALPPGSSFVPLMTLYLTDSTSP

SEQ ID NO: 179600 - protein, 96 aa, Triticum aestivum
  Clone ID: PAT_TA_74018.pep
RVVSAITTDVSWMEERKIKEKTSNLLVSQIFYPRHRIANNLLVLENSQHYPANCWIRYTPSLYLIFQKILLESSHGKDKRSKDLHRQNTEAILNIY

SEQ ID NO: 179601 - protein, 94 aa, Triticum aestivum
  Clone ID: PAT_TA_74019.pep
PASSNMNSFIAVGSIGSNGLECMDSPLTFLPPTYKHPHLLEDSVTHDCLLVLAGCMEKIDCWPHPLWRRGAYGCRGTGSCAASAGAGRQAGMGI

SEQ ID NO: 179602 - protein, 133 aa, Triticum aestivum
  unsure (1)..(133): unsure at all Xaa locations
  Clone ID: PAT_TA_74020.pep
QEIADALAAEPSQTAADWPDITTRVFSMKFKEFLDGVKDDLYLVEFQKRGLPHTHXLVWLKADTKNPSPSFIDGLISAELLDPLVDPLGYALVDEFMVHGPCGAYNAKCACMKNNCCSKRFPKALSDGTMVDH

SEQ ID NO: 179603 - protein, 96 aa, Triticum aestivum
  Clone ID: PAT_TA_74021.pep
LVIVSCLLSKIASEAAPCNSGSTLLKTLAAIPVKTCCYFTLFERISSNTDIMCHNNAKFCQFQCESTVRLNINVWHIADLTIFFSACRNVSDYILF

SEQ ID NO: 179604 - protein, 75 aa, Triticum aestivum
  unsure (1)..(75): unsure at all Xaa locations
  Clone ID: PAT_TA_74022.pep
TFINANVGSAPDVYFQTYRVEQQDGDGAPNNDAHDRVYITLPKXHHVLRKVGDCRHCGALRFQYEGPAFCLMVSS

SEQ ID NO: 179605 - protein, 65 aa, Triticum aestivum
  Clone ID: PAT_TA_74023.pep
SAREQPQQHLASTTAAAASATTAAATDANTPDTQSIIRPARTCCWPKGMFPLVCCLMHVASVPNI

SEQ ID NO: 179606 - protein, 71 aa, Triticum aestivum
  Clone ID: PAT_TA_74024.pep
LEWISSTTCMDGFTRNNTYPVLQKKQYICLLFICYVKWSSFKASELFCYCSTRKVQASKNQKMPLELSSTS

SEQ ID NO: 179607 - protein, 69 aa, Triticum aestivum
  Clone ID: PAT_TA_74025.pep
TRMWRRALPMAPEAARQEPPSRGGKSPSTRPLRLRHQGPTAPDPGASSRRRSRRLLMHLVMAGVAIQST

SEQ ID NO: 179608 - protein, 209 aa, Triticum aestivum
  Clone ID: PAT_TA_74026.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAQGPRDHAPAPAAAAPAQAAAAPKKAKK

SEQ ID NO: 179609 - protein, 138 aa, Triticum aestivum
  Clone ID: PAT_TA_74027.pep
LLSGRNLDDYVQVKHILVEMGVYFQSQDDYLDCFGDPEVMGKVGTDIEDFKCSWLFVQALVRVDERQKDILFENYGKSDPACVAKVKALYKELNLERVFSEYESETYEKLISDIEAQPNEAVQAVLKSFLHKIYRRRK

SEQ ID NO: 179610 - protein, 81 aa, Triticum aestivum
  Clone ID: PAT_TA_74028.pep
SFNENEDVLIVIEVTHIKELHRTGDLLFKFLAANRLNFGQHIFKNKHGTTTIRKWKTAAATIQLYIFYKMGLPKGTRGIRV

SEQ ID NO: 179611 - protein, 121 aa, Triticum aestivum
  Clone ID: PAT_TA_74029.pep
MAKSGTEEWRRNADTHKMSPEEVRAAGVEASMRPPGRGGGAGEVLHQRGGRLPYGPGTMALMGFGIVGAIGYLVLYQKARPGTPATEVAKVAVGHGDPAVGREVQKRQDEAQPPPPPREGK

SEQ ID NO: 179612 - protein, 88 aa, Triticum aestivum
  Clone ID: PAT_TA_74030.pep
GTSSRSYLGGLWSARDGVSSPAERNLGTARLCSLDCSGVLHILNPIRVVILFVTSECFWATYEISVLVCALNIQGRNCLFCRWLVFPN

SEQ ID NO: 179613 - protein, 150 aa, Triticum aestivum
  Clone ID: PAT_TA_74031.pep
FSNNNQLGYTTSCGFFQLAHYLYLPEMRSNETENSYITVLFSHKLPRDDFQQLFLFAEKLSQCLYIRCQYAICILPCCFDISYRVMVFQQLFSILVKVIVVFVRKLLDMRLIYYHGIFACYRGMLFNPLVKLPWYLYIGYGACGLYITVT

SEQ ID NO: 179614 - protein, 99 aa, Triticum aestivum
  Clone ID: PAT_TA_74032.pep
MQFTHYTPGQKLNSGPASATQTLQIFSIKLTEIAVGLKWPLSVYGLVAVRDVADHNRNLLFSRNRSQAQELKEDDRILRLIGPSRAIVFTDRVDFEIQL

SEQ ID NO: 179615 - protein, 182 aa, Triticum aestivum
  Clone ID: PAT_TA_74033.pep
MGFAERAVAAAGAAVVSAVLVNPLDVAKTRLQAQAAGVVYNPIWSDFRCYPWCNPGGLKLSGLGPSCSPECFQYRGTMDVFSKIARQEGIFRLWRGTAASLALAVPTVGIYLPSYDLLRNWIEEYSDHSYPKLRPYAPLIAGSIARSLACITCSPIELARTRMQAFKQSNGGAKPPGMWKTM

SEQ ID NO: 179616 - protein, 114 aa, Triticum aestivum
  Clone ID: PAT_TA_74034.pep
ERPPLLWYTVLVWQCSLMCIVENVASFMPQFSAHGTFRFFAFCLGAQSLWSGSSSSGGEGVEWSQGARVGSVRTSSGARRSRAGGRTGERGGPGGATARRRRRRRAPWRPVKGL

SEQ ID NO: 179617 - protein, 50 aa, Triticum aestivum
  Clone ID: PAT_TA_74035.pep
TVSYIEVRLNEYWNHISTSNLSFIYPRSIKPKEPHRFNQGTLDIHHTKIE

SEQ ID NO: 179618 - protein, 199 aa, Triticum aestivum; identical to SEQ ID NO: 171579
  unsure (1)..(199): unsure at all Xaa locations
  Clone ID: PAT_TA_74036.pep

SEQ ID NO: 179619 - protein, 161 aa, Triticum aestivum; identical to SEQ ID NO: 129051
  Clone ID: PAT_TA_74037.pep

SEQ ID NO: 179620 - protein, 131 aa, Triticum aestivum
  unsure (1)..(131): unsure at all Xaa locations
  Clone ID: PAT_TA_74038.pep
GSWGAPTFPRGVFKFGQKGFFSEFYPPRAGPCKKLAPFFEKATPPLQKKKTLVFPKMXAPKNVPSEFXVQGFPPLFFVPPSGKKVSFKGGRPAPEFVSFLKKNKEIFGQAVSADPKKAGEPASPEPLKDEL

SEQ ID NO: 179621 - protein, 104 aa, Triticum aestivum
  unsure (1)..(104): unsure at all Xaa locations
  Clone ID: PAT_TA_74039.pep
LYRAYCQLTDCLIGGCHADXLINRSLRDICCHSGNVAHYQPLMRLTMPHFYRLGHAVSGIXPRIHFVLSGGGMPIYLPSPEXHNMVTCLHTEFEDFPSLAGPKA

SEQ ID NO: 179622 - protein, 130 aa, Triticum aestivum
  unsure (1)..(130): unsure at all Xaa locations
  Clone ID: PAT_TA_74040.pep
KKSQKEKKKKKQKRKKGNKXIKKERXKNRKKREEILKGARKHKXRRKKKQSKKTRGNNEKRKEKNSINKKKKNRNRGEKXRRKDNRKHSKKREEEIRQITTKKRSDDQGKETIRERKKKNNHENRGDMTT

SEQ ID NO: 179623 - protein, 87 aa, Triticum aestivum
  unsure (1)..(87): unsure at all Xaa locations
  Clone ID: PAT_TA_74041.pep
GQQQRHKTHPADHEDDYLYTRVLIGESQVAWSSILSRYTRSEHCLEYXFSIRDQFVTRTLQVQCXILKGQKXNTAGQERYRAMTXCY

SEQ ID NO: 179624 - protein, 109 aa, Triticum aestivum
  Clone ID: PAT_TA_74042.pep
GLASLCSAFNASSSARLCAVRPPLWLRAKSPLCFGELAKPAFQIQPTNHVVAVLCQHITCCCSIVASSPSCERQAHQRQTEQTVHYSNTRTQRRLMVTILGSVVPSTDN

SEQ ID NO: 179625 - protein, 55 aa, Triticum aestivum
  Clone ID: PAT_TA_74043.pep
KKFHRLGEVLKTNPLNYLFCPPAKSPGPGRKKKKKKKKKKKKKKKKKKKKKKKPR

SEQ ID NO: 179626 - protein, 168 aa, Triticum aestivum
  unsure (1)..(168): unsure at all Xaa locations
  Clone ID: PAT_TA_74044.pep
ERESXXRSLLPLLHRIADPVLSLAPSPHPQHPHLLILTHPPRLHHPLRPCTRPTIHVTLHRPHAPLPLELTHLPLSHTLLYLGSYPPALLLLMPSCPRIHSSSPSCTPLPVLILVAMGTPLVIIVSHLTALDSLHNKGTLLTLASPRTSILTLPSCLAIPLPASPVHP

SEQ ID NO: 179627 - protein, 91 aa, Triticum aestivum
  Clone ID: PAT_TA_74045.pep
QLHIRPSSFISSQSMSTPSLHSSKAMHQLAIVRVIVRQSFIRLLDSGFGASGVRRFRHQQSVVALPMMTHPMFYLKDLSQAAASFISVPLE

SEQ ID NO: 179628 - protein, 175 aa, Triticum aestivum
  unsure (1)..(175): unsure at all Xaa locations
  Clone ID: PAT_TA_74046.pep
RERERERERERERERERERASPSPPPGERQSNSEREAEIVIFLEPGKAVILLHGRCAGEKVVIVRVFGEGTRHRPYWLCLVAGLAKYPEMVIRLVSDKNTDHTFRVMVFLKLVNFTHLMPTRXPLHVXLKEVASGAPVSLTYKDKNVGAAYAAKANLEERFMTGQNMCFFTKLQF

SEQ ID NO: 179629 - protein, 141 aa, Triticum aestivum
  unsure (1)..(141): unsure at all Xaa locations
  Clone ID: PAT_TA_74047.pep
QGLQGYYTSSTDXVVQGHEPXQGRQGHCRIMSXETGQAQRPRXGQHVGQVHQPGHGQQGYYPISMLQTGSGHQSGQGRPSYHGHLLGQRQLSGQERLXFDIPYHVXTEHQTASPXGNVLQPATQMSNMCAMWGGDALVAFQ

SEQ ID NO: 179630 - protein, 116 aa, Triticum aestivum
  unsure (1)..(116): unsure at all Xaa locations
  Clone ID: PAT_TA_74048.pep
ARRRERTPRARPNGGGGLEAADGGAKARAGGGGAERGGEDDGEGGHEKXGGGGWXGATRAAGTSGARNGGSARAGGGGRGGCSPGLGSGGARASGGTGRAPGGAASGRAGGGRGAA

SEQ ID NO: 179631 - protein, 168 aa, Triticum aestivum
  Clone ID: PAT_TA_74049.pep
FPLCPSKQKKSRGGARAPDSPYRAVVFLFPARLFTPLCLRTPLSSSTFSLFRTFPLSSFGVLAKKPAPFPLFSFFTVCFSYWLFLAFLFFYLSPFLLFLFLLFFSHWAHFPHFPFYLLQFLPFFAFLFFRFCPILLFFPSLGLPLPRLLYPFFLFFPLSFTFSPLYSF

SEQ ID NO: 179632 - protein, 86 aa, Triticum aestivum
  Clone ID: PAT_TA_74050.pep
YRRTVLPYRLICRYSGPHGGFERGRCALVRRLEISRAGPDRRGSDSSPAPPRGSGRTSGRSSSPSASSATLRRSTFLPYPWSGACR

SEQ ID NO: 179633 - protein, 113 aa, Triticum aestivum
  Clone ID: PAT_TA_74051.pep
AGHVSTVINPQDHKDIVVYVIKPRGVNVLWVIYDFVALNIDTQFRDTLRQSDRASGTRLRYVLQRSHGQGVSFITPSQIRASYSMPARYRRGQGLPHGQWSKIALCLIHRSAG

SEQ ID NO: 179634 - protein, 82 aa, Triticum aestivum
  unsure (1)..(82): unsure at all Xaa locations
  Clone ID: PAT_TA_74052.pep
TYLTKNVTGNLNQNVEWWKIAHCGLXNCHNGPRKPLRVRGLSRSFLQHGRRGVCPSKLVITVATVQGSRSSALCHLAANELY

SEQ ID NO: 179635 - protein, 209 aa, Triticum aestivum
  unsure (1)..(209): unsure at all Xaa locations
  Clone ID: PAT_TA_74053.pep
GVGKRKERGEEGGEKRLGEWKKKRGWVERKRGEEKKEGGKXEVGEVEEKEGTKKREGRWGGGGRRGKKEEGESREGEKVRREXDGKGEKEGRERDEESGKXEGDRREEEKEVRGDKVRKEREEEEEGKGEKEGRGGGRGEGRRKDGKGEEERREGRRRGGGRKRRGRGNIGGGRGGREEGGRGGAKRRMSIMIEGWGKEIGKCDGRRGG

SEQ ID NO: 179636 - protein, 82 aa, Triticum aestivum
  Clone ID: PAT_TA_74054.pep
RERERERERERERERERERERERERERERERERESEREREREREHTHKHHRARVGGHHEEHAQARSSDLHGEKRSCASGHYL

SEQ ID NO: 179637 - protein, 193 aa, Triticum aestivum
  unsure (1)..(193): unsure at all Xaa locations
  Clone ID: PAT_TA_74055.pep
RVQYDEGLQELCDASGMLLPVSELSRCLAVRGSLCYCMLHERGGALXGSLIRHEYAAIFLRSVSLSASFDLWFRMLVARRLKRQEWASCADLPSHDMTLRDELTSVLYRRRTFFDRVGVSTSRASTSXVSALAPLLALTDXERYLPVSTGITAVFPKGMSKDRRVILRLIRASRGPXTYKLESRCPSLRIRWF

SEQ ID NO: 179638 - protein, 266 aa, Triticum aestivum; identical to SEQ ID NO: 171581
  unsure (1)..(266): unsure at all Xaa locations
  Clone ID: PAT_TA_74056.pep

SEQ ID NO: 179639 - protein, 107 aa, Triticum aestivum
  unsure (1)..(107): unsure at all Xaa locations
  Clone ID: PAT_TA_74057.pep
MRVNVQPLIGQDQQQVQGFIGCEHQXPLVVGHVWFQPQQXAHAXIGRSVPHQQLAQGSVYQPPQRAQRKGMTSLALRILSAMGRANVPLYKARTSVPFGAGAGVGAL

SEQ ID NO: 179640 - protein, 97 aa, Triticum aestivum
  Clone ID: PAT_TA_74058.pep
NQPLFCPSQTAAHTDVDLYVEVHKMGQNTHITHHIHPERERDQLNPLNIHLVICINRPLQINCRKFSIFPQLKVMPTRYLPSHLKDLRVSIFFLLAA

SEQ ID NO: 179641 - protein, 72 aa, Triticum aestivum
  Clone ID: PAT_TA_74059.pep
RARHRVESHSLYYCHIRILHNIGMFLHFDVNSLFPGCAPILSTSRNSALQRNPRKKRRHWRIRLQFLEIAPD

SEQ ID NO: 179642 - protein, 186 aa, Triticum aestivum
  unsure (1)..(186): unsure at all Xaa locations
  Clone ID: PAT_TA_74060.pep
GGSTKSIRAEQMLTNFFNVNELWKSINPYEAGVYRAAAHAAIFSDDGNNKVQNLLLLYVTPLTVALETATRVITVFISTYTDIPTQKARVIYTYSYNHAGDVIQXCKLRGLRPWSTNLIEXFELSEISXAPRGVPHITWCSDIDANVILNVYAEDKTTGQKNKMTITYDNGTAEHGRHMTIWSHYA

SEQ ID NO: 179643 - protein, 223 aa, Triticum aestivum
  Clone ID: PAT_TA_74061.pep
PRRPQQQFPQPQQPQQPFPQPQQPQLPFPQQPQQPFPQPQQPQQPFPQSQQPQQPFPQPQQQFPQAQQPQQSFPQQQQWMIQAFLQQQMNPCKNFLLQQMQPVSLGASLVGIILAPKGLAPWWHQQMVGEQLGTNFLKQLPEAGGISQRGGHFHSLWQPRNKQTEGVAESLPGHLFSDSGQGSWGFNSKPYTNQALIWEGGSGALWNWKNSFQTMLQRGMCPP

SEQ ID NO: 179644 - protein, 194 aa, Triticum aestivum
  unsure (1)..(194): unsure at all Xaa locations
  Clone ID: PAT_TA_74062.pep
MAPKADKKPAAENKVEKAAEKTPAGKKPKAEKRLPAGKTASKEAGGEGKTRGRKKGSKAKKGVETYKIYIFKVLKQVHPDIGIXSKAMSIMNSFINDIFEKLAXESAKLARYNKKPTITSREIQTXVRLXXPGELAKHAVXEGTKAVTKVTILYNGRVQVGSASASGLLTLLIYLSASKGGGKKTVLGEWPPLF

SEQ ID NO: 179645 - protein, 64 aa, Triticum aestivum
  Clone ID: PAT_TA_74063.pep
MESKGGKKSSTSRSLMYEAPLRYSIEDVRPAGRPQKFSGGYLNWAKKPSRYSVLGSPSPVVKRF

SEQ ID NO: 179646 - protein, 196 aa, Triticum aestivum
  unsure (1)..(196): unsure at all Xaa locations
  Clone ID: PAT_TA_74064.pep
TFTHPQQTFPHXPQQQVPQSKXPQQPFLHPQQPLSLQPQRPFPLTXLPQQPLIHQPHQPFSQTQQPQQPFCHLPHQPFDQTQQPQQPFDQLQQPQQPLWQPQQQLPMPRQPQQXLSQHHRTFIEPSLQQQLNPCKNMLLQQCQPASLVSYLWSIIWAQSDCQVMRXQCCQQLAQIPQQLQCALIHSVAHSIIMQQQ

SEQ ID NO: 179647 - protein, 103 aa, Triticum aestivum
  unsure (1)..(103): unsure at all Xaa locations
  Clone ID: PAT_TA_74065.pep
MWTVTPAYLDQRLGAVKRCCREAAMAGAKVAVVATVFCAIPTLACVMMLPWAMAHLRPTVQALIMFIVDGMAYFIWPDKTILYMARKDYFDDAAQHXKNTCLH

SEQ ID NO: 179648 - protein, 180 aa, Triticum aestivum
  Clone ID: PAT_TA_74066.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYSCHCGGGGSYRRLAGGGLPACHGLEVGFTGSWCEQDVHVVPVPWAWYGMRPSWSCAPALLVYVSCVVSPSCSCAYLSRWRGSSQ

SEQ ID NO: 179649 - protein, 55 aa, Triticum aestivum
  Clone ID: PAT_TA_74067.pep
KSLPSPKPSPPPWPPPPPPPAHSPEPPPPPPPCPSPPDSLSRATRPPSAVRSPSA

SEQ ID NO: 179650 - protein, 102 aa, Triticum aestivum
  unsure (1)..(102): unsure at all Xaa locations
  Clone ID: PAT_TA_74068.pep
MAGMAPEXGSEVDAKNYDAKMHELLIQGETDEHFTFYDEVHESWDDMCLQENLVRGMDAHGLEKPYAMHERGIVAVCDEARRYACQHKSGDTKRLATLKDLG

SEQ ID NO: 179651 - protein, 104 aa, Triticum aestivum
  Clone ID: PAT_TA_74069.pep
MTKMGSRYEVDVTVVSDRDLKNVNWRNGGLYPYAVLWIDTSARCYTRVDLYIGDNPSWDVKVVVPLPLCSRLEDAVLYIDVVHANAVEGVKPAPRIRTGDCAET

SEQ ID NO: 179652 - protein, 201 aa, Triticum aestivum
  unsure (1)..(201): unsure at all Xaa locations
  Clone ID: PAT_TA_74070.pep
MKTLLILTILAMATTIATANMQVDPSSRVQWPQEQPPPQSQQPFSQQPQQIFPQPQQTFPHQPQQAFLQPQQTFPRRPQQQFPQPQQPQQPFSQPQQPQLPFSQQTQQPFPQAQQPQQPFSQSQQPQQPFPQPQQQFPQPQQPQQSFPQQQQWMIQSFLQQQMNPCKNFLLQQCNPVSLVSSLVXIILPTNDCQLMQQQCC

SEQ ID NO: 179653 - protein, 252 aa, Triticum aestivum
  unsure (1)..(252): unsure at all Xaa locations
  Clone ID: PAT_TA_74071.pep
SIILLPFSDHLSPYLYPISPSPSPISFPHLLSLSPLPFTIHFSSPSPSYLLSIPFILLSTHTTFPHLFLLPPFLPTFPLFLPSIPSNIHPSIHSIFISSFFHSSFIHSISFRYSSFISSXHPSSILLSSTYHPSSFIHPSFHXPSIHPSIHPSSIHPSIHPSFHHPILSSHPSIPSYHSFPSHSIPYPFHPIPFPFPSPFPSPFPISHLPFLYYPLPHIPHITHISLFLPNSPLSAISPYFPHISTIPXYST

SEQ ID NO: 179654 - protein, 144 aa, Triticum aestivum
  unsure (1)..(144): unsure at all Xaa locations
  Clone ID: PAT_TA_74072.pep
KESTLHLVLRLRGGMQIFVKTLTGKTITLEVESSDTIDNVKAKIQDKEGIPPDQQRLIFAGKQLEDGRTLADYNIQKESTLHLVLXLRGGMQIFVKTLTGKTITLEVEFFDTIXNRYGEIHEQGGDFSPDPQRVYYFSRQGKLE

SEQ ID NO: 179655 - protein, 237 aa, Triticum aestivum
  unsure (1)..(237): unsure at all Xaa locations
  Clone ID: PAT_TA_74073.pep
QQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCKPVSLVSYLVXMILPRNDCQVMQQQCCQQLAQIPRQLQCAAIHSVVHSIVMQQXEQQQGLTGSLPAQLVFRLRFKGAGGIHSIPFIQTQGSKLWKGGIHRANWGNLEENTLFPKK

SEQ ID NO: 179656 - protein, 198 aa, Triticum aestivum
  unsure (1)..(198): unsure at all Xaa locations
  Clone ID: PAT_TA_74074.pep
GCVLMLSFGGGNVEPLSFFSGSVPNRPGKVFLLGGNSRATGLGLDIALWENARALAXLEIPNWGPNSSGPYAHGISPGRLRLGSRLPAIGSEGRPGMGAASMYLLGCFPCFVPSGPVFCAAMIPSTVRRSSVLRVRVVEVYGGAVVDALCVTPVLQEQIDPDRVDLHLGSHGQRHHXHPVRXYIAPVIFLVLXGAGDR

SEQ ID NO: 179657 - protein, 99 aa, Triticum aestivum
  unsure (1)..(99): unsure at all Xaa locations
  Clone ID: PAT_TA_74075.pep
RACLHHRNGALKTSYPRVVITGAWFYMSLTSTPMHGTPKGSSRELVTEHSYATSCGTNWXQPPTYLRTILDGQTHLSSRKPGPSIDRHIVXWRPFLTHR

SEQ ID NO: 179658 - protein, 90 aa, Triticum aestivum
  unsure (1)..(90): unsure at all Xaa locations
  Clone ID: PAT_TA_74076.pep
LGQVIGMMRHRFSPLCRALGLIRSGCRVLSMFVVXFYLRQRKKKIVLYTGSWYFSAESVCFCVSVYLSVCLSLEVSLFLYRYLSRSVVLF

SEQ ID NO: 179659 - protein, 191 aa, Triticum aestivum
  unsure (1)..(191): unsure at all Xaa locations
  Clone ID: PAT_TA_74077.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXPPDQQRLIFAGKQLEDGRTLADYNIQKESTXHLVLRLRGGMQIFVKTLTGKTITLEVESSDTIDNVNAQIQDXEGIPPD

SEQ ID NO: 179660 - protein, 170 aa, Triticum aestivum
  unsure (1)..(170): unsure at all Xaa locations
  Clone ID: PAT_TA_74078.pep
GKPPPPPLLPSLSLLGALSLRIDKTHMNIGGIVHVDCRRWNTTGHVLYKLGRIHRHLIVRGAHEPHAMNHRALMHPXGLDWLQDDHQSGINSDNGPWQECTAXSYRTRLDARGDRDCFXHMITACSHNDRAVLMSDDTTGGCHCWLIQCWPTPLLHTATCLSLLQGEHMI

SEQ ID NO: 179661 - protein, 137 aa, Triticum aestivum
  Clone ID: PAT_TA_74079.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRKIVRPPKKGSAVQRPRTRTPDSWFMDGVSWGIVGVPQA

SEQ ID NO: 179662 - protein, 115 aa, Triticum aestivum
  unsure (1)..(115): unsure at all Xaa locations
  Clone ID: PAT_TA_74080.pep
FTMRWGLHLCLTRAGASLPRRRLRRLPILSPSFPPCASSSTGSVFEILARKGLYLEKGYXQGLAETRPKGGKENQIKFKGVPPGKFVLFSFCKRSLSLSETYNEPMVYKQPDTSG

SEQ ID NO: 179663 - protein, 165 aa, Triticum aestivum
  Clone ID: PAT_TA_74081.pep
MATHISKKKKFVSDGVFYAELNEMLTRELAEDGYSGAEVRVTPMRTEIIMRATRTHNVLGEKGRTIRELTYVVQKRYNFPENSVELYAENVVNRGLCAIDHAESLRYKLLGGLAVRRACYADLRSVMGSGAKGCEDIVSGTLTAQRAQMMKLKDWYMISCRQPRN

SEQ ID NO: 179664 - protein, 106 aa, Triticum aestivum
  Clone ID: PAT_TA_74082.pep
PQQISPAGFLLRGSQPTTLTARRTPRIPKPANIARSSAESSGFVTTSAPRELSAAFLRVHSRHGGTLPTSSAFDCSSKRTCGMTKCTKEPVTLSPRNACSDGWWSF

SEQ ID NO: 179665 - protein, 118 aa, Triticum aestivum
  unsure (1)..(118): unsure at all Xaa locations
  Clone ID: PAT_TA_74083.pep
STRGPGPAGTPRGGRTGRPRPFRRPXVQGGGSGLVFANDVEQRPRGGGSDGGAGGGRRGGGPASRLPGGRGGGPRGSGRQGPWXQPLPPFRPVSGLGKGIRPRWKKRTRRGKEREGKG

SEQ ID NO: 179666 - protein, 64 aa, Triticum aestivum
  Clone ID: PAT_TA_74084.pep
RERERERERERERERERERERERECVLAFIAFISLFVTCAGIVVLLSRMGPSFLVRRDRLRLWL

SEQ ID NO: 179667 - protein, 77 aa, Triticum aestivum
  unsure (1)..(77): unsure at all Xaa locations
  Clone ID: PAT_TA_74085.pep
MHRSQCLPMNMTKFISVESIDRMNSLGGMFHVIHYRPRAPVETCNDEPDIVPXEPDAGHDGDDHSDDIADDGCVISD

SEQ ID NO: 179668 - protein, 144 aa, Triticum aestivum; identical to SEQ ID NO: 126361
  Clone ID: PAT_TA_74086.pep

SEQ ID NO: 179669 - protein, 95 aa, Triticum aestivum
  unsure (1)..(95): unsure at all Xaa locations
  Clone ID: PAT_TA_74087.pep
QRSTIAPPRXPPHTPXPPPRSRLPAAQMSPAPSLCRSATPPSPRAPRRRAHSAPQYREHHELGYHTELLQGYFMTSSSWVIISPLISGKKIYGLT

SEQ ID NO: 179670 - protein, 86 aa, Triticum aestivum
  unsure (1)..(86): unsure at all Xaa locations
  Clone ID: PAT_TA_74088.pep
MHHTLRAPTTAAATMGVWDAMYRLAMRRNGTYVTFLGLRAFGGXPLAHYGVYKVWQMNNGEKLYQDIYALRQRPREERTHSNTHFP

SEQ ID NO: 179671 - protein, 146 aa, Triticum aestivum
  unsure (1)..(146): unsure at all Xaa locations
  Clone ID: PAT_TA_74089.pep
GLPRYNPIAFKTLFLIARPVAINKSGPPDHKLFGLSYLRLWNKLAGEQNYVNFKTLVDRTLANTPHDPCVHPPAALQTSLPELGTEMILLSAQGQLEXFPFEEHTDPPVXGLGGFGGDVESPTAGLEWEVQDQTDYHAWGSSLSTG

SEQ ID NO: 179672 - protein, 175 aa, Triticum aestivum
  unsure (1)..(175): unsure at all Xaa locations
  Clone ID: PAT_TA_74090.pep
MKTLLILTIIAVALTTTTANIQVDPSGQVQWAQQQQPFPQPQQPLSQQPQQIFSQPQQTFPHQPQQAIPQPQQTFPHQPQQQFPQPQQPQQPVAQQPQQQFSQPQQPQQPFAQQPQQQCPQPQQPQQPFSQPQQPQLPFPQQPQQPCPQPXQPQQPFSQVQQPQQPLPQPPQPEQ

SEQ ID NO: 179673 - protein, 166 aa, Triticum aestivum
  unsure (1)..(166): unsure at all Xaa locations
  Clone ID: PAT_TA_74091.pep
MKTFLIFALLAIAATSAIAQMETSRVPGLEKPWQQQPLPPQQQPPCSQHQQPFPQHHQPIFLLHNQQFSXQQQPVLPQQQPVIILQQPPFSQQQQPVLPQQPPFSQQQQQQQQQQPPFLEQQQPGVPQQPPFLQXQQPPFLQEEPPYYNNPFFTKHHKFPTTKTWW

SEQ ID NO: 179674 - protein, 69 aa, Triticum aestivum
  Clone ID: PAT_TA_74092.pep
ALGEGIDHETRQDMDKKVKEVDSSNYVRNQAKTVDVSLTLSHYLSLSLSLSLSLSLSLSLSLSLSLSLS

SEQ ID NO: 179675 - protein, 109 aa, Triticum aestivum
  Clone ID: PAT_TA_74093.pep
VRADHQVVYVQQSDAYFITMCPAHAASTPWSVAFREQQGVIDDDIVKVAGDRVSTPTPTAQPTSDSTALSLSVSLSLSLSLSLSLSLSLSLSLSLSLSLSLSLSLSLSL

SEQ ID NO: 179676 - protein, 84 aa, Triticum aestivum
  unsure (1)..(84): unsure at all Xaa locations
  Clone ID: PAT_TA_74094.pep
GQTGNIVLSGVATMSAGISNRKSKQSSALARSSRKIRGVAPRERKPSACXGGTIWGFLSPFHEMWIEKFESDYSGPSIVHRKGF

SEQ ID NO: 179677 - protein, 150 aa, Triticum aestivum
  Clone ID: PAT_TA_74095.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESDVAAAATK

SEQ ID NO: 179678 - protein, 181 aa, Triticum aestivum
  unsure (1)..(181): unsure at all Xaa locations
  Clone ID: PAT_TA_74096.pep
KGRTEEGGRGGGIGGAGKRGEKNVEDTEKEEGAQTLRGRRRKSRRGRRKEEXEEKRGGKRRERGGGKEEDAETRKGDEERGTKGGERAEEEGSREKMEGGGEKKRGPRRRKNGTGDTGRIAKRESXEEWRRRLGSGGEGEKKRMRKEMEEGGGGIGLRKRKKKKEIGEGKKWVGREMECQG

SEQ ID NO: 179679 - protein, 123 aa, Triticum aestivum
  unsure (1)..(123): unsure at all Xaa locations
  Clone ID: PAT_TA_74097.pep
SKDDSGPCYTYPQRGGAIHTGGHIAIKAHTCQVVEACTYKTAKHGHAMCDFVAIDIFNRKKLDDIVPXCHNCDLPHVVRLDNHLIDITEDGYASLLTESGHTNDDLQLPTDDAVLGQIREWMC

SEQ ID NO: 179680 - protein, 63 aa, Triticum aestivum
  Clone ID: PAT_TA_74098.pep
KKSPAQDNLDADMSAHDRVANNSKVELQNACVIKSLKMLKTDICRACCPSRRDAVSGAPNLLW

SEQ ID NO: 179681 - protein, 154 aa, Triticum aestivum
  unsure (1)..(154): unsure at all Xaa locations
  Clone ID: PAT_TA_74099.pep
MFGFGHHHKDQAPPASGPNQIFKIYCRASEDYCLAVRNGEVVLAPVNPKDETQHWLKDMRFSTTVKDEEGMPAFALVNKATGLAVKHFIGQSHPEKLPPKTAAYDDSXVLSTESKNLXKASRCIRLSNNTRAWFASLNGETDQGCVHDRTTVVV

SEQ ID NO: 179682 - protein, 171 aa, Triticum aestivum
  unsure (1)..(171): unsure at all Xaa locations
  Clone ID: PAT_TA_74100.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKGHXSSPRRNPRGSRALGGLGFRNLRVVFKASPWFPRRGFPWWCRSFLM

SEQ ID NO: 179683 - protein, 169 aa, Triticum aestivum
  unsure (1)..(169): unsure at all Xaa locations
  Clone ID: PAT_TA_74101.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESGTKYLLSKLKXPLSLCVAKPSLKMPPWVSAYYKEGSWEPTFLHFAHGLKEVKC

SEQ ID NO: 179684 - protein, 162 aa, Triticum aestivum
  unsure (1)..(162): unsure at all Xaa locations
  Clone ID: PAT_TA_74102.pep
MKTLLVFALLAAAATSAIAQMETSCIPGLERPWQQQPLQQRETFAQLPPSSQQQQPFSQQPXLLQQQPSFSQQPLFXQKQQPGLPQQPAFSQQQQTGLPQQPALSQQQHQQLVQQQMRIVHPSIVQQLDPCKVFLQQQCIPVAMPQHLARSQMWPQSSCDVM

SEQ ID NO: 179685 - protein, 170 aa, Triticum aestivum
  Clone ID: PAT_TA_74103.pep
MRECISIHIGQAGIQVGNACWELYCLEHGIQPDGQMPGDKTVGGGDDAFNTFFSETGAGKHVPRAVFVDLEPTVIDEVRTGAYRQLVHPEQLISGKEDAANNFYRGHYTIGKEIADLCLDRIRKLSDNCTGLQGFLAFNAVGGGTCYGLGSLLLERLSADYGKKSQAGFT

SEQ ID NO: 179686 - protein, 153 aa, Triticum aestivum
  Clone ID: PAT_TA_74104.pep
SLPNRYGGRGHRAGVSRHTECRALVTGLPSSASWRDLPDPLRQAGDVCYYAVYREGGRTIGIADYTYYVDLNYAITKLDDTASINAFSTAPITATEYAGTSRRSYSCSRSRRRRGHTAESRVTEPTSRRYAIDVARSALSFRSRPWRLHLSQQ

SEQ ID NO: 179687 - protein, 194 aa, Triticum aestivum
  unsure (1)..(194): unsure at all Xaa locations
  Clone ID: PAT_TA_74105.pep
MKTVLILTILAMATTIGTGNMQADRSSQLQWPQEQPPVQSQQPFSSPPQQIFCQPQQKFSDKPQXSFVQPQLILPRCPHQQDDKSXLPQEPFDHSQQPELPFPHLPRQPLRDPHQPQQPFPXVTRTTSTFCLMXQQLPEAQQPQLSFPQQQQLMIQSFLQQQMNPLQNIILQQCNPVSLVSSLVAMILPRSDCH

SEQ ID NO: 179688 - protein, 162 aa, Triticum aestivum
  unsure (1)..(162): unsure at all Xaa locations
  Clone ID: PAT_TA_74106.pep
QQQQQEQQILQQILQQQLIPCMDVVLQQHNIARGRSQVLQQSTYQLLQELCCQHLWQIPEKLQCQAIHNVVHAIILHQQQKQQQQLSSQVSFQQPQQQYPLGQGSFRPSQQNPHAQGXSVQPQQLPQFEEIRNLALQTLPAMCNVYIPPYCTIAPFGIFGTN

SEQ ID NO: 179689 - protein, 100 aa, Triticum aestivum
  unsure (1)..(100): unsure at all Xaa locations
  Clone ID: PAT_TA_74107.pep
HASFSVPLPIAYDATNYIINPIVLAYNYTYPVTYWGATRAISLXASLQMLSIFREHIPLTSILDNFAFYXNPHMMPQLKTIELPTIPYQVWDIRAPNPVA

SEQ ID NO: 179690 - protein, 178 aa, Triticum aestivum
  unsure (1)..(178): unsure at all Xaa locations
  Clone ID: PAT_TA_74108.pep
MKTFLVFALLTVAATSAIAQMETRCIPGLERPWQQQPLPPQQTFPQQPLFSQQQQQQLFPQQPSFSQQQPPFWQQQPPFSQQQPILPQQPPFSQQQQLVLPQQPPFSQQQQPVXPPQQSPFPQQQQQHQQLVQQQIPGCQPSXILQQLKXHCRVFXQQQCSPVAMPQRLARSQMLQQS

SEQ ID NO: 179691 - protein, 132 aa, Triticum aestivum
  unsure (1)..(132): unsure at all Xaa locations
  Clone ID: PAT_TA_74109.pep
WRRTDPQNRRGGHRIVRYCRRRHAMHLWICLVRPQAVLLLLGLPGLPAPSHMKKAKLPTVYCCSVDHTSRSLLCVPRTPEGSTQKTPALSDPDPSDPIAGTHACASASLYTMQRLEWVQPRCDGCRVEFXIE

SEQ ID NO: 179692 - protein, 207 aa, Triticum aestivum
  unsure (1)..(207): unsure at all Xaa locations
  Clone ID: PAT_TA_74110.pep
MVAYCPIMENACGIAEISQMPDEVLLRTNALYNNDNSTVDVNLGVAIYSTELGKLALLNAYKSPAQMLIHNELRPKEYLPITGLADANXLSAEIILRADRTAIHENRVGTAQGLSRTGSLRVGGEYLALHYHERTIYIRQPNWENDPKVVTIADLTARSYRDYDPATRGLDFQGPLEDLRSSTSAXELLHACAHQTNCVDPTLDNGN

SEQ ID NO: 179693 - protein, 175 aa, Triticum aestivum
  unsure (1)..(175): unsure at all Xaa locations
  Clone ID: PAT_TA_74111.pep
MARTKQTARKSTGGKAPRKQLATKAARKSAPATGGVKKPHRFRPGTVALREIRKYQKSTELLIRKLPXQRLVPEIAQDFKTDLRFDAPTVFPPLAGGGRRGPYLVGGLFKEHPKTLLVAHSQRQSARFTHNGPPKGNHPRLGKRPNSPWAGKEGGPLKFFTRPPPGSFLSPPRIW

SEQ ID NO: 179694 - protein, 210 aa, Triticum aestivum
  unsure (1)..(210): unsure at all Xaa locations
  Clone ID: PAT_TA_74112.pep
AQPAVVHQQPPGLPLQHIPYVLSCILPPLMPCEVLLQQQCTPVAMPHSLARSQMWWNSSCHVMQHQCCQQMPRIPRQSRYDAIRAIIYSIVLQEQHHGLGVNQPXTHNPYRXVRGVCXPQQLQKLIGQCSLQRPTPQQPGPWPTPPPAPHGTLFETHQIAXLELMTHIALRTLCMMRSVNLPAYGTTTNVPCRDVSQIGAYLIRHDLRNV

SEQ ID NO: 179695 - protein, 130 aa, Triticum aestivum
  unsure (1)..(130): unsure at all Xaa locations
  Clone ID: PAT_TA_74113.pep
GTNVLTRWRVPSPIKTESSSPEEDALLVALVLQRCARPKSVISTRVPWRADNXCLLQEYNQLNHVAQHRPFIXQERTLMIATQARYGNIGADIDRILSDRTDKLVKNHWNSNLRRCHRQAEVMCADTGAQ

SEQ ID NO: 179696 - protein, 138 aa, Triticum aestivum
  unsure (1)..(138): unsure at all Xaa locations
  Clone ID: PAT_TA_74114.pep
MARTKQTARKSTGGKAPRKQLATKAARKSAPATGGVKKPHRFRPGTVALREIRKYQKSTELLIRKLPFQRLVREIAQDFKTDLRXQSSAVSALQEAAEAYLVGLFEDTNLCAIHAKRXTIMPKDXQARRRXXGERAAA

SEQ ID NO: 179697 - protein, 85 aa, Triticum aestivum
  unsure (1)..(85): unsure at all Xaa locations
  Clone ID: PAT_TA_74115.pep
QILVVTGHNLHAVVFNLYLLNMIKYHHLVMTEKQHCRQALTTIXLQSASAPIHRTSLYIVVGKKNNHNLALISNHRCHNSHRSVR

SEQ ID NO: 179698 - protein, 138 aa, Triticum aestivum
  unsure (1)..(138): unsure at all Xaa locations
  Clone ID: PAT_TA_74116.pep
LVVATGLWFSICFFYTGQLTVRLRWGQRWWLFGGKGPAGAGEDLAPFAASRRSWTLRARRRDLAVQRRLNGDSIDSPPRQSTPTWPRDLKEPGRQRVQRNLKRPAKPQGRSTVMTGTGGRDLSISXGVQGPWAAAILF

SEQ ID NO: 179699 - protein, 160 aa, Triticum aestivum
  unsure (1)..(160): unsure at all Xaa locations
  Clone ID: PAT_TA_74117.pep
RKPTDISRVHSGSWPQAEKKPVAEKAEKTTAAKKTKAEKRPPASNEGGEKKGKKKSKKSVETYKIYIFKVLKQVHPDIGISSKAMSIMNSFINDIFEKLAGESAKLARYNKKPTIKXQEIQTXXRLSSRELASTPLEAPSAQSLSNGGLLGENFDCMSTD

SEQ ID NO: 179700 - protein, 108 aa, Triticum aestivum
  Clone ID: PAT_TA_74118.pep
AIRTFYRWKPCQRRQLHGTLKQMELTPQELQTAINGLPCVRLLVWADPIVRSVVTDPLLPHEHYGHCVYLVPVIMDISDEAMTMNLFTELWRFIEADLYAISDAMHLL

SEQ ID NO: 179701 - protein, 211 aa, Triticum aestivum
  Clone ID: PAT_TA_74119.pep
QQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRPLFQLVQGQGIIQPQQPAQLEVIRSLVLRTLPTMCNVYVSPDCSTINA

SEQ ID NO: 179702 - protein, 150 aa, Triticum aestivum
  unsure (1)..(150): unsure at all Xaa locations
  Clone ID: PAT_TA_74120.pep
MVKAVAALTGSEGVKGTIFFTQEGDGPTTVTGSVTGLKEGLHGFHVHALGDTTNGCMSTGPHFNPAGHVHGAPEDEIRHAGDLGNWDNXADGVANINVTDCHIRLTGPNSIVGRAVVVHGDADDLGTGGHERSKSTGNAGARVACAIIGS

SEQ ID NO: 179703 - protein, 144 aa, Triticum aestivum
  unsure (1)..(144): unsure at all Xaa locations
  Clone ID: PAT_TA_74121.pep
MESNMITTAASFYTAASAVTSDLSCPLNNLSNIFTRHASSADAIACDTPDLIINPTATDALVNTGNTSNDDRTVALAIHDYIHAVTDTLNMAAARNHLSXAYKDSEHLEATVSHCDHTLMLRLLCRVRAPLILQGWTAQRTMSE

SEQ ID NO: 179704 - protein, 163 aa, Triticum aestivum
  unsure (1)..(163): unsure at all Xaa locations
  Clone ID: PAT_TA_74122.pep
QQPFAQQPQQPFPQTQQPQQPFPQQPQQPLPQTQQPQQPFPQLQQPHQPFHQPQQQLPQPQQPQQSFPQQQRPFIQASVQQRLNPCKNILLQQWQPAAIVSSXLWSIIWPQSDCQVMQQQCCQELAQIPQQLQCAAIHSVVHSIIVQQRQPQQQQQRQQRQQG

SEQ ID NO: 179705 - protein, 186 aa, Triticum aestivum
  unsure (1)..(186): unsure at all Xaa locations
  Clone ID: PAT_TA_74123.pep
PQPQQPQQPFLQPQQPFPQQPQQPFPQTQQPQQPFPQQPQQPFPQTQQPQXQPFPQQPQQPFPQTQQPQQPFPQLQQPQQPFPQPQQQLPQPQQPQQSFPQQQRPFIQPSLPQQVDPWQNYLFATLQTCALVSXLWXIIWAQXDCQVMRATCCQQLAQIPQQLQCAAIHSVVHSIIMQQQQQQQQQ

SEQ ID NO: 179706 - protein, 69 aa, Triticum aestivum
  Clone ID: PAT_TA_74124.pep
MARTKQTARKSTGGKAPRKQLAPSGRKWPGTAGENRPFAGPGARDRRPKARSCIEAAFSAVGDAQIKTD

SEQ ID NO: 179707 - protein, 127 aa, Triticum aestivum
  Clone ID: PAT_TA_74125.pep
RRHAPAPTRRPHPGPIVSIRLFRIPSTPANVHDRPALPTYFPGEYLLTALPTSLGSQLPLSPATRPGSPSRGWLLTPMCACARPSLARGETWAACRFWLAMRRLPPAVSVRSVSHRSLRLMLLGLEY

SEQ ID NO: 179708 - protein, 137 aa, Triticum aestivum
  unsure (1)..(137): unsure at all Xaa locations
  Clone ID: PAT_TA_74126.pep
MGKIKIGINGFGRIGRLVARVALQSDDVELVAVNDPFITTEYMTYMFKYDTVHGHWKHSDIKLKDDKTLLFGEXKPVTVFGVRNPEEIPWGEAGADYVVESTGVFTDKDKAAAHFEGGAKKVVISVPAKMPYVWGGV

SEQ ID NO: 179709 - protein, 144 aa, Triticum aestivum
  unsure (1)..(144): unsure at all Xaa locations
  Clone ID: PAT_TA_74127.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYERNVEATGEDFSVEPSDERRPFRAX

SEQ ID NO: 179710 - protein, 150 aa, Triticum aestivum
  unsure (1)..(150): unsure at all Xaa locations
  Clone ID: PAT_TA_74128.pep
MARGLKKHLKRLNAPSHWMLDKLGGAFAPKPSSGPHKARECLPLILILRNRLKYALTYREVQSILMQRHIMVDGKVRTDKTYPAGFMDIIXIPKTCENYXLFYDTXGSLSGFTLFKGLKIALVSKRLSKGQKCLWPQCRGPQEGGPYSPL

SEQ ID NO: 179711 - protein, 169 aa, Triticum aestivum
  unsure (1)..(169): unsure at all Xaa locations
  Clone ID: PAT_TA_74129.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQIXNYEEFVKVMMGPNEHHRGSPRPGRRNWCHLA

SEQ ID NO: 179712 - protein, 82 aa, Triticum aestivum
  unsure (1)..(82): unsure at all Xaa locations
  Clone ID: PAT_TA_74130.pep
PKKLSKIKVVRTSIARVLSVISQNNKWGMREAYKNKSVALDLSTKKSRANSRGFXKHQLSXKTEREKKREKCFPMRKYANEG

SEQ ID NO: 179713 - protein, 51 aa, Triticum aestivum
  Clone ID: PAT_TA_74131.pep
LCTLYSLRHPSLLSCWCQYTTVRPRVLNPKTESSKLLSVIEASSVHVGIPH

SEQ ID NO: 179714 - protein, 69 aa, Triticum aestivum
  unsure (1)..(69): unsure at all Xaa locations
  Clone ID: PAT_TA_74132.pep
RKNPRPSCGLAQLAQATIICDACERGFPXCCVHLFGTLMRQPPPPPMPRRVQVRRSPVALTIDWLGKMG

SEQ ID NO: 179715 - protein, 159 aa, Triticum aestivum
  unsure (1)..(159): unsure at all Xaa locations
  Clone ID: PAT_TA_74133.pep
MKTFLVFGLLTAAATSAIAQMETRCIPGLERPWQQQPLPPQQTFSQQPLFXQQQQQQLFSXQPSFWQQQPPFWQQQPPFSHEQPIVPQQPPFSQEQQLXVVPRQPPFXHGQQPVLPSQQLTFAQQQQQHQQVVRQQIPVVQPFILQQLNPCKVFLQQQC

SEQ ID NO: 179716 - protein, 156 aa, Triticum aestivum
  unsure (1)..(156): unsure at all Xaa locations
  Clone ID: PAT_TA_74134.pep
MNTLLFSVLIIRDGTSTFPHMETICMTALEIGWXQRPLPPQQTFIHHTSIXQQQQQRLFPQEPLFGDDQPPLWALQPPFSEQRPILPXASTIVAATQLVLPQQPSFSHAQQPALPPQQSSFTQQQPLQQQLVHQHIRVVQPCILLQISPCEVFLQH

SEQ ID NO: 179717 - protein, 167 aa, Triticum aestivum
  unsure (1)..(167): unsure at all Xaa locations
  Clone ID: PAT_TA_74135.pep
QPQLPYSQPQPFRPQQPYPQPQPQYSQPQQPISQQQQQQQQQQQQQQQQQQQQQQQILQQILQQQLIPCMDVVLQEHNIAHGRSQVLQQSTYQLLQELCCQHLWQIPEQSQCQAIHNVVHAIILHQQQKQQQQQPSSHVXFPFKPRAPFRAIFRKTPTGPRGLWFKA

SEQ ID NO: 179718 - protein, 77 aa, Triticum aestivum
  unsure (1)..(77): unsure at all Xaa locations
  Clone ID: PAT_TA_74136.pep
MSRRSGRTIYLGLISEDIREMEMNDLXYKYGAIVXIRAEDPPMTAADTYVEYEHPRHAHDVXYGRDGYHYNRYQLLH

SEQ ID NO: 179719 - protein, 188 aa, Triticum aestivum
  unsure (1)..(188): unsure at all Xaa locations
  Clone ID: PAT_TA_74137.pep
MKTLLILTILAMAITIATANMQVDPSGQVQWPQQQPFLQPHQPFSQQPQQIFPQPQQTFPHQPQQQFPQPQQPQQQFLQPRQPFPQQPQQPYXQQPQEPXPQTQQPQQPFPQSKQPQQPFPQPQQPQQSFPQQQPSLIQQSLQQQLNPCKNFLLQQCKPVSLVSSLWSIILPPSDCQVMRQQCCQQLA

SEQ ID NO: 179720 - protein, 78 aa, Triticum aestivum
  unsure (1)..(78): unsure at all Xaa locations
  Clone ID: PAT_TA_74138.pep
NGSRLRDLDCTHSNYQTLMRPXIVIYCHYLXVSGLGNLRACCLXLDVVAVSQAPSPESNPNSPSPVTTMVGPYPTIES

SEQ ID NO: 179721 - protein, 136 aa, Triticum aestivum
  unsure (1)..(136): unsure at all Xaa locations
  Clone ID: PAT_TA_74139.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDXQLARRIRGERA

SEQ ID NO: 179722 - protein, 128 aa, Triticum aestivum
  Clone ID: PAT_TA_74140.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDN

SEQ ID NO: 179723 - protein, 166 aa, Triticum aestivum
  Clone ID: PAT_TA_74141.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQL

SEQ ID NO: 179724 - protein, 49 aa, Triticum aestivum; identical to SEQ ID NO: 147490
  Clone ID: PAT_TA_74142.pep

SEQ ID NO: 179725 - protein, 75 aa, Triticum aestivum; identical to SEQ ID NO: 116116
  Clone ID: PAT_TA_74143.pep

SEQ ID NO: 179726 - protein, 263 aa, Triticum aestivum
  unsure (1)..(263): unsure at all Xaa locations
  Clone ID: PAT_TA_74144.pep
NRRRLYDSVNRNCPTTCSSSASLPSPGLPPSWTVAHRSRPAPKSPARSASVSSRADLLARFVGRRRRRRRRREEXEXXFLLVFFAGADRTCQQPPGSRNPGWTPRSWNLVKAWTSGEHMTPSPKFRKERSAGGLAAPHWSWWHYLVVWKTNFPWGFWGGTYPRCFLFTLLKNRGGWNLKLGPGVEPGKRAFGKYNLGVSTNGILILGFFPLTGHKTIPGSLPQVGGVEPFLKVRAPIGGALGITNFSRGAWFSKTPLXKGFKI

SEQ ID NO: 179727 - protein, 186 aa, Triticum aestivum
  unsure (1)..(186): unsure at all Xaa locations
  Clone ID: PAT_TA_74145.pep
QQQFPQPQQPQQPFPQPQQPQLPFPQQPQQPFPQPQQPQQPFPQSQQPQQPFPQPQQQFPQPQQPQQSFPQQQQWMIQSFLQQQMNPCKNFLLQQCNPVSLVSSLVSIILPRSDCQLMQQQCCQQLAQXPQQXQCAAIHKRRAIPSFMQPGTQRGRGKPAPIFQASPQGVLGGIPIPNTSQPNPGV

SEQ ID NO: 179728 - protein, 178 aa, Triticum aestivum
  unsure (1)..(178): unsure at all Xaa locations
  Clone ID: PAT_TA_74146.pep
MVSGSGVCAKRVVVDARHHMLGRLASIVAKELLNGQRVVVVRCEEICMSGGLVRQKMKYLRFLRKKNNTKAFHGPNQFPAPGQNLLRNNPGIDSDKNRRGQGALRRLQAYXGVXARTTDQRCHPDASGLSCSWTVCSQSQESMTRTSGLRKERKQALHREALAASVRPKAREVELTEI

SEQ ID NO: 179729 - protein, 57 aa, Triticum aestivum
  Clone ID: PAT_TA_74147.pep
KGLGKGGTKIHRKVLRDNIKGITKPAIQRMALRGRVNRILGLIYDETHGVLKIILER

SEQ ID NO: 179730 - protein, 206 aa, Triticum aestivum
  unsure (1)..(206): unsure at all Xaa locations
  Clone ID: PAT_TA_74148.pep
MGQNKNGINRFRKIRKVVSQVGLHNDKFELVGVNKPFIXTTGSLTSLFRSKTVNGHWRPRDFKLKDDKTLFFGEKPVTVFGVRNPEEIPWGEAGADYFVESTGVFTDKDKAAAHLKGGAKKVVIFAPSKNAPMFVGGVNEDKYTXXVKHCSNACXTTNCLAPLVRIINDHFGIIXEGWMTTVHAITGTQKTVMGPLSKDXWKGGRP

SEQ ID NO: 179731 - protein, 202 aa, Triticum aestivum
  unsure (1)..(202): unsure at all Xaa locations
  Clone ID: PAT_TA_74149.pep
MKTLLILTILAMAITIGTXANMQVDLSGQVTGRDHHQFLQPNQPFSQQPQQIFPQPQQTFPHQPQQQFPQPQQPQQQFLQPRQPFPQQPQQPYPQQPQQPFPQTQQPQQPFPQSKQPQQPFPQPQQPEQSFPQTQTIVIQQSLQQQVKPCKXXLLQQCXPVXLCHXSVNHLAPSDCXVMRHKCVNTSTNSQHVLHSVCIHNM

SEQ ID NO: 179732 - protein, 83 aa, Triticum aestivum
  Clone ID: PAT_TA_74150.pep
TALGEGGWSKPNRGTKSKGKKEFKRGPDEKRGLKTQGQRGEILNPPGGLIPLGAWKKRKGPKQEGRQGCTPLRRNPGKPGTTG

SEQ ID NO: 179733 - protein, 129 aa, Triticum aestivum
  unsure (1)..(129): unsure at all Xaa locations
  Clone ID: PAT_TA_74151.pep
AVVCKGEGAAPASLLKSGAPVAFRSVDSPAVTGDRRPYNTKAKEVSRYDDDDDDYSARDLVTPSFFSQDVIDSLXPPTSMARLLSLMKGRLYXTAAGAXGASLLRRXVAKEDDDPGYLKGPLPGLTRAR

SEQ ID NO: 179734 - protein, 143 aa, Triticum aestivum
  Clone ID: PAT_TA_74152.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKEPKEGK

SEQ ID NO: 179735 - protein, 282 aa, Triticum aestivum
  unsure (1)..(282): unsure at all Xaa locations
  Clone ID: PAT_TA_74153.pep
PPPTSMPVDSPFTGSRRPTPGLPWPSTAAPTMMPPRCPTSSYLSSPSRAQTPLDQRRSDAPQPPPRAGSSGAPPRSAAGXQPRHQRIWLHPHHQSHNXQRCSGAPPPQWPWTMRGGMPKLMPPMALEACSLFPPRRGTFGPTRQKXPSLTLXGFPQPGIPPTXGLGANGPNPXPWFGQSPLSPFPPGLGQGDQRALFFRGAFGVDGPVPGGHRPDMVGFLGQPPVGARGQGWPFNGPPGPPKPKPPKPGQVAVLGPSETTTIRSTPSSWVPFSPEPDNSLGG

SEQ ID NO: 179736 - protein, 97 aa, Triticum aestivum
  unsure (1)..(97): unsure at all Xaa locations
  Clone ID: PAT_TA_74154.pep
VLLLHQLLFQITKKPSCIRNTIGPEYSANVRFLGMANQTFFMSNYVSRGWKIRFSSXFARKLLGSPTKFVLHAPIQVAMRNVRFAMPKNLTSDLAFS

SEQ ID NO: 179737 - protein, 65 aa, Triticum aestivum
  Clone ID: PAT_TA_74155.pep
SSTGGPFSYLLTDWTILYRFLLHVLQPTHSTGAHIYAASSSLTTNNMMLVFSSVAPIPQVGYRNY

SEQ ID NO: 179738 - protein, 90 aa, Triticum aestivum
  Clone ID: PAT_TA_74156.pep
MGKEKTHINIVVIGHVDSGKSTTTGHLIYKLGGIDKRVIERFEKEAAEMNKRSFKYAWVLDKLKAERERGITIDIALWKFETTKYYCTVI

SEQ ID NO: 179739 - protein, 141 aa, Triticum aestivum
  unsure (1)..(141): unsure at all Xaa locations
  Clone ID: PAT_TA_74157.pep
LFANSKMGTPAAGQGQPLHGAMNNGNKINASEREANLVFAMPPLQQILKENPPRAEMGAPTTLIKPTIGRSVFTYTLGAFTPKEHKGCPSLEGRGGIHICTMQXLERGRNXQGPRFGSFHRTWYPHPLANGHNNAGGGPKP

SEQ ID NO: 179740 - protein, 173 aa, Triticum aestivum
  unsure (1)..(173): unsure at all Xaa locations
  Clone ID: PAT_TA_74158.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEXAAAATEEAKKSNNVQRKPEKRQQGRTLDS

SEQ ID NO: 179741 - protein, 172 aa, Triticum aestivum
  unsure (1)..(172): unsure at all Xaa locations
  Clone ID: PAT_TA_74159.pep
MEECLDQQQQQQKKSNNGQLQRLEGIEEEGGQAPAEKWPPTTVRAPETPTETMEFLARSWSLSGAEISKALKVLSNKGVCDIPEHRRRRGRKVKNRGPAPXXNTLTPTIAAGAXXEEEVPSPPVSSKAGKIGRASSFGPGAAXGRARGGKNTMGAWFKDXKERNAPRPVPNG

SEQ ID NO: 179742 - protein, 109 aa, Triticum aestivum
  unsure (1)..(109): unsure at all Xaa locations
  Clone ID: PAT_TA_74160.pep
XXFFFFFFFFFFFFFFFFFFFFFLGPNQKQQTFWAKLIQTKVFGIHKKLVLAKLFFNQIYFEAFPQNFCPFKGKGGNPALLTPCFFQGLKSFLAPNDGPVHGLLALLGL

SEQ ID NO: 179743 - protein, 147 aa, Triticum aestivum
  Clone ID: PAT_TA_74161.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYL

SEQ ID NO: 179744 - protein, 106 aa, Triticum aestivum
  Clone ID: PAT_TA_74162.pep
MRQPVISLKPLISPTKSDHTGGVYTTNGKPECHDSKNQPTGPKCPATGKKIQRVANLRPIVYWRTRLSSSRMTANPPYKFVIAAAARRYDTIKRFLAQSTCIPKVR

SEQ ID NO: 179745 - protein, 98 aa, Triticum aestivum
  Clone ID: PAT_TA_74163.pep
PFTAFHTACDPYHPSSPKHQPSTQPQEQLNSTYKSLNPYQDTLLQHCTPITDMSLLPSQLVQHSISYVMLQQCFHQLKAIPKQSTYEAIHNFMHAIIV

SEQ ID NO: 179746 - protein, 183 aa, Triticum aestivum
  Clone ID: PAT_TA_74164.pep
MAACPDRANDDLRRRLDVDTPAPPQIAKEKQGLDTGMPLSPQWLMKEPSSQGSRSDATKTSGNGEDMDSSAKKKDVFRASVLDGETARRDHWRDDEREPNSGPRWVRWRETHKEQADARKVEKWSDDSSKFSVDGRRAPHERWGDSSNKEGSYDQRREGTWITRWGSNDNESDNWRDRWSDSG

SEQ ID NO: 179747 - protein, 62 aa, Triticum aestivum
  Clone ID: PAT_TA_74165.pep
RKSKPCMRMGTLHVLNHPCYEIVWPNHSAAIVLTYTHKSVFLMFSFVKCYLCNIECGMLLPQ

SEQ ID NO: 179748 - protein, 182 aa, Triticum aestivum
  unsure (1)..(182): unsure at all Xaa locations
  Clone ID: PAT_TA_74166.pep
NIQQGLKRGMRTEVTKHSPSLQRDAIHINEAYINQLPRYLTVRLPRLDWQNTAQSPIKIFQKVEFPTELDMHDLCSIELKQKIQASIQALEHSSMDVDHVDSSKPEKALTAIYDLVAVLTHQGRSALFGHYVAWVKHQSGRWIQFNDHVTSLHDESEXLSLCGGSDQDKHTAYICVYKARLV

SEQ ID NO: 179749 - protein, 135 aa, Triticum aestivum
  unsure (1)..(135): unsure at all Xaa locations
  Clone ID: PAT_TA_74167.pep
RKGRGXXRERSEGXGGRRTXASSCRSPPPYLDRRRVTRQPQERTPRGQASLPKPPIPARRAASERGIRERDAGEGRGGDGGLRPGEAHRRQSAGNVSGMRVEAGVGMAASDPARRAGIRARRPRAGRGWRQGWGW

SEQ ID NO: 179750 - protein, 125 aa, Triticum aestivum
  Clone ID: PAT_TA_74168.pep
AQLESLTNPIRFFQRFLGFLVAYERFLSLIFRTGFSFKSLTFSFFCPYSRARMALCFPVVPAPPMMMLIPYSDSTGLRNPGTSRIVARALLILPHPFMLDWFFSLLFLRSLSSPFNTLFVIKSIF

SEQ ID NO: 179751 - protein, 145 aa, Triticum aestivum
  Clone ID: PAT_TA_74169.pep
IVGSSMARSRRGRQLREWCRGPEDPLDGGRPRRSPRPLPCHRRRGLQWRHNSHHHHLHYPDPSSTMAASNSKTWPLARGRIKTGSRSCDGRSRNLGRARGHSCDRSFSPTQACRSPPFTPADLLEAATTIRGGSRSTRCLRSRRS

SEQ ID NO: 179752 - protein, 72 aa, Triticum aestivum
  Clone ID: PAT_TA_74170.pep
TTHHLSDWIHTIIPSYTHNTFTTMTKLWPLTNPHLITILQPPFRSTTNITTLRAIHRSNIYITTIICQVALT

SEQ ID NO: 179753 - protein, 163 aa, Triticum aestivum
  Clone ID: PAT_TA_74171.pep
ESMESHAAKKSLQTPDRGTLERLDPETIKSVPNGEHIMGKKGDSEKWSRNDKRITVYQENRIGEREEPKEALNKKKEPGREERQQEVYLDIKEQSDVAGAERKACGTASAGSTGICGSHEATRSPSLYSVSLSLSLSLSLSLSLSLSLSLSLSLSLSLSLSLS

SEQ ID NO: 179754 - protein, 102 aa, Triticum aestivum
  Clone ID: PAT_TA_74172.pep
VYTVRKRRQMNDGRKLYHLVRYLISHISAYQCAPEEGYMRTQTNQWWSGETTEMSPCSSWWVVTVAVRCEIGSNSTEIKRSCQAPGQIGSPRWKRRLGSHSM

SEQ ID NO: 179755 - protein, 199 aa, Triticum aestivum
  unsure (1)..(199): unsure at all Xaa locations
  Clone ID: PAT_TA_74173.pep
HQSTIKTFLIFALLAIAPTNAIAQMETSHVPDLDIPWLPQPLPPQQQPPXTXQQQPFPQXQQPIIILTQSPFSXQQQPALTPHNQXLILQQPPFSTAQHXTILQHPPFQQLQQQPQPQQPPSLQQQQPVLPQQPPFLHQQPSTIFPSHQPTHIHKQPTFFHSQPPTGFLQQLNPLSAEPFRSYCCLNLYQGDSCPHSKV

SEQ ID NO: 179756 - protein, 210 aa, Triticum aestivum
  unsure (1)..(210): unsure at all Xaa locations
  Clone ID: PAT_TA_74174.pep
PQQQLPQPXSPLHLFFQPQQPFPQLXQQQYPQXPFLLYQQTQQPFLLFPQXQQPQRXXSQPQQQFPQPQQPQQSFPQQQPPFIQPSLQQQVNPCKNLLLQQCKPVSLVSSLWSMIWPQSDCQVMXRHTSIKQLVQFPSKNLQCAGPSLPINTFPIIHAPQEPTKEPTNKHCHIPWLEQNYETNHSSKDKRVPNRCKGPVSYIPKPPPKHR

SEQ ID NO: 179757 - protein, 90 aa, Triticum aestivum
  unsure (1)..(90): unsure at all Xaa locations
  Clone ID: PAT_TA_74175.pep
FYFLVNTFXIPGFCPSLIRRYYAFNYKPSITKSRFQEPGVLVGILRLMAGVTCLILLFSEIHFIYTGFCPNLIRRYYAFNYKPSITKSRF

SEQ ID NO: 179758 - protein, 204 aa, Triticum aestivum
  unsure (1)..(204): unsure at all Xaa locations
  Clone ID: PAT_TA_74176.pep
ATRQGQRLECGKSAPPGTARVMGXRSSXMKVARXKQGRSTARERSIKPKGRRKSIFSGSTRAXARNNELMGTPALFVRCSMRTGPRCGLIGTRILRRKPAGGVVATRPSAASSDGRATPRKTIWRRPAQRPSHRRERTPVRPASPAQGRRAXTRRTTWWGRKLIGSVPSLGPSGPGRNSGEAPSSPPSTPGSLLSDGTGRSDKT

SEQ ID NO: 179759 - protein, 104 aa, Triticum aestivum
  unsure (1)..(104): unsure at all Xaa locations
  Clone ID: PAT_TA_74177.pep
MARKATEAREKMPRAQPDPXEERPRCKSANTNFCYYNTYTKSHPRYLSKAXPHSWTDGGCLRNIAITSGCRKPKPSGTSDANDLRVDSLSEHTDCHSLGSFAME

SEQ ID NO: 179760 - protein, 214 aa, Triticum aestivum
  unsure (1)..(214): unsure at all Xaa locations
  Clone ID: PAT_TA_74178.pep
MASQSSPAGAPPGFPKPTNYLPAVDLPRALGRCRMLLDRLLQHEDGWVFAKPVDTYELGLRDYYSIIAEPMDLGTVSRRLELRRYPNLLCFAKDVRRTFSNAMTYNNKGDDVYESAAKLSRIFESGWASILAALPSPPPVAVRRARLKDELPRLPVDLQDKAAIIMTDIGGWIQEVDGRXEXDLDKADEATLDKLEWLLALATMRKEAALDNQI

SEQ ID NO: 179761 - protein, 165 aa, Triticum aestivum
  Clone ID: PAT_TA_74179.pep
LHGAQEGRTRGALKNRAHPPRTTNGGQKPPEEDKTPQTHRGPTPPKGNAPGQRAPPNPGTKSGTKARPQGAPQGTRGGKGATGNRPPNRGNTPPGPHSGNPKADTPGPKGQQRIWRSTRNGKTRAPRHLESPPRITRKRVVKWAGQPKKKKNKKNFSKRPIGGLP

SEQ ID NO: 179762 - protein, 141 aa, Triticum aestivum
  Clone ID: PAT_TA_74180.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKGQGLVQVRPGRAFPLT

SEQ ID NO: 179763 - protein, 96 aa, Triticum aestivum
  unsure (1)..(96): unsure at all Xaa locations
  Clone ID: PAT_TA_74181.pep
VVVFLVPCFFFNLSFVFILFFHCKYSFFLIIYLIEYLYWIELCNCXYLFNFLYLVIXYFCIRYLDCFFYDIFLMIVCLIILFKIFVVIMWLSVNCD

SEQ ID NO: 179764 - protein, 156 aa, Triticum aestivum
  Clone ID: PAT_TA_74182.pep
MDRSKLNKVVGKKFGGPRKKSVTKFIKAGLQFPFCRIGRYLKKGRYAQRVGSGAPVYLTAILEYLADEVLDLAGNAAKDIKKTLIVPKHLVLSIRNDQELGRLLSGVTICHRGVIPNINPVLLPKKAVQKADKAGTPPKFPNKALQFPQGRPPTRP

SEQ ID NO: 179765 - protein, 61 aa, Triticum aestivum
  Clone ID: PAT_TA_74183.pep
TTLCGCHENFYSICPSTRRACTECPTQSEQCNLHSVPPCTRRHTSSQPLVAISNWRNHQCR

SEQ ID NO: 179766 - protein, 215 aa, Triticum aestivum
  unsure (1)..(215): unsure at all Xaa locations
  Clone ID: PAT_TA_74184.pep
TGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVXTFGPTGLTTEVKVREMHHESXLEAXXXDNVGFNVKNVACKDLKRGFGAFKLKMXPCQEAANLTSRSLY

SEQ ID NO: 179767 - protein, 84 aa, Triticum aestivum
  unsure (1)..(84): unsure at all Xaa locations
  Clone ID: PAT_TA_74185.pep
GACCAGPHKASIPCLSAGVTKDKQKXWRMACVGYAATYCRMSFAHSYNCGSDTFPPLTDDCSLCAGDHRLYIMERGLTRAILTH

SEQ ID NO: 179768 - protein, 87 aa, Triticum aestivum
  Clone ID: PAT_TA_74186.pep
ITCLMLMYMVYICPSLIGNERSSGTINIQQEYASSLSCKQRLGSMSVFVTSVNKVVSSVNMHSKWIPLTRTVVLRFVPMSLRAQCSL

SEQ ID NO: 179769 - protein, 86 aa, Triticum aestivum
  unsure (1)..(86): unsure at all Xaa locations
  Clone ID: PAT_TA_74187.pep
ICGPDISFFIIYLNISXIFKLLNTVIFLFDDEGSILSLGKLYHDMSTAGGLVEQVQKHTLRLCEDEGRGLKQLGEGGKNQVENNFW

SEQ ID NO: 179770 - protein, 183 aa, Triticum aestivum
  Clone ID: PAT_TA_74188.pep
GKYKLLKGAKGEIMFLKAELESMRAFLERMSEAEEEPDKQAKLWAKEVCDLSYDIEDSVDEFIVLVECESDCEPHGFKGFIHRSMNLLTTMNTRHRVAKEFRGLNSRVVEVSERRMKYKIDDAVSKQNKTTIVLYLLALYADTGGLVGIDGPRDELIQLMAGEEGGFAQLTKVLSIVGFGRLG

SEQ ID NO: 179771 - protein, 186 aa, Triticum aestivum
  unsure (1)..(186): unsure at all Xaa locations
  Clone ID: PAT_TA_74189.pep
MSSSRAAMLRRLITHRHRSIVSVCDGIGSPQRQLTRHRYSNPHQGYSNPTPDLAGARAFTSLLSTPWPCRPRASLSSLSFFSSLAGRGEDQEVEGLDMDAGTVRCAXNYAPLTPLSFIERAAAVYGDRPAVVYGEGPRRTWREVRERCVRVGXRLXXRXGXARGDVVAVLSPNVPAMYELHFGVPM

SEQ ID NO: 179772 - protein, 214 aa, Triticum aestivum
  unsure (1)..(214): unsure at all Xaa locations
  Clone ID: PAT_TA_74190.pep
VGMLFMASMEDNEAIEIVGAERFSQYMGYGSSFRFVGDYLDTKPLDAMGRRKTRIVAIDALDCPTKLQYETSGLLREVNKAFVGFLDQSKHQFDVKPLQDSNSKDNHPSVNSVDCIGVSTGNWGCGAXGGNPEIKSMIQWLAASQAHRXFVNYYTFEDASLRRLEEVMQWVLRHGWTVGELWHIDVEYSSQRLKRETXDGXFDWLLXEDKRHMM

SEQ ID NO: 179773 - protein, 252 aa, Triticum aestivum
  Clone ID: PAT_TA_74191.pep
GSPKLGRPPAKRGFHPRGLGFSPGKKGPEQKDFFLPPDIPKKPTPPYSTPEGPLFERIGHPTPQTKPGPNQGPCCPPHGFTRNHLIPCRPSFGSWPTTRALARGKGEPRPTESDAQLETREGGQTSHRRSGSRPDPATRICRASTARLGPLGPRQSCRHAAARRPTKSSPPETAATMPSPGNDAAEHRATGPPKPIWGPKGPRSGLGGRRQPLAPPCRPTANGRTAASSTTEARGITADGPHRHRPRSTAAS

SEQ ID NO: 179774 - protein, 181 aa, Triticum aestivum
  unsure (1)..(181): unsure at all Xaa locations
  Clone ID: PAT_TA_74192.pep
MPVFRSYPPATMAANEPMRELVTGAARHIGYALVXMIASGVMLGAYHAVILHMLDIEFAAEALKGVKMRVIDAAFHFQGVXTTDVVEACTCVNVADMVGGFPRKXMDRNDVMTNNVSIYKAQASAVEAHAXPNCKGLGVGNPANTNALILEGVAPSIPEKNIXCLTLLDHNRGTRQISERL

SEQ ID NO: 179775 - protein, 88 aa, Triticum aestivum
  Clone ID: PAT_TA_74193.pep
YLHTAYRNKRTCMRYRRGLLEPFYKILDIFLKEHHSKFKLVLVKALQHININGKVPRAHHVASSSIQTQHKPYLMGKMTLLQMDPERD

SEQ ID NO: 179776 - protein, 113 aa, Triticum aestivum
  unsure (1)..(113): unsure at all Xaa locations
  Clone ID: PAT_TA_74194.pep
DRSPVDPTTTATPAPAPMDYEFRSRSGSGSYGGAGGGGGXXXXILYLHTRQSTQCATWPPAGVIALYLQPTDAIYFDSCCLLEGCVFRSYVYMLLRIISAPCFSGSLIFVYLG

SEQ ID NO: 179777 - protein, 116 aa, Triticum aestivum
  unsure (1)..(116): unsure at all Xaa locations
  Clone ID: PAT_TA_74195.pep
HKMALLFRFSQLRNSIWSSCPARLRMQHTGLSPGTLLDPKSYEKRLFSTRVQETASLHRTDLGPCISGIQPLKFQQTSEHEQSAPLLIFDIETTGXFQKTTGNFQKGNRITEFAVR

SEQ ID NO: 179778 - protein, 111 aa, Triticum aestivum
  unsure (1)..(111): unsure at all Xaa locations
  Clone ID: PAT_TA_74196.pep
TLQFDESLILINPQISNVPAFQYCKLITQPRYTYSKIQSQFHIPHKLYLNYSRLRTFRILTSSCTXTSQYIQIALILIHHMVIYYKQTTLTCRKSLLHIPQSIYTSLSIIK

SEQ ID NO: 179779 - protein, 173 aa, Triticum aestivum
  unsure (1)..(173): unsure at all Xaa locations
  Clone ID: PAT_TA_74197.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSGDYXKKVQAGFTVYP

SEQ ID NO: 179780 - protein, 205 aa, Triticum aestivum
  unsure (1)..(205): unsure at all Xaa locations
  Clone ID: PAT_TA_74198.pep
MKTFLVFALLTVAATSAIAQMETRCIPGLERPWQQQPLPPQQTFPQQPLFSQQQQQQLFPQQPSFSQQQPPFWQQQPPFSQQQPILPQQPPFSQQQQLVLPQQPPFSQQQQPVLPPQQSPFXQQQQQHQQLVQQQIPVVQPSILQQLNPCKVFLQQQCSPVAMPQRLARSQMLQQSSCHVMQQQCCQQLPXIXQQSRYEAIRAII

SEQ ID NO: 179781 - protein, 165 aa, Triticum aestivum
  Clone ID: PAT_TA_74199.pep
ERETSTSSPSPPTWAGPSWIRPNTPPSCSCRPSFLFSPPSWTGPATVATPPPIPRAFGLPFTSLLPGRRAACPLLLFGVRAGRPAFAPVAGRAAFIDAGHPCPPVYFRPRPAWFCALLALVGASWPRSPSGCQPCIAPLVGLTAHPSPPPGAFAWVPRTLSSSAP

SEQ ID NO: 179782 - protein, 73 aa, Triticum aestivum
  Clone ID: PAT_TA_74200.pep
AVRPLSTLSIQVYPRVPSHTVSVGCAIVGKGFMPGSDQYARRRLKTHIGPGDALGCGIDVPTNQCPYTPNEVS

SEQ ID NO: 179783 - protein, 152 aa, Triticum aestivum
  unsure (1)..(152): unsure at all Xaa locations
  Clone ID: PAT_TA_74201.pep
MADMTLLPAAGDGAEAARPRKKKTMKSLYLAFFDTAADGRSRACRLCGKSYCLTTATGNLGKHLNNRHPGYDQLADHHLHLQGENPAQSAISGMFARSKKPQAPVRAHPQPQPQPQAQVQVQSVQAQAKARAVRAQPSAKPAVDVDYVNWLX

SEQ ID NO: 179784 - protein, 197 aa, Triticum aestivum
  unsure (1)..(197): unsure at all Xaa locations
  Clone ID: PAT_TA_74202.pep
MGISRDSMHKRRATGGKQKAWRKKRKYELGRQPANTKLLSNMTVRRVRVRGCNAKWRALRLDTGNFSWGSEAVTRKTRLLDVVYNSPNNELVRTQTLVKNAIVQVDALAFKQWHLTHYGVEIGRKKKAAAADKKEAADGQDAEVDAAATDEAKKSNNVQRKLEKRQHGRTLDSHIEEQLTGGRLLGCISYRPVQCGX

SEQ ID NO: 179785 - protein, 140 aa, Triticum aestivum
  unsure (1)..(140): unsure at all Xaa locations
  Clone ID: PAT_TA_74203.pep
MKTLLMLTILVNAITITTDYMQRRPSWSITMITSXLFPQPQQPLSQQPRHAFPQPQQTWPHXPQQQVPQTQXSQEPFLQAQQALPQQPQQPFRXTQIAQLPFXQQTQQPVSPTSDGPNPPFRHKPVPPFRAEPSLLLRQT

SEQ ID NO: 179786 - protein, 206 aa, Triticum aestivum
  unsure (1)..(206): unsure at all Xaa locations
  Clone ID: PAT_TA_74204.pep
MRIQTTDTTMGISRDSMHNLLTSTGKQSACXMNQESQLDRQPTNSXLLRNMTQRMVRAFGCNAMWWALRLDTDSCSWCSEDGTLRTRLLHVDCHPPHTERATTXTLDKNASVHAXDHLDFRQWHLTHYGAEIEQKKRDAAADQNDAADGQEAEVDAAATVVAEKSNHGQMQLEMRRLGRTLDSHIEEQLTGGRLLACISDRPGQRR

SEQ ID NO: 179787 - protein, 166 aa, Triticum aestivum
  unsure (1)..(166): unsure at all Xaa locations
  Clone ID: PAT_TA_74205.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGSGSYSGGGGGYSGQGGGGYGQGGGGLXGQRGGGGYSGGGGGYGGLRGGYGGQHWGGDFRRPCRN

SEQ ID NO: 179788 - protein, 121 aa, Triticum aestivum
  Clone ID: PAT_TA_74206.pep
MRSKANGDTAFKASGKNKTATGGVAKPKRAPTPFFAFLAEFRPQYMEKHPEAKGVAAVTKAAGEKWRSMSDEEKAKYGGKKADAPASKAVNKKESTSSKKAKTDADEEGSDVEDDGEEDEE

SEQ ID NO: 179789 - protein, 168 aa, Triticum aestivum
  Clone ID: PAT_TA_74207.pep
MKKFLGLALIVVAATTTDAEPFTAFRTAWEPHHPSSPEQQPTPQTQEQPVPHQKLNPCRDALLQQCSPNADMSFLRSQVVQHISCLVMWEQCCQPLKAIPKQSKCEAIHNVVHTISLQQQQQLVQGICTQPQQQQQQGQPQQGQGYSQPQQQTQPDQGWNAVIGTGVN

SEQ ID NO: 179790 - protein, 37 aa, Triticum aestivum
  Clone ID: PAT_TA_74208.pep
EYREFVRNGLDNVKLGEMKNGKICNELKDSNLLDYIC

SEQ ID NO: 179791 - protein, 202 aa, Triticum aestivum
  unsure (1)..(202): unsure at all Xaa locations
  Clone ID: PAT_TA_74209.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLNNGLTTGGFEAGISKDGQTREHALLAFTLGVKQMICCCNKMDATTPKYSKARYEEXIVKXSLIRTLKKGWLPTLKKVPFCSQSLGFEG

SEQ ID NO: 179792 - protein, 86 aa, Triticum aestivum
  Clone ID: PAT_TA_74210.pep
WWRREPSVEADRGGGRRQRADPAGRGVAREKVGGRLVEEEGRGWSGRRWWCSPSSTSSAYSSPRSASPNGAHADKVLDVQTNLFSM

SEQ ID NO: 179793 - protein, 138 aa, Triticum aestivum
  Clone ID: PAT_TA_74211.pep
KFFNNKKQTRRIQHKSTMKTLLIQTILAKATTEATANMQGDPNGQVQRSKKTNQLKKNTNKAILTNKSTKHDILAPNSQTKPCDHRCIHTRQNKCYRQGTPKGGPNQSITNLPPTETAKANPTTPNKNVYPTEPAKTK

SEQ ID NO: 179794 - protein, 93 aa, Triticum aestivum
  Clone ID: PAT_TA_74212.pep
HHIALLSSRNPSTLHNRESGYPISKEMDLSSTHSTYIDMVLTSTSIKLRLIFLFTVRLSLIKVFYFPHADHRWYALNVDAPLNYQFSHLTTTI

SEQ ID NO: 179795 - protein, 157 aa, Triticum aestivum
  unsure (1)..(157): unsure at all Xaa locations
  Clone ID: PAT_TA_74213.pep
MERIDGAGLGARGSAGAMLGMEMHLVHQPQPQMHAASSFQQPPEHLHHGNGGDGGFQVQHHQAMPVRQQHPQPPYAAYVAPPSRVVKAHEEEEMGNGVGNGGGXLXXPXAXAAXCPWSRMKWTDAMVRLLIAVVYNAGDDGEGVSAGGKAAASHSHG

SEQ ID NO: 179796 - protein, 246 aa, Triticum aestivum
  unsure (1)..(246): unsure at all Xaa locations
  Clone ID: PAT_TA_74214.pep
TNIFRLIFFTFIPHILSYFFNQLIVIYFIFNSPYFSYFIPISFYHAPPYFLYYYIYIFSFIFLFFYNISYSLYLLNSFLIILSFLIQFHLILYFFNFYSYFIXFIIIFLFPTFFINYXHLFFLLHHFFLSFTLFSLFFQSLIFFSPLFQNIYLISFNLIXSIIFLNHHFPXFSLYLSFNXFILFHTFFLSFQYTQFSIYLNHSSFFILLNKYFLFIHLIFTIYLYTFIILLFFYIITPSPLXSFIL

SEQ ID NO: 179797 - protein, 74 aa, Triticum aestivum
  Clone ID: PAT_TA_74215.pep
HELDPYFCTHGGKDRRLLPRDNNTTCKLYDEADTHCNRNLTRRNAPKNEDALKRCTYLHRFKKKKHLKALGFTT

SEQ ID NO: 179798 - protein, 168 aa, Triticum aestivum
  unsure (1)..(168): unsure at all Xaa locations
  Clone ID: PAT_TA_74216.pep
MFGFGHHHKDQAPAASGPNQIFKIYCRASEDYCLAVRDGEVVLAPVNPKDETQHWLKDMRFSTTVKDEEGMPALALVNKDTGLDVKHSIGQAHPVKLVPVNPAYEDALVLWTESNDVGQGFRXIRMVNNTRLHFYALNGDKDHGGVHEGTHRPCFWELVQRGDNQVLE

SEQ ID NO: 179799 - protein, 290 aa, Triticum aestivum
  unsure (1)..(290): unsure at all Xaa locations
  Clone ID: PAT_TA_74217.pep
KSTTEQQTRQTPNTPTKXTKEESTTTEETETPTPRTATTATPTKTTTKNPQTPPTHPRRQKQQPTEKQGRTRKSGKNTQPGEQRQDTSRPTPKRRQKSNRPKRTPXQXTTATTXNTXXETQRTTNETPHPNTPQPXTTRGTAPTTXRNTQNKSDDRQQTPRQQHHTRTHTQGTAKQPASRXTPHTTGAGTNQTPQNXHAHQQARTTRQDGPDTHNEANRATQKTKKTRPNTTEQHRKNSKKTHKNKREPPTDTRKKSTTTTQQKTQPQSKKRTPSKQGKETPNKKKKREP

SEQ ID NO: 179800 - protein, 134 aa, Triticum aestivum
  Clone ID: PAT_TA_74218.pep
RSVEPSAAAPPSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 179801 - protein, 129 aa, Triticum aestivum
  unsure (1)..(129): unsure at all Xaa locations
  Clone ID: PAT_TA_74219.pep
LPYTQTQLPYSQTELPYAQPERLRPQQPYSQSLPQCYQPPQPIAQQQQXQQQQLRKRLPLQPCPQPLQRQQPFPHSLEPQEPFSQTQQPEQLIPQHQQPLFQPYIQQQMNTGTITFYGAETWGFGESGE

SEQ ID NO: 179802 - protein, 219 aa, Triticum aestivum
  unsure (1)..(219): unsure at all Xaa locations
  Clone ID: PAT_TA_74220.pep
FPPPPRRVTLEVFWWXXGISPTSWPHSVSLEFAQVRPGRSPLSLGLRFSLCFQTTRGAAIVMLLPLGIYHGRFRFEYRVAAFYLALFSAYPWCPPRRIDLPHGQCWGFIKQTALRSCLGVVSHFSQCYSVWGCRPLWCFVRFSSGHTPFGCLFHFGKPRFDPGFWRGLGGSVMFLFARLADLGVLEVLLGEAGGLLGDEGPRDVEPADQGPGAAPLPAE

SEQ ID NO: 179803 - protein, 137 aa, Triticum aestivum
  Clone ID: PAT_TA_74221.pep
MAPKAAEKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHVRLRGAPRAGNQVQPRP

SEQ ID NO: 179804 - protein, 104 aa, Triticum aestivum
  unsure (1)..(104): unsure at all Xaa locations
  Clone ID: PAT_TA_74222.pep
MGRVIRAQRKGAGYVFKSHTHHRKGPDRVKSLDFGERNGYLKGRVTDGIHDPGRGAPLDKVNLRHPDRYKHQKEXLFVTAEGIVSPGHVLFTGGTPETTPFSGG

SEQ ID NO: 179805 - protein, 195 aa, Triticum aestivum
  unsure (1)..(195): unsure at all Xaa locations
  Clone ID: PAT_TA_74223.pep
AGRHGCSGEPCHGIGSSKGAIVGRQNWRCGTNRKPGYGAELRANVEPTKGGGRLRLYIASGRSRGSKLTYAGMRRHSASIAXPKFNALAAGLQPADWKNTPAEDRGNRDGAGRGRGGRVAGAVPGPARGGTPATRTPTGGSRAGAGAAAIRRPAWGTVGEPGERGRGPRPPLPRRGRPPRGLLDRLNRAIWAPGP

SEQ ID NO: 179806 - protein, 138 aa, Triticum aestivum
  Clone ID: PAT_TA_74224.pep
GMGTIGKGPDLYGRGIWKAIPNRKYLPCTVSRYWSAPLSLSICLFPRLPSSRLSYSSYLYIRMPCPPSYDIRVITLVTSGGPVLPVLVSLLLTHRWRGGFLPVHINRGITSSLNRPGYKLLSPFPRFFTTLFLYLRDV

SEQ ID NO: 179807 - protein, 175 aa, Triticum aestivum
  unsure (1)..(175): unsure at all Xaa locations
  Clone ID: PAT_TA_74225.pep
VGTSDGERDRMSRSPSPDPSRLPSRRTSEPRGNTTPPATVAPNTSLSTPSPLPAAGAPVMAPNPERGSYPFRPSAAESEAPRIPEHRRHQAGLLREANILVVGDVGPERDVRHPGRRSRWQGSRSHCPPGHHDXHXRAEXEGTIMSPVFPCYVIQIQAGVGYPDRDVVSVRVRVR

SEQ ID NO: 179808 - protein, 99 aa, Triticum aestivum
  Clone ID: PAT_TA_74226.pep
EREPLSPPSTIPTLRTVNLQIQSPSYRTSPPAIENSARQEPHFLAELFLTPRNPDSFPCGEPGGSAPLPQNPKPLTTSMVFLEEGQAALFHLREGECSP

SEQ ID NO: 179809 - protein, 200 aa, Triticum aestivum
  unsure (1)..(200): unsure at all Xaa locations
  Clone ID: PAT_TA_74227.pep
MKTLLILTILAMATTIATANMQVDPSGQVQWPQQQPFPQPQQPFCQQPQRTIPQPHQTFHHQPQQTFPQPQQTYPHQPQQQFPQTQQPQQPFPQPQQTFPQQPQLPFAQQPQQPIPPXPNKPQQPFPQSQQPQQPFPQPQQQFPQPQQPQQSLPQQQQPAIQSFLQQQMNPCKNFLLQQCNHVSLVSSLVXIILPRSDCT

SEQ ID NO: 179810 - protein, 127 aa, Triticum aestivum
  Clone ID: PAT_TA_74228.pep
SFQQMKQQGKSDDELISAISRRMAMVTGAEFIDEQDQRSMKDYNAHTQPTTTSERRKKQPHGRTTKQPQAPLTKRNSSSERSHDPSKKATRQAGNKQGDGDGEQRGAAMASTERRQKQCSGEAERGT

SEQ ID NO: 179811 - protein, 203 aa, Triticum aestivum
  unsure (1)..(203): unsure at all Xaa locations
  Clone ID: PAT_TA_74229.pep
QILAAAPPRRKRSPGRRRRREKPWPPPGPSPARRPRRHPRRSAAAGRPRPRWRPRSRRRGPRRPCPRXRPRRKATSGSGRRGSRRTWSGCRSSASSTSPPASTSPPPPPAPAPAPVAAAXRRRPETPGSPAXAGPRIRGPPXPMAGRARVGSGVERSVGSPSGILVGKILAEKRGRKRGSFEWGGEKGPFFLLIWEGKRWPKG

SEQ ID NO: 179812 - protein, 147 aa, Triticum aestivum
  unsure (1)..(147): unsure at all Xaa locations
  Clone ID: PAT_TA_74230.pep
RRLILTSVAAGGVQNRWALQLSLLTHYVQTLGLSHALTKFMWMCRPIDGLVAQPYVGLYNDKRTCRWRRHTPSIVTGCIHIRIDVVVIGCXADIGADLGDSNEESNLYHEPLWHAINEDDPGYCLLDLSNNTVQGADSALMADDNLT

SEQ ID NO: 179813 - protein, 212 aa, Triticum aestivum
  Clone ID: PAT_TA_74231.pep
LSLSLSLSLLSSLLKPSASLSSEGVDNEMTELSDEEDEYDQLPPFRVLKRSEYEKLTKEQRTAYLDELDYRETSYLKQQWKEGIRSQKLAEAQNSEASSAVADDYEETTSPVVHISDMEIPLSFDSDYPAHRYRHIITNDQLFRPVLDPQGWDHDIGFDGINFQSCHDLKKNISTSIAGQMRKDKEDMYIQSDCSVSYSDQRRYSLMGGMDM

SEQ ID NO: 179814 - protein, 85 aa, Triticum aestivum
  unsure (1)..(85): unsure at all Xaa locations
  Clone ID: PAT_TA_74232.pep
PTPIEQWNMANMAEGTEVWIXRDDLSCMQLRGNKVPKLXLVLTDAAPHGADCAMTGGGIHSNHWRATVAAGKHVNIECYPILRTS

SEQ ID NO: 179815 - protein, 138 aa, Triticum aestivum
  Clone ID: PAT_TA_74233.pep
MARTKQTARKSTGGKAPRKQLATKAARKSAPATGGVKKPHRFRPGTVALREIRMYQKSTELLIRKLPFQRLVREIAQDFKTDLRFQSSVVSALQEAAEAYLVELFDDTNLCAIHAQGVTIMPKDIQTYPARIRGGRGA

SEQ ID NO: 179816 - protein, 75 aa, Triticum aestivum
  Clone ID: PAT_TA_74234.pep
RFVWEKAEVALCYMCCKGISVFFQLGFYKQNLAPGPKRVVFFQKKYVFRKWGILSNFLCGVSLMKRGSKLFFYVY

SEQ ID NO: 179817 - protein, 227 aa, Triticum aestivum
  unsure (1)..(227): unsure at all Xaa locations
  Clone ID: PAT_TA_74235.pep
ELGLDIQEAHAFSTIDGYSLDVFVVTGWRLVGTKQLQEKIMEKFRSVEAQACTVSSASSPSLEGLQGGESRPTSTSVQIPSDGADVWEIDLKLLKFGNKIASGSNGDLYRGSYCIQDVAIKVVRPERISADMYRDFAQEVYIMRKXRHRNVVQFIGACTRQPNLYIITDFMSGGSVYDYLHKKGXFFKLPEILRVATDISKGMSYLHQNNIIHRDLKTAKFLMDEKX

SEQ ID NO: 179818 - protein, 210 aa, Triticum aestivum
  Clone ID: PAT_TA_74236.pep
MSPPSLCAAPPRAGPTPPPLLRLRRRAASSVSASRAAAPSVSDDLVLRIAEQLEDAAPSSPLLDPLRSASALSLLTTPWPTRRSNEAFRFTDISYLRSLPISTPTRTPGLAPPPPSSDLESHVLFSDGRLVAASGAHVSALADMPPRPRPGTGAARRRPPARVLPTRDILLRTSTPVRREATVARGCTVPEWGQGWPDDPRPHHVRPTAA

SEQ ID NO: 179819 - protein, 145 aa, Triticum aestivum
  Clone ID: PAT_TA_74237.pep
APCFHRHRRRAPCFHRPPPPPLPLLPPSAASPAFFRSRTKNDVRCRPGPSLWPCALTTAVGQHGGPASRNVASCSHRAMCGLLPAKRPRQQHTSRPSPALRCQPIHLRDPRPFSTASRACSTPQLSRPPSVVQLFFCATCCRSKL

SEQ ID NO: 179820 - protein, 155 aa, Triticum aestivum
  Clone ID: PAT_TA_74238.pep
MATSLSPTVVVMALLLATLIALSLAHKEHQHAPTQAPSPAHHHGHLAPAPSHYHHHGPVSTPAPARGGHHQHHHAPAHSPGHHHHHHAPAHSPGHHHHHQAPSPSPIHHHHHHSPAPSPIHHHHHHAPAPSPVHHHRHHVPAPSPVHLDAKELDT

SEQ ID NO: 179821 - protein, 223 aa, Triticum aestivum
  Clone ID: PAT_TA_74239.pep
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVAKYKVGAPARVGLVAPVDVVGFPWEKLVWIPSQNVPSFQGALNYFPTQRFNQGVTWWEKLTYSRWEALYAKYKGWNKGGAHFLKILGPLAFAPKTLGLFTAHLFLQYWAPGGHLPKWS

SEQ ID NO: 179822 - protein, 200 aa, Triticum aestivum
  unsure (1)..(200): unsure at all Xaa locations
  Clone ID: PAT_TA_74240.pep
PQPQQPCSQQPQQIFPQPQQTFPHQPQQAFPQPQQTFPHQPQQQFPQPQQPQQPFPQQPQQQFPQPQQPQQPFPQQPQQQFPQPQQPQQPFAQPQQPQLPFPQQPQQPFPQPQQPQQPFSQLQQPQQPLPQAQQPXQTFPQQQQPLIQPYLQQQMNPCKXYLLQQCTPVSLGSSLVSMILPRSDCRXDAEQCCQQLAQNS

SEQ ID NO: 179823 - protein, 168 aa, Triticum aestivum
  Clone ID: PAT_TA_74241.pep
PDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEGEKLRHHRTTSRAKIPGTKEGHFPRNQDSALDSFAWA

SEQ ID NO: 179824 - protein, 99 aa, Triticum aestivum
  Clone ID: PAT_TA_74242.pep
CTPHATCDNQSCNPSQEPPAPIPHVPPCRLAPAAGPLRPSRTDPRAYLVKDYMNCMETCERMSSILSLSLSLSLSLSLSLSLSLSLSLSHISLSLSLSL

SEQ ID NO: 179825 - protein, 131 aa, Triticum aestivum
  unsure (1)..(131): unsure at all Xaa locations
  Clone ID: PAT_TA_74243.pep
DTICIIPLTQGIERNIMTHLDDERGIQFLSIXQGNGGSPLSPGGLTLPGVRGLLGSLPGAGRSCARKARHPLWVRPPNGLGRVKWGHAEGVPVGGFGCDPVGLGRHVQGVVVGSPERRGPRPCHRRGSRQS

SEQ ID NO: 179826 - protein, 120 aa, Triticum aestivum
  unsure (1)..(120): unsure at all Xaa locations
  Clone ID: PAT_TA_74244.pep
MKTLLILTIIVEALTTSSANIQVDPSVQAQWPQQQLLLSQPQQXLSQQRQQIFGQRQHTFADRPHQACPQSPQTFPYQPQQRFGLPQLPQHLFAQQPLEQFAETXQLQQPFSQGRRQQCS

SEQ ID NO: 179827 - protein, 139 aa, Triticum aestivum
  Clone ID: PAT_TA_74245.pep
MLIALLVVLLAFSGPIKGEDDLGGGDGGDLAPPPNPGGSHLSPPPPPSPKSHPPPPPKTDLAPPPPPPSPKTNPPPPAPIQPPPGPCAEVRSYRGPCVNMVCAAACIAELHGGHCRGHIFTGGCYCFVCSVAKSGPSLH

SEQ ID NO: 179828 - protein, 89 aa, Triticum aestivum
  Clone ID: PAT_TA_74246.pep
DTKQSQNARRPPVVTIAGAHQTKPKQYLGGPFIAAVTVSANAHSRWMPVHRPARVPPAHASGNFLLRFKIQFPENLDLVFGMHLKSPKI

SEQ ID NO: 179829 - protein, 194 aa, Triticum aestivum
  unsure (1)..(194): unsure at all Xaa locations
  Clone ID: PAT_TA_74247.pep
MPLPNQQPAAAAAAAIEHIYKPEDTSRFEPRLKVVNREKSELLHKIRDSYDRARERLAKATAFKEEIFLGAGLSFGLLDPTTNIIYNTLVASNLCDEKIQGVQDGNIAERSLDGLVAFLTFFFRYLANWEAVRYLLLADADLVYAMRLVVHDRCISPFNLNSDTSKSDVRTALMCAALASKHMDPHHLXHTWLS

SEQ ID NO: 179830 - protein, 170 aa, Triticum aestivum
  unsure (1)..(170): unsure at all Xaa locations
  Clone ID: PAT_TA_74248.pep
DVGKLNRLVIXPKQHAVNHLPLQLPAAGGESKGLLLNFEDAAGKVWRFRYSYWNSSQSYLLSNGWSRFVKEKGLGAGDVVGFYRAAAGEDSKLCIDCKQRPSTNSPAPADPVDQSAVPVKKAVRLFGXELLTAPDXTEQGMPGCNGARDLVKSPXPTAGFKKQCIELALA

SEQ ID NO: 179831 - protein, 190 aa, Triticum aestivum
  Clone ID: PAT_TA_74249.pep
ANFTANWSGPNVCAYNGVFCAPHPADGGVVVVAGIDLNHADLAGYIPDSLPAGLPDLALLHLNSNRFCGVLPDTFLHLRLLHELDISNNRFVGGFPEVVLQLPSLRYLDLRFNEFEGGIPPALFDRPLDAIFLNSNRLTRPIPPNLGNSPASVLVLAHNRLGGCIPPSIGRMAETLNEIVLIDDDLTGCI

SEQ ID NO: 179832 - protein, 103 aa, Triticum aestivum
  Clone ID: PAT_TA_74250.pep
GIPLAMTASHGILPLTIVVLVLLSSDIQNVRALVREEADVTTDYNHYTCTKVIGRRCTIRTCRDSCHKKLSGVGNCLADGECRCSYYCNTPPSFMTKSDETLH

SEQ ID NO: 179833 - protein, 110 aa, Triticum aestivum
  unsure (1)..(110): unsure at all Xaa locations
  Clone ID: PAT_TA_74251.pep
ISTGAIIESPKIRRRPPKSRRTCGVCTNPPLTCMASSSGISQPWKVRSSHDRSRISGVYGSEPSFRWIVAREISCSWTAPXXRARSQRKKKEFWXFSSGKGFLFQNGCMV

SEQ ID NO: 179834 - protein, 198 aa, Triticum aestivum
  Clone ID: PAT_TA_74252.pep
QATFSTNSSILPSTLPSLSTNYTFYFIYINIYSSYPPQPTFTPTNFTFLPTPSSSFTSRPLSRPEANCILQPFTHSYHHKHIVFPFPHHSLSPLISFPPSLPSLFLYYCIHHQTHPLFTIHLYLSSSSLITILPSLSKYIPTSFLKNNTPSHFPHSIFLQLHSLFPLHIYFHPLHTQISLSINNPTQPQSSPFISLSP

SEQ ID NO: 179835 - protein, 141 aa, Triticum aestivum
  unsure (1)..(141): unsure at all Xaa locations
  Clone ID: PAT_TA_74253.pep
MGSVGGGGSPEQDQPVCVTGATGYVGSWLVRTLLRRGRRVHATARDPAKAWRMLSAMEGKERLTVFRADMAEEGSFDDALAGCAALFHVAASMDLHLSPDQHDAEERVRSXVLEPATRGTINVLRSCVRAGTVRRVVFTSS

SEQ ID NO: 179836 - protein, 152 aa, Triticum aestivum
  Clone ID: PAT_TA_74254.pep
MKTMLILALIALAATSVVAQLDTTCSQGYGQCQQQPQQQVNTCAALLQQCSPTPYVQSQMWQASGCQLMRQQCCQPLAQISEQARCHAVCGVAQVIMRQQQGQSFGQPQQQQGQSFGQPQQQVPIEIRRMVLQTLPSMCNVPMATTCVGGTC

SEQ ID NO: 179837 - protein, 197 aa, Triticum aestivum
  Clone ID: PAT_TA_74255.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGL

SEQ ID NO: 179838 - protein, 196 aa, Triticum aestivum
  unsure (1)..(196): unsure at all Xaa locations
  Clone ID: PAT_TA_74256.pep
LRRISTVCQAVDVGVTTGXIKYWSRAGAVSNXCSNGHPRNTGPRSSGPEQCQQAPALRGFLTTTNKVVSSPPLVRRHRGSGEGRWRRPPGEYNNAGRRVSVQQHRHTGPGGRGACGGGGSSRRQQPGARHGLVGRPTGGGTTEAGGVGRDMEARGGVEGSASGDGSGPPPPSRGAARLRRPALRRWRRSNRWGWGY

SEQ ID NO: 179839 - protein, 110 aa, Triticum aestivum
  unsure (1)..(110): unsure at all Xaa locations
  Clone ID: PAT_TA_74257.pep
MASRFSNVDPVTEADMRRQGLDPHELDRSTEQLMSLIHGNLPDPPVFTTSRLTXXRARPFDGVDPIKRLFDALXRDIVFPLPGKGRGRTGGLGGRLGRVWSSKAVGLIDT

SEQ ID NO: 179840 - protein, 67 aa, Triticum aestivum
  Clone ID: PAT_TA_74258.pep
KMTSAPSSARNSVRTRGSGEQYYRVGRGSKELLPRLLPCAPALWARGNGTTAHQERYYRWHAVLPLP

SEQ ID NO: 179841 - protein, 112 aa, Triticum aestivum
  Clone ID: PAT_TA_74259.pep
TLRALTLEEDIHLSTPGARPAARGSGDGEAEGAPPGGQGGLRPQGQARPLPRSFPRGGIYERGSWRGKPWAGNWCSHFTIFGRWVQSISFQRICEDGTCLWNVNLVGIWNIL

SEQ ID NO: 179842 - protein, 129 aa, Triticum aestivum
  unsure (1)..(129): unsure at all Xaa locations
  Clone ID: PAT_TA_74260.pep
MCAVLQLACWAVEAYNVRHWTTVPANXNGYVAQYMLGRHYRRYSKVXIDASISYLDRLKLAGYCNDVWVFYIDETMLCNLSYYATHGFWATPYNSTSYNTYVLEASAPALPETKRLYYKLIAVGMKPTF

SEQ ID NO: 179843 - protein, 140 aa, Triticum aestivum
  unsure (1)..(140): unsure at all Xaa locations
  Clone ID: PAT_TA_74261.pep
PELATLARGSKKHLXRFTAPSHWMLDKLGGAFGPKPLFGPHNARECLPLHLILRNRLKYALTYREGQCILIQRPIMVDGXVRTDXDLPLXFMDIIFIPKTGENYRLLFYTQGRLRLHSVRDEDAKVKSLQRSLLYNFCPK

SEQ ID NO: 179844 - protein, 86 aa, Triticum aestivum
  unsure (1)..(86): unsure at all Xaa locations
  Clone ID: PAT_TA_74262.pep
DLPAGWHIARHTSLAGNYKLPWDNDSYWREPCNNRLAPDIGACEALSXQTGSIFFFPALLLTDAQNDKGFKMPDTPNVFPADIKRA

SEQ ID NO: 179845 - protein, 101 aa, Triticum aestivum
  Clone ID: PAT_TA_74263.pep
LWRLTLVEETGGPSHIERLKKIPLWCKVKHPSRVIPKKEPRGVFYIYRFSKTKILCPNPLIVLAKIWNPSKIKAFFRMKRPLHQGLGTDTLLNLLQKTNIV

SEQ ID NO: 179846 - protein, 186 aa, Triticum aestivum
  unsure (1)..(186): unsure at all Xaa locations
  Clone ID: PAT_TA_74264.pep
CRGADGAWEFSWDQDSLLRQLKESLRAHQGRAHMDFVYIGGLRDDIPAEDQDKVALELYERFRCVPAFLPDDLRSRFYHGFCKQQLWPLFHYMLXLSPSSAGRFDRDLGKGLSCSSTQIFRQRTCEGDHTPERGTFVLWVRRNSHILCVWAHTFSVGARKNFQNPGVQGSWGFFSRWQQAPGSPLI

SEQ ID NO: 179847 - protein, 143 aa, Triticum aestivum
  Clone ID: PAT_TA_74265.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYT

SEQ ID NO: 179848 - protein, 74 aa, Triticum aestivum
  unsure (1)..(74): unsure at all Xaa locations
  Clone ID: PAT_TA_74266.pep
ITDDEIGELKEAFRLFYTDGYGCIITKELGTVMCSLAQTPTYAEFQDLINXLCACGYGTIDFPELLNVVARKFT

SEQ ID NO: 179849 - protein, 116 aa, Triticum aestivum
  Clone ID: PAT_TA_74267.pep
ISAPATHFKYAPPTLRATTPTCADRASAPQSLSHNPSTQQPQKQVPLMQQQQQFTGQKKQFPPQQLLSNNHPFPSKQPYLELITHFFPHLPISGNPTPFSHHQHPLYPNTPGNPNR

SEQ ID NO: 179850 - protein, 161 aa, Triticum aestivum
  Clone ID: PAT_TA_74268.pep
PPILMGPDRFSLVRDLSSPVASHRIGRLWELILLVCSETVSSSMILLVHSAFTLIVDINSLSRQWDRPTKVPLSLRQVPGWLHLLTRQRRQDGAPATEPPPAGAPHVESAAVARAAETAPVASAALSVPEAHAAAGASSSSHGRLHGTGRVVVLVAAAAGR

SEQ ID NO: 179851 - protein, 82 aa, Triticum aestivum
  Clone ID: PAT_TA_74269.pep
IKNGFYMMLLLSMAGDNCCHVRQVLRFGGYNHSFWRTVSKLGRFVKLGTFRMEIIFLPMIFISVSSLRRGCAFLALASSHFA

SEQ ID NO: 179852 - protein, 190 aa, Triticum aestivum
  Clone ID: PAT_TA_74270.pep
MARVMHRSSSDGGSSSGWSEAAAAAAVGEEERAGWEVRPSGMVVQARDRGADGAAAVVPPRPPPPEIRVRVKYGAATHEVAVSSIATFGELKKALAPRTGLQPSEQLVTYKGRERKNSEFLDRFGVKKQVQSSSFSEGPGEALEPAAYNRSGQEGTAQGIPRNAPNPGPNRGPNGPPGRVRTKASAGFTR

SEQ ID NO: 179853 - protein, 88 aa, Triticum aestivum
  Clone ID: PAT_TA_74271.pep
NRSSLHPTKTSTQTLASETSELDTFNHSIFTPFQLQDPQKQPLYHKPSPTLQKTSLHFYQYDGASLYVPSGIFMKSFPPIPKTVFTLT

SEQ ID NO: 179854 - protein, 188 aa, Triticum aestivum
  unsure (1)..(188): unsure at all Xaa locations
  Clone ID: PAT_TA_74272.pep
VNQCLEMYLRCAVHDTPRQWRKWLPAAEFWYNSAHHSSLNCSPFKALYGKEPNLGGLPHLSSALQDQAASPELDWTAHTEMLRAQLARAQTRFKKQADCHRAERAFDIGEKVLLXLQXYAQSTVANRPCCKLSYKFFGPFEVTERIGTLAYRLQLPPDSRIHPVFHVSQLKPFTPDYTPVFAELPRVP

SEQ ID NO: 179855 - protein, 113 aa, Triticum aestivum
  Clone ID: PAT_TA_74273.pep
DRHKFRIFYSSWLLAFTSEVLMALLVLAKRDGRGGSDGGLPWMLGACVHLAGKWQRAAATKRLHAAARQFHAAAACSCGHHRSNLLALKKSASRRRERGANLGGDRGGREERI

SEQ ID NO: 179856 - protein, 188 aa, Triticum aestivum
  Clone ID: PAT_TA_74274.pep
IASHCRKQPLDLKTSMVTRIRSETVVSCCSPPDCTSEGPGPNHPPPSLEGDCSHLSELLILAEQGHLVGCRYCHIPSLARPSAGVGSHGLSGHGSGPRRPPLHRWKEVPQPGRSRQARSMRSVHGEHTTPKPHILASHNHDPCQEVRECAQEEQKRPAATILRSGMSSPANPPAAARQGDKVRAARVS

SEQ ID NO: 179857 - protein, 97 aa, Triticum aestivum
  Clone ID: PAT_TA_74275.pep
INYTLFDGTSYSDNPHYPRANTCNKPRLLGGAQLLDKMLTRTLLADPMINDNSDGSHVLCAGNAYLKSLAYPLSMVGYVSTSTIMADTELRFLLPDK

SEQ ID NO: 179858 - protein, 106 aa, Triticum aestivum
  Clone ID: PAT_TA_74276.pep
TRGRLTSTNLLCLLAMGNLLLKLTQSLTMECARLLPLLLLQHDISSLYKPFFHLHHIDNVFYDSDQIHFPIPRLLHQPCSPNNLLHTMLMALRLNTKIAYLFSYNL

SEQ ID NO: 179859 - protein, 201 aa, Triticum aestivum
  unsure (1)..(201): unsure at all Xaa locations
  Clone ID: PAT_TA_74277.pep
PPPQPHKQTNTMTPTQPTSTQTNTHTKTXTPPAHTPKSPKPTPNHTKRKKQNHSHKQTTPSKPNPPNEPIQPITNKSTQYTPTQKQPNTNQPISQQKQINTPPPSRHLVPPTTSNNIQHHTRNTSPHLATDQTSPHQTLSHEIQNPNTHHKHKPKTNPPLHSPNKQLNQSLPPKESQYKLPSTKTNTSARKTVRAPQTPPS

SEQ ID NO: 179860 - protein, 73 aa, Triticum aestivum
  Clone ID: PAT_TA_74278.pep
GRIDILAREKVPFQKGCEGRMHLEPVLRPNSPLAVFLWFETMVENLRQEPTLPWRMFFFKEVFSEIGIDLSSN

SEQ ID NO: 179861 - protein, 73 aa, Triticum aestivum
  Clone ID: PAT_TA_74279.pep
IELQKRLTLWDRVVQIKYTGQTSEDSGQTSEVSFRGCRPLNFFTLLSLSIRSPGHSQQCQQKPPKFSSYHNPS

SEQ ID NO: 179862 - protein, 107 aa, Triticum aestivum
  unsure (1)..(107): unsure at all Xaa locations
  Clone ID: PAT_TA_74280.pep
IIHHSRTSLCSEXNYILHCHPWYHLCYSIRSTCLPILSIYAVGEVTPLTHAQSCPRAAGRRFRAPKVTVRYATVEVTLRLVARTRWFGFVLARDDMACTIITRLSWC

SEQ ID NO: 179863 - protein, 94 aa, Triticum aestivum
  unsure (1)..(94): unsure at all Xaa locations
  Clone ID: PAT_TA_74281.pep
LPYSQSKTPQNATITIPHYPQQPQQQXPQPQQPQQPFSQPQQPQLPFPQQPQQGRSFLDKALSPTFHRLQKPTQHLYPIPQQPQQPCPPNKQQP

SEQ ID NO: 179864 - protein, 146 aa, Triticum aestivum
  unsure (1)..(146): unsure at all Xaa locations
  Clone ID: PAT_TA_74282.pep
MDIAQEDERDQGQDHDHVIVVAGDQGEGEGEETTMDGSVDWNGSPCLRAKSGGWPAGLLILLNQALATMAVNGVSINLVTFMRVVMQLDNANAAKYVSNWSGTTYVFSIVGAIIADSYWGRYKSCIIFQLIFLAGLVELAISSYXF

SEQ ID NO: 179865 - protein, 142 aa, Triticum aestivum
  Clone ID: PAT_TA_74283.pep
FIERFPVSRGRAHVLFEPGRRPRRRNSHQKAGNCIVAPASFFPCAGNPWRERLTQMKLRWVPQLRRKRKMGCFEVMCPTRSIPLCSVHIGLAPALVLRGWSSRMSSTGPRRDSPPRRRGNPAPPPRPAPCRRRRSHRPPRAE

SEQ ID NO: 179866 - protein, 166 aa, Triticum aestivum
  unsure (1)..(166): unsure at all Xaa locations
  Clone ID: PAT_TA_74284.pep
SHWPSPPPAXHPDPTWQPRASPDPRPPPPRPXPPPLPPPRRPRPPPRRQAPPPXPSPPTPARPRPRRSHSRPPLPLPRPRRAGTARAGPSCPTSCPGPDSSRRAARSGRSSRRXRWCRSSRRRCPARTCHSRRLWSSSTRRIWSSPPTRWDPSSCISRGILVDAGI

SEQ ID NO: 179867 - protein, 101 aa, Triticum aestivum
  unsure (1)..(101): unsure at all Xaa locations
  Clone ID: PAT_TA_74285.pep
SRPGSVGRLGRRRYDHRRRAAPWRARCGIGERWIVHLLIQIQEAWWDVAHSPRXRAVSRIRTCGRSRDRVQRGRRRFVHSRARTTSASDAGFDVSRRIVGP

SEQ ID NO: 179868 - protein, 147 aa, Triticum aestivum
  unsure (1)..(147): unsure at all Xaa locations
  Clone ID: PAT_TA_74286.pep
MYKAWRQASLKVRRQVSTYELGRTIGEGTCGTGRFAXDTESEDPVAIKILDKDKDQKHGLVQQIRREICTMKLIQRPNVVRLHEVMGSKARIFIALEYGTGGELHDIIGDRGSLKEDEARRYCXQLSNAADYCHSMGXYHRDPELEN

SEQ ID NO: 179869 - protein, 167 aa, Triticum aestivum
  unsure (1)..(167): unsure at all Xaa locations
  Clone ID: PAT_TA_74287.pep
MQSAGAMGLLRPCAARAILKSPSPGAARLPASRTALRLSAAAPRAGLVAAAGLGRIGLVPASPEQEKRSDCLVAAAAAGKASAGDEAGEESGASLAKTLHLGVFFGLWYLFXIYFNNCTNKAGSLKGFFPLNSPLNHSQSRLQIFGLGWQTFPAFSPLGLMVAAPNS

SEQ ID NO: 179870 - protein, 119 aa, Triticum aestivum
  Clone ID: PAT_TA_74288.pep
KVEALTRVVVGKKKFFCFSEEEANIYYSATDRGLDHRNDICKSSLKGSGKYYVEMFNGNAREWYHGGGEGRHSPGCERSGGSVMWNTCLLVGGGWGKRKKEGRGVKEKSVHGGLKKGGK

SEQ ID NO: 179871 - protein, 121 aa, Triticum aestivum
  unsure (1)..(121): unsure at all Xaa locations
  Clone ID: PAT_TA_74289.pep
IKIFCLFHNKISIKEXINPSLSIPLVIKLPPSXPLSQYKTNFFLLILQQPYTTNDSTPTNQLKFNLXKTTISFPINPITYGKSHNFHPLYISHTISKKXNKYSFSXLKIXQKYPPLPKTSF

SEQ ID NO: 179872 - protein, 184 aa, Triticum aestivum
  unsure (1)..(184): unsure at all Xaa locations
  Clone ID: PAT_TA_74290.pep
MKTFLIFVLLAMAMKIATAARELNPSNKELPPQQSPFPQQQQQHQQLVQQQIPVVQPSILQQLNPCKVFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGAQTSQQQXGTGYLLQXHQIAQL

SEQ ID NO: 179873 - protein, 76 aa, Triticum aestivum
  unsure (1)..(76): unsure at all Xaa locations
  Clone ID: PAT_TA_74291.pep
SGHTLSTVDAYFLLGNLLHLSFSSTVHGPLSSYLLLASENYHFWSSDITLFMLSIFLSHYMVVLDLVVSFEKGIXL

SEQ ID NO: 179874 - protein, 157 aa, Triticum aestivum
  Clone ID: PAT_TA_74292.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNN

SEQ ID NO: 179875 - protein, 159 aa, Triticum aestivum
  Clone ID: PAT_TA_74293.pep
MKTFLICGLLAMAMKIATVARELNPSNKELPPQQSPFSQQQQQHQQLVQQQMPVVQTSILQQLNPCKVFLQQQCRPVAMPQRLARSQMLQQSSCHVMQQQCCQQLPQIPQQSRYEAIRAIIYSIILQEQQQVQGSIQSQQQQPQQMGQCVCQPQQQSQQ

SEQ ID NO: 179876 - protein, 129 aa, Triticum aestivum
  Clone ID: PAT_TA_74294.pep
PHSPLPIQIGSGSIPPLHPLRSTRLRCPSPSSTSPHQPPPRQPPSTLAAPRRCSPSPAPPHRAALRPDTPSSSPGPRARPGPPRCRRCRLAGRPRPRRRRSSTSGPPQARDCTSAGSICWSPGSRRHLR

SEQ ID NO: 179877 - protein, 178 aa, Triticum aestivum
  unsure (1)..(178): unsure at all Xaa locations
  Clone ID: PAT_TA_74295.pep
KYHSTPLHWLTQHHAVPRRSTRPPPWKLTRPAPPPRAPAPHTLTXPPRRPAPLPRPRAPPPVQPVPPRRRPVLLARQEARPPPSPPRAPLALPQPRPPWSLSRPRLAPLSLWGPRPPARPQLLARAPWPPPSQRRQVPPPWSPRPRRGQQAPXPRPRPARGPPPSSRPPRRRRASPPW

SEQ ID NO: 179878 - protein, 120 aa, Triticum aestivum
  Clone ID: PAT_TA_74296.pep
TTVTTPRAMDGACAAPVSQNPPPDSPVTGVAMHISKATATEEETPSLAASASMPTTAKTLSNICFTSSLTVPSRIMMKCMASITMLDLSTLQGRVRRSPTNLVKISIIRFRLSRSVIMRS

SEQ ID NO: 179879 - protein, 174 aa, Triticum aestivum
  Clone ID: PAT_TA_74297.pep
AAPAKLSNTSSSLSNQQQLLAGISSSTSSSFSPSAAPAVAATESAAANTQPPGPQRPAAAPLLSITPLSTLRSAAPQRTQDARTPSLHWCSSACCRSAHARQQPPRAAPLPLQPPEDEEEPEQGLCLRSKKQQQQPPAQLCRAAPRVSRACSSPQPPARAPDPPPPRRTSPPSP

SEQ ID NO: 179880 - protein, 174 aa, Triticum aestivum
  unsure (1)..(174): unsure at all Xaa locations
  Clone ID: PAT_TA_74298.pep
MKTFLILALLAIVATTTTTVAXVAEPQLQAQNASHQQPREQDPLVQQQQCVGRQQQHFSGQQQPFAPQQPYPQPQPFLPQLPYPQPQPFPPQQSYAQPQPQYSEPQQPILHQRGPTTTTTTNNNNNNNGNNQPATTLQHPVAGQGLPYAASPAENHLIAFNASGKSAINGTLPI

SEQ ID NO: 179881 - protein, 172 aa, Triticum aestivum
  unsure (1)..(172): unsure at all Xaa locations
  Clone ID: PAT_TA_74299.pep
KVSVWWDFENCHVPQNVNVCRVAQRVSAALRAAGVRGPLSITAFGDVVQLSRVAQEALVATGVVISHVPSSGKNSSDRSFMADLVYWIAQNPPPAHFFLISGDKDFANIXHRLRMSNYNILLACPGKTTSVLCNAATIMWPWEALVKGENFSPKRFNHPPDGLSGSWYGHYK

SEQ ID NO: 179882 - protein, 159 aa, Triticum aestivum
  unsure (1)..(159): unsure at all Xaa locations
  Clone ID: PAT_TA_74300.pep
MDNLGHRENGRQRPDPYKALHTQWMMPQRQMKDHHSMNLLALMSERDTAIMERDHALAEKKAAMAERDMAFAQRDSAMAERNAXIVERDNALAALELARTNGFNMNNGTGFNPGSLNGAKNFHHQDQQPHAQSSPLQLADSPYDHAREMHISDAYPIST

SEQ ID NO: 179883 - protein, 72 aa, Triticum aestivum
  Clone ID: PAT_TA_74301.pep
MEAKDVAPVAAGTADAPTTAPAPAPAPAAAPAPVSQAKPQSQTHTQPPPIVCMPTPAHPFAHHQHHHHHQHE

SEQ ID NO: 179884 - protein, 200 aa, Triticum aestivum
  unsure (1)..(200): unsure at all Xaa locations
  Clone ID: PAT_TA_74302.pep
YAELAAFAPLLPLPPHRSLKPIAPPPPPPPNPSSSHVPPPRSPLPPVASPPPPPPFGPSPXTHPCPFPPTRSPPPPSRRPRPRRRFIPRPGRSRVRPPSRRSRLSRAXTXARXSXXSPXLFWLCPTRIPTPCPPSTPIHSPPSSQSHRSPPSSSCPSXRPKPLPRPRGLFVSPHAXXXXPRXPSLSSPSRLPAAPGTPPA

SEQ ID NO: 179885 - protein, 118 aa, Triticum aestivum
  unsure (1)..(118): unsure at all Xaa locations
  Clone ID: PAT_TA_74303.pep
VAVAGALSKDMMVKRVFVLSDMEFDGWVGGXAWVSSHEAIKKKFAAEGFAVPEVVFWNVGTSKASVPVVAAQAGVALVSGYSKNLVRLFLEADGVLTPSAIMADAISGPEYDALEVLD

SEQ ID NO: 179886 - protein, 213 aa, Triticum aestivum
  unsure (1)..(213): unsure at all Xaa locations
  Clone ID: PAT_TA_74304.pep
NYRISGRRYISAGTRRLPPPSHLHPSRNPPASTPLIPPHSAPGGKAGGLRSKVRRRRFPPPRQSLHSRKVPLPPPVKMMRCAVRGGGAHVVVGERRSASSSPGGSGGRSVVRMSEGRGGLCCGGVRSRAADLAGLEMGRXSAGAAGLFRSARYGRCAPPSSWIPRDNSIWTKLSKLKSSPGSGFLPITIGPFAFALGGPNFWFRGYPHHGVVG

SEQ ID NO: 179887 - protein, 142 aa, Triticum aestivum
  Clone ID: PAT_TA_74305.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSTGNAGAR

SEQ ID NO: 179888 - protein, 80 aa, Triticum aestivum
  unsure (1)..(80): unsure at all Xaa locations
  Clone ID: PAT_TA_74306.pep
HVQVNKTSPPLTSSLFYNTPSLTLAIILTHTITLSHHLKEISLVYLAIYIYNTTLSSKNRITLHVYAXHSKHNPTSATYK

SEQ ID NO: 179889 - protein, 178 aa, Triticum aestivum
  Clone ID: PAT_TA_74307.pep
SPAAPPPHTRPSRRPDLSPAISKSRPPPRRPQKPRSLPPPPPPRSSSPPDPPPRSQPQPQPQWRPPPRRPPPSSPAAPRPPPPPPRRSGARGSRPGASRRARWRSRPGPTRASRSTFASRCRARVRPRAGTPRPVAHPCAQERAVGGTFTRSLEPFEGHMRRWLLCRGPNPHTLPAFG

SEQ ID NO: 179890 - protein, 73 aa, Triticum aestivum
  unsure (1)..(73): unsure at all Xaa locations
  Clone ID: PAT_TA_74308.pep
ERANLKPAENWRLDQDELMTHDIXGPGTIRIFKQELXDVAYVWXPHKGRIIPDHYILTNDQSADMKRSHCNGL

SEQ ID NO: 179891 - protein, 161 aa, Triticum aestivum
  unsure (1)..(161): unsure at all Xaa locations
  Clone ID: PAT_TA_74309.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPLSQQPQQPFPQTQQPQQPFXQLQEPQQPFSQTQQQLAEAQQP

SEQ ID NO: 179892 - protein, 120 aa, Triticum aestivum
  unsure (1)..(120): unsure at all Xaa locations
  Clone ID: PAT_TA_74310.pep
SPRPXPPPPPXRLLAPPAVSXKSPPPPPPPLYPPVPPPPTTYSDGARYGWNLPPPPPPPPPSLLPPREERWGGGLPPPPPDQREGPRANLPSAPLRAPPAGPEGSPERSLPRCMWWAEGG

SEQ ID NO: 179893 - protein, 56 aa, Triticum aestivum
  Clone ID: PAT_TA_74311.pep
TSFSHKPHVQRNILKWLEAQTNQPFISGTGIFFFTGKLLLELDTPDKATQKENDTL

SEQ ID NO: 179894 - protein, 99 aa, Triticum aestivum
  Clone ID: PAT_TA_74312.pep
GRRRPPSPRLASGRHAAPPLQALQLLGGNLPAPLHPALPQSRRNFRPPRAIRADDCPSLLLLRPVPPSVRRRVIARFPAVRPLDHHALYLQVCVYSLPL

SEQ ID NO: 179895 - protein, 38 aa, Triticum aestivum
  Clone ID: PAT_TA_74313.pep
FKPPKVSFRTKVFHPNINSNGSICLDILKEQWSPALTI

SEQ ID NO: 179896 - protein, 138 aa, Triticum aestivum
  unsure (1)..(138): unsure at all Xaa locations
  Clone ID: PAT_TA_74314.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKXSDNCTGLQGFLVX

SEQ ID NO: 179897 - protein, 149 aa, Triticum aestivum
  unsure (1)..(149): unsure at all Xaa locations
  Clone ID: PAT_TA_74315.pep
MDAYEATKVVFARVQGLVDADLASKIMGMLLTQDKSEEDMIRLAFGPEHLLQSVVADLAACSKPPSPPAPAWRMAPGAAGGDAEGGLPFGAASEAFYPEEEYGCWSPASGTHHRRSFSLSDAEGGWKPCQYFARGFCKNGSGCRXLHGL

SEQ ID NO: 179898 - protein, 111 aa, Triticum aestivum
  Clone ID: PAT_TA_74316.pep
YRNYMVLSPMVRAGTLPFKLLSPVYGAAFSYGEEFIDHSFVNCPRVIYESLGTTDFVERGTDCLVFRTCPQDTDKVVFQICTSHAVRALHAAELVCNDIAAIDIHMGCSTV

SEQ ID NO: 179899 - protein, 155 aa, Triticum aestivum
  Clone ID: PAT_TA_74317.pep
AAGTLVFSMQPNPPLPLTLLEPNRSCNRIVPDLIQQILITTLNTLPVPNQTRQTDRSHPSYKRAMSPAEIQPNPLRPRPRPRRLHREETSRNPAGGERRSPEYEAEREEDVPSRGVPSDLPPPELGELRKPSTARRSSISSWGRRERRWRRRAET

SEQ ID NO: 179900 - protein, 60 aa, Triticum aestivum
  Clone ID: PAT_TA_74318.pep
NFHQLFHTLSILYLLTLKLIASSTKIYLLFLTPISSLLNQSKFSIFFLPKSLLSHIYVYP

SEQ ID NO: 179901 - protein, 100 aa, Triticum aestivum
  Clone ID: PAT_TA_74319.pep
RIHPKPAISRISSFPVLLIAPKLVTPYSQYTKFPKPASTNRTIRNAQFPKPPPASRPPNSNFVYAITPNPSRIVLGDLRILICNAHNMCSLRKRSLYISP

SEQ ID NO: 179902 - protein, 202 aa, Triticum aestivum
  Clone ID: PAT_TA_74320.pep
SDSFARVLPAQSTVMGSPAWRGLWRGLSRCGRSPYTAAPPPSLYLARAAEVPDASGRRHLAVQRHAISHMLGTMDLAPSINTEEWWKRRSRYHGASWVQAHAPSRFFSATPKDLLKGSKADPSDLAVPSPGDDAHGPGDMAMHNRFASAQPLALVEQVKCWQIRYLSKGAQAAGAIDSNFERGLICVEVYAYLYLPLIRRRE

SEQ ID NO: 179903 - protein, 86 aa, Triticum aestivum
  Clone ID: PAT_TA_74321.pep
TADIHPYFSNEKRVLLRTHQKDFQQFGGWGCVLIPQLFKTPPFFLKPNPRGRGPPKFFRARKHPPILSIDATPFFGGHNKMTSLNN

SEQ ID NO: 179904 - protein, 122 aa, Triticum aestivum
  unsure (1)..(122): unsure at all Xaa locations
  Clone ID: PAT_TA_74322.pep
FRAWRNHGHSCFLCEIVIRSQFHTTYEPEAXSVXLGCLMSELTHINCVXAHCPLSSRETCRASCINESANAXXEAXXVLGALPLSRSLTRCASSFGCGXAVSAHSKAVIRSTESGDNGRKNM

SEQ ID NO: 179905 - protein, 148 aa, Triticum aestivum
  unsure (1)..(148): unsure at all Xaa locations
  Clone ID: PAT_TA_74323.pep
ITKGSRSRDPVXNVYEPPIGGXMVXIGHVFVPPPLIDMISNVTILAGVELVPHASHAAGSTVVDLFPPXKAWCECNGKHRAFVRHIMSDTDACPEVVEYCQCASLHLCQPVGRHPWRSMNFVCAHHGSTRSHVVTYNHQHAFPSGQYQ

SEQ ID NO: 179906 - protein, 103 aa, Triticum aestivum; identical to SEQ ID NO: 107316
  Clone ID: PAT_TA_74324.pep

SEQ ID NO: 179907 - protein, 116 aa, Triticum aestivum
  unsure (1)..(116): unsure at all Xaa locations
  Clone ID: PAT_TA_74325.pep
TPRLAGPSRPPQSTGGKAPRKQLATKAARKSAPTTXGGGKKPHRYRPGTVALREIRKYQKNTELLIPQAAPSSALVPPRIRGQGPFKDRTLPAFPGSPTAPWPGPLPKGGPGPEWR

SEQ ID NO: 179908 - protein, 162 aa, Triticum aestivum
  unsure (1)..(162): unsure at all Xaa locations
  Clone ID: PAT_TA_74326.pep
PRPVRTEDRGLDAFLNVQREHLTLMHTHSNEYYDLGDVPDIHDTYLWRXRMIASVMCIFNLSQNHWPVDMDKTEAASVIXDDQLYCISETDCLCALYELDSXSGENVQNCRIVFIACSPYTYRIHTKMLDSTYNDHLKHDLDSYLYEIQAHDPYDVELDVLQ

SEQ ID NO: 179909 - protein, 204 aa, Triticum aestivum
  unsure (1)..(204): unsure at all Xaa locations
  Clone ID: PAT_TA_74327.pep
QQPQQPFPQTQQPQQLFSQSQQPQQQFSQPQQQFPQPQQPQQSFPQQQPPFIQPSLQQQVNPCKNFLLQQCKPVSLVSSLWSMIWPQSDCQVMRQQCCQQLAQIPQQLQCAAIHTIIHFLIMPPEQPGPPPGLAILVALYXNHKGVKGLFVQGQGLFHPQHHINGSETGHGCENSSNLCNXVCPPERSIISAPFSSVLPGFGGL
